United States Patent 7,868,149 (PLANT GENOME SEQUENCE AND USES THEREOF) - sequence listing, part 24

SEQ ID NO: 11801 - DNA, 4159 bp, Oryza sativa
agctataaccccattttgagaagataaaagaggagagagaagagtaccgggctatagatttgtagccagctgcagcacaggctctaagatgcatgtatgtatgataagtgagaccatgtattaattgtgtaccatatactctcttcgtttcaaaatgtttaacaccgttgactttttagtacgtgtttgaccattcgtcttattcaaaaaatttaagtaattatttattcttttcatatcatttgattcattattaaatatattttcatgcacacatatagttttacatatttcataaaattttttgaataagacgaacggttaaacatgtgctaaaaagtcaacggtgtcaaacattttaaaatggagggagtattatagataactattgtatgaattatctattaaattgactagtattaaattgactagtagttgacttgttcttagtactactagaactagaactagtcacttgagctggttttggggtcaagtgcaaattgtcggataaaaaaagggagaacattttcattatccaacagcgtatccccccttcaatttagcttggttatgctctgcactctgcactccaaattgttgctcttttggtcttctccttaatacaaaagatattcgtgtttttctgtattcacaagaaataatttttaccgttctgtcacagtttacattttaaattgccacacggcttcgaccatcacagaggaaacatgtaaatatgttttggcctgcagatcttggtgtttagtaactagtagtcctcgttggattgaattttgggaacagctatgtagtctattggtatatatcccaggttctgaatcgacgtttcacgaagagacttgtgaactgccagtgtagtgtagagtgattttttcgaaaaaaaaaaactctcaattcctttttacttgttatcgttgactcgtactatcactaataattcttaagatctttcaataaagatggcatctcatggtcgcgcgaacgcgcaactccgagtggctaagtacatatggaacaaattcaccaaacgtccctcaactttagatcgagtttgtatgacatctctaatctctaataccaaaaatctttacccctaaactatacaaaaccgtgcataaaggaacactttacactatacccatatactagattcccagttaatcatagaaatcttcttgttctttcgttcaaggaaaacaatctccttattatctcagaataaaataataataagacgatttcttctcatatatatatgatttgcatctgtgatcatattaggttgtgtttagattggtccaaagtttgaaatttggttgaaattggagacgatatgactgaaaagttgtgtgcgtataaaaggtttgatgtgatggatagttagaagtttgaaaaaaaaaactttagaactaaacacaccatgagggaaatcaaatcaaatactacgtactgtatttcgtttatttaaagattagagacattgcttcgttggactaaaaaaatcatgagagatcgattgcttcattagctcaaagtttcaaacccacacgaaaaaactcccaaagtaaataaaaaaacgaataaagaaaaaaaccgacacgaacggattccacgtcacaatcctcatccaatcctctcacatcgtaaagcgtgcgatagaaagtccgcggatcgacacgtcatcatgacgagcaaacgaagctcgacacgcaccgtttatctctcccatcctttcctattaacccaatgacatgtgggaccagaaaatgcaaaggaggttgtggccccacctgtcagtgagatagtgggtcacgagaaggtagttagtcaaagaaaggtaagccttatctacacatcaccatctgcttgttgccacgtcaccccatatctcctctcgcttccttgccttcgctgtcttaacagtaccaaaattaccaaaaaaacgcccacagatttcttcattattacacagatttcctcagaattcggaggttaggggcatatatgaaaatattagttttgttaggggtcaatctgtgagagaggtcaaccttttgtgcccataaaaaagcaacgtcctaacgtaacggcaacgaccaccgcttcgctttccgtcgcgcgcgcgtttcgtcgaacaccacgccggcgaccacgacatggccaccgccgcctcccgctccggccgccgacgcggcggcggagacgacgaagacgaccggacggcggcgatgcgacggctgcgcgtgctgtccctccacctgcaggatccgtccccctcgtcggaggcggggctggcgcccgcggcgtgcgcggcggcggggaggcggcgggcgacggggggagcggacgcggcggcggcgctggcggcgtacctgagggggaggcaccgggacacgcaggcgcgggtgttcgagttcttcctctcgcggcccgacctccagacgcccgtcgagatgtccaccgccgcgcaccgggagctctgcttccggcagctgtgcgcgctggtgcgggaggccggggtgcgcccgctcagcctcatggcgaacgaccccgccgagtacttcgccgtcatggaggccgccggcggcgccgacatctccctcggcgtcaagctcggcgtccagtacaggtaaaggattacaaattgagtaatactaaataattagtaattgactagttcctgtcggtgctgaatgttctgcacgtctcatggtttctcttcaaatttttttcacgctcaactgcaatttgttatacacttatactaattgttaaactcaatcaaatgtatgcttcctcgaagagttcgtgtgttccaatccaatgggaactcaataaatctaaaaaaaattggtaatagttagctggttactggtagtctggtagtgatcttctttccttcttcttcttctttttttttttaccgagatgaataattgaggaaaacaaagcgaccatgcgatgtaatcatgtaatacatgctaattgtgttttcaccttcgcaataattaaagcattattgctgtgattgcgaaaggggggcttgtacctatcgatagctcaacgagatacagtactgctgctgttggctgttggcaacaatatgccaatattgcatttgcactcttccacgagggcaactattgttagttgggttgttagttataagggctatgaaaagcaacagttcatttataatacgaaattttttgtttctcttttgtaatggtttgatattaaatgatggtcgtcttttgcaaccgtcgagtgtcagcctgcttacttgctatgataaagagagctaattaattcttgattttgatggctcaatcaagcatcaaaacgtgcttgagcttgcttttggaaagcatttttgttggttattagtttttaggccattttatttacaggatgaatgatagcatgccaagctccaaaaatgcagatgatcttttaccctttttttaacaaagttattttttaggagctttgcattggaaattcactacatgacctgcttgttaatgcagcctttggggaggttctataataaatctgggaaccaaaaagcacagagataggttctttgacggaatcgacaatttggattatcctggctgttttgctatgacagagctgcaccatggttagttcttacttctatttactcactaactaatcattatcactgcttggttgctttacactttatcagtccaaacctcctagttcaacctccatcccattactgttatgtaccatattattttggttcttccttacacagtcggatctgaaccctgcaccaaacaacactgttctgttctcaataatttgagaatgaatattcatgcccatgcagcctgttagctcccatcatgataatagttaagtcctccacacgttactatttcatcttattttatttattttcccttcttaacaggatctaatgtccaggccctacaaactactgctacattcgatccagttactgatgagttcattatcaatacacccaatgatggagctattaagtggtggattggtaatgcagcacttcatggaaaattcgctactgtttttgcaaggttaattttgcccctccaaggaaaaggtgggggggctgcaggaa

SEQ ID NO: 11802 - DNA, 654 bp, Oryza sativa
gaacttctctccattctcattaaacccaacccttcttattacttcatcaaactttaagtaccactgtctggaggcctgttttaatccataaatggatttctttagatggcaccccatttgttcttttccttccacaacaaaacccttgggttgtgccatgtaaacgttatcatatagatccccgttaagaaatgccatctttatatccattcaatgtagctctagatcataatgtgcaacaagtgccattacgatcctgaagatatctttacatggcaccagagaaaaggtctcattataatcgattccttctctttgagtaaacccttttgccacaagtcatgctttatatctttctacattccctttggagtcacattttgttttgtagacccatttgcagcctactgttttggctcctttaggaatttcttctaagtcccaaactttgttagtactcattgatctcatttcatctttcatggcttcaagccacttcgatgaatgagcacttctcatgacttcttcaaaagaggtgggatctccctctgtttgaacttctttactagcatagacttggtagtcactagtaatagttgtccttctctctctttcagatcttctgagttgtggtacttcatcgggctgcaggaa

SEQ ID NO: 11803 - DNA, 600 bp, Oryza sativa
acgaaatcggaatcgggcaagcactcgaccttaccatagccaactcagctaaggacgaacccctgatggcagctgcctcttatttctggtcaaacaccatcaatgccttcttgtttaaccatgggccgatgactccaactctcatagatatcagcatgattacgggtttggacgtcacttcatcggctaacgctatgggcttaaacacaaagaatcaatacgacttcaagaccaagagcataggcggctggtcaggctatgtagcagcatacatgggccaggattcgatcacccctcgagaacatgtggctttcttgttaatgtggctagagaaatttctcttttgtggatccagctgcggtcctacaaccaattggcagttcgtaaccgaagccttggaaacgaaaagacaatttcctttaggcaaaatcctcctcggctacttgtaccaaatgctaaataatgcatcggctaagctagctgtcggctcagtagtcggagcaggtggaccatggtggctactgcaatcctggctaaatctggtagtcatgaaagttgtcaatcggccatccgtgacagaagcagaattcccaaaactgg

SEQ ID NO: 11804 - DNA, 722 bp, Oryza sativa
gaccattatcacagaactaacctacaccaaaaaccggtcgtagctgcgcttcttcctgcccaccgcatgccctggcgcctccgtgctgcagcatatcatgtagctgtagtaaggcgccatcctggacttccatcctagagcctcgaatctcccgcgaggtgtggcgcttcccagcatgatgtccgagatattgggagcctggtccggacaggagtccgtctcatagtaatcagacatccacagaggattgctggcctctgcaaatctcaagcaatgcacccattggcccttcagtaagagattgttagggtgatcaccatgcaaacggagctggttgcgtatgtatgccctcaggtacttcagagtagagcaccagaactgggcattgaaattatccctcagtaatccaccaatggtgtatgcagccagaaaggacccgctgtactccgttgcaatctccatggctaccgaagcaagcttcgggtgctcatccgggtctctgcttccaaatgcaagcttcttgaagaaataccagtaggcttctggatgcaagaggtccagccgaatagctgctgctgttcccagattctcgatcttatctgacctgctggtgatgattattttgctcccacgggcccagcaactcatcgaagattttaagctttgccatgtttgttcactgatatcgcaagctacctcaataattatcaaccaccttttac

SEQ ID NO: 11805 - DNA, 3320 bp, Oryza sativa
tagtttctaacataacaactgttgctagagtaccagaacgtatccattcacgcgcatgaacagtgtgcacaggtagtgtatcatgcatgtggcagatggcctacttaacattatcaactggtcttaataattataatccatggacgacctgataccaagtcaaactcccctatgccaaaaaccgcttcctcttgaatattatatgctgctgtgcttgtgcttcacaactcattacgaactcatggtagggaggtatgcgtgatctccatactaggacctcaaattttccatgagctttagaagttccagtatggacttcatgtagcattaccttaggatcatcatccctgagacatgttttatagccattgactagaatgaattttggatccctaaaattttcaacaagatatataccgtgatttttttgaacaagagtgtatggatgttcaccaaatagaatgacatgtttttcaacgatgtttctgtgacatctaaggaacaaatgccaaaactgggtgcaaaaattagctctgaataatgaagcaacgaaattagcagctacaaaacatctgtactctgctgccatttccatagctgctgattctagaaatgggtgctccacagggtttgtgcttccaaaggcaagcaccttgaagaagtaccaatgggcctcctgaggcaacaaacttagctcaagaggttgagttgttccaacattcctgaacctttcagatctacttgtaataataattttactcccatgtggtatgcagcttcttgaagagtacaatcttctccagttttcctcatctacatcgccatcatcaataaattcgatgatgataagtgaccgttcatgtgcaacacaactttgatgcttgactatgccactatctctgagatcagcaaagcttttgcttccgatatcacttccactacagaaaacaatagaagagaaaaaactgcgtaccctctcatcatagcaaatatgctcaacaagagtacttttcccaactcttgctggacctattattggaagaactcccaaactttctgccccaagagattctcgcaacaagaaattggtaatcctctctatttctgcttggcgaccaaacatgcatttttccaaaattaaatgttggctataaggttggcggtgtatgtgaggatatcccttcaagaaaacaagaaactctttcatatcgtcagtgatactcagtaggctacaaagcatctctcccacctccttcctatcctcaccttgaaaagccatggtgaacgtcctagtggagaaacacaaccgcttggtaggtctgagtttgggaaaggaaaatgagtgatcaccaacctcatcattgaccatctcatgctgaagcactccattcttgatagtatcaaccaagtagtatcccttgtacatgccttctcttagcatctgaagctgctggagcatcgctcgatttgtgatgtgccgcccctcgacctccaggacagttgcctcgatccgcagcagcaagtggcgcaggcattgcagatccacccccatgcccatcttctgctggtagtatttgtcaactaagaaggatatggatctactcacaagatcaccaagaactgcagacaggagcacctccattctgaagctcccacagtggaagagggacggtttcttgctgggggtactaaattaattcagggatcaggacacagctgatctctggctggatgagtttaaacactcgcgtgcaacatttcaacggacaatgtggttttttttttttgaactaatcaatgtggtttattcaaccccgtgtgtttgactatagaaattttgggtgcagcctaaagagaattctaaaccatcgtgaccgtggataggctatttaatttacgatacgagttgtcaactaagatgtgcatagtctacaattaccgcaagcttacgacatcgttcgaccacatttgcgttccccgacctcattgtgtccatcttgacttgttaaggaaactggaggattcgcaaaactcaaatcgaatcaggaggagttcgttgcttacccgcaggctagagagtacggacgcggccgcgcggcgccgcggagcagtgtgccgcacccaaggcccgcgcgcacgccaccgcggtgggagcggcggccgtacggcggggtgtgatgtccagggcgccgcacgagaagcccacgcgagaggtccgcgtccgcccgcccgcccgcggcagcatccgcgaccgccacgcggccgagcatcgccgccgcgtcggctccgcgcggaagcctttggtcgcgaagtggggatacggggaagagaaagacctgagaaagcgagcaaacgttgcacgggacgggggttattagcgaaagaaaaccgttcgttggtgggggattgggagggaatgcactgccttttttcacgcacacatttcccaaactattaaatggtatatttgttaaaaaaatctataaaaaagttgatctaaaaaacatattaatttatttttaaaatttaaaatagttaatactcaattaattatgtgctaatagctcatctatctcgttttgtgtatcttctcaatcttctttttttctctcctctcaaacacttaggctgcgttcggcagctgaagaaagtgagtgagtttgtttcgattttcgcgcgcacgcttcttaaactactaaacggtgtattttttgtaaaaattttctataggaaagttgctttgaaaattcatattaatctatttttcaaatttaaaatagttaatactcaattaatcatacgctaatggctcacctcgttacgtatcttcccaattttctcaatttcctcctcctcaaactcaccttagggtagatgagttactgaacttaattagatcatgattacagaactagatatgctccaagaggatgatgatcctgatccatcaaggtagcagctttgtcagggagaaacacgaatacacaataactagtgatactgaactgctgtagtttaactattgtagctcagatctatctattatattagtaaaacagctttgaaaggagacaccacgttcgctgtgggggctagaaattcccacattaatcggagaaaaggaaaagaagagtccaggtagaaatacaattttaaaatagctgaaattcggaattaaaaataaggaatattgaaagatgggtctatataagaacccaatacgagattaatcaaattcggaataaaaccaaaataaaatccgaaattagaaaagaaaaggagagtccaagtaggaatacaatttaaaaataactgaaatt

SEQ ID NO: 11806 - DNA, 3119 bp, Oryza sativa
cggttggcaggacttctacaaagtaaaaaaaaaactccaatgataatcatatttgatttttaaaatctcaatgacaataaggagaggcagcgggcgggtcgtacaggagtatagttgcagagccgccaacggttggtgagacttctagaaaataaaaaatgaattacaacgatagttatgttcgatttttataatcccaatgacaataaagagtaggcggcggacgagtcgtagagaagtacagtggcattgtttgacgtgacttctaaaaattataaaaaaatgaaacccaacaagacaataaattctaaaaactacaaggtccaatttttaaaggttcggaacttctaaaaattaaagaaaaaaacccaatgatgatcatgtttgattttaaaatctcaatgataataaagaaaggagacagtgagcgagctataaaggagtacaatggcaaagcctctgatagtttggcgggacttatagaaagtaaaaaatgaactcgaacaataattatgttcgatttgtaaaatcccaatgacaataaagagaaaagacagtggacgagccgtagaggagtataatgacagcgtttgacaggacttccagaaattataaaaacgtaacccaacgaaataataaactcaaaaaactataatatccaatttttaaaggtttcaaggagaatgaatagaaatagtggtaaaccgagcaagcaaataaagaagaatatgacagaagtaaggggtagcagctggtgtgacttttaacaactacataattagaaatacggggatgatacggggatagctatttaataaattttaagtaaaatcatactaaaaagtatatgattttgtttgggtgctaaccgcaattgcgcgggccacccagctagttatattattaaaatagctttgaaaggaggcaccacgttcgctgtgagggctagaaattcccacattaatcggagaaaaaagaaaaaaagaaaaggagagttcaagtaggaatacaatctaaaaatagctgaaattcataaagaagtttccatataagaacccaatacgagattaatcaaaattcgaaataaaaataaaataaaatccaaaattagaaaaagagagagagagagagagttcaagtagaaatacaatttaagaatagctaaaattcggaattaaaaacaaacaatattgaaagaagtttccatataaaaatccaatacgatattaatcaaaattcgaaataaaaataaaataaaatccaaaattacaaaagaaaatgatagtccaagtaggaatacagtgtaaaaatagctaaaattcagaattaaaaataagaaatattgagagaagagtccatataagatcccaataagagattaattaaaattggaaataaaaataaaaatctgaaattaaaaaaaataaagaagagttcaagtagaaatacaatttaaaattagctaaaatataattaaaaataagcaatattgaaagaagaatccatataagaacccaatacgagattaattaaaattcagaataaaaaataaaataatatccaaatttagaaaaattaaaagagagttcaagtatgaatacaattttgaaagaactgaaattcaaaaataaaaaataaaaatattaaaagaacacaatatgatattaattaaaatttaaaaaataaattatgaaattagaaaaataaaaataaaatttcaattaggaatacaatttataaataactaaaatttatgataaaaataaagactattgaaagaaaagaccatctaaaacacatgacgagataaattaagtaacagacctataaaggagtagagtggtggcggttgatacgacatataaaaactgttaataaaacaccaaataaaatcctaatgacgattaaaaggagagacgacaggcaggccgtgaagcaaacgagcaaggcgcttcccgggacttctaaaaagtaaaaaaaaaacccattgataatcatattcgatttttgaaatctcaatgacaataaaaaggagaagcggcgggcggggtgtataggagagccgccaatggttggcgggacttctagaaaataaaaaatgaattccaacaatagttatgttcgatttttagaatcccaattacaataaagagtaggcggcggatgggccgtagaggagtatagtgacatcgtttaacgggacttctaaaaattataaaataataaaaccaacaagacaataaactctaaaaactacaaggtctaatttttaaatcacaatgacaataaagagtaggcggcggactggctgtagaggggcatagtggcatcgtttgatgagacttctaaaaattataaaaaatgaaactacaagtccaatttttaaaggttcgaaacttctaaaaactaaaaaaataatgataattatgttcgattttaaaatctcaatgacaataaagaagagaggcagcgggtgagccgtagaggagtacaatggcaaagccaatgacggtttggcgggacttctagaaattaaaaatgaacacaaacgataattatgttcaactttttaaatctcaatgacaataaagcgaagagacagtggacgggccgtagaggagtataatggcaacgtttgacggaacatctagaaattataaaaataaaacccaatgtgacaataaactctaaaaattataaaatccaatttttaaaggttccaagaagaatgaaaagaaatagtggtagatcgagtaagcaaataaagaaggagatggcataaggggtaacaactggtgtgacttttaaaaactatataattagaaacacgaggatgataaggtttggtctttaaaagtcttaagacaatcagataactatttaataaattttaagtaaaatcatataaaaaaatatatgattttgtataggtgctagccgcgcaattgcgcgggccactcaactagttatagatgattacagaactgagatgttgcaagaggattatgatactccatcctgatccatcaaggcaacagcttctcagggtgatacacaatacacaatagtagtgtcaacaaatgcttgttcagcacaaacaaaaaaaggagaaagaaatg

SEQ ID NO: 11807 - DNA, 3878 bp, Oryza sativa
ctgcagcccagaatcaaagagtagtgattgcgcaccctataatcacgacaagcatgctcgactagagtgcttttcccacattttcttggaccaattattggaagcacaggaaaatcttcatcaccaagaccatctgtttgcagcaagaaactgagcacctgctcatgttccatttgacggccaaacatgcaattttccaaaactgaatatgtgtcacgaggctggtggtgcactactcgataattcctcaaaaatacaacaagattcatcatgtcagaaatgcctttttctatggtagtaatcattccttgtagttgttttatgctgttactaccaaaacacagtgttcttctatgactggagaaacgaagacgcttggctggattgaacttagaaaatgaatagacatgactcacctcctcatcctttctgtcctcttgaagggctggatatttatacctatcaagcaagtagtggcctctgtacatcccctctattaacatctgcaactgatggagcatcccttcattggcaatacactttccctctgcctcctcaatgatggtctgggctcttagtagcagtcggtttagtgtctccagagccacctcagcatctggcagttgctgatatttcttgatggcaaaggttgtgagtctataggcaatatcacttacggctgcaggaaccagcatattcatggtgattggtgaacctccccaaaagatggtgcagtgaaacaaaaatataagggagagatcaagcagagcagtggtgctctatgatgctaatgtgctgtttttctacagtacttcacgcatcgcactttcctcagtaactttcttatcacatcactctcatggccgtccaaaatacatttaactcgcttacaagggagcactgtggataaactaacaagtatttctttaaagagaacttctcggctgagaaattaacaacttctcatcgaggaatgatcctgattttcctgcattgagatttgactcgagggtccatatctgtttagtaaatgaggcgcaagataaacttgttttctaaatagagaatacatttcctacaagatttctctttaaagttaatttaaatataatctcctacaacaaatatggattgatatgcagatagatgccatgtcagtatgtcacatcattccatggtcaactataatactatacccaataattgagcattttttgtttctagcgttttaaccgcaagaatcaaaacgtgctatgatgtgaacatccccaatcgccatccaggttaaatccaatacaatccaatcaaataacgccgtaggagagcaaatcgatgaaagagacaaacttacgggccctatacgctcgttgatcgtctctgccagtaattgattagttaccagtcacatcggcgccgccatcaggtggggtgacgccgcatatgggagacaggtgaaggaagcttccgggcacggggaaggagaggaggcggggattccacctgcggcggcgccggcgtacgcgaccaccgcgcggccgcgggtacccgcgcgcccgcgcccggcgacgccggacgctgtcaccggtcgcgagcatttgcggtgcggaagggagcggaggccggaggggaggtgagagtctgagagacgagagaatgagcggtcgtaacagaggggatgacgagagagagggatggaccttcttgggccggagaacttgttaggtgagctcttttcgctagttgggccgggattcctctcttgaaggaataagttcaccagacatccctcaattttacgtccagtttgtatgacatccttaatcctcaatactagaaatcttcacccttatactatacaaaaccgtacaatttagttcccataacagtatggttctctggtttcactgatgtggcatcctagtcagcaaactaaaaaataaaaaaattatgagcccacatgtaagtgagaaaaaaaagagtagttaactagttggaccggatcctagggcctggaatctcctgcccaatagctctcccttaaaatgatgtgctcatgggctgctttggtcgacggccgccgtcctcctcaccaccccacatggaaagaagagagatattggtgaaggcagagataggtgaagatgttctgacatgtaggacccatgttgactcaacgctgatgacttgggtcaaattgcgatgcgggacaaaatcgcctcgctgtactgccatgggacctatattgcaccggtttttgataattgagagacccgttgtatttggtattttggttgaaggatgaaaatcgatctcgttgtcgagttaaagggacctaaaatgaacttattccaatttttttatcccatcaactatttgaaaatttcaatttgttagggttgtgttcgacagtgatagctgagaactaatccctcgtgcacgcaaaacggatagacttattagcatatgattaattaagtattaggtatttttttaaaaaaaaaaggattaatttgattttttaaagcaaatttcctatagaaaacttaaaaaaacactgtttaacagtttgaaaagcatgtgcgtggaaaaaaaggaatatgagttgggaaagaagggggaagaacacaacctatattgataacccactccacatagggcactcccctaataataaggtaaatgctccgatactacttgaacaaaacaaaatatttctgccgtagttagcagtcaaaccaactctacctttgattcctcaatatttttttattaattactccataatcctttccatataaatattatttccttcgtgggtctgttcccctactccacgatacgccatcatgagctttagaaatattgttgattaattccatatttaccaaatcaaccctctatagtctatcctaccagaaaattggtgaatctttcacaataccaacaatttggtagggtagagaaccaaacttgctcgataatgcgcatcatatttatcaattcctttttcaaagaaattaattaggagcatggaaaaaatcagcatgcatttggcaaaccttgtccatatggaactaaactctcaaggattttagttagtcctccacaacttagtaaaattttgagagcctcctctgataggttgagctagagataataagctgtagaaaattgaacaaagcaactaaaatagtgtgtatgtaaaatttttaatatgtattattagcattttaaaaaccaatgccgaataatagtctatcatgaggaaaaacccctaagaatcaactataagttctaaaatttaaatttttgctgcatatgccaacaaacagacgacgagtatgcaggtcggtttgaacatttggaaggaaatggaagaaacaggcgaggtttgcaaaacgaggtaggtagggatgcacagcaacggccaaaacagaaggatgatcatgccgactgtcaccaagagcctacaacaatcgagcatcaagatggggatagcctttaagttcgtcggtgaagctctagaccccttgggaaaatattctttaaaaatgcaagttgcgacgctattagagtatgttgagagaaaggatccatcgaacaaaggttccatttgacttagtatatattcagccattcaggccttcagggttgcaagcaaagcagtgacgaaagcagcactgctttcagttgtgtatggattcaagcgaagcactgacgaaagcagcggcgtcttcagtgcgacggggtcgagacgggatcactcaaaaatcggctaagatggataataaactatggtggaaactggaaagcatcagtcgttttcgagaaatctatcatgtatatgagcaattctacggtatttaaggaggtaccat

SEQ ID NO: 11808 - DNA, 14329 bp, Oryza sativa
  unsure (1)..(14329): unsure at all n locations
cgagataccaaatttataatagaaaaaatggtactttatggtacaccctcaagaaccgtaaaattgctcaatgtatatagtcttcgagacagcagcgacgaacagcagcacgcctaaacggaagcgattaatttcaattgccctgaaaaaaataaattagtacagctagtgcatgcaaagacatctgtcactgtttagttgcgaaagaggcatatctagtaatggcagtgtcaaccccaacaatgatttgcattattgctgtttttagaataataaaatgttattctcaacacatataaatcacgtcagcagttcagcactgtcccataaggtaaaactctcaaactggccgagaggcaaagtctgacgatcgcttgaacaactctagctaggcagcagaagatgcccaatgttgtcaatatgccatccagcaactgctccggccgtcacagagaagcaaaagctgtgtttccttctcctaggagagagccaagcggacaagcctggaggttggctgctaatgctatggagcgtccagttgccaatatttctgctaggcactgtaagcggccataggccggttggtgtgaaaacgcaaagatccccttcagggtcgcccacaggaaaaacataaaaaccatgtgctcaaaaactacacagccatgagcagatgcgctactcattcgaggaaagtaaattcagtgcaacaaaaggattcatttcgttaattcattcctgaaaaatttgttgctgtgctgaattagtaattggacagcagacagcacgcttgaggcttgacaatctttactcatggccgccgaattgccaatgtacgttttccctgaaaaaagtgaccactgaccatgctaacatgcagctgtagatcctttcttgaggttctggacaggacagatccaaagatgtttcactgaagaacatggaagagatcgactagcaagtctcagaaatgttcactgaagaatatgacgagtcccgtgagttcagaattcggaaatgtgttcaccgaagaaaaacgaaagttcagaattcagaaaagctgactattttattttttgaacgactcgcccgagacgatacggagttctattcatagagcgaagctgactattttatcacctcctacgttgttattatgactagataagcaaacataggaagtactaatgccataggagctttcaaatggggctattttaaggtagtggatagtattacattccacgagaccttcgcaaaattacaaagtgaacatccagtacaagtgtccggagacgagcacgacaatgtgcagtacggttcaccttcagctcgccggagcaaagcttacagccattacaagcaaaaaagaaacacattgtgctattacttgtagtgttattaagtaataacaccactagtaccagttcaagcacagctcgaaacaaggagaaaatttagtagcgcatacaccatgtcctgctcagatgctgtagtccgaccattgctggatgaaggaggtgtggtccatggattcacccggcatgtcgtcgcccttcttcccgccgagcagcctcgccggattccccaccgccggggtccttcgggggacgttgatgaacccccaccaacccgccccgaacttgggccccggggccgatccttgactttgccgaggatcgtcgcgccggcgccaatgaagacgccgtcgccgatcttgggggtggcccggtcgcccacgggccttgcctgtncccgcccagcgtgacgtggtggaggatggagacgttgtcgccgatgacggcggtctctccgatgacgacgcccgtggcgtggtcgaggaggacgcccttgccgatcgcggcggcggggtggatgtcgacggcgaacacctcggcgacgcgggactggagcgcgagcgcgagggcgcggcggtcctgcgcccagagcacgtgcgcgacgcgctgggcctggatggcgaggaagcccttgtagttgaggaggcagtgggagaagccgacgcaggcggggtccctggagcgcgcggcgaggaggtcggcgacgacggcggcgcggagggtggggtgcgcggcgagggaggcgacgaagaggtcgtagaggagcgtggagagcagcgtggaggagcagagcttgttggcgaggtggaaggcgagcgagcggtcgagggaggggtgggagagcacggtggcgtagaggaacgacgcgagcgccggctcggcgtcggcgtcgcggcgcgcctcggccttgatctgggaccagacccacgactcgtcggcgtccgactccgggggcgggtacgccggcacgacggccgggtggagcgccggcgggctgtgccggcgtggctggggatcgtcccggagaggctggcccgcagtcatcgtcgccgtcgccgtcgccgtcgtgtcgaggtgtgtggatatgtggcggtcggcggcgaggaaggcgtgtggcccgtgccgaggcgagagcgaataaataggcgtgtgccgagtggggacacgtcagccaaccaatcgaaaacaggtaaactttatctctgcgtgggcccggagttaagctggtacacacgatgagcacgagcccgagttggcgcgccgtggacgcgtgggcaagcgccaaggcggatcgagcggcgacgggcctggcccacgtttcgtggcctagctcggccctgcacaaacaccggatcgagcgaactggatccacgcggataaccgcgggtggcggcaggcggtgtcgagtttgtgcacgtccacgtcgtgatccacctgaccacctctagccagaaggcgccggttgatcgagccggagatacctgcgctgacgcgagtacgcgacgctaagctggtcgtacttggttggttgaatacgatctgatcgcaatattgttgccatcgatggacgaaaatcacacgattacacgagcaattatttggttgtgaaaccgtgaaagcatccaaatgttccatataaccgttggattaacgtgcacgggacggcccgacggggagagtgcatcgataagagtcatagtatagccaactactcattccaaattatctataaccaatctaacagcatatttatacaatagttatatactacactattaatatatggtccaacctgtcatacacacattgtgtcttgaagtctgtgctacagctgactataaatctataacccgctgctattctctcttctcatttatcttcttaaaatatatttacagcctgctattgtaatccctccgttttttaatagatgacgccgttaactttttctcacatgtttggccattcgtcttattaaaaactttacgtaattataatttattttattatgagttgttttatcactcatagtactttaattgtgatttatatcttatacatttgcataaaatttttaaataagacgaatggttaaacatgtgagaaaaagtcaacggctattaaaaaacggagctaatatttgctctaactgggtatggatgataggtcacgccgtcacgtgccaaagtcagagtgggccggtcccgatactgttgtcttgcgccgctgagtttctgaccccgccgcggcctccgccgtttcgtacgccttctcctctcccgcgcgcacccgcctccgcctccgccttccccggccgccgccgccgccgcaggagaggagacgcaggccgcggcggcgtcaaccgccgctctccctttgccaccatctccgctcccgacacacactccactccactccagtccacagcactaacccatcggtcccggcgatccccactagtgcccctcctcgcccgcttgccatggcggcttgcggcgccgcggcggcggagtattcagctctcctgtccctctcatgtgggcctatcactcgccgccgtttcgccgtctcctgccgcgctcgaccgcccggcaacctcaggtgagtgcctgaccaatctgctgcttcctgcttgctgggagtagctgggggacacgcgatgtgttcgagaaagtgtccatgagcgaacgcatttgggattgcgcggtcgttgcgtgcaaacgaggccgtttgtgccaaacgttctctcactgttccacccgctcgtgcaaaatggatgtcgccgagcatcgatcgtggcatgttgtcgtgtctcaacccattagtcgagtaggaatatctgttaatactctgtccagtggtgaacgaatctaagctgacttagaggctgctctgcacggttaatctgcagtgctcgagctaatgaaatttcacattaatcttctgaaaaagcagtgtgtttcagtgtgctaagtcattttgcaaaacatggtaaagtcgctctattccatattggtctagaaatccctgggtttgcgcattctagttggtagagttcacatgaaggtttttgcgcttgactcatgactgacagcttctgtgtggtagtgcacagcagaagaagaagcgagggaaaaacattgctccaaaacagcgctcttcaaatgcaaaactcttgcttactactgaggaaaatggacagcttccaagtaccagtttgaggacttctatggaacgtcctcagaagagtacatccagtgaggacgataccaatggggctattagccagatagatgaaaaaattgcagccattggtaatgaacagcaagaggtactgccttactggggtggtcatatacttatatcagcctatcagggtatcctggtgcacttccacacctccttcaaacaagctagctaatttaaagagatatgcttctacattcatagatcaaggattattgaacttttgtttatgtgacttctgtgcagtatgtcagaaaaaaacattaaaaagaaaaggcacagtcatattgcagaaccatgataacataggattaaaacatttaaattgctattcatttcctttggactgattatgcattgtcgcttcctaggagggcaaccttgttataaatgtttttccctatttggaatagagttcatccttatgtagtattatgcagaaattcgtctgataaaggattgtaatgtttattttcactcctcagtttgccatgttcatccttatttagtaccaataccaatatgctaaattgcctctcaatatcttagcagttatcaccaggccatccacaataaccttagagctcgcatcgtctccaccagaactagaatgatactgctttgagcgagacactgctacctagttgtactatgcaagcgtgtagtctttcttatgtccttcagaaattgtttcatttttcataagaatttctcctcttatatattaacacagaggtcaaaggataaacatttcgaatcagactttcaacttgaagattttggggaaatgatacaaaacatggaaaagagtatggaatgctttcttctcaagtgtattcatacattcatgcatgatatctgatgaaaatacatgaaaaataatttttaaaaatctgacatggctagatattctgctcctaaatcaagctcgtcttcaagcaattgaagatgttgacaaaattcttactgaaaaggaagctttgcagaaaaaggttgacactctagagatgaatttgtcaaaagcacttgcaaccaaagggaacataaatacagatatccctggtgatcatttagagaaatttacaaaagaaattttgatagaaagtgctctaagtggaggcaatccagcacatttgtgtgagtctccacttttcatggagctgactgttctaaaagaagagaatatgctacttaaggctgacgcacaatttcttaaagcaaagattgttgagtttgctgaaacagaggaattcctattcaaattggagaaagaaaggtcactgttagacgctacagttagggagctggaagctaggtttctagttgctcaaactgatatctggaaagttgtccctctgcaatatgatgtttggatggagaaagtagaaaatctgcaacacatgcttggatgtttgaaaaatcatgtagagaagtatgctgcattgttggatcagcatgatgatctgcatgacaagattgatgagctagaagcatcactaaaagaagggaaaacatctgagttttctccttatgttgttgaacttctgcaacagaagttgaaagcagcaaaaagccatcaccaagcaggccatcaagaaacaaacactcacattcaagtatatcagcagttaactgaggaatttcaagataacctaggtaaactaatagaagaaagtggcagactggagcattctgcaaatagtatgccatcagaattctggagtcacatcctgctcatgattgatggttggttccttgagcggaaaataccaaatactgatgcacgtatgctgagagaaatggcatggaagagagatgaccgtatctgtgaagcctactttgcttgcaagggtgcaaaagaaagtgatgttatggaaactttcctaaagctatcgttatcaggaaacaggtattaaatttatcttgtgaatcactttatttttgatgggttcaaatatgaattagaaaacttatctgcaattttttcataagatctatactactttagtggtggtgtccaaatctgcctccaacgtcacgagcaaacgtgtggggccataaggtctcagcacatgaatgcttttgctttgatgttatatgcctaattaaataactatgttataaacttgtaatttttgcttgtgcttttatctcttgtaatatccattacaacacacggacctttagctagtattttctaatatattatcagtcaatgcagttctggcttgcacattgtccatatagcagcagagatggctccagtggcaaaggtgatcctgtacatcaattcacacttccatcaagtatttggttctgtcggtgccttatccactctcactgcacaatatatcctttctgtaggctatgtaccaagaaaatgtaatttcgtgaattgcagccttgcctgatataatccacacaagcttagctctatcttgttcacatctgcagttatttttgcctagtagttgtcaacaataatgccaacagccaagtactggcattccattttgagttgaaaagattgtatcgagactttgcaaccaacaagaacatgcaaaataatggagaaatgcactgaaaattgtatttagcactaagttcatgcatctcaaaattcaattggaattatgtagaaatttcttggttgaacttcacattggctgaaaattgacttagaatgataacattatttggcttacctttacttattaaatgcatacaatttattcaaaaccagttataccaacaactgattagtcagaaaagtaatggaagtcacccaccacaaaccatgccgtgttttgcactagaaattccatccgatatttgctagtaggtgccacattgcctgcttagtcagaaaatcaacatgcctgcttgcttgctagtaggtgccacaatgctgggcacattaaagttggtgatgatcaacatggccctgatcaagcacatgagtagggaaatgagtgatttgattcttaatagttttctcctatgtaaagcgttaaatatttgtacatgaggttgaattcatcttcacatcaaaaaccaagtacttagtcatataatacaggaataatgggtaggattagtgtgctgtattgtttgacaagaaatttcatagcattaatgaaagttccccatttgttaggaacttgcattgtataattgatggaaaatttacaagaacaccctaaaaatattttatgtattggttatactcctgaatttttagtgtagattcgtgtcaggtaagttcatctctacatgaggtcttccccttctgaatgaattttcctatttgctactagcgttctagaaggtgctaggtttgttgcctgccttctagaacaggggccactaccagcagttttcttctatattaagaaatagaccataaagtcataaacattatatctgtgtatgcaactgctcatagccttaaatcctagttatgagaaagattaattggctgtggaaagtagtctgctggcaatttcatgtttcaaaatcaaatagattatctcaaccagaccacattctgactggaagttgaaatgagataactgttacatgggcagttatattgagaaatatttgcagaaattcttatgtaattgtttatacttatctttccatgctgcttggatttgaagtattgcttatactaatcagcattttaattgtgtaatctcatttaagtttgcttaacaaaatggttcttcaggttggcggtctggcagatgtagttgctggtcttggcaaggcacttcagactaagggacatttagtagagattgttcttcccaaatacgactgtatgcaacttgaccagattactaatcttaaggtttgtgcttgttggttagccatgatttttttttacatggttttgcatctttaatctgagcctctgaggtaagattgtattcttggtgatcctgcaggttttagatgttgtcatacaatcctattttgatggaaatctattcagcaacaacgtgtggacaggaactgttgaaggttctaagcaactctattggaccttataagaactcaaaaaaagttaataattgtttgctaactgcaattccaatatacaggtcttccagtctattttattgagccacagcatccttcaaaattcttctggagggcccaatactatggagagcatgacgattttaaacgttattcatactttagccgtgcagcactggaattactttaccaatctgggaagaaaattgatataatccactgccatgactggcaaactgcatttgttgtaagaactgaaattcatttcgcttgctttttcatcaatagctgaaaacatataaattttgctgttattcatttgctaagttctgggtgtcaactattctctaccgtgttcaagaatattgtatcttacacttagatttcaggcacctctatattgggatatatatgcaactcgaggcttcagctcagctagaatttgtttcacttgccacaacttcgaataccaaggtacagcacctgctcctgatttatcatattgcggccttgatgttgagcagttggatagaccagacaggatgcaagacaatgcacatggaagaataaatgttgccaaggtatagaatagagaaatagcagttgttttgaattctgtaccttaaaagtcatgatttttatatttttgcttcttattggtttcagggtggaattgtttattccaatattgtgacaactgtatcaccaacatatgctttagaagtgcgctcagaggtaacaccagcaactctgttttctaaacaactattacaaattcaatatcagcttcacacactttagatgttttctttcaactgtagatacatgatcaacctctcaaatagtacatatttttttttgtaacattagtatttatacttagagtaattgactacacaaaggtcgatgtatttatctgatagaccaaatcttttttcgaggcaacatttatgtaagctgttaatgtacaagtaatgtgaaaaattaatatgtttatttgacaggcacttcttcatctaaaacaagtggcatttcttagtccatgtaggattaactgtctgcatttgctgtccttgcttttcttttggcctttgccccagagtaaaaattgctagctcaaaacatatggcataagtaaacaaggtttgaagagacttcagtgaaggccttttatgtctgacattgttatgcaattttttttaattgttttaagaattttcaaggcattttacttgatatgttactaatgaattaggggtctgatataagttgcccatcatgaccttttttattggtcagggtggtcgtggtctccaagatacacttaaaatgcattccaggaaatttgtggggatacttaatggaatcgacacaggaacatggaacccttccacagacagatttcttgctgtgcaatatagtgctactgatcttcaggggaaagcagcaaacaaagcatttctcaggaagcagctagggctgtattctgaggatgcctctcaaccactggtatgaatttcagttctacgcccatcttaactaattatatggctatctattcatctattgtagcctttttaatgtaatcaagtcatttcattgttttttcttgaaaacgccagagaattgcatttcatttcatttaggggaagagaataaaggaaaaatacaaagtaggagagaccaaagcctcctacacacccaagccccggccaactagctgcctaggtttgccgaaccactaagaaacttttggagggcagacgctcccactatacaccaaagattaccctcattctctaccacctgcaagaccgttgcaacattaggactggcgccattgaaaacacagtcattgcgatgcttccaagtctcccaagccactaagataaccaaggaattgagcccttttcgcacgtcctttggccagtattttgtatattggctccaccacagcagctttttataacaagccccttgatttgtttaaccactttttataacaagaaagtacttctgttaggggagaataccatttaaaaatcacatatctgaactctgttttctccagttcaagaaaaccccttttgagttttgaactttatatcattttcattttttgttggtattattcgtttagattagctgtctccttttgttttgtttcttggagtacagtctctattgaaatgaattagtctcgtagtttatgttcagctttgatcctcattttgtgccttttaatgaccatggttttctgaggcaggtagcctgcattacgaggctagttcctcaaaagggtctacatcttatcaggcatgcaatatacaaaacagctgagttaggaggacagtttgtactcctgggttcaagtccagttccacatattcaggtctgtatactcatcgagtgcctcattttattttctcaactgcagctcacatttggccctatgagttcttgatttgccatggatatgtctggttccatagttttatgtatataatttattttcttctacatcttggctgatcttgttactgtgaactgatcgttgtgcatttgtatcacagagggaatttgagggtgttgcagaccaattccagaagaataacaatattaggttaattctgaaatatgatgaagctttgtctcattgtatttatgcggcatctgacatgtttatcattccatcaatgtttgagccttgtggccttactcaggtgatctatccgtacatattaaattatagatcttccatttaccaaccaaataggcctacaattgctaaatgtgcgccagtgtgcccacatagcttgcttgggttcaaattggcatttgtgagctattatcacaaggcatggatttagactaggttttactttgatctaaatatcccatacaagtcttacatggttgtgtcatccaaataattttcttttatgaaattagccacattttactaaccattttacatggttgttgacattttattctttttcatgcccaagtctgacaagtttttatcaaccagatgatagctatgagatatggttctgtgccaattgttcgacaaactggtggattgtgtgataggtgatttctccctcaaacatttcctttgcatagtatattctgatatatctgttgtgttctacttttccagtgtttttgattttgatgatgaaactatacctgtggagctgcggaatggctttacatttgctaggactgatgagcaggtgagttttacaatggaatgcactttcaaatttggatttctaatgttttatgggtagagctcacgtgggatgcctattttggtaggatctaagcagttgcttggaaagggcattcagctactacagcagaaaacctatggtttggaaacagttagtgcagaaggatatgcagattgatttcagctgggattctccagcttcacagtacgaaaacctttatcagagtgctgttgctcaggcaaggggagcggctcaaacataaaccttttcatgatgacattgtgagcttagattctcccaagcgcagagacaatcgtcagttttatcatatctgaaccaggcatatgctgaagaaatattgttcttctcacattcacagaattcacacatcgtgatccttgctgttgccattcccgaaagaactgagaaagagtagtcttacagttgatcaagatattgcattttgcagtcagtgcacggaactagttctgggtttaatggggatgagtaatcataatctatactggattgcccccctctaaattccccccaaccgttagtttttgtgggaatgcaagaagtaaatatgtgcactgtagggtgacattcgcatacatgatactgtacggtttattcagatcaacgtttgggtaatgtgactacttttgagtttgagagatttgcgtgctccgttctaaccttctagggtgtgtttagaaaatgggttaggagaggtgggattgggaaatggaaatgaataaagggataggatgaaatggggtgagaagaatgggtggctaagattgaagcttaccctttaaggggtgggaaatcatatcccaaacccattttccaaacacagccccaaggttataaattttttttttgagggaccaaggttataaattcgtcgtctgaaattgacattttgttttgcgtttttgcatgtgattatttgagtccgcgtacatttccatgtaccatggggtattccgttccataccgccaggcaaactgatttcccaggaacaaatcagataaaaattattttacacaatcaggtccattgtacttctttcatcaaccaaccagataacattgttttacacaatctgaacgaacgaagcaaatattcgggtacgcggaaagaggagaacgtcgcgcgtctcaccgcagcctgcatgaaagcaatggacctcaccgccgttgctcgccggagatccacactcacttgccggggacgaagttggtggcgtaggcccatgcgttgttgttgacggggtcggcgaggtggtcggccaggttctccagtggccccttgccggtgacgatggcctggacgaagaacccgaacatggagaacatggcgaggcggccgttcttgatctccttcaccttgagctcggcgaacgcctcggggtcgtcggcgaggccgagcgggtcgaagctgccgccggggtagagcgggtcgacgacctcgccgagcgggccgccggcgacgcggtacccctcgacggcgcccatgagcacgacctggcaaccccagatcgccaggatgctctgcgcgtggatcaggctggggttgccgaggtagtcgagccccccctcgctgaagatctgggaccccgccttgaaccacacggcctcgccgaacttcacgccgttgcgggcgaggagctccgggaagacgcagccgagcgcgcccagcatggcccaccggcagtggatcacctccagctcccggttcttggcgaacgtctccgggtcggccgacagcccggcggtgtcccagccgtagtcgccggggaactcgccggtgaggtaggacggcggctcgccggagagcgggccgaggtagagcacgcgtcggcgccgtaccacgggctccccgacgccgcggcgggcttgggcttggccgccgacttgcgcatcgtgacgcggccctcgccgaacaccttggcattggcgaccgccttgccggcgagggcgcaggggaggagagtgccatggtggacgccgccattgacgcgagcctaggactaggaggagatggccacagatgcttttggaatgtgtgtcttttgagctcgtgagctgctgtggtgaggaaagtagtgagctcgagtggggtttaaatagtggcgggaaacggggacgctgcaaggatgggcctatctcttgcgatcgtctggttggatactttggatagctcgcttcgtctatctcgccacctgtgcacgctttctgctgacgtggagatcagccaatcagcagacgacggggtggacatctcgatatgagtcgatagagtagcaattattagatcctaggccctgtttggatccggaggaatagccctccggaatctcgttatttaagagtattaaacgtaaattactgacaaaacccattccataatccctaagctattttgcgaga

SEQ ID NO: 11809 - DNA, 9509 bp, Oryza sativa
  unsure (1)..(9509): unsure at all n locations
aaaatagcctaggggttatggaatcggttttgtcggtaatctacgtttaataatcctaaatagcaagattccagagggttatttaatagcccggaggatccaaacaaggccttagctaggctaatgggctaatatcttgttcggacaaataacccagcttggcccatgggctataataatccataacatctctcttcgtttagctttggaattcctttaggctgcgtttggctaatgggttatgtctaatgggaaatagaaatgatatcttgttggaatgaggtggtagattatatgaagagaaattgtatcctatgtttggttagatggatggaaaaggaagtttctagactaatgaccaaaatacccctccttgcaataagtggcagaacatagacagatagaaaggggtcaaaatggcaaggggcaatatggtaatttcgcctagcactctatccacccctcaatccagcaggattgtgcatcccatttccaatgtatccaaacagcataaatctggaaaagggaaatgatatccatttcccatcctcctaatcccattagccatacgtagccttagcttttatcactcgtgtcagattatcacacgcagcttgaagaggctattaaatactctgtagctaatatagtactctcttcatcttatgagacttcttagtcaaacgttttcaagttaaatcgaatttatagagaaaatagagtaacacttttaacaaaaacaaacatagtatcaaaatctattcaatgttatatttaataaaactaatttgatattttacatgttgctaatttttctataaatttgattaaactttaaaaagtttgattaaaaaaaaagagagtcaaagtgtcttacaagatgaagtggaaggagcagtaactttgatatattgaaaagaaaataccatggttcaagcctattcattattgtcagtgttacggataagtcatatttcctatacttaggttcgtattgtgtggaagtaccatatacctaatgttatacgagagcggaaaggtatatccaaacaagttaataaagtgagcctgaaaggaaattatctttgccggaatagaaagtgttaagagtctaacctagagaagacaagcttcttcatgttctacttggagaagaaggcgcttactagtataaatacaagcctcccgtgaagggatggacatctaatcacgtctcacaagtcatagctagagcctcatatagagacaattcggaggaagtcgaagccctagtccaagtcatagctagagcctcatacagagacaattcggagaaagttgaagccctagtcattgataagatcttgctgagccgtaagattatattcaacgggtcagattagctagtctactccatccatataatccgtgtggtacttttctcagttcattacttataataagggttattacttagcttgagagctcaaatcagtataaatccttatctcttgtcttcttgatatgatcttgcatataccttgttctaacgtttttcatactctacaaatattattgacaactatcatgaaaaaaaaaaccatgcaaaatgtgcatgttaaaagagaagggaaatagctagaggagcactaaattccgcatagcaaagtttatttctgcaggtcttctttggcgatttgtcctgaataattgctgggaagtgcacctgaatgaatccctgatacaagcaagcaaagacatcgattcacgtgagagcaaataacatccataattaagctgtgtgttcggacgtccattttctcaacccatattgctcgttttccgcacgcacgattttcaaactgctaaacggtgagttttttgtaaaaagtttctatacgaaagttgcttaaaaaatcaaattaatctattttttaaaaaaattagctaatacttaattaatcacgcgctaatagatcgctctattttccgtgctactgttccaagttgggaacaacccatagggaacacagcctagtttagctaaacacaatgcaacatgtgtttgccataatgcaatcaatctttggactgaacgtctgaaccctttcgaaacagcgcacttttcttgagtgttctgtgctaatattccactccagaagcgcccaggttcttatcgatgccacaacgaaaatgcagcagaatttctggcttactacctctctgcactagagcattatcacaacaaatctgctactttgatagttgatgcctggtagtgacaagaagcacgaatcttaccacgtacagtgcgcgcatcaaccacatgaaaagcatctactcacggggatgtgtcggctgtcaactgaacacaaattgcaggggttggttccttccatctgctttctccacaagtgaacattcacatatggtgttccatactttgatccgcatctgatttatagccatgtgttgcgaatttgtgaatacctcgccatattcgcaagttggtgaacatatcaccaattgtattcgagaatatagttgattacaagccgtaacgtttattagtgactaaaaacaatttatagataaaaaatttatatatgtacgtattattagcgacttaaaggttaatgctaaaaataattcactataaagaccatcaaattcaactctaaaattaagtttaaattttagctacaacgagtaaacattggagctaatcaatgtgaagccttctagcctttgttatttttggcgtggttttgcaagtgtctgatctcataatttccaagtgatggataattttaaaattttcccgaatcttcatccatttatttatgtatttattttgttatggatctttttacgtgtcaacacatgagcttgggacttgggagcctggccaagtggtgctagatactaggaatagtgtacaatgtatacagaattataagaggtgagccacgcaagctgccactaactacgcgggttaaacggaatattccttgctagtaagatacaggagaacttgttctttttcttaacctgataatgtagaataaggtagcagcaactaggagccttcccaagtgactaggagtaggcttctctcacatgaccgatgtctcgatacacacatggcacatggaaatgaaacactgcttcttgaccaaaaatctgggattggacctctgtttatatttcagcctgctggattagaagggaaggaaaaaaaattggatggaaattgacagatagaccagccaaacgatccagaaaccaactccctcacgttgtaccagtggttcaaaatcaaaagaggcaggcagaaaggaccaacgaggcaacgatcgaatcgtgtccatggtctccacctcacgggagattctccgcatccaccgaatatccactaggcgacgcccccggcaaatgctcccaatttttttctcacatgcactttgtcacctgtcagaaacgtgacccctgttatcctgtaccataaactacagtatttgtacttagctcctggcatccaaaaattatcattttctctgcactatacccttatatacctcgtgcgtaagaatatctcaattccttttttttcccaataagtactccaattcagccgcgtataaactcagaaacacgtagagattgtttctcaccgcagcagattgtggcaacccaactgcggatcaaaaaccaattgttccacacatataccactcgcctgggaaaccggcagagccacccaaaagatagatgcgccgaaagcgaccgccaccaccggtccaccgcggcacacgcgacgcgagaagcagagaaggatattcccctcgcggctcccctccggatccttcccccacacaccgcaagtccgcaacgcgagccgcaagcgcgcaggcgcgcaaccgcgcaacggccgcacgaaaagcgaaaccgaaagacacaaccccgcatcccattcccgcgggcctctcggctgcttccggaaactcgtgttttctctcacaatccctactcccacccgcgcatcttcgtaatattcgctcggcatctcccccctcgccctcccgcgctcccggtatataagccgacccccccgcggcctcccattctcctcatcagatcaaagcaagcaaacaacaacaaaaaccacttctcgtgggtagaagagagagagagcgaggcgatttcgaccaagaagatggccgggatcgtggtggtgttcgacttcgacaagacgatcatcgacgtcgacagcgacaactgggtcgtggacgggctcggcgcgacggaggagttcgagcggctgctgcccaccatgccgtggaacaccctcatggacaccatgatgggcgagctccacgcgagcggcaagtcgctcgccgacgtcgcgggcgtgctcaggtcggcgccgctcgacccgcgcgtcgtcgccgccatcaaggcctgctacggcctgggctgcgacctccggatcctcagcgacgccaaccgcttcttcatcgacaccatcctcgaccaccacggcctcacgggttacttctccgagatcaacaccaacccgagcgccgtcgacgccgccaccggccgcctccgcatcgcgccgtaccacgacttccacgccggcccgcacgggtgcggcctcgggatctgcccgcccaacatgtgcaagggccaggtgctcgaccgcatccgcgcctccgccggcgccgccggcaagagggtcatctacctcggtgacggccgcggcgactactgcccgtcgctccgcctcggccgcgacgacttcatgatgccacgcaggggcttccccgtgtgggagctcatctgcgaggacccgtcgctgctccacgcggaggtgcactcgtgggccgacggcgccgagatggaggagacgctgctgcggctggtcggcagggtgctcctcgaggagaggaacctgccgccgctcgactgcaagctcgagtcgttgccggccgtcgccgtgcaggacggcatgcccatgacgctccggatcaagaactgatcaatggcggcgacgaacgtacgcatgatttcgagcgcgaaacggctagctcgaacaatgtgtgtgtgaggattgcgatacgggtataattttaactattgactgatttttgcgctacgcgtgattgagcctgcgattagtagaggctcattgtatcttgtccgatcaattgaagtaaaacatttggcttggctctctctctatgagatgtaatccatttctattatcttaaaagaaaaaaagtaaaacattcagaaaaaaagtaaaacattcctgacagtgaattgactagtctgaattttggtgataattaattgtctgtcgcctaaaatgttttacccatttcgtcaaaagaacgtgctcacccaaagtcggtttggttaatttgtgattattgtatactattagtagaatcttcgtctcatatacttatatgcaaggaaagagatggttccgataacagtggaataaagtagaagcctacgaagagctataaataaaaacatgcgcataatacaattctcggtcactcagcttttgtcttttgtgtggaaaaaaagcttgtggctcggatcaactcgaacttgcagtcttaaaaaagttaagcaagctaggctttcagtttgtgaatcaaacaagctagcttgcgagccgctagtttaacttgttagtacaatagatcaccatagtttttagtgcttatcaactaatgtttagtcacttaattacattcaaaataactgtatttaataaattatttattaggtagtagtatttattatttatttatgataaaatagtaaatttgaaattatgaaggtgaaataatatgttaaaaaagcttaataggtcagcttatgagccaagccgagatagatttttagctcgttgaggataaagagccgagccgagccgagataagatggcttgttaagatgacaagctcaaacgtaccgagcaggcttattatttgcaagctggataccgtactccaacccataagttcatctcatatttttagcttaatagactagatcagtttagctgcctgcggatgcccaaccgcacagttaccgtcctaacatgtaggtccaatatttccatattcttaccgaaattttgagatgttccacagctcgatattcgtatttcgaatgtttagcaaagatgtggcgcgagaaaattcatctagcaattcggaaagcgccacacgggcggcggaaccgccatctcctgcgctttcaccgagcgagaagatacgatgatatcttcgcgtatccggtactcgtgaacctgaaagtttggacactgattgaaagagatattccccggcaggttcgccaccggattcagcttctcaccaaattttaggcacatattctaggcatatgctgggcatcgtttctgctcccctctctgttgcgctcctcgtcgatccacgagaaaggtgcagtggacgccattgaactgcagccactggctcccacagctcgccgttcacacacgtgccaccctcccattactcgattccgaccctcgacgacggcgacctcccggtgagtgggccgcgacggccagcttcagcccacgtcgtcttcgtctttgcaacggcccatcaaacgatgggcctcgtcgagagataagcccacaatggaacgggctattgttgggtttgggcccatcacgcagcccggcctctctctcgcgtcgtgacgcacaccacccatcgcctctcctctcctacgcttcctctctctctccgacctcctcggatccgcctcgatctcctcctcctcctccacgcgcgggcggcgaggaaaccctaccgcgaacgacggcgatggcgctgctcccgcggacggcgcggctggcgctgctctcggcgccgcgggcgtactcggcggccgctacgggggcgggcgcagccccggcgaggtacgcgggggcgccgccgccggcgccccagtcgaaggcggccgagttcgtgatctccaaggtggacgacctcatgaactgggcgcggagggggtcgatctggccgatgacgttcgggctggcctgctgcgccgtcgagatgatgcacgccggcgcgtcccgctacgacttcgaccgcttcggcgtcatcttccgcccatccccgcgacagtccgactgcatgatcgtcgccgggacgctcaccaacaagatggcgcccgcgctccgcaagtcagtaccaccttcctcccctcggctgctcagatttcgcgttcctgtgttccgatctgggaatttggtgttgcccagcttttagatcttggaaattatcttgccagggtgaaaaagactcaatagctaatgtgatgtcattctgtagtgtagaaaagccataatccgaaaagccttaatccccacctttaatgtcatttggaaacttgccacaaattcgacacaagcaccaatgttctgaatgcccggacaggacaaatgggatagtgcggtgaataattgaaacctccttccagcatcaatagtgcattagtctaaatattttggcatgattcaaagtatgccaatgaagattgtggatcattcaacccaccataacttaggataacttagcatacgccctatatggccttgcagatatttgagaggataaatcgacttgataaatatatagggtcaattcaatggcttggtgttaaacactggctggatttgattttagaaccataaaccactgcctgtggatcccgatttgatggcttggtgttaaagtcttgctggatttgatttgaggacctatgcattcatggaggatcagacttggaatgcttatgcgttcaagcttcagtagtgctaaatgttaacttaattaaagcattgcgtttgacttccaggatatatgtgtaacataaattgatttgatgtttacgttgtcgattactcattagtgaaaaaacatatttgctggtgaattagatattgtgggtacatagcatggttgttaaggcattgttatggcatcgccatagtggtaaaggcggttgcaggatatatgttgttgcagatcccatgccactaccatcagatctagctcaagatcgcagttgttgcagcttgctggagcctttgaatctctctggtggcggcgacggacaatgaggtgagcagaggcattgagctctaatgggccaatggcgccatggcagtggtagcagcctgagatgttgagctcatgcaaaggtggtcggcagccagatggcggctagtgcctcctctgctgatggctggtggctggtggctggtggctggtggctggtggagtatgatgcctcttagggcatacgtagaacatgtgggtatgaagctaatgttagctttggtgggttggctgcttggcttattgggccttttatcaatttcccctttgctcttgctgatttttctacaatattctccactaatcacaccttagtcacctcatatgacatcacaattcacaacacctcatgccctatgatgctgaggcggtggtgtgcaactgtgttgcctcaaaacaccttatgccttaacaacacttgtacctaggttatttaagatttgcttgtctcgataccaattttttcaaaaaataatatagtgctccacggtagaaaaaaaaacaaatatatgccctgattatttgcataagcatggatttgcttctccaagaatctataactctagaaagcaaagaaaaatctaattctgatcagcaaggtgtagtttgtattgatgtgcttctctgaaatgtccagaaaccagcaaaaggagtggcgtgttgttctgagtgtttgaaatcaaataaaattattttgttgtatgaatgccatggcctttgtggaaatcagtgcttttcttgtgtatcctctggttatctgctattaattttagggtgctacttccttcttcttttttttcaaacatgctttttaagatttcgtgaagaacttctgttgtgccttttgctatttaggaatggttttgtcaaaagaccattcaacctttcttacctgctcacaattttataatgctaatggcattggtaacttcttccacagggtttatgatcagatgcctgagcctcggtgggttatttccatgggcagctgtgccaatggtggtggatactaccattactcctactctgttgtgcgtggatgcgaccgtattgttcctgtggacatttacgtccctggatgccctccaactgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11810 - DNA, 662 bp, Oryza sativa
gcggcgctggcgccggcgccggcgccggcgtgctgcacatagttggcgtcgcgagggtcgggaagagcaccctcgtcgaacacgtctgccacgacgagagggtccgcggccgattctcctccatcgtgtgcttgagccgagaagaccttgaggacatgggagaccatcgtgctctgaccgtcaagcacggcagccatgcctcccacgggagctcgctcgtcgtcgtcgacctagccgaggacgaggagcccgtgggcgacggggcatggaggcggctgcggtcgtcggcgatgtgcagggcgcgggggagcaggatcatcgtgacgagcaggtcgccggagacggtccgtggcatcccggcggcgcgcgccatcgagctcaagttcctccgcgacgacgtctactggtacttcttcaaggtgctcgcgttcggcagcgcgaacccggacgaccacccgaggctggcgtccatcgccatggacatctccgcggagcagaagggcggcttcataggcgccaccatcgccagcagcctgatgagggccaacccggacgcgcactactggaccctcatcctcaagaacatgagggagtacacgcggaagcaccgcgccatgttcggcaagcacccgcacgacctgctgcggaacaaccacccggtg

SEQ ID NO: 11811 - DNA, 25008 bp, Oryza sativa
caccgtgtccttgataggaagaagcgtcttaggcagctggttacatgaaatgaagctgatcatctcgtttcatcttgtcatggtgtatgtagatccgatcctctgcagcggctgtgcgcgaaattgtacattgcattaagttgtggtcccacgtaatgtgtagttgaatcaaactcctccgcctcccaatgcaacctgtggattgaaactgtggcgccaacaacgaagttgcgccaaatagcatcctgccatgcttatgaccgtatgaggagtttttttttttaatcgtaccgtgctctttattaacaagggactttacaaactccggaaggggatcagcccaatggacatctgacccgggtacacacatcgaccttgtcaaaatccacatagatcatcattttaatttgcctgaagatgacgcccgcaggagcatgatcatagtcagttgacttcaaagcacccaccaggatagaacaatctggcgttgaagaacaatctgacttcaaagcagccatcaggatagaacaatctggttgcttctgacctggcgaacaactcctggatctctgacatccgtgccctcactgtcctggtcatgtcccagtttcttcttatttgggatgcggtgcttcacgtacaactctcgccgggtgtcgaggatcgtctcgtttggcgttggacctctaaccagcgctactcagcgcgttcggtgtaccaagcattcttctatggccagcattcctttgcctatgccgatcttctctggcacgaaaaagggtattgctaaatgcaggttcttcctttggtttgcattccagcagcgctgctagacaactgatctcctccagaagcgtggcatcgataatcactcggtctgccccttttgcgctcaggatcttgagacggcgaaccacatgctcctcgactacgtgtttgcttggcaggtttggctctgtgttctgtcgcctcctggctaggctaccctctctcacccctgtggcaatcggttccaggattggtggctgccctccagggcctgcttacctaagcatctccgtgccggcttcaaccccttagtgctcctaatctcttggcaattgtggaaggaacgaaactctagggttttcgactctgcactctcttcaatctcagtggttctggagtctatccactcggaggaccatctgtagtctttaacaggcgttgccgtttttggggacttgtttggagtgtagcgtggctcggccccttcccgctgtttggagttttgttttagccgccgtagttttctaagcttcagccttttattttgctttttctcccttcccttggcataagctggtttggctaattgtgttgtgtaactataaatcttttaatatattgacgtacaattgttttgcgcgttttaaaaaaaagatagaacaatacgttcctatggcgaattggcgatgtgtgagattccatgacttgttgcagtaagcagagcatacaagcaagcttcagcttcgacactctgagcatcatgcacaaattcaattttccctgcacctgctggcacgccatttccgtcatgatcccgaatcacaaatccccagccaccagttttgctagcttcatagaaagcaccatcaatgttcagtctcacctcaccttgaggtggaggtcgccagttttcagtactcgaggatttggctgggttttatcatatctgaccgtatgagtagttggcattacatctcgcttgcccatccaattatgaacatgccctccgtcccatattataagggatttttggtggatatgatatctctatccaaattcatcgtattagaatatgtcacgtccacgaaaaatcccttataatatgggatggagggagtacttctcaaaaagcacgattttttcaggaatttgttcagttactaaaaaaacccttcaatccaaaaccccttcttggcgtggtattcagcccacgaaccattaaaaatccaagcccacaatttggtccacaagctgcatctattcccaagcccacccgtcactcaaaggcccggttggtctctctctccctcgccgcgtcctgctgggaaatccggcgatggctgcgggcgctatctccgccggcgggcgcgcggcgcgggcgtccgcggcggcgctgtggtcccggcgccggcagtggttgcttctgcgcgtggagtccctgccgcccatactctccgcccgcgcgatccccgccgcggacctgcatgccgagccggtttgcgccgccggccccgtcctcctccccgccgcctgacttccacgccgccgtgatgggtaaatagcatagctaggtaggtagccgttggttggtggatttgttgtgatttccatgttctcatcggataggttgattggatagattgattttgttgtcctaaatgtcgtgctctctaaacgcttagcatgtagggagatctcctgacgagttggctatcgatattggggatgaatggctgcttggggtactttcctcagtaaattacaatatgattcgatgtaactgttgagtagtccaggtctcagtgccgactgccgagtgtgggctgggtttgggggctgtaattagtaacattgttgctgactttgtacatgtttaccctctactcccccatcccaaaaaaaggcaacctagtgatttgttgtactaggaggtcgtctttttttttttaggacggagggagtatgacttaataaaaagttcgattggtgcactagtgtcggtccagtgagattaggccaccaagctctcttgcagtgctaagtggtaaactgctaatacacgttctgaaatccacaatcacttgccctcaatgccccggcctagcagtgcctttgtagaatcattgtatctagatagcagcctccaatgatttcaatgtgtccacatcacaattccttgtcgctaatctatttaagaaacatgcctgattgccgtaagtcttgctcctgcagtacggcctgaaacacctcttttccctctatgatttataacagttcaccatggagaccttcctttctgcagttcttggtgatcttatcagcagatccatatccttcctcattgatacttgatactactggaagcaacagggtgtggacgagaatctgcattggctgcagtgcgcgcgtctgttgatccaaaccgttgttgaggaggccgataggagacacatcacaagctaagcaatgatccttcaacttcaaatgatgagaaaagcgatgtacaaaggctactacatgtctgaatctttcagttaccaaatcatcacaggtaaatcccaaggtgagttggttgacctcttgatcgctttctcccatttagttcagcaaagtggttttatttatccactggaacaacggaaatactctgtaaggggaagagataaaagagatgcaaaagatggttggtatcttgaaaaaacatagaatagagcagtcttttctactacaaatgagcataggtagtatgaagtagaggattattgataacctatgttaattggttgagtctgaatcgagttgatgtttgctaattgtaaggtatgagtcgtgttctgaaaatcaccttctcagccttctgaatggcccactgtgtaaggaaaagaaaaaaaagaagccaaagcattgaaatgttttgaaggtgtgactcgttctctgaaccttctcagtcctcacgaaccttctgttggcgacgggccacctgtcgacatgactaattgtgcagtcaacagctgaatgtctgaaacggacaatcatatgtcaatgagtgatccactgtgtaaaacaagccaaagcattgctcctagcagcggtcttgcaatgcaattttgtttttgaagacacttgcaatgagttcaacagcaacaggacaacttgtttaaattgccagcctgattgctctccctcttcctatcacaaaaatctcaccatggacaccatcttttctgctgttcttggtgatctttttagcaggtccatatccttcgtgattgatatataccatcaccatcaccagggcggtgtggaggagaatctacagcagttacaccgcatgctgttgcgaatcaaagccgtcgttgaggaggcagacagtaggtgcatcacaaaccaagcgatgctgctgcaactcaggatgttgagagatgtcatgttcagaggctactatttcgttgataatttcaggtacagaatctttcaagctcaagctaaagacgaggtgggtgatcactctctcgacctgccccctttcaatccattagaacgattttttatcttcactagagcaagtaaaatcgcatctgaaatcttggagaaaaaagagctgcaaaaagatgcttggtcacctggaaaccattgtttcagacacgcaagagtttgttgtgcttgcgagcagctaccctcgtataactcgccaaccctattgcagctatgtgttgctggaaaactgcatgtttggtcgtcatgcagaactggaaagggtcatcaagttcttgctagaacaacatcctctttgtggtgcaaaaggtattgatgtgcttccgataattggaccaggcaaagttgggaagagcactcttgttgagcatgtctgccgtgatgaaagagtacgtaaatgcttctctacaattgttttctatggcccggatagcattgataatggagacatggtgcttcttccagacaccagggcaatcaaatatcgaaatcctgcctcaggcgaacagtcattagctatcattgaacttgtcgatgagatggatgatgaaacatggagaagaatattacacagcttgagaggagaccacataacatctgtgagtaagatcataataacgagtcgatcaagaaagatagcaacttttggaacaacaaaagcactccaattagattttctcccaaaagaagccttttggtatctgttcaagacggttgcatttgggagcacaaatcctgaggaggagccgaagctagcatccatttgtatggagatcgcagacttggtgaatggatcattcatggaatcaaatgttgttgggagcatactcagatctaatattactgctcaattctggtacaattttctcaaacgcttgaaatatttcactgacagacatttccgtctgctaggtgaacacccaagagactcatacaagtctaaccgtgggcgtacttacatatggatgcataaaaactactatggtgacggtgacgcagcgacatacaatctttaccatgcaaattctgcaggactaaataatctaccaatgatacgaatgagcgatatgcttatcggaaatgttaagcctcagaagaaatgtgaagccctggaatggcaatccagcatacctccatactatagctatatcgtgcaatacgggatacttgcacggcagccgcttatgctacctaaaaggaagcgatcccgggcgctcttagaggagttagtttgatccaaaataatgttggttgtcaaactagtttagctccatccatatggcacatcaaacaaatatggattctataacagcaacagtttataaaatatgtttgactccattcttatccagttattttgatgtaaacttactattacttgtgtacatctttatgcaggaatgtcgtgccatcttccgtcatataatcttttagtcatatggttttgttttttttttgtaaggttggacatatctttttatgtttatatatttataaaattttatgaaatttgaatctgtatctctatatcactccctttgttctcgaataacattgacatctgactcaccacaaattatatttgaacgattagattttgatgaatgaaacttgtatggttatatttgtgaagcatagcactttaataatgtaacattaactaacatatttaggtatttatatattttttaaaaaaagaagtggtctaagtttgaaattgaacagtacaaacatgactaaaaggagccatcatattcattctcaaggcttagaaattattatgttaaatgaaataaaaaagaaatatctatgctatccatcaaagtggaacattatatagtatagatcgatagccacagatgtataagaaacagttttattttaaaaaaggagaggaagagtggtgtagaacatgcaaatttacttcaaataacactgcccaactggttcgttttatgtttagcttagataattcttcattcaaccttttgtcaaaggagggattgttttataaagaaaaagtgtggagtgacagtgactgaaatgtagcaaattttcagttgcctcaggatgaacaagaaatccctctctttttcttttttttttttggctgcagtaaaatgtgggtctttgttcatttcttaaaacagagacaagttggcttttaaatttctccctcgtgcattttttttgtaagacccaatttgatttgtcatggtcttttatgttgaactttgacattaaatatatttgtaacaaaatgttacttcctccgtttcacaacgtaagtcattctagcattttccacattcatattgatgttaatgaatctaaatagaatgacttacattgtgaaacggagggagtactaagttagaagagcatgaccatatgaaagcgtgttgaaccataattccagtggcgactcaagtatcaagcaatacaatgcctttaccactcagaatctcacatcatctgtttgtacgtttttcgtcagacttccatgcttgttttctctcatgagttctgacactgagagaacacaagaaggttcctcatgcttctatggcttaatctgatgatcataccatttcttctgttttctccaaatataagtaagaaacatattgcatcacattctctcgtatgacacctgcatggattttttttctaaaataaacaaaaacacatattgctttctccagcattccaagagtcaaggaaacatggaacaggacagtcttttctacgaataaagcaaacaataatatgaagtggagggtaatttatcaaagagtaaaatgcatggaggatcacttaacttgtttagttgtgtcaagtaggtcactctacttttaaaatacacatctagatcactaatgagtcaagtgagtcacttgttcatctaactatccatatgagcataccttgtacgcatgacatgctacctatgattgaaaaaaatgctttgacatatgtagaaaatcacatatgtatttttttcccattctcacagcacgaccacttgaaaatatacgaaattaggagaaccaaatcattttcactttgcttttttatgagttattgtacaatcttaaacaacaacggaggcaaaatcctattaggcaatggcggcggatgctcaaacatttttttcaaccctaggtgacatgctatatgtatgaggtgtgctcatgtgaatagttaaatggctaaatgactcacttaacttacattaatgatccagatgtgcattttaaaagtagagtgacctatatgatacacctaagcaaattggatgaccctccatgtatattactccttatcaaacgcctggcttaattacctaattctgaaaacgtaagggagctgacgtttgctaattctaaggtctagcacgtgtactgaaaatcatcgcctcttatgagcccttcgttgtcactatcggcgactgaatgtgcagtcaacactcaacaactaaaacgtttgaaaccaacaactcagcaagaaatcgctgttaagggctgacctggagcaattcaacaacaacatgtacagctccctgtggctaggcttcagtataagttgcatgcctgccctgattatacccttgttccaatcataacaaaaatcttaaccatgatggacactttcttttctgctgttcttggtgatcttctcagcaggtccatatccttcatgattgacagatacaaacagcaacagcagagcgtggaggaggagagccgtctgcagcagttacaccgcgtgcttctacggatcgaagccatcgtcgaggaggccgacgggaggctcatcacaaaccgagcgatgctgcaacagcttggcatgttgagagagatgatgtacagaggctactacttcctcgatggtttcaggtatcgaatcgctcaaccacatgctcaagatgaggtgggtgatctgtcccctttcagtccattaaagcggttctgtatctccactagagataggaaaactacaatatccgaaattttggagaaaaaagagctgcaagagatgcttggtcgcctgaaaaccgtagtttcagacatgcaggagtttgttgtgctcgtcagcggctaccctcgtatgaaacgccaaccatattgcagctacttgttgctggagaactgcatgtttggccgccaaatagagaaggagaggatcatcaacttcttgctagcaccacatcctctcggtgatgaagaagatatcgatgtgcttccgataattggaccgggcagagttgggaagagcacactcgtcgagcacgtctgccgtgatgaaagggttcgtgaatacttttctacgactgttttctatggcccagatagcattggcgatggagacctggcgcctcttacagacaccggtgcaatcaaacatcgaaatcctgcctcaagcaagctgtcactagcgatcattgaacttgtggatgagatggatgatgaaacatggagaagaatattgcaaagcctaagatcaggagaccatgtagcacctgtgagcaagatcataataacaagtcgatcaaacaagatcgcaacttttggaacaacaaaagcactccatttaggttttttgccaaaagaagatttttggtatttcttcaagacggtcgcatttgggagcacaaatccagaagaggagccgaagctagcatctatatgtatggagattgcagctgttctgaatggatctttcatgggattaaacatcgttgcgagcatactcaattctaatctcagcgctcaattctggtacagtttgctcaaacgcctgaaatttttcacatacaggcatatacatctgctaggtgaacacccaagagacttgtataatgctaacagtggacgtacttacatttggatgcatgaaaactattgtggtgacagtgacttagtgacatacaattattaccaagtaaattctgcaaggttaaatggtctacaaacggtactaacaagcagagatattctaaccggaactgttaagcctcaggcagcaaaatatgaagtcttggaatggcaatccagcatacctccatacattagctacatcacgcaatacgagatacttgcacaacagaaacttatgctacctcctaaaaggaagcgatccggggcgctctcagaagagttagtttgatatggaattagtgttgtcaaactttagattaggtccatcaacggactgtttggtaaacatgttccatttcgttccaatccaattatttttcaaatggtgttactcatgtgtgcccccttctctttcccaccctctttgatgatgtaaactaactagtattaatcaattgtgtgcatcttcggtatcaaatcttttagtcatgttgggacaaaatccaacaagtatgcgtgtatttctctctgtattggatgcctcaaccgcgggcaacgtttacacatttatatggagtgtacaaagaggaaattacattgctacccacattgctggctaatctaagtggttggccggtgggccagcctgacggccatcgggtaaattccctggtgacaggagggctgcgcccattaaggaagcggcgcatgttcccgagggtgcccgctattacccggataaagccatgctccgggtaatagcgtgcgccatctcgccatcgtcagtggtgtcagaggtggttggcggcgtgtagtacgtatttatgccatcccactgagcgtccagtcctccatctcaagcctagggctcttgaagccctggtttcctccggggcagcagttagccctggaggccttgataggcctccgaagtccttatacggcttcggaggccacggagcgctccggaggccttggtcaattccggagcccctgggtagctccggaagcctcaaacagctccggagcctacgggaggctccggatgccttggctgcctccggagcctcaagcgggctccggaagccttggttggccccagagcctctaaattgctccggagcctagggtagtagccatctttagtcattttcctagggtggatggctccgttgaagctcggttcgtctttcggaggcttgctcctttacccggagccattcccccaacaagtcatatggtttttttttgttgcacatatcttttgtcttgatttattttctaaagagttcgtgaaactttgatctatatattttaactattagattttttatgaatgaaagttgcatatttatatttgtgaagctacatacttcaataatgtaacatatttttcaagtatttatttatttttgctaaaaagagttcaaaactaaattatttcaagaacagagatatctattaacttattaaagtaacagaaaaagggaaaactattctaatccctcgaggggatgttccctcgtttgcttaaaaaccatctaaacggttatgaaaaattctggaaaaatttgacaacattcatacaacacatatatacaactccacaaaatattaagtccaaacttaactcacaagtcaagatataaaaaaaggcaaatttagcgtatgaatagtatcgtactgtttatatctaaatttatcttttatgtttcttgatgtgtagatcgaatttgaacatgaattttggtggactagtaggtaccattatactctatattgtcaattgttttcagaatttttcacaactatttgcatcgaatttaaaagaaaaaggtatacgaggggatatcctctcgatggattagaatccactccctagaaaaaggagcctccacgttctctcacggcttagaaattctcatattaatcggagaaaaagaaaaacagtaaggaatattagaagaggagactagagtccatatagaaatacaatttagaaatagttaaaattcggaattaaaaaataagtaatattggaagaggagactagagtccatatagaaatccaatttataaataactgaaattcggaattaaaaaataaagaatattagaagaagagtatagagtccatatagaaatacaattaagatataatagaaatttggaattaaaaataaggaatattagaagtgagtattgagtccatatagaaatacaattaagaaataatagaaattcggaattaaaaataaggaatattagaattagagtatagagtccatataggaatttaaaactaactaaaatttagaataaataaaataaaattaaaaatttagtttagagttcgcataaaaatacaatttacaaataactaaaattcgaaattaaaaaaaacatggaaagaagagtctaaagtcattataggaatacaatttaaaagtaactgaaattcgaaattaaaaattaaagaatattgaaagatgactttagagtccacatagaaatacaattagaaataataaaaattcagaattaaaaataaataatattgggagaaaagcctagagtctatatagaaatacaatttacaggtaatgaaaatccagaatttaaaatatatatataaagacgagtctagtgtctatatgaatataatttacgaataactaaaatttgatattaaaaataattaataactagcacatatataaaatacaatatgaatattacacattagtagtttcgtaaagttagtataaaatttaaaattatgttgtcttcttaatatatttgaataatatattgagaaaacatatatgctattatatgagataaaatgtaatgatgctagccgcgcaatctgcgcgggccaccatgctagttataaatatggctaaaaggagccactatgttcattcttgaggcttaaaaaaattaccatgttaaataaattaaaaataaatatatgtgtaatctatgctgatgggactaaattatagtggattgattgatcgctacatatgtataagaaataattttaaataaagggataagtccgagttaccatctaatatatcatattttgccacttttgtcttgaaactatctagggcttgttcagattgtagacaaaataaatctatgccaaaatttagtaagttggcaatattaccaaaattttagcaagatttcttatgtatttaccaaatttggcaacaaactaaacgcatacattttttttacaactttaaaataaaataatatagttgaaaatagcatcaatctgaacagccccttactttacccatccccttggttcaaaccaaccctataatttttcgtctatgtgatgcttacatgatgatccagtcagccaataatattttaaagaaatggtcggttttcatctacgtggtgcttatatggtggtccaatcaggcaacaaaattttaaataaatgataggacccatgcatcaatctttcttctccttctagcagtctagatcctggggcatttgactatttaccacccacaatctatgacatgtggattcagtagtaaattcttaattgccacttgtaaaaatggtaaatagttaaatatctctattgcagttgcaacctcaagcgtgcttgccgccctccaagatctccacaaactaactgcctcgggtgtctcctccttgatcttcggagttcagtggcttgttagctcaggttgagtttagctccaaactttttttttcaaactttcaacttttccatcatatcaaaactttcctacacacataaacttccaacttttccgttacatcgttccaatttcaaccaaacttttaattttggtgtgaactaaacacacccttcaatagttttgaacggtaactgccatagagggttagttttatctgcaatatctattgatattgtaaaactcttgcctaaaaaaaatatcgtcaacctccggcaagttccaccttccatttccgcacatccatgtggttgtactactgctgttttggtccagatttttgttttaaatctttgtagtcctcaggacctctgccactggacatgcatctcttctacaaatacttcccctttccacagccttctcgacatgtgatgatttctatatgtcagtggcatctatactccaaatttaaaaataaccgatgtaaaatagaccacgaatttattatcttgataaagtaatagaaaataaagtcaccaatgtttgctcttatagcttagaaatttatgcattaatcagatctaagtcattgattaaagtgtgtgtcaagagtatgacggactagattaaaactgagttcaagtaggaatataatttaaaataagattaaaaagaatccatattgatcacaatgtataatccaagttgacatacaatttaaaatatagaatgcatgaaaaatagtgtatcagaaaaggagtgttaagtatatgagaagaggacacaaaattcttatatataatatcattcaagtttttatgtgtatattatatattattctcaagaatgaatttattaatcatgtattatcgtcaagttacatctaaatataaactttagctttcaaatcatctattaaaatatgtttatttgtaaaatcatggtgattaagttacgattaacaattggtcgagatgttgataaaatgctattttttaatgtttgtgattttataatggtttacgtatgtaacatgtgctcgaaaatatggtttcttagttgttaatgggcaaccgttgcttgtggttggaggggcgtacgttgttgccttgttggtgatcactctcttggcctgtcccatttctgcccattgaagcgtctctgcatctccactagaacatggaaaattctgtcacaagtcctggagaagaaagagctgcaaaagatgcttgatcacctgcaaagcatagtttcagacatgcaggagtttgctgtgcttatgagcagctaccctcgtatgagtcgccagccttatggcagctacttgttgctggaaaactgcatgtctctcggcctttgtacatttactactcccttcgattctataataattatgttttaaacaaagttaagatcaaacttttataactttgaccattaataattttaaaaatatttagtttaaaaaaactagaacaacatatatagatttgtctttcaaaacactacaataaaagtaaacatacatttatttaatatatgtattataatagaaaaataaggtagaccgtattaattgtttaaaacgttaattaaattgaaagtagtaattctaaggtctagcacatgcactgaaaatcacctacccataacgagcctttcgttgaccacctaccgatgactaatactccatccgtccctaaatatttgttaccgttgactttttaaaatatatttaaccattcatcttattttaaaaaataagtaattattaattattttcctatcatttgattcattgttaaatatactactactactactcaagtttttcaataatattcataaaagtttttgaataatatgaacacttaaatatgtttaaaaaaatcaacgacgtcaagtatttaggaacaaagggagtactaattgtgcagtcaatgaacgacctagacagcggccttgcaatactatgcaattcaacagcaacacggcaagtggcaactccttgtggctagccttttgtataagacaacaggtgcacctaattggtttcttctaatcacaaaatctcaccatggacgccttcttctctgctgttcttggtgatcttctcagcaggtccatatccttcacgattgacagatactaccggcagcatcagggtgtggaggagaatctacggaagttacaccgcatgttgctgcggatccaagccatcgttgaggaggcacatgggaggcagatcacgaaccaagctatgctgcttcagcttaggatggtgagagccgtgatgtacagaggctactacttccttgataatttcaggtaccgaactgttcaagcgcatgctcaagatgaggtgggtgatcgctctcttggcctgtcccctttcagccaatttaagcggttttgtttctccactagaacaaggaaaattgcatccgaagttttggaccagaaggagttgcagaagatgcttggtcacctagaaaacattgtttcagacatgcaggagtttgttgcgtttgtgagttgctaccctcatatgagtcgtcaaccttattgcagctacttgttgctagaaaactgcatgtttggtcgccagatagaacaggagaggatcatcaacttcttgctagaaccaaatcatcctagtgcaaaaggcattaatgtgcttccgataattggaccgggcagggtaggaaagagcactcttgttgagcatgtctgtcatgatgaacgggtgcgtaaatacttctccatgattgttttatgtagcgcagatagtattgggggtggttttcttacagacaccggtctaatcaaacatcgaaatcctacctcaactggacaatcattggttatcattgaacttgctgatgatgatatggacgacagaacatgggcaagaatattgcacaacctaagaggagagcacataacacctgtgagtaagatcatattaacgagccgatcagacaagataagggcttttggaacaacagaagcacttcatttagattttcttccaaaagaagcattttggtatttcttcaagacgattgcttttgggagcaggaatcccgaagaagagccaaagctagcatccatttgtatggagatcgcgaccttggtgaagggatctttcatggcaacacacgtcattggtggcatactcaggtctaatcttagtgctcaattctggtgcaggtttctcaaatgcttcaggcattacacagacatgcatatctccgtgctaggagaacacccaagcgacgcgtatacaaaaacaagtggacttacttacatttggacatctagaaatatgagtgttgtcgcagcgacatatagcctccatcaagcaagttctgctcagctggctgatctatccccaattctatcaaatgatgttcttaccggagacgttgagcctccggagaaatttgatgccctggagtggcgatctagcatacctccttactacaactatatttcgcattacgagatacttgcacaaccaccggatatgctgcctaaaaggaagcggtcccggtcgctctcagaaggtttggtttaatctagaatcatatgaggtttaagcaacagacggagttggcaactttgttgattcacttagccagttgttttagcaattagcatggagtttgtccaatgtaatttccctttctgacaatgtaaactaaactaaacttctatgacttttgaagttgatgtgtagtactccctccatctcaccatctcaaaatacaggactgaagcacaaccccttttttttcatgtcttatattggccactactaaaatggtatttttgcatgcatccaaaagctatttttgcatgcggttgaaccgtccgtctgccaggagatgattgcaatcgctattttttcatgcgaatggcgcacccacatggaaaaattgttttttggcaagcgggtgcttgtcgtcgtcgtagtctgccactgctcgtcgtctccgtcgtcgagtcccgccagctcatcgttgttgtcgtcgtcactcctccttgcgcctctaccactatccctccgcaccccgatggattcactggatctgcccatcatggcgccacattcaccactgatcccttgctgcccggtcccactcgagcccgccgtcggtcgctcctactcaaggtccccgttgccgctcgctccgcacgaggatgccaccagatatactcatcaattattttaagtagaaatacaacttaaaataactgaaatttggattaaaataaagaaaataaaaagaaccatattgaacccaacatataatacaagtagaaatacgatttaaagtatctgaaatttgaataacaaataaaaataagaagagtccatgtagaacataatatgaaattaattgaaattcggaataaaaatataataaaatcatcaattggattacagcaccaattccaagttaaaaattattaaaactcaaaatgaataaaataatatgtaacaagtgtccttgccaaatgtggagtatataattggaagaactatagtataactatttttttgtcggcaattttttttgggaatcaacacctaaaccctaactctaaacctttcgaattatgggccattgaatttgctccaagattcatgcaaatgggggcgtcggaaaaaatgcaatggggcagccaggaagaatagaacacgcaacctaagatttgcgtgcgtgcgccttcacaagtgaaccagcacctcgttttgatttcttctgtacaagttatataccggttacaatataactacgtacaagttatatatcggttacaatataactataatcaagttataatgtaattatactagtttataattatagttacatttgaaagtttttctattgaaagttatattggtacttcaatttatataagaaactaggactaaatataaagattttgtcaaatgctcaacaagttagcggcgcataaatcatgttagtcaaccaagtttgttcagtggtcgttggtggtgaaaaagaaatttagtgtttttttgcctttggttatatattgagccttgctggcatttgtatgtgtaatgaaatgtggtcaagaaaaacatgaaacgcaagtggcttttctggcagtcaaggaaacatggagggactggtcaaattgtagctaaaataaatcttacctggtaagatggtaatattatcaaaattttggcacgatttcttatatatttaccaaatttggcaacaaactaaacatagatatttttttggcaactttactaaaaaatagcatggttgaaaatggcatcaaagtgaacaggcccgaaacatactcctccctctcatttcaagtgtaattgtaggtttccgtatctaaggtttgaccatccgtcttatttaaaaaatttatgagaaaataaaaaaagtcacgtataaagtactatttatattttatcatctaataacaataaaaatactaatcataaaaaaattcagataagacagacggtcaaatatagtacacggaaacacacacctgcacttaaaaagggatagaagtaaatggtaggaagtagatgattatttatcacctaaactagataactgcttacttccgaagtgagctggtatttgctactccctccgtttcatattatatatcatttaatttttttattagtcaaacttattaaagtttaattaagtttgtaacaaaatataataatatttttaatacaaagtaaatattatattaagttatattcaatatcaaatttaatgggactaatttgttgtcgtagatcttcatgttttttctataagtttgatcaaagttaaagttaaagaaatttaacttaaaaaaaagtcaaacgaacggagggggcagtaattctaaggtctgacacatgctatgaaaatcagtggccagtctaacaggacaaattgtgcagtcacaatggaaagtctgaaaccgacattgcaggcgccgtcaatgatgaatgaacaactgtattgcatatactccagagttctagaccgcgggtcttgcaatccacttcttcttcttttttttctttttcttctttccgactcttccatcaaagactcttgcaaatgcagttcaacatcgacaagatagcatgtggctagcttccctgcctcactgcacaccttcttccaatcacaacaccccaccatggacaccttcttttctgctgttcttggtgatcttctcagcaggtctgtatccttcctgatcaacagataccaccagcaacagaaggatgccgaggagaatcaacagcggttacaccgtgtgcttctgcggatcgaagccacagtcgaggaggccgaccggaggtgcatcacaaaccaggcgatgctgctgcagctcaggatgctgagagacgtgatgtacagaggctattacttcctcgatagcttcaggtaccgaaacatccaagcacatgctcaagatgaggttggtgatcactctcttggcctgtcccatttctgtccattaaagcgtttctgcatctccactagaacatggaaaattctgtcacaagttctggagaagaaagagctgcaagagatgcttgatcacctgcaaggcatagtttcagacatgcaggagtttgttgtgcttatgagcagctaccctcgtatgagtcgccagccttatggcagctacttgttgctggaaaactgcatgtttggccgccaaatagagaaggagaggatcatcaacttcttgctagaaccacatcgtcctgccggttcaaaaggcattgatgtgctcccaataattgggccttgcagagttgggaagaccactcttgttgagcatgtctgccatgatgaaatggttcgtaaatgcttctctaaaatacttatgtatggcgcagatagtattgagtgtggagaattggtgcctcttactgaaatcggtgtaatcaaacatcgaaatcctgcatcaactggacaatcacttcttatcattgaacttgtcaatgatatggataatgaaacatggacaagaatattgcacagactgagaggagaccactcaacacctgtgggtaagatcatcataacaagtcgatcaaacaaggtagcaacctttggaacaacggaagcacttcaactagattttctcccagaagaagagttttggtatttcttcaagacgatggtatttgggagcgcaaatcctgaagaagagccggagctagcagccatatgtatggagatcgctgccttgatgaatagatcattcatgggaacatacatcattggtgacatactcaggtctaatctcaatcctcaattttggtacaagtttctcgaatgctttaaatattatacagacattcatatccgtgagctaggcgaacatccaactgaaacatataaaaggataagtggacacacttgcgtttggacgcctgaaaatcggtgtgttactgaagcgacatatgcattgacatacactctttatcaagcaagttctgaagatctgaatgatcagcccatggtgctagcaagcgatgttcttgttggaaatgttcagcttcaagggaaagttgatgtcctgcaatggcgatcgaagataccaccttactactgctacatggcacatttcgaggtacttgcacggccgctgcatatgccgcctaaaaggaagcgatcccggtcactgtctggacagttagtttgatctgaaatcgttggggtcactagagtctagagttggttgatccatatggcacaggaaacagtatggatgccgtaacaacaactgatagtttagttcaacagagagtttgctcacatgtttcccccgttttgacattgtaaactaaactattagctatgtacatctctttgcatggatgtaatgccatcttcccttatctaatcttcgttccagatggttttttcagtcgcattcaagtaatgaaccttaatttaaccggtttcggcctgtgctttataaatagctttggcagaaaagacaaaacagtccctccaacgtataaatagttgtgacttcacgttttcatcgtctttagtaaaatcaagtccaccacatagaaactcatatcatgctctaccatattttttttgcagataatctcaattttagtttactaatacattctaataaaggacaatcgtacttgttgaacttatcccttgcaacttagataccatgaggtggtccttgaaaagtttttgaataagtagagggaattcgtaatcctctggacgtagagcactagagcgcgtggggctttgaaaccaaatacaatctccgttttttaatagatgacgccgttgacttcctgtcacacgtttgaccattcatcttattcaaaaaatttacgtaattataatttatttcgttgtgagttgttttatcactcaaagtattttaagcgtgatttatatcttatacatttgcataagtttttttaataagacgaatgatcaaacatatatttaaaagtcagcggcgtcatctattaaaaaatgaagggagtatattacccaaatggaagagtccctcttcaaaataggtctaatagataagctatataagcgatatattgattttcctttccaacaatgggcttgatgtgatagcataagcctttgtagcaatcaagactagtaagtccattaatccaaacaattgtccatgtaccagtagaagatttggtagctattgtagcctctcctttgggcggaaccccccgtctgaggagttactcggaatgctgtcgatcggtgtcattggtttcgtactctcgtctcgggtgtagtaagtcaatttataattcttgacaccagcttgaaatttaacattttctttagtttctgtttccggtgacatacatccatcccacagttcatgaatttatgctatagttacatttgaaagtttttctaaaaaaaaatattgaaagttgtgtatagcccggttccccaccttttggaactatcttgatacttgcatgggtttgttttgaagtgttttcagaacatgtgcagcttctttatcttattttgagaaaaaaaaaaggaaatttgaggccttgagggggaagcactagcagaaggacggtatgactattcagcccgcttaagattaaaagcccaaccttaaaactggcccatatatcttgggctcttcccttcctgcctcccgttgcaaggctcggttgggttctctggccgcgtcacaggctcatggtgacggcgtcaggtccggcgatggccgccggggagatcttccgccggcgcgcctccaccatcctctggcaggtagagtttcctgccgcacaaactcgccggccgcgccgctcgagctcgtccgcgtatccacgccaccgccgcccgtgctgcccctggtttgctgcgccggattaatcctcgctgcctgacttccacgacggcgcgattggtagggtaaatatcttgggtagatagatgcatattgggtgctggatttcttgtgatttcaatgctttcatcgactaggccgatacaatagctagggttggctttgggctttggcgcggccctaaatgcgttgctctctaactgtactgagtgctatagcacgcatctatgaacctttcccattcttgatgccatgaattgttctcttcgacaaagcctcattaaaattatgtatgatcatggcaaatccgccttgtgctcttccaaatgttcctattcaacagctgaaatcaacaagcactcagttagtcctcagtgacccacgtgcctttgaagaattgttgcatttagatagcagcctgccatccaactatttccatggatcaacatcatagcatttgactaacctgcctaattgtcacaggtcccactagttcttgcaatagggcctgaaataccacttttacaattcccttcacaacagttaaccatagtgacattttttttgcctgcacttcttggtgatcttataagcagatccatatcctacatattcctcattgatatatactactggaatcaagcagcggtgtggagggagaatctgacatggttacattgcggcactgctgtcaatggaagctttcaagctgtgctggttccagatgttggctaattctaaggtttgacacgtcctctgcaaatcgtggcctcttacaagccttttcattggccacctatggctaattgtgcagaaatcaactgagccatcaataaatgacccactgtgcaaagcgttctgtgcattgcaccttgacagcggccttcccatgcaattcagcagcaacatgacaactctttactccttctcgctagctttgtgtttatagagttgcattttactgttgagttgccttcctgattgatttaccttttctaagcacaagatatatcactatggataccttcttttctgcagttcttggtgatcttctcggcaggtccatatccttcatagttgacagttactaccagcagcatcagggtgtggaggagaatctacagaagttacaccatgtgctgctgcggatccaagccatcgttgaggaggcgtcaagtaggcacatcacaaatcaagctatgctgctgcaacttacgatgctgagcaatatgatgtacagaggctactacttccttgataatttcaggtaccgaatcgttcgaccgcatgctcaagatgagctgggtgatcgctctcttggcatgtcccctttcagtccatttaagcggttgtgcttctccactagaacacggaaaattgtatctgaagttttggagagaaaagagctgcagaagatgcttggtcacctggaaaccattgtttctgacatgcaggagtttgttgtgtttctaagcagctaccctcgtatgggtcgccagccttactgcagctacttgttgctagaaaattgcatgtttggccgccaagcagaacaagagagggtaatcaacttcttgctaaaaccatgccgccctggtgcagaaggctgtgatgtgcttccgataattggcccaggcagggttgggaagagcactcttgtagagcatgtctgtcgcgatgaaagggtacgtaaatacttctctacaattgttttctacagcccagatggtattgggggtgaataccatgcgcttcttacagacaccgttgtaatcaaacatcaaaatccttcatcgactgaacaatcattgcttgtcattgaactttccaatgatatggatgatgaaacatggagaaggatactgcacagattgagaaaccacataacacctgtgagtaagatcataataacaagtcgatcaaagaacatagcaacttttggaacaacaggagcacttcaactagattttctcccaaaagaagcattttggtacttcttcaagacaattgcattcgggagctcaaatcctgaagaggagccgaaactagcagccgtatgtatggagatcgccgtcctgatgaatggatcgttcattggagcacacgtcattggtggaatactcaggtcaaatcttagtgctcaattctggtacacctttcttgaatactatagatatttcacaggctggtatatccacctccaaggtgaacatcagagcgacatgtttaagaaaagaagtggacttacttacatttggtcgtataaaaattggtctgctgtgacggcgacattccatctttatcaaataagttctgcgaatctgaatgatctgcccgtgatacgaacaagcgaacttcttactagagatattaagcttgaagggaaatttgatgccctagaatggcgatctagtgtacctccttactacagctacatggtgcatcacgaggtacttgcacgaccgccaattatttttcctaagaggaagcgatcccggccgatctaacaagggttagtttgatctagaactagttttgagacatactccggagtatctccatcagtatggcacaggaaacaaccatgatgttataacagcaatagagtaatagactgagtttagcaattttgttaattcacttcttagcaagttattctagcaattagcatggagtttcaactatgtattttccctttttgactgatattattagctgtgtccatctatggt

SEQ ID NO: 11812 - DNA, 12180 bp, Oryza sativa
ttttttcgtcaataagttattggtttttgttcacactggagcctcactaagtaaatcaattactcgtgaacatattgttagattaattcgttattgttgagtaataattttactatctagttaaatatagttaaatagactcaagtatttttcacggacacttattagcacatggtaaatgttttacaataagcctacacgatatgaatacaatgagaaatatgagaatagtaacttttttacaataagcctacacggcatgaaacaatcatacggtgtgagtaaacattttactctatgacaatataacatagatctagagaccggccggtggttggtggcggagatgactggcgctggctggacattgacggcgtcgcggcatggaggtggtcgttgctgctcctccatggcactggctagcaaccggatctgaaaatgtacttggttgtattcacatgagcataatgtactctgctatacctgaaaatgagaaagcaaaaattaaatccggactatagtgttcttgggctcgccttactcccagcctacaattaaacattgtgctactcagcggaatgagaaaacaaataccaaatccagaaataaatctatttggtcaagatgatcggaataaatcattcagctgcaaggttcattttctagattttctagttcaactgagccgaatgaatcattccgctgcactatattacagatgggcaaatggcacagttctagaagggttaaaactagagggtgagcatttaagtaaaaccaaatagatccgtctaaaacaatgataaattctcagatcatgaatcatgacacatcagtaaataacatttgaaaaatagatttttttcctccgtgatgcaaaactgggataaaaaatggctcattttttccttcgcataaataaatgggaatcaaggagttttaatccttcactgataaaaaacgttaccatcatcacgttaataggttgtagattattttattcaaacacctatgctctgttgaaccacaaaatttcagagagcagttcagagaaaatcaattgatatgctctgttgaaccacaaaacttcatagaactgctaccgaattgagcttctagagttttcatttatcaaacatatcagagaacctgatgatgatgctattggcagttttccaaatattgcacgcacaaatatatcactaaacaaatgaaattcacatgggaacacttttctgaatatattgcacaaacaactcatgactgaacaaatgaaaattaagatgagagcatggttcttcatgcgttgcaaaaaaaacctctggtatcagggctattcactcatgatgcttgatccagcaaaagcagcaatcatcacaacaatacatagaaccaaattcactaagaatacatgatcatttatgaaaatatgtccaattacagctatttctgaaaatgcaagctctaacagatagcaccggtggtttatacaagttttgagttgtataaatttgagattactgtcgaaattcaaacatacacagatcatatcagccatgacatcttaatttatgaataacgctagcacaagtggcttggataatttctgaatcatataaattttgaacagaacacatgaacattgagaatttagcaggcttattacaaactacaaagatataaaggggcaaatttttcatttaatacctttatcgctattgatttgtaatacttggttactgctaagcaagggaataatattaagatgctcttagaacagctctgttcaactagatcgagaccacaaaaagccaaaagcacaatagtaacaagctcagctcagaacttccatcgatccaataaaaaaaaggaactaaccagcgccgctgagggtgcagcagcaccaaatcccaccgttctccagtcaggcctggcaggactagtcgctggcgcctacagcaatgcgatcgacgagcactgtctgtccacgggcagtggcggacctgcaagcagcaacctacacctctgcctgggtctctgctatgcttcgacagcccaatggtcgtcgatccaccccagatcaggcgagtcccgagcctacattgactgcatccagcgggggacgccggcggcggctagagagggaggtcggagtcatgggagaaggcagcaccagtgagcacgaagccttccccggatcagccgttgcccagtcgtagccgccggatctggcaccactcaactcgcatgccacgggagttgggagcaggtcccggtcgggtccggcacgagcagtttgcgcgccccgcccatcacctccaagacgctcgcgccctacccagcggcgccgatggcctcggcgagcgcgggcggaatggcggcgaatgcgcccgactggaggagcacgaagcctcttccccctcgcctcccccatcctccaccgccgcaagccgtcgccgtcgccggccacaccattgccgactcctccgctgggctctcctcccgccgccaccgggccgccgccgccggatccgggaggaggacggccgcccgccgctgtagccgtcgccgtcgcaggccgtcgtcgtcgccggccgcgcccgccgctgccgcaaggcgtcgccatcgctggctaccggaggaagcccgagccaatagccgcacgccgcccacgcgcctcgtcatcaccggattcaccgcccgaacctcctcgtctccgagccgtggctgggggggggggggggggtgctggtctggggtaaggggtagaatgtgaaggggagcattttagttctactttcaatattccttattcttttaatccgaaattttaattatgtctaaattacattctatatagactcttatacttttattttaatattccttattttttaaaatttttaattttagatatttataaattatatttctatatggactctaacctctacttttgttcttttttttaatttcgaatttcaattatttataattgtatacgtatatgggctctagccttctatttcaatattcaattttttttaaaaaaattcgaatttcagttatttttaaattatattcctatttaaactctatttttcctttttcttcgattaatatgagaatttttaagccgtgagagcgaacatagaggctcctttttctatcactttaataatatcatcgaatagtccgatacaatagctggattttttgtgatttcagtgctatcatcgaatgccttgttctctaactgtacctgagtgctagcacgcatatatgaaactgtcccattcttgatgctatgaattgttctcttcgacaaagcctcattaaaattatgtatgatcatggcaaatcgaccttgtgttctttttttttttttgaattttcaacgccggggggggggagcttccccgcctgaatttacagggatgaaagggcagaagcgaagcaacgcttccactgcgaaactatgggacgtacattacatttcaatcgttctgaccaaagggatgcatcttcaacacatcggcgaaggatccgctggagggagggggattcttttctgaagaccacattgtgtcggtgattccaaagacaccaaaagcaaaggaggtagaagcacttgaattctaccgtcgagattatcggaggcggcttgagctgaaataggagttgtgctaaggggatattcgggtgaactcggatcacagaccagaaagctaaagaaagggacagtgtaaaaggaggtgatcttcgtcttcatcttggcagaggcacagctcgcatgcagcagttgacaatattgttttcttgtagaggtttgcgcaagtgggcagcctgttttttttcatgagctaggcgaagaattgcactcttggcagagctgcattgttccagacgaaatcccagttggcacaattaggtagattggaagaggaaaggaattgatatagggagctggaggagaaggtctctgagtggccatttggggagtagatccgctgatccataccacttgagagctccagttgttggatgatatcctgcacttctgctaagtcttctcgggcggctgaagagagacgaggggtgagtcccagagggagccccgcttgcttcacttggcggactgagcagtgttgtctagttgagtgcgacaacagagccggaaaggattgggaaagaggggcgttgccatgccagacatcgagccagaaggatgatcttctcccgtttctaattattactctggtgattcgcctgtactcggggagcttgtctgcgatagatttccaatgagtgccgaggagtctgctgggttggagggcttcgtctcggaattgttcccaaatccaattaatccatgcagagttttccgtgtggagggtgtggattttttcgtgtgttcttcaaaatgttcctagtcaacagctgaaatcaacaagcacttagttagtcctaagtgacccacgtgcctttgaagaatcgttgcatttagatagcagcctgccatccaactattttcatggatcaacatcatagtagtatttgacgagtgatggtcctctgcagtactgcacatatagtgctgcccactgatatgtgagtcccacagaccctcgggtccacatgtcagtctgcagtacttgcatgtgcatgtgcacacgcagaggatctgaattgatatttgactaacctgcctgattgtcacaggtcccactagctcttgcaatacggcctgaaataccacttttacaactcccttcacaacagttcaccatagtgactttgtttttttccccctgcacttcttggtgatcttatcagcagatccatatcctacatattcctcattgatatgtactactggaatcaagcagcgttgtggaaggagaatttgacatggttacattgcggcactgctgtcaatggaagctttcaagctgtgctggttccagatgttggctaattctaaggtttgacgcatgctcttaaaatcgttgcctcttacaagccttttcactggccacctatggctaattgtgcagaaatcaactgagccatcaataaatgacccactgtgcaaagcgttccgtgcattgcacctagacagcggccttacgatgcaattcagctacatgacaactctttactcctcgctagctttgtgttttcagagttggcattttgctgttgagttgcattcctgattgctttgccttttctaagcacaagatatatcactatggataccttcttttctgcagttcttggtgatcttctcagcaggtccatatccttcatggttgacagttactaccagaagcatcagggtgttgaggagaatctacaatgcttacatcgcttgctgctccggatccaagccatcgttgaggaggctgacagtaggcacatcacaaatcaagctatgctgctgcaacttagaatgctgagcaatatgatgtacaggggctactacttccttgataatttcaggtgccgaatcgttcaagcgcatgctcaagatgaggtgcgtgatcactctcttgccctgtcctctttcaatccattaaagcagttttgcttctccactacaacaaggaaaatggtatctgaagtttcggagagaaaagagctgcataagatgcttggtcacctggaaagcattgtttcagacatgcaggagtttgttgtgtttgtgagcagctaccctcgtatgagtcgacaaccttattgcagctacttgttgctagagaactgcatgtttggtcgccaagaagaacaggaaagggtcatcaacttcctgctagcacgacatcctcccggcggtgaagaagttattgatgtgcttccgataattggcccaggcagggttgggaagagcactcttgttgagcatgtctgccatgatgaaagggtgcgtaaatacttctctacaattgttttctatggccttggtagcattgagaataatggagacatggcgtttcttccagataccggcgcagtcaaatatcgaaatcctgtctcaggcaaacagtcattagctatcattgaacttgttgatgagatggatgatgaaacatggaagaagatattgcacagccttagaggagaccacatagcacctgtgagtaagatcataataatgagccgatcaaacaagatagaattgtttggaacaacaaaggcactccaattagattttctcccaaaagaagttttttggtatttcttcaagacgattgcatttgggagcacaagtcctgtagaggagcctaagctagcatccatatgtatggacatcgcggctttggtgaatagatcattcattggattaaacgtccatgggagcatactaagatctaatatatgtgctcaattctggtacagttatctcaaacgtctgaaatattacacagacaagcatgtccgtctgtttggtgaacacccaagagacacaaataaaaataacggtggacttacttacgtttggatgcataaaaacaaacatggctgcagtggcctagcgacatacaaactttatcaagcaagttctataagtcaaaataatctaccaacgatacgatcaattgatatggtttctcgaaatgttaagcctcgagcgaaatatgaagtcttggaatggcaatccagcatacctccatactatagctacatcgcgcaatacgagatacttgcacaaccgaaactcatgctacctcctaaaaggaagcgatccggggcgctctcagaagagttagtttgatctggaatggaattggtgttgtcaaactgtattgtaggtccatccatatggcaaagcaaacaatttggatgctataacatcaacagtttagcaaatatgttagtccattcttatccagttattttaacttgttgtttgccccatgttttccccccttttgatgatgtaaacttacaacagttatgtacatccctctgcaggaatgctgtgtcatcttccgttatccgatcttttaatcatatggttttgttttcttttctgaaggttggatgtacctttttcgctttatacatttctaaaaatttataaaagttgaatctgcatatctctatattaccccctctgtctgaataacattgtcaactattgacatctcactcactgcaaattatatttgaacaattagattttgatgaatggaacttgcatggttatatttgaacaggagcaacaagaatgcctcctgtttggtgagcatttgagctcaggggagggcctcaggctgagcccacagcactgggctcctggagcgcaccatggttgtgcctgagcttagccgtctcacatgcatctcgaacaaacacaaagcagtgataacaaacagttaaacatgcagggaatagcaatcttcaacaaaatggtaaaagctagcctacaaatttagaggctaattctgagtacaagcaacttcggtatacaaagtagagaaacaggatgaaagaaaaccacatgcaacacaccgttacttgctctgattaactatgacatgattcaaatccgggcaaaatttaaaggtgacgccagtaaaaacaatgcttataatgctcttataccgttcacatccttgacttttcttttctttttttttttgtgaaagaaaacatccttgacttcccaccaaggattatattgcctttgtccttcagtaggcttcaagagctaattgatgctcacatgttagaacaaagttcaccagactgaacacatttttttcaaaaagagagagagagagagagagagagagttagagagagagttagaatcattcacaaaatctatagttcaccaacaaaacaattatacccaggcgctctcagaagggttagtttgatttgaaatcagggggtgtttagatccaggagtgtaaagttttggcgtgtcacatcggatattatatagggtgtcgcatagggtgtttggacactaataaaaaaataattacagaattcgtcagtaaactgtgagacgaatttattaagcctaattaatccattattagcaaatgtttattgtagcaccatgttgtcaaatcatggagcaattaggcttaaaagattcgtttcgcaaatttattatttaatacttcatgcaagtgttaaaacgttcgatgtgacagggtgtaaaattttggggtggaatgtgaacagggtctcagtgttggtattgtcaagatccagagtaggtccatcatatggcacaacaaaacaatacgataccgtaatggcaacagacaagggtcaagtaatttgattgattcacttcttacttcttatagctaatgttttagctattagcatggagtctcccacttttcgaatttgcgctactattgtacattgcggccgtgtttagatctaaagtttttcttcaaacttccaacttttccatcacatcaaaactttcctacacacaaacttttaacttttccgtcacatcgttccaattttaatcaaacttctaattttggcgggaactaaacacagcctgcatctaggacggagtacaagttggccgtgtttagttccaaagttttttttcaaacttccaacttttccatcacatccaaacttttctagatacataaacttccaacttttccatcacatcgttccaatttcaaccaaattttctgtcacatcgttccaatttctaccgaattttcaattttgtgttaactaaacacgaccgtaggtgtgatctaaaaatatatagcaagctagaaggtctctgttacggaccatgtttttatgttggcttttgtaacttgagcagagcatgcttcttcctgtttagttcaagatttcctgtttgggtcataaaccagcagttcgtacggctgtgtttagttcacaccaaaattgaaaatttagttgaaattaaaacgatgtgataaaaaagttgaaagtttgtgtaagaacattttgatttgatgaaaaggttataagtttgaagaattattttgaaactaaacacgccgtaccaccagacaccccagacacccaattctgactagctcgtgcaattgcggaagagaacggaccattctgcagtttgtccttgagctcaggctgtgtccatagctctgggctcctggagcgcaccatggttgtacgctgaggtctcacacagcgtaggacatcatcacacgcaaacacaagccagcggcaacagcagctaataaacatgcaaggaatgcagatttttaacaaaatggtaaaagctagcctacaaaattagaggctaattctgacaagcaactccggtatacaaagtagaccaacacacgatggaaaaaaggcacaggcaacaccattatttgttccgattaaccgtgacaatatgattcaactgcgggcaaaatttaaaggtgacaccagtaaaaacaatgctgcgatgctcttagaccgttcacgcacgcggcttcccaccaagggttgggaactgagcctgatcttcaatggatggtgcagatgtagaatatgggccacgttggtaaccaccaccatatccacgaccgccacgatctccacgcccccttccacgaccacggccgccatagtacctttctccttccgcaggcttcaggaactcattgatgctcacagactggaacaaaatttaacagattagaaacctgagtttttttttccaagataaattgagttgctatcaatcgcaaaatctaggaatatccaataattacaccataggcttgtttgaaaatttattagtagtcattttaccaaggcatccccatgttcttccaaacagatgtcttattatcatatccatctacccaacactcacaaccaaaacgaatgtgtacaagaacctcaaatttacaagattttggcatccagactgacctacgaagaatgtgtaaaggtctgccaattactacgtatgtaagttaaaataccttcttggcacgctcatcgcgctcagcattttccttcttcttatccttgtcagaaccctaagaaaatggtacatttaatcaaaaaaaaattctagaatcagacaactgtagggattgaaatagagcacactgagaaatataccagcttaatgaaaatttcatcatttcctttcttggtagaaagtggctgcatagactgcaggtccttatcgacctcaaccttcctctcttcagccttgaaagcaagaagagctttccgcttttcctcccttaatttctcaaactcctcaagagtcatctcctagatagtagaatataataacattgggaggtcagtgctgatcttattatacagcaaatgcattagcagaagcaataatcacaattaaattcactgggaaaaccagaaaagtgtaatagctgttcaaagctttcaatgtaactatatatagcttgttccatgggctgaacagatagagcatagcaaccaagttcaagaaataagcggtaacaataaggtagcaacattactagcaaagtaaattagttctagaaaaatgcacaggaaaaaatgacagtaagatgaaatcaccacatcataatacacaactaccaatctaccatacatctactgggtgtgttaatacaaaacattaccagcaaattggcttcaagcaagatgtatagacaaaacagtgtagtaagataaaacgtctatattctggaacccataataccgcacatcaaaagtgtacacaaacacttttatcccattgtattacacgcaaattgattaagaatgctgtggttgaaattaagtatcgcttgagttgaaaaatatacagtccatcagcccagcacaatcctgttaacatgatatgtgaacatgcatgtgcagatagtagttaacttgggttgataactcatgtgtaaacccaaccaccaactgaatttgcaactacttgtcacatccagggtgatggaattgcatcattttgacagtagaaaagtatcatatagtaagcaatatgatggcgacatgccaaataataccagcaacacagaacaacaatagactcgtaaaagtgacgtagcaaaaatagttccaaaatgtactattagacacacaagaataaattttttatttcagcaaacctctaaaatagcagtgcagtttcctcaatttagacagagtagagaacagatgaaaatcattaccttatcctcttccttctcttcttcctcatttgcagcaccctccttgttatccttctctccagttggagcatcatcctgctcaccctgtttctcagcaataggagcactctcctcaaccttcaaggcttcctcagtctccctacataccaagaataacactatgagttatctgtgccttcactatccaagacaagaggcatcataaacagataaaattcccctactgtgcaagagcctcatcagtagcagttccccagttcccacgccctgcaccatcacgcttcatctcataaccacggccagtaccactgtggcgctcataatttctccggggcggcctctcagaatcatccccatattcaccatttcggtagccaccacgcctacctccatggaatggagctcgagggcctctctccctgtcaccttctccaccagcagcaacagccccatctccatagcctccaccgtaaccaccctggtagccattggcattgtctccaccaaaatcacggttctggccatatccccgtccacctctgccacggccacgctcaccacggccaaatcctccacgtgatggtgcaccaccaccccgtgcctcccgcgctgaaacaaatacaattcaggcgctgaaatcagaaccagtggtgtttgcaggaataaattctaaaaactgatcgaagattcgaacagcaggttttaagaggggaataaattctactttccagcaatgcaaagctcacgcctttacagatcatagcaacaaagtttacagccgacatgttcctaactccaagattgagcaaaaagaactacaagaataatctcctagcaagtagcaacatacaatccaatcacaaccactaaaccatagtaaaaaaaaactcatcatacaaaactaagtatcattcagtataaacatctcacgacgaatatcagatctaaacactccgcggcaaccacaactcaccagcctgggtgg

SEQ ID NO: 11813 - DNA, 3621 bp, Oryza sativa
agtgtgtgaggaggagaaaccctagccgcgagctcatatccttcgtgtcggattagtggatttatttttttactttttttttctcggaggtgatgaaattaccgtattagccttgagcccagcgactatttgctgagctgggttttgggtgacgttagccacgcgggaggttgaaggggtagtttggggatttccttgggtggggtggtctcgagaggtgtgaaggcgctcgtggatttaggaatctggcaatctggaccgatggggttggggaatgcggatcggacggctgagattcgctggtaggagcaaaatgggctcccctgctgccacgctgccggaacaattcgatcatttccaatctcagccgtccgattattcgatcccttcaaaaatggctgccactaatgcatggtacgccacctctccaaaaaagacccagatcggtcgaaccactgctttcgatatctcgatcgaaccttcaaccctttacacctttgcatccatcgtgttacactgtcacttctctaacattcttctcgttgttagtaaatttaaatcacggtttatacgacattctctctctgtcaaaaaaaaacaacctaggttacctttcttttttacggatggagtagtatttagaacctcttttatttgtatgaaaatataagaattttgaaggatttcagttctataaaaaaaatcctataaaaacctttggagcaatgattaaatcatatcttatcttttgaaattcatatggaatgatatagatccaacctcttacaaaaatttcctttgagtatattctctcgttcaatttatgtgtttttcctgtaatacaatctaatggccattcatgtgttttgtaattctctgttttatatttacttgtcagaatcatatatttttcttattcctctatttttttccattcatgcgattcaaatgagtccttactcttctcattattagacactaagagcaaggtcaatagtatagccaactactgactccaaaacatctatagccaatctaatagcctattcatacaatagttaactataaaaatatactacaccattaatacacggtcccatctctcatacacacataacatcttggagttcgtgttgcagccggctacaaatttgtagcccgctttcttctctctcttctcttttcttctcgatatatagttacagccggcttatagcctgctattgtacctgctctaaatcatagtcacaatggctgctacttcagtcaaatcttgaagaaattcctatatagcgccactcatgggaatttccttcagtcaagtcttctcattattagttacactactttgctagacaattctcggatgcctactccctccgttccaaaataactcaactcaaatgatgtgacccaccactcatgaaaagcaacaaaaccatcagctcacaagtgcaaatagcatgaggtcctccaactaccatgatcattcacgtctcaattgatggtcgctgcaatttgaaaaaaggatggacaaattttgcatcagataatgatatatatatcgacccagtttgcatcttccacttctacaagatgaatcacgtgcaagtaacaattgatgttctgtgatgagcatatcaatacctaaacctatgctgtgatcgcccttttgttagcattgaactgtaatatatacttctatagaaatgaaccgcttatgctctctgttacaactcctatgataactagtgaaaccccgcgcattgctgcgggaatttagtatgataacaataaaaaaaataacatgtaagatagctagataacatcagattaattaagtaaattaatatggtttatgataatttaaatttaaatagtatgtagaatggtgatttaaacgtaaaaagtaagatggtatgactttatggaagaagaaaagtagggagatagtttggaccgtagattaatcatctaaaggctaaaaacaattgatgtgatatgacttaattagaggaaaaaaggagaaaaataatttggaccatagattaatcatttaagcactaactaaatgaggatgaactatataaatatataggatatcataaaacataataaaaatatacattgaaacattatgtgaactatgttggatgataatttagcatgcttgtatttgaaaagctcttaaattataaaaactataaagatatagcatgtttacatgatgtttaaatgtgatgattgttagtgaataataatgtggcatcttgttaattattggatgatgatgtaatatttttacatgttaagcttaagtagttagtgagggataactttatagtaagataggattacctttacatctttggtgcttatgctatgtactgaactctcttgtacgtataaaataccatctatgcgtgtaactttcggtaaagaccattaactattagtagacataatataatattaatttcttttacatttatctgcttttcttgctttctgactctatttccaatccaactgcatataggcggcgcgccccaggctctagtgttcatttaggtgcgaactgatcctggctgtggaagcctggattttagcgtagtttgttacaacagttaatatcacatgcggttgcaagccttccgattaaatgattaatggacaagatgttaaatcatccatatgtggaaggagagactgacgagtgtgtcccacaccgattttcacctagaattaccatgttggtatgccacgtagacaaaaatgataaatagttaagatatcacctcttaaaaagggcaaaaaaaaattaagtgcaagtgtaagaggggcatttaaatagtgacgaatagttaaatttccgtttagtaaaagaggacggttttgtgttaaaaagcttatttctatcaaaaaaataaggttagttatctgatctatctcttagattctctgggtactcatggagcatctccagcagtctctccaaatctctccaaatctagctctccaaatatctatttggccaactcttcatttaatttggcaagtcaaactcttatttactccaacagcctctccatctatcatccctattacaagtctatgacaaataggatccatatgtcactcaacaaaccttcttcaatcttgtttttttcccacccatactacatctcccttttctctcccgtgctactgccccttcctcacgcccctacctcggtacggcgccagcggacggcgcccctacctcggtgcggcgacggcgacgacgacttgcgtgccgaccggcggaggcggggtgacaggtggaagcgggccgacgggcggaagcgaggccgcggggcaggcggaggcggggcgacgacggtggcgagcgaaggccggcgcggccttcaacgagcggaggcggcgggctgcggcgagcgaaggccgcggcggggcgggcggaggcgggacgacggctctggcaagcgagggccacgattgcgacgagcggaggaggcggggagaggcggggctgcggctgcggcgagcgaaaggcgcggctgcagcgagcggcggggcagacggaggccgacggctgcagcgggctggggcgagcggcgg

SEQ ID NO: 11814 - DNA, 1742 bp, Oryza sativa
tttaaccaataaggaggagggtttgactagccaaatagcttggccagtgagttggtgatattgatggagcatgttttatttgatagaatagccaaaatttaacttgaagagtcaattagagagactgttggagatgctcttcaatcaataacacgttaataacatgttgaaggtagccatattaatggagccggacgtagtactattctgcatagaaccgtcctccggtatgtatatgcgtcatgtgcgtcttccctgtcacgagtgcgtgaactggagaagatgaacgaaatagccagagtcccatgtgccgaccgatgtgcggtgcactcgtgcaaccgcgtcgtcgctggatgctgcagctctgctgctgcgtgacgtgacggatggggggacacactcgcaaaaaccccagctgacctcatcgccgggtggtcccccctctctcccctcctcctaccgctccccatggccgccgccgccacccgcgccgtccgccgcctcctcatcgcctcgcggagtctccacgcaagtacgccacctctcgcgcactaactctgacctccaccggccaccgctcgctctcacacctttggttttttttttttttttgcttcctccccccgcgcgcccagtctcttccgagggagcggcgagggaggcggccacgagcttcgtccaccccgccgccgtcgtccaccccgacgccgtcgtcggacaggtaaagatctcccccattccgattgctcccactcaccagccgcggctctggctgagttgagttgctgtatcggccaacgaacttgtcgtggagtctctgcgcttggctgttggatttggtccatgcggaaatgtcgaatgcgtgctagccttcgcctgcttggtgcagatgctcataatctgagatgattactttctgcttcataggaaataaaaatgcattgatttctggtagtaaatcattgtgcatatgtgccttgaacttgaaccactatttgtagggtgtctcgataggcccattttgcaccgtgggagcttcagcgaggattggtgacgcttgtcagttacacgctgggagccatgtcatgggagataccgagctaggggagagatgtgttgttctcacgtaagatataatttttttccccactttctgttttcggctccatcgatggatctagaaatgtttgcattcttctgatatgataatagaacattcgggtgatatcgaaattgaaaaatgatgggaaaaaaaaaacaattctccaccaatagaaattctagtgaaagtaagctactaagcttggattatcactggtgctatgtggagctaagatgttgttcttgtaggtacttttgaatactacacatcccctgttaggctatctaccaggacaatagttctaatttctttcctcgccgcatcaagctaatttgttgcaataacttttctatcaacagctgaaccatagccagcagcattctaagcttcaaatatgcaatattggagaacaatgcatcatattgcatgtttgtcaagaaatctgactatatgacatgtgaacaactttaatgtggaatttagctttctggcagtggcgctatccttggttcagacattcctgggcaaaccattatcggtgaaaacaatgtcattggacaccacgctgtagttggtgttaagtgccaagatctcaagtataaggttagaattttttttttgtttatcactggatttttag

SEQ ID NO: 11815 - DNA, 1261 bp, Oryza sativa
tcttataatgggttcatgccatatagcacatgattgcaggattggcaacaataacatatttgctaacaatactctatttgctggccatgttgttgttgaagtgggtgattatttaccatgataatcttcatccattttcttggtcaagaacccatctgtgtattgatggaattcattgtttcaggattgcacccatactgcaggggctgttgttgtccatcaattttgtcatattgggtcattttcatttctaggtggaggctctgtggtatgttgtgtcgataagctttcatctgaattctgtaaaattacaaagttcttatgccaacaaattacattgcatgtaatcttgatcgatcttctcaaggaatgataatgatgcaaataagacataagaagcaggcctcgtgaactgaagtcatagaattagcatgcacttcatctggtgatacttttctaggaataggtgcatgatcactactactaggtacttatgtttgttagcttattagttgcagccaacatttgaattttgaaacttaattttagagtcaatattgtttttttttatcatagcctactttgcagcattggcttttaaaccacgaataatacatatacagaagttccacccatattttttttgttgcatcgttcatatttctatggcttatgagctgtagctcaaccaatcagaggcctagacttgtatgcggtcaatcatgtcaagtgtcagtacttttgcatatattttctttccaacaacattcttatttgatgctgatggcgttgcagttctcacctaggctgtccatttgtactggcactgcaattctttagtctttttttggggggaatgaattcttgtctttgaactctgaatatgatgtccgagagtatgaaattcattcagttcaatttgaatcagatcgcacaagatgtgccaagatacatgatggttgcaggtgatagagcagagcttcgtgggctgaatcttgaaggtcttaagcgcaatggtttctcagaccaagaggtttccatatacttctgaaatatgtagcctttattcataacatgagtgcacttctttatgttcctctagtagttgtgcgagggtacttaaagttctgttgtgatgttcctttaccaatatggtaatgtttaaacatattgtcatcttatcacatttactggtaaagcataacgaggatgatctggaaccaacctcaattgactgcaccttcttagttaactatataac

SEQ ID NO: 11816 - DNA, 9286 bp, Oryza sativa
cccccccccccccacacacacacactttgatacatcagctgataatctgatctgttaatacaaggctcaagtatgccaacagtcatgaagaaccatgatgattttttttatgttaccaacagaatgatgtgttgttaagtactctatgcgccgtttaaggattccccatattttgggagattaggcttgaagtttaacttagtgactagatatctgcagccaattataattttttctgtcttatataattttatctcacttcataaatgaaggtacggatgttgaggaaagcttatcaacaagtatttatgccatctattaatagtcagagtagctttgatgagagacttgctgaactggtaaacacacattggccatctttctagttgttacttccactccatgtatttatttatttgggaatctgtgtaacaggaacgggaaattgagttatcagaaactcatgtatcctatatggtggaatctattcgcatgtcctttggccaaggacgtcgtggaatttgcaaatttagaagttggaaccgctgaaatttctataaactttcaagttttactggcaatttccgagacatcacttaggtaatgcattcaattatcaaactttttgtgttatatgaggtggatgataatatttttgggcaaatgcgatgtcataagaactaacttatacaaaatataatcatggaagagacaatccaactccagaacgaggaaatatcgttccagaaagattgaacacaaccaacaaattgaaaactgcacacaaatgtgcctgaagattgacctggactttcaatcgtgaaagttgaaaccaaccaaaccaacttcttctcttactgcttagggaagtgcatgagctcacataaacatgtggagatacacttcttttcccaaaaagttgcttcctggtgtttcataatttctagaataagttttggattgattctggttgggttgttttggtcctcatgtttattgtatgtttctggttgcaggaagcatcgctcattctttggactgggcatgtttcacatcgtgttcttgaaagaagtcgcccattctttgactgttaaagcaagagtttctcgttgatattctaatacctgaacacaggaatacatcatacagatgttgaatgccccttcactccagatttgaccaaatactgtcgcatctggatataggacacttggaagttgcgtgtcgtttctttttcttttttattttctcttgagatgagatgagtagtggtgttcgtggatgcacaaatgctccttagtcgttgtacatatatttggcgttgcctcggttttgttcatcctgtacagtgtatgtatgtcgcctcctggatctcaggctcgaatttgtattgtctgaacgatgttactgctagtgctgagatggtccaaaatttgcattggtgttcttcggacgacatacagtttgactattaatgttgaatctgcttgcttcagaaaccttcagatcatcagatgtgccggacccaaatatcagttctaaaccttccagggcctatggaccgtatatattgtcattccaggtcttgcgggttcaaatgaatgatagctctcgaccgtacacatttgtcatttgatataatcagcgacaacaataaagataatggccttgtttggatcctccgagctattaaatagtcctctggaatcttgctatttaggagtattaaacatagattaccgataaaactgattctataacccctaggcttttttgcgagacgaatctaatgatgtatattaatccatgattagcggctgattactgtagtatcactgtagcaaattatggattaatatacctcgttagattcgtctcgcaaaatagtctaggggttatggaatgggttttgggttatggaatgggttttgtcagtgatctagcggatccaaacaaggccaataacataaaactgccatcacatgacatgaaagttgctgtggtgtagtggttatcacgtcagtcttacacactgaaggtctccagttcgatcctgggcagcaacaatttttttgttactttttccaataatgttttttttgttgtcatagatcccccttaaccaatatatgaacgcataatctttcaatccaacatcatctattctatctttacctttttttttaaaaaaaaaacatatctcatgcttacttaccgtaaccttgtcttgaatctcgacttcataaattatgataaaaaaaatctcgacttcatcttagatattttttattattaaaatgtactattacagcaactccaaattaacaacacattacactagctccccaaccaaactcaattttcttattgacctaggcagtctcagtagccaactacaatgatattttgagcattgcaaggaagggggtattaaaaagaaaaatataaacatcatcaaacaaaatgtgcaaaaagatatgttgaatagtttcttgcccgttactagctctccttcatgaaggctataaattaacatatttgtttatgcttctatggctattgtaaattaatgatggaaaattgaaccaatataaagaaaaaagaagacaaattcataatcgaaaaaacttatattccctttcgatgaacattgaagttcgagtaccaacattttgtgtaatatgtatccggtacttttcagtatatcaagactagactaatgcaaattgtatgtacaatattttggttgagaagagagagctcaagaataagtaatagtagtagtagtaaacattctattttgtttattctagcatggactgtttttattggtaattaattaagaaagaggtgacaaatagatagtcattttcatattgctaggtcagcatcggtgtcacttatagctaggtcaatatatgatccgagttgcttaatcttggagccaagcagggtatatattcgcacaaattcacctgaccaacagtccagggactaacattgcttctttaagctgccatctagcggcggtgcaagcataagatatgtattttattcttttttaaaaaagaaaaagaaaacaacgttgaattgaaaattatttttatggctttcatatattggtaagggggtaaattttaacagaactcaagataactatgcaagttatcttcatgtcttttagctgacttcactttgatatcataggtgggtcagaatattgtgtgcaatggtgctatactattaaaattgataataatatgtcttttatttcactttagatggtgtagtatttatagaatactccctctgtcccaaaatatagcaaccttatataggataggacacatcctagtacaatgaatgtggagagaggtactccctccgtcacaaaaagaatcaacctaggagaggatgtgacccccctcctaggttgatgtatgtggacacccccatgtccacatacattgtcctaggaggggatgtgatccctcctaggttgattctttaagggacggagggagtatatccacattcgttgtactagaatacatctcatccattataaggttattatattttgggacggagggagtatcatggaaagaatgttttttttaagtcataatttagagaaagttgagggtttgttccaataacttatgttttttctgttaaaactcattggtggtgtgttttatggcaaataaggatatgtaaaccaacttttttgaaatttgtttatgtaattattagaaaatatttacataaacattagttcggtggaaaagtttttataaaggactgtattaattttttatgtaaattttttaaagaaacaccaattaaatagaagagaactgatcttaagccgtggtttattgttttcaatgaatataagaaactttttggctcatggctcaagcttttacgccatgatcagacatgcaagtatgcagccatccggtaccattttagttaactgttttcaccggaaaaggcatcgattttcttaaagtaagttttgggaggatataccagcaaataaatatgatcagctatttattagccgccctaaacgtatgcatgatatgatcttgagttttaaacaaacaggccgatttgtgccttttatctggagttttcggtccacacattctgacacttacggattgcctcagccctagaacatatgaattttgtcatactaatatatatagtaaccaccacactaattcattttttacataagaggaggacattacatctttgacctttgcatttatcatataggatgcacatcacattactatacgttttgacaaagcaaaattcagaacagacaaaacccatatgagatactgaataatgaaattaattaagctagtatacgctttagcacatctcataaagcggatgaagactcccttgacaattaatctattctaaggcttgttaagattgatggatcgattgatccaaaaccatctactacctcagtagtcataagaagttttaaaattagacatgggtattaaagagtaggtgaaattaaataaaaaatgattgtgattgattgagaagatgaagtatatggagaatttaaatgatgaaatgttgtgaatatttgagaaaaaatataggtgaagaaattattatattttacacaaattttaaaagctaaaattttttatgttttgggatagaagaagtaactcctaacatgatgttcgatttgtgctatggcttgttatcatccgttgtcaagtctcttccatagccaaacccacagctcttcttatagtcggtttagtgtgaagacagattaacttgccctgccaaaatgttgccattttggacagtaattttagcaatgtttaatttgctatcaatacttatctatatatactacatgtatgttgctaaaatattagcaatagtaaaccatataagcctttagcgatcgcattgtccacgaaaaattggcagatcgcctcatcatccggaatgagtatggactggatgtccctagagatgaaaacggagctggtaatacttataccatattcgtttttatatttgttgttagatacgaaaacgaataccaataggttggatatgaaaacaaatacgaaatatctcaaatacgaataaggatcaaatatgatcggacacggataaaaacatttttttctcagaatacaaaagccacctcagcttctaatagaaacaaatatcatcatatataattaacttgtttataaaaaatatagtatactttataaaatatttaaaagtttaaataatattaataatatggattggtgttaagagatgtgctactattaaaatctaaaaaggtatattgagggtcacagagttataaagaaatggagtatgtcttatggcttcagcgaatatccgaatagcattgttcaccggatatccgtatctgaactatccgaaaattatctactctgaaaagtatccgtatttgttttttatccggagcggacgttttcatccctagatggccatgtgatagcctggtccaacaaacctgttattgtgtgcctctagccataatttttccttttctttttcggaacaaaccacaaattaacatatacgctcatatacacgtgaatatactcaccctacacacacttattactatgaacatgtacatgcacacactatcgcgctctacgagcacattttatctataaacgagagcactggtatcaaaactgtaattaagagttattagccgagcacctacatcaagtcaacccgagtatataagttcgatcgcaagaaacctaatgtcgctgcatcgtatatcaaggactacatacccagcccttctatttttcatttgacattggtaattcaaaatggaactaagccctgtttgattcagcttaggattattataatctagattattagttgtaaactgaaacaaacaagtagattattatgctagattattataatctataagctagattactataatccaataatcttctctagaggagctttttccaaattattgagtggctaaagacccactactcttagatgcctctaataatccagagaaacaaataactcgtggcttattttatatcagcttattataatccagcttagagtaatctgatttaataatctagattacaataatcttaagcagaaacaaacagtgcctaactaatgtgaaataacaaaaaaaaaaggaggaggaactatgaacatgtgaataagatgcacaataaattgaaatttttctctttttttggaaattaatattatgtctgcaattaaagctaaagtggccaaactaaacatatagccgcgacccactaatattaggttccttaatttgtcagcatgcgctaaattgtcaataacatgtaaatatatacatgtccaaaacataagtgccattcaaaaaagatgaggcaaagcatcaattaataaggtatggtatgtaccatgacataatcttatagggtaattttaccatatttgagaagtatacctggaggtacacatctctaggtactaagtattttaaggtataaaagattttaatataaatttaggtatctcaagataaaggtaaaactcctcaaatatcatatatcactattctttcttcgaagggctaatcctatctatctactccatccttatttattatttatccatctgcagttgcaactttgcacggcaattgaataagatttgctgaaacttcgtatatggtttctagtggacacataaattaaaacggtagcagtacacctgttcaaaatgtgtgatttggagataagatcacaagattttgagacctaaagaagttagatggacttgatggattaggcaaggaacatgctgcctaatatttatgcagtacacaactaaccattctatgctagtctccccaaaaaaaatatgcaattaacattgctgtgacatgctagccaattaaccatagcatcagctacagcaacatataggaaagaaacgatgtgcaagaattcgcatgcatcacaatcacacagctcgtgtatgcattttgatgaacattattggtgtacgagttttgacgaacattatctatcttgtaacatcacaagcagcatggtcgtatacatggtcaactcggtgctaagctgagcggcggccgtgcatgctgattagctggtggttggtgtgagatgaaattaactaataaatactctagtaaattataacaattcaaattggtgcttggcaccttaattatataattgatggttgatcgtatatagccaaaacatgaaacatgagacaatcagacaacagcaatttccacggacagttagtacaacaaccttacttccattggctaattggcttgttctcgcagtagtaactcacgacgaaaaaggaacacggtctttggtcgagaaaccgaggcggctgctgtttgtgaaagaacagcaaaacacatgttgttttaaaaggtgggaattagttaagaacgacagaaacgttcatttgtgtgggtgggtgaggggggggggtggttttaaaaaatccggttttttaacaaattggtccttttcaaaaacttatttcgaaactagtcactgcaaaaaacttcaaccaaaaataggccgtggactcagcgccatagaccttggcgctgagttataacgtctcagcgccaacgttgttggcgctaacatctaatccgaggtggcatgaatttgctgagtcattatagctcagtgcaaagttgtttggcactaaggtcctgacgattcaaatagacgcgcaagcatcttagtgtagcaaaatagtgatagcctagtggttaatgtctcaagtgaggcataaggttccaggttcgaatcctggtatcccccgcctcaccctttttttttattttggattttttccttttctcttttttgttctctcgactactctcttattttgtaattttttgtattttgggttttttccttttctcttttttgttctctcgactactcactcttattctttacaaaatgacagtttcgtttgtaaatttgttttattttgaatttgatttgaaatttcagtttaagttctcaattgccatataatataccactttaatattttttcccaaattcaaaaaaattgcaatttaaacatatcttttgaagatagtatcatgagataaacagaaaagaaaaaataaagagtgagagagagaagaaaaaaaagaaaatgaaaaaaatgggtttttttttctctcgactactcactcttattttttacaaaatgacagtttcgtttgtaattttttttattttgaatttgatttgaaaattcagtttaagttatcaattgccatataatataccactttaatatttttttccaaattcaaaaaaaatgcaatttaaacatatcttttgaagatagtatcacgagacaaacagaaaagaaaaaaataaagagtgagagagagaagaaaaaaaagaagaaaaataaaaaaaatgggagagaaaaaacgaaaaaaagaagaaaagaaaaaaaagaatggggagagatgggggatccaaaaaaagaaaaaacgaagaaaagaagaaaagaaggaaagaagaaaagaaaaaaaaattgggggagatgggaggtcgaaccctgcttcataggattagagtagaatcatgctaccactatgctatcggtgggttgttgaagctgaatgcctcctcagcaatttaaatcattaggaccccagcgccaactcaacaaatttatgccacctcagattcgagcttggcgccaacgttgatgacgctgagacgttatagctcagcgccaaggtccatggcgctgagttcacggcctatttttggttgaagttttttgcagggactagtttcgaaataagtttttgaaagggaccagtttgttaaaaaaaggtaaaaaactggcagatttttggcaagatagtggaaacagattatatgctttcaacatgctctgtttatctatctaactggaaagtaacttttcggttcaaattggccacttgcttgtatcctgttaaggatttgtttcatgttcttatcacttggacggtccacattatatacccagcagctggaagcattatccggtaagattttgatttattttcggatagcattgtcaaatgggaattttcttttttctttttacatcttcagcagttgaactgtcataggtttcctgtacggggctgcaggaa

SEQ ID NO: 11817 - DNA, 12050 bp, Oryza sativa
  unsure (1)..(12050): unsure at all n locations
caataatgtgcgcgtgagaaaggtcaggaatcgcagggcatataattggatccatatatacatgcactacaatcgcttgcgtgcgtgcatacagcattcacatatgtatgtactatattctcgtatctatctactaaactaaaaattcagatatggttagtgtgcatgagcatatacaaactacacaagcaacatgcatggttattgattaactctatgtttatgtgtgtggatgaaacacattgcatcaaccaattggagaaggaaccgtaagaatcttaatcagaacattctactcttgcagctacggatcacttcaaggaagaacacagcagcagaaaatgttttaacatgcaccacatgttttactagtagatcaatatcgattgatgaaattaacgggaccagaccggagtcagtccccattttacctgacgaacttctccaactacgttagatatacgtagagctagcatatagatgacgataatcacgtaggtcatcagatgctactgttttcgtttcacagagaccagatcaacagagattaattaatccttccaattgtttacagtagtcatttggcttgcgacattaccaatatacgtgcttaatgtccgtatcaagtgcacatatgcattatttctgctcatcgtagaccgaagttacgacgatggacactaccgaaaaggcactgactgcaagcaagcgtcacttatcttgctatcttgctggctttacttgtagcggagagtggaaagaccagttcagattcagtagttttactgaacctgaacctgaccatttctaccacatttctgcatttcatttcagaaaaaaaaagtagtaatagtcttaaaatcttaatacaagcggaaaacggaaaagaaaaacaaatactatttttcagcttttcttttttgtttcctgaataattcgacaacagtttggaagtctaatacgcatgcagctaattcagcatctgtttagttatccccagaagaaaagatcatgtggccgagaagaacatcagactggatcactggaactagcgttcttgtgttggaagtcaaaattaccattcaagaaaaaaaatataaaactggttataaaaattggttgcaacgtccaatggattatatgctcatctagataggagcatatacgtacgacgaactgcggtagttgccaagttataatcaagttaggtcctcctaggcctgtagaatatatgatcgctgatcagagggcacaagcaagcgcccgcccatggacattatttctgtcgcttgaccaaagcatttttctatgccgcacatacaccttccctacaagaaaaaaccgtcgagtcgatcttgaaattaaatcctgcaaactcaaataaataactagtcggcgacagggacggactaagtacaattataatcattcttaaaaaaactagacatctcatttttaatttattccatcctaaagacaacaacgaaagacacggttgtctcaccatcggtgtctctcgtaaaatacacagagagacgaagctgaccggtggtggtggttgaagttttctatggcttttcttgacgtctcgcgatgtgagaggcgatgtgtgtgtgtgcgagcgagcgctagctaggtcaactttgctctcagctctcgctcccgatgccacacgctgacgctgtgctcgttataaacccccggcctcgccggggcctcaccaaccacggccgcgcttcgcttcttcctctgatcagagtggggtgaggcgaagtgctcgatcgggagcggtggtggtggtggggagagagagagagagaacttaacgatggggaggtcgccgtgctgcgacaaggcgagcgtgaagcgggggccgtggtcggaggaggaggacgccatactcaggagcttcgtcgagaggttcggcaatgccggcaactggatcgcgctgccccacaaagcaggtgcgcgtctgcatgcgtccgctgcttctttctttttgaaaaccgtgtgctacgctagagtcctagacgagttcgtgcgtggttcgatgaacagtggtcaaaggcttctgtcacttgcaactttttaacggcagcttggtagtatatggagtacttagcttctctgaaatattgctagttgtatacttgtatctctctctgtgactttatctagctcggtctgtcagcgtagggacgggtgagtttactgataactcgctcgtacgtatgcacacgtaaggatgacgtcgttaatgtgttgccatttgattgtcatcgtcagggcttaaacggtgcggcaagagctgccgcctccggtggctcaactacctccgcccggcgatccggcacggcggcttcaccgacgaggaggacaacctcatcctgtcgctctacggcgaaatgggaagcaagtacgtgcatgcatgcgtgcgctctagtctacctgcattcacatgacctctacctctgtgcgagtatattgattatacttctgcgtgcgtcgccgtggatgtgcacaggtggtcggtgatcgcgtccaagctccccggccggacggacaacgacgtcaagaactactggaacaccaagctcaagaagaggtacttggccgcggccgcaacagaagcaaccactcctcctcctcctgccgccggcgacgatgacaacaacccaacgacacaagcctccagccaacccgctcctcctactcctccggcgcccctcgtcaacctcgacgcggccggcctcgacggcgccgtgggcgacaacgacgagctcctgctgcacaagtcggagcagctgtacgccgagctgatgggcctcatcgagcagcagcagtactccacgatcaccgccgccgccgtcgacgcggcgacgacgacgacgtcgtggtcgtcgccgtcgacgggaacgacaagtccgaccgctagcagcagtactgacggcagcagcagcagcagcaacctgccgtggccggccgtggacgtgcacgacagtacgatgatgccgccgttgtcggagtccagcggcagcagcagcggcttgttcttcggctctcacgcgttcggtagtggctcgttccaagacctgctcggctctgcagcttccttcgacgatgtcatgctgtcgcaagagatgctgtactactagctaggattaataagaagaaattaatgtttgcttatctcattagtctagctagcaaagtggtaattgaattatctcaattaagttataagtatgctgcattggctagctagtgacggaacgagacgtcatgatatgtaccgtgcaagcgtgcaaatcaactatgactgtgtgagtgcgcgtaaacgtacgtgtgtgtgtgacacgattgtatatatatggtctcagaagtgtaagaaatagtcatgcggtactggaagatgacatcgcgcgtgctgggtcgccccaacatatagccgtgtactaaggtgaatctattgacttggcactaaaaattttatcttattggcaggtcaattagtttgtcgtcgtcaagttttagattgaatcatcctcatcacaacaccttgcactgtctcattgccttttcatcttgttcgcgcgcgctagctaaagtagttactccgtttcacaatataagttattctaatattttttatatttatatttatgttaatgaatctagacatatatatttatttagattaattaacattaatataaatgtgagaaatgatagaatgacttatatttgtgaaacggagagagtagcaaataatgcatgccatcgcctaacgacgccgtcgtcgcagcattgttattgccataagacgcagcacaaatcctgaagcgtgtgtccttccatgccagcaatgcaccatgccgccatctgatagagtgagtgtacatcagaagagcggctgtttgtggtgtgggagcgagtctgctctgctgctgggccaaaagtgaaatttggctggaccaagttgcggctcacgagtcacgacacgtttccgctcatttgggccaacgagcagcaccagcattacagaaacgggataagctagttcactttaggcccctcaatttgtcagccaatatgaaattcatccctaaaccgaaataccagatataacacgtccctcaactttcaaaaccacttgaaataagaccctaagatgatttggatggcggtttcagttgacatggtatctacgtgaatggtttgactaggttatcgtctcacgtggcgttataatcaagattaaaaaaaaattaaaataagagtaaaatatatgggcccatatattagtcaatacaaacataataaggaagtgggacccacatgtcngtggtnccacnttcttcacctcacccctctctcctctctacttcctccttcccattgttcgcaatgaggaatcagtggcaacggcggccagcaagaaggcagcgacggcggttggcgggaggtgtctattgaggagggagccatgacgttccgaggcgacggagaagaggatagaggcgagctccgaccaaattattcacagtgataatttcaaaaatggcgcaacgcctggcggagatggtgatctctccccgacggacgcctgcctcacggtgatggagctggtgaacatgatctccgtccttatggcgctcaccgctgccatccgccttgacgtcccagccaagctctgggctagaggtgccaatgccccgttccccacgggacaccctaacccctttgtcctcgagcgcctcctccgcctgctcacctcctgcagtgtcttctgcgagcacaagggctccccgcgccacttcgcgctcaccaccggcgatgatgaatcctagagctggccaccgctagagaggccggcggtggcggtgcaaatcaatagcacggaggagctagtggaggaaaaaatcagcgcggtggatatcaaagtcgacgggcaaaggtagaagagccattggaggaagaaatcagcgtggtgaagactaaagtcgatgtctgacaggaatacgagtggcgtccgctccaattcgctcactgaccaccaaccatggctcgagcccttcctcctccccttactcctcgtctcgttcttgctcacgctcgccgccacggtggctgcattcatcggcctcgagtccttcttggtgatggtgtgccgcccgtgactcctccgtcggcaatgaaactttcaccaccctccttgccccggtgttgatgtaaaaacacggtggcctgggagatctgcttaacttcagtgcatgtccaaagctagcctaagtgtgtcaaggcgtgccaactgatttggtcctgcaattagcaagaaagacaaaaagtagagttagtcagccgacagtcgatcggccaataggccgatagcatatcgttggtggtctcagccgatgtagttagaccaaatcggctatagactgggtagatcggtgaatattaaaccctaaacatgcctcatcggctgtaatattgtctatcaggtttaataaagaagtttaagatagtattataaaagtagccgatggaacaatatttagggtaagagagataatatactagctaatactctagtacaggcttatataggcagatcaatctatataaatatatcaaattgtggttggttagtagtttagatagcccagccgataccaatctagcttgatataactgtatagggagatctatctatataagtggcaaatatacataaaactttagtaaagaagcatgtatattaggtaagatcggctaaaacctcgatactacccttattaacaatcaagaagcaagctagagatcatggttctgaacacgacatagtaggtcgaatgtactaatgcagcactaagtatgaaaagaaatatgatatctagacaatcaagtcgttgactgaatttttaggatggtagatgtctaagctaatctaatctagtaagacgaattagccaatactggcagaaatcctaaagcaagaagcagccgatagagctaaattgatatgctaagactagaataacaaagacatatgataacaatggttatgatacaaggactagaatatctaaaacgacatagtagctccgatagtacaagccatcgagacgagttacctcttgcgaagcgaactcgtcgaaaagtaaaagggtggtgatgcgccgaagttgtattggattgtccctcgtattacaatgctataaggttcatatttatatcccgagtacaaaatagtccattatggacatgactcaaacatttttaaagataaaatacaaacaagaccatatacagcggtctcttgccaaatctaactcaaaccgacataactaacctagttaataggtacaattgccatacacgagctctatctctgattgacaatgacagttatcttgatctaggcctatgccgagcctagattataccatatcggcagcttgccatatcggccaagtcaagcctttgtctagtgtttagccgatacgatattcaaccgatattcaaccgatgtgcagtttgacttagagatcaactagattttacacctaatccgcttcgatctttcttcttctccaaatctgatgccaaattccgttgttaacacccggtcctctagctctcggccctgaccccactcctccccacctgcacccgcctcctctccctttctgtccaagtgcccatcactgtccgcctcgccgccgcctccttctcgctcaccgtcggtcagacggacaacgagattaagaactactggaacatgcacatcaagcgcaagctcctgagttgaggcatcgacccgcagacatatcggccggtcaacgccgggagcagcgccgccacggtgagcgggctaaccacgacggctagcaccgttgccttgccgtccctggcaccgacaatggcgtgagggagctcgagaaggggtccacattttcttttaattttaatttttactagcaaaaatgcccgtgcgttgcaacgggcgaaaaaattctaatcataatatacgtttttcatgcataatgatttcaatgacagtgtttgtattttaatgagcggcttgttttttttataaacggtgttcgcgattttctcaaaccattttttagaaatgccgtatttctttctaatattttttcttagcatgttttttttgcttgtattttcgaatgttcctttttgcttttttccaatacaggagaatatatgacgaaataaaagccgtgtagtatgtggcaaaaaattgatggattctatctgactcaagtgtccatcaatttagctttttctaatagttttttcagagcgatttgtttttttaatagatggcgttttttttcttgcgatgttttctcaaaccattttttagaaatggcacatttttctggcggttttttccttgcatgttttttttaaaaaattttttaccgacgatggaaatagcttttctcgcacgtttttttattttttttatggaagatggaaaacatttttagagtgttcttttttgcgcttttttctgacttttttctcacgcgtttttttgaaccgtttttattttctcatgcattttctctttttaaatagttagattagattagagatagagaagagatatatactgattagaaatcagactttgtttcacccattctatttttttttctcgcgagcattttttaattcatacgaaccaagtttttattttttacgaaccatttttttgccactttcttagggaatcggacgaatttttttagatatttttttttcagattttttttcgcctttataggaatttgacttttttccgtttttaaaggaattggatttagcttttttcaccactttttgtttgccttttataggaatatgattttttttgtttcggatctatggtttttttggccatctaggggaaacagacttttgttgttgttgtttttcttttttcctttttttgcggcttttctttttctttttatgcacctttctgtttttgttatctcccttttattatttttttaaaaaacgacctcaaaataccttattgcaagattatagggactaatgtaaatataaaaattacagggactcaaatacaaaagtacatacccaaaaattaaaatcatataaaaatagaatgctctcgacatgtaggttccgtttttgcaaacagatctccaatccgacgcaacaatttttttcaccaagatgtatgggatatcacgggagattaaaaccgagcggagtggtgcgtgggatctcggactcaagcctagaggagaggtgccttttatttttcgtttttaaagaggaatcagatctagagttggatttttttcgtttagagatagagaatcggacagatttttttttaatttttgtcgtccttcttcttacccagagacggattcgtttttctttaatggacagatccggttttcccaccttttttcggccgtttttttgatcggacaggtttaggttttttctcacccggttttttctggatcggatagatttggttttttcgcccggtttttcgttttttcgccttttttatcggataggtttggttttttttcctttttttccgcccggttttttaggacagatttggtttttttgtccggtttttttgacggatgatgaaagcacctcttattttttaagtagtatatagacgttttggttctaatgtcacctcactgtcgtgtaggacgatgaccaagtcaaaccagctacgtaggcaccatgtcagtcgaaactactgttcaaaacatcttgtgatctcttttacactggtttttgggagttgggaaatgcgctatatatatggtattgtggttcagatatatgattcaaactcggcgacaaatggaaggacctcatgtgaacttattctttacaacaacgggaaaaatacaaggcccacagttgtagcgagctgcgggaaagcaccggccgaactactaacatacagtacgtgggaatacgcaaggtcgaaccgtcgctgcagaccgcaaaagtcatcgatgcccaactaggccgccacacctctacacggccccatccggcagcctcctgcccgcgcggcgcgacgcaccaccggctcactacgcgctagctgcatgcatcaggactgcggtgctacgatttgatatgtccctgttttgaatggttaccgtacgcaaatttaagctgcaaattaatctagtagtactactatatatgtattgcatagttaagctgcaaattgatctcgcatataatgccctcgtgcaaacgcatctattgcgaatccgaaatttgattgatctcgcatatgcaatatgaatatatatttggactctggtgttcctagtttctacgtctcctacctagctacgaaaaaatgtacattgtacacgatacgaactcgtgctttggtacctgtccataaaacacatattttacccacgagtgcagcagctcgtctcaggtcggccaccatctatcggcaacgctagctagcccatccatgtggacgatgccgttgccgccgctgcggccgccgccgaggcggtcgccaccgacgacgatcggggaagcgtacccggacgcgcggggcttcgcgacgctgaagtggatagtgatactgctcctcgtgtcgtgcatgttcgccggtggcctctacgccctgacgcccctcgtatccaaggaccctctctacctcgcccgcgtcccgtggcgtctgccggtgcgcgtcttgtgtgactcctacctgtcgctgatcatggtgatccgcgcgtacacgttcatgcacctgccgcgcgcgccgctggtcgtcgacgactatcttatgctcctcggtctcggcgttatcggtggcgtcactgtcgtaacgacgtccaaagttttaaatctccggctatagctgccgctatagagatagctgctgggaacggacggagctaagagatgcagtttttagcgctaagaatagcgggacgctaatagcgccatttagccggcaatagccgctaaactggccgtaatttagcgtagctaaattgtaaaacgcggccggtctggcccaagaggaaaccggcccaactagaccagagtcgagaggtgggtaaagtgctgcaaaccctagctcgtaagctcccagcagcacactatccattccaacttcaaagcgctcactctccagctgcaagaaaagtggaagcggccggcggcggcggcgcagaggcgtccggcggcggcggtggcttcaagcggatcgaccaacgcaggtggctcgtggaggcgaccggcgccggctgctgcttcgagcgggcgtccaaccagcggcggcggctgtgaaggcagctgagcagcggggcaagtccgacgaggaggtccgtcagtgcaacgtctccgaagcactgaagcagcagcaccaaaggtgacggcatggcacaacaatccggtcagttctcacatcgtcctctcttttttgcttgtatgttgcagatcttacaatatgtgaacaagttgtccatatttgttacctgtaatttcagatacttgccttatgatgtagatcttactatatgtgaattattttcttactccctgagatctctcgtttgcttgtttcgcctgtttaggtggtaatgataatacgtgctatatcagtttgcattattttgatgcttaggcagctttgacgctagcattaatgtgggctaagtttgctttttatataggtaatccgtccagtgctgcctctgtctcagtagaagctggaccaaaacaagctggtatcaactcagatgatcctgcatgggctcactgtttctgcccagacataaccaagaaacatcacctacggtgcaagtattgtgacaaggtctgcactgctggaattacaagaattaagtaccatcttgctggaattaaaggtttcaatactactaagtgtcagaaagttccaagtccagtgcatcaagagatgtttgatttgcttaccaagaagactagtgaaaaggaacagaaaaacaaagaaaaggaagtggccagagctcaagttgacatagaaaattcagattgtgaaagtgcagtgaaggttcagatcatggcaataatgttcttgtggtgaagccaaaggagacaacaggatctagtagctctagatctgtagcaggtggtcatactattgacaagtactacaagcctccttctatagaagaatctgccagtatgacacaaagagtaattaagctaagcaataaggttcaaacagcattgacaactcagaaaagagaagagaggaggaatataacttgtgagtacatatgtcagtggttctatgaagctagtattccacacaacacagtaacccttcctagctttgctcatatgttagaggccattggacaatttggtagaagtctgaaagggcctagtccctatgagatgagtggatcgttcttacagaaaaggaaggaaaaggtgatggatggattcaaggagcacaaggaatcatgggagctcacaggttgttctatcatgacagatgcatggacagataggaagggtaggggagtgatgaatttagttgtgcatagtgctcatggggtactcttcttagattcagtggaatgctcaggtgacaggaaagatggcaaatatatctttaaacttgtggacaggtacatagaagagataggggaacaacatgttgtccaagtggtgactgataatgctagcgtcaacacaattgcagcaagtctattgacagcaaaaagaccatcaatattttggaatggatgtgctgctcattgcttggatctcatgctcgaggatattgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11818 - DNA, 325 bp, Oryza sativa
agtgaacatccagtacaagtgtccggagacgagcacgacaatgtgcagtacggttcaccttcagctcgccggagcaaagcttacagccattacaagcaaaaaagaaacacattgtgctattacttgtagtgttattaagtaataacaccactagtaccagttcaagcacagctcgaaacaaggagaaaatttagtagcgcatacaccatgtcctgctcagatgctgtagtccgaccattgctggatgaaggaggtgtggtccatggattcacccggcatgtcgtcgcccttcttcccgccgagcagcctcgccggattccccacc

SEQ ID NO: 11819 - DNA, 1438 bp, Oryza sativa
gacccgacccattgccatccctacctccaccgacacctccttgccgaggagctccgccgccacccgctcctcccattcgacgccaccgctccgggcctcggcgacggcggcgtgcaggcgaggggagctgggacttgggttgtgctttatcaggccggcctaaggcacgacggcccgacatgctagaaagcacggtctgacacggcccgtaaatgggctaggccgtacttgggctggcacggcacgcgaatggcccgtaggcacgatgatggcccgatggcccatggcacgatattggcccatcaggaatggctgctagcctgctagggcgcatgcgcatcgggccatcagcagaaaatctgagtggcactacagctccggaccccggcagcaagacgctcagacctccgaaaatgcttaggatcatatgttcgacgcaaccaataaaaaccggacggataaactactacctccctattcactccacaaatacatacatgttgtaatggtcttcaaaataatttttctcatgaactacttatccaatctacgatatgatcacaccattatatttgttataattaaatctttataacaaggtatcacatcattacattccgatgaaaaaaaaacatatgtttcaatccgttaaatttaatgtttcagatgcggtagcaatatgtttcaacgtgtgtttttgttatgtttcataaaaaaaatttaaatatttcaacaactgattttttttcactatatataactcaatgtttcaacaattgattttttgtttcaccaatatataactcatgtccctactctctctctctcgccatctattggctttctcccacaccatgcatgaatcatgatgcaagtatttagtgatattaaaatatttttccttctaaactacttatccgatgaacgattcgatcacaccgttgaattcattataattaaatctttacaacaagatatcacatgattatattctgatgaaagaaaaatatatgttttgacaataaaagcttaatgcttcatacgtgatagttatatctttcaccatgtgttcttattgtgtttcacaaaatttcaatatgtttcataggctcatttttctgtttcaccacgtataatttaatgttgcaccaacggtcaactgaaacatttgaccgtccgatttttttttacatcggacgtctgatttatagctctctcctcgtacctcagaggatctcctgcaaggatgcgatggtgtccggcgattcccttccgcattggcgcaatgaatggaggcggccggccgaagagacacagccgtggcgccgcgcagacgcagtcaagtgacgccgcccggccgaatggacgcaatcgagtactggggatggggacggcggacggccaaacggacacatcttgccatctaccactggacaaa

SEQ ID NO: 11820 - DNA, 1933 bp, Oryza sativa
ttatgaagcagcttaatgatgccacatctcttcttaaagtggtgaagattaccagaagtgatgatgggtttgcagaggtcacacttgtggatactgacaacaagactagaaggcatattgttgacctagacaaccaaaaatgctcctgtagggcttggcaaataacagggaagccatgcaggcatgcattggcctggatatgcagcagtggaggaaggatacaagattttgtgagcccatattatagtgtgcaaatgttcaggacagcttatgcaggcagagtaccacctatgactgataggacacagtggccagtagttgatttgggcttcaaggtgcatgtccctaagcagaagagaggtgctgggaggcctagagtacagagaataaggggatttcttgagcctggaagaaagagagtgaaatgcaagagatgtaaaagatttggacattttgagaaaacatgcaagctagctgaacctgtagatgcagatgatatgagcagccactgcaccccccaaaaacggtatattgctgtcattgtgcttccattcttaattagtctttgtgcaagcggtttgtgttctttaactccaacttgataaaaaaaacccaacttgataattattgttagttacactcctgatatattgtgctatgttgtagtcactaagattcaggcttgtatgcttgccatatggtctaaaaattctcacttttttgtaggaagagacaagtgtgcaggcaaggaaatgatccaggagtgtcaacaagtgaagcaagctgctctgcaccaaagaagaaaaaaacacctaggaaaaaaaagacaccaaaaagaagaagactccccagaagaggaaagacctagcatcctcaagtgcaccaccaactagagtagttaggagcctatctacctatcttctactgtaatgccagctgcctcctctctaagtattttgctaattgccaatggctgtgatgaacttgtaatgcacgtgtgcctgtgaacttgtagtaacctatttgcagtgacaatgtagcctgccccatctcttaagtattttgctagtaaggctgctatgaaccagtaatgttgctcatgtatgtctatactgttgtatgcatatgttgagcctgaaaactgaaattatggaatgcatcaatgatctcttttgctgaaaatttactgtactcatgtgctctctccttttgtaaagatttctgtgctgtaaactgaaattatggaatgcaccaatgatctctttgctgaaaatttgtgatggacaattgtctgcatggcactgattctatacaggaatctgacaatttttcccagcaatctgcaaattttatggttctattattgtaacaattcactactttcttctcaaacatacactttcattcatattgttcagcactgcacatacacatactttcttctgaaacatactctttcattcatataggtcaccacagtacatacacatgacaatacatccatatttccaatccaaaatacacttgttgacaatacatccatttttttcccatctaatttctacctaccattaagcaagcaaataagacagtgatcactaaggtaaggtatagaagtctagcacggctaaatttaacttcttccaactgcttcttcatcgctaaacactccagcctacactggttgagtgtctcaattgttgacttcaactcattttcctttgcatcaaggacctcacaaatcttcgctttttcattcttctcatcatctaaatattggcgaagaatgtcgattgtttcttgcatatgatcgtactcgccggcgtgacagtacgcaaccatctcctcaacatactcattcagcaggtcttcccatatccataagaagcaacagccctaagcaaacaactaagaattaagacaccgaaatgaa

SEQ ID NO: 11821 - DNA, 3444 bp, Oryza sativa
tgagtttttgcttgtaacgtttatcactcgtcttattcaaattttttttaaattattatttattttatttttgacttactttattatctacaatactttaagcacaacttttcgtttttttatatttgcaaaaaaaaattgaataagacgagtggtcaaacgttgcatgcaaaaactcaaaatcccttatattgtgggacggagggagtattatttgtttcgaaaaatgttactgatatgggttgccagttgcccctcgcacaatattcacttatctcttttagacctatatggtactggcaccactgccatacgtactccttttatctatcgttgtgtataagatccatctctattcctatgttccaataaattaaaaacttttcaagtttttttaaataaaccggtatctttaagtgggtctaccagtgtaaggggtcggtccatccaactataaggacggttttaagttaagaaccggtacctacaaatgagaataggcataggttccaattaaatcggtacatatgagcatcatctatagcagtgtacgcgcataatttttcattagcaagtacgcaatgtcaccttatttccttggggtcaggttgaatccagcgacaccgaggctagaggagctgagataggacgtaggatttgaccagctttataaccaaaaggttaaacgaagtggacgattcactattgtttccacaaagtcttcggttatgatgtaaagtgaccagggacatgacatggaaagatgattctttacgtagttaatgatcagatgatgacaactatactactgtctttgttttttaatatataagatcgtttgacattttgacaaatgtttgatcatctgttttattcaaaactcttatacaaatataaaaaatatttaacttttataaaaaaacatttgatgataaatcaagtcacaataaataaataataattacataactttttaaataaggcaaatagtcaaacgagtattttaaaagatcaatagcattatatattaaacaacgagagtacttagctaaagcaaagaaaaataaacatgtacgttttgtttccttgtgtatttacaactctggtaggctcactcaagaaaggacagagtacatataaactccaataacgactgcacgttctaaacgccaaactgtgcaaacgtacaacaatcaataataaatctcatgttactgttttgacatcttctttatagcctttatgtacgttatatgcgtccattttctagcacgcacaagttgggagaagaaacttagctaaaattgcgtcagtgccgtaattaatttcttgtatcatcaacaagcaaaattttctccgagatctgaaaatgcacaccgacacactgtacgccccataacagatgccgcacgtgggagctattataccgttgaaattttcaagttaagaaatactagctctgtttcattttaaatgcaactatgtttttccgtacctaattttgatcgtttgtccatcttatttaaaaaaattttgaaaaaaattaaaaacataagtcataagtaaagtactattcatattcatgttttatcatctcataataacaaaaatactaattataaaaaaaattttaaataagacggacgattaaagttggacgcggaagcacttaaatttggacggagggagtaataccgagtctcttttatactaggtactataggagtaccattcaagtgcccatattttagatcaaaggtagcatcctaattggctgtgttttgtgatgtatggttgattgttgagacttgagacttgaggcagtaattttttttagataattaaacttgacgaactttgaagcacaatatgaaggaatttttatttcgataaattttcgttaccgtattcgagcctgttcctattcacttcgttctcatgtttaccaatcactaagtcgcgcgttgcgcaacaatgaatatacactcctaagtgttaacctgtacatattcctaagttgtcttgtaagtgttttatactgttattttagaaaagtagaaattagtggcacatcgttttgttgcccaatattaggatacaaccattcaagtatttgttgttggtgcatatgacacacccttctctcgatcactatattttcactcaacatattgaactttcatcacgatatatatattataagtatttctaaggcattttttatgctgaatggaatataaatgataatttagataacataatgttataaaagatgcttttgagctcaactataaacacaacactttagcgattaataaaaaaaatcaagcgtatactccctctagtttttaacggacgacaccgctggcttttgaacatgcttttgactattcatcttatttaaaagccatgtaaatatgaaatatacatataagttattctgaaagtacttctaataataaaataaataataaaaataattatgtaattttggtcaaatatatatttaaaaatcaagagcatcatatattaaaaactgaaacaaaataaagcatatcgaagtccatctaatatgctagtactttgtactattcgtaaatacattttataattttatttgaatttgagttgtgccattcttttttttctatggctgaccatgtgcctggcagctttgagacttcctcgttggaagtctagaagtttcttgagggcagctcctgtgccttgaaattttttttctggttttttaatagaagtatgaatctaatgtttcattttttgcttgctgtctgcatccaacagtggttctttcgtgacctagctcgattgcaagaaactttagttctttaaatactttagattcggaattttcccctgagaatcatgcttattttggcccggaaattccttccgagggcccccacacatagcgtttatctggccttcttttcccatgacaagccaacaaggccaaatacggattccatctccatacgttcatcatgttacgatggaccgaaatccaagcccatttatgtgttaacaaggcccaactatgctaaagttgtttcatatctggcccatcaacacgttgcagttatgggtcgtcattccacagtgggcttgtcacaacaaaactcgtaggaaaaagtccaatttgactcccttaaatataggcaaaatctaattcgtacccctcaactggaaaaccgggtaggacgactcccctaactattgtaaccgggcaattggactccctcggcggtttcggagggcggttttgctgacgtggcaatgttgacccggttttcgtcccacgtggcgcttacatggcattagaattaaaaaaatatctgtgggtcccatctgtcattaaaaaaattatattgggggacccactgacatgtggggcccacatgtcatcctctcttctctaccttt

SEQ ID NO: 11822 - DNA, 7449 bp, Oryza sativa
  unsure (1)..(7449): unsure at all n locations
tcttcgattcccgtcgctccggtgagtctcgcgtcgattccttgcgcatgaaccaccctagggacctcactaataacatcagagcacatgcatgtttattagatcggtggatcaagccgtcgccgttcaccccggaggttcttgccgccgccgagcacgattccggcgacgagacggcgacggcgcgatggagaccgacccgccgccgccgccaacccgacccccgtccgtcgctgccgccaacccgacccccgtccgtcgccgccgccaatgcctatgtggcccctgctcctgtgaagacaaacgggggagaaagagatgagggagagagagggaggaggaagagctggccccgccgccgaccactccctcgaccgccgccgccctagtgtcgctgaaagggtcaattaggcctagaggagggggggtgaataggctaatttaaaactttatgcggaagctaaaactgagttagggtcggaaagtctgatccacagtcagactatccgaaaatatcagatagtctgatgttggatcagactgtctgatccactaaaggaacactacaagtagatctagtgcacaaacaagagtatggcacaaacagcgactagatctaaagcggcacaaaagcaaagctaaataataggagaagagatatcaccaacaatgaagttcaccgagttgttcccggagttcaaatccttgaggggattctactctacgttgaggagctcactaagagccgggtctttgctaaccctttcctcaagaggttgcactaagcactcctctttccactaaggggtatctctttccttgtggaggcgagatccggccttcacaaacttctcccggccaaccacacgtagatcggtggctcgggagtgacacctagccgtttaggagtcctcaacctccaagagtaacaaacaccacacaactcttggtcaaaccctagtgctcaagatcgagtgaaacacacactaggccctcaaacaccaaatccacaaccaccaagatctactacacaaagaacaaagagggatttgagagagggagagagagctcaaagatccaaaacactttagcaccaagctcaacccaaagtgaatgtgaatgaatgagttgggtaaccctagaaaagggttaggtggggggtatttatagaagcccccaaaatgtggccgttgggagagaatcttttcatcccacctcggaaagtccgaggtgacatcggatagtccgatgtttttgacccccaagcaggccagagacagagaacaaaattctagaggatttcggacaatccgatcgatcggaaagtccgatgtcatattggatattccattatttttgaaccaagaatttcatcctctcacagagactcaagttccattgaatttcggagtctctggatcatcggatactccgatcacatcggatagtctgatttaaaactcactcaaaaggaataaaaagcaattcaaaatagagagtgaagttctgagaaatttcagatagtccgacgtatcggatagtccgaccttatatcggatagtccgatattttttagccaacactcagaccgaagacagtgagcaaagttctgtgaaatttcggatagtctgagcatcggatagtctgatcaacatcggacagtccgacagacataaaacaggaacacttcaaataaatgattttgagcactagtgttctaccaattatatgcatgtggcatccctcttaatagtacggcatcctaatactcaagaacacaagatatacatggattagaagacaattaccacaaaagatgccgcaatacttattgtgttgacatccactcctttttcatccttgcatacatctcaacaaaaagcattagttaccctctaattgtgttgtcattaacaccaaaataaatgaggggtcctagatgcactttcattctccccctttttggtgattaatgacaacacacttagaagtaataaaagattaggattttggtggagctccccctaaatatatgctagaaatgaaataggagagctccccctcaatctatgcactagattagaaatgacaatataacctcatgcatatgccaatgacaagatatttcacacatttgagcatggataatagataattgcacataacaagacacaaaaacccaagggtcgactagccatcacgaaaggagatagattagagatttttgatgataggtggttctccccctttggcaacaaggcaccaaaagggaaaaaatagaggatcactcatccttatcagaatcctcgccctcctcacttgactcctcagcatagtcaccttcctcctcctcttcttcttcctccataggagccttgccatgatccgcacgagaggagcttgcctcagctgcaaaagggtcctcaatcacatcctccccactgtcctcaacctcagaaccatcgggagaacacggcaaatgggtgttgcgaaggagggtcttgatccgtcgagtgtccttcttccttgctctgcgttccttggcttgccgaactgagatggtcttgcataagttgaagatggacttgaagaacctcaaggacgagttggagtccggcttggtgacggtagcggagggaccggcacgagaagaagcacgagtggttcgtccagccggcacagcagcaaccttgatgggacggacttggtaatcggtatgtgccacctccttgtgaaacttcttcttggacacaatctcaatcatcttcataatgtaaggcccatagccaagtcctcgcttaggcatcatggagataagccggatttcttcaaagatgaagtcaaaggcgtcaaagagctgtgggtgagccttcatcttgtaaagcaaatttcttgtataggcaaggacgttgctagcatcaccttccttgggattgagagttttgcgcaagagcttgttgagataggcatagaagggaaggagacctttgatggtgcctaactcatagtccacatcttggtacaagaagtgaagagaatttgtgtccatgggcttctcatcatgaatcttgacacgattggtgcgagagcgagtcggaaaccccaaaatggcagcaaacttagcatatgtcacggagtatatgatgccatctgtcatccaatgaataatcttttctttgttgggctcaaaataaagtgtggcatagaattgtgcgaagatttctttgcaccatgggtattgcaagcccatgagttccttcaagttttgccgagcacaagcttcaatgacttcatcaataattgaatcatgcaactcctccatatacttccaatcaacccactgcataagaataggccccttcttaggtgcattcactgtctcatagtaatcctgctgaaaaaggttccaaaaccgaggatcagtggacaactgttgaaatttgtagagatctttctacgctctttctccacttcagtccacttgcggttccaccttatgactctccgatgataattaggatctctagagggagcagtgataaagaaaggcccttcttcctgagcggcttgctgagcggcaatgtcctcttctaaatgaatctcttcctcaaaggatggtgcatgagaaccactaccttgacccggctcagaagaatccgtaggattgcctctccttacttttttagcaggtgcacttgatctttctccactgactcggctgcggcgaggaggaagaggagcaccatgctccacattagccacttgagctgcttggtcagaggcttgagcttgcgcgtcaatggcatctttgcgagattcggacatacgccgtatagcatgacgagccttggaagcgggagagcgacctcgagaactcattgtcccacggcgagagtaaacttgattcttgaactgacccgtgatcatgaggatacactgatttagaacagaggataatgattaagaagaagtggaagaagaatatttaaatgtgaagcaaggagaaatttggactgggccaaaaggaggtcggatagtctgatttgacgtcggactatccggtgtacatcggactatccgacagcatatcagacaatccgacggccttttgccctagaccaacaaatctcgattcacacaaacatatccaatggaatcaaaggatcttctaggtactagatctaggcactaaaacaagaagattcaccgaaggaaatcttgaaataatacaccatgagggagatcgagggaaaacaaggaaatacctcaagaaccactaagagaatcactggggaaccagtgatttggaaggagttgagggagggaaaccaccctaaaggaaggaatagcaatcggagactccgaaacgaagatttttggtggcctagaactagggtttggagtggagaagaggggtggagagagaaacgactgagacaaatgactgaaggggtaagaaagagttacccccggggaggttaagtccccttgcccttggccccacgtcggatagtccgatttgaaatcggactgtccgattgtagtcggatagtctgacttgatgtcagacagtccgacatcctttgtggcagagacaataaaggatggctcaaggaagatttttttcaacaacattttgataggatgaactcgatggctagactattacttggacaaatgcagcanaagaaagaaaactaggcaccctcgagagagggaatgtacgaatctatagcaaattgtgcaaggaccaagattcattagagaatgagatccccgtacacatagatttcaagttatccacatagattatgactagtgtttattcatgaattgaatgttcactttgtcatgatatggcaagcaaacctattctagtaaatgaaaaacacatgcatgcaaaagatcaagccacattccgagaatccaagatatttagctcacttctcaactcacaaaacctagcttcatctagaggcttggtgaagatatccgccaattgtttgtcggttctcacatgttggatgtctatgttgcctcttgtggaatggtctctcaagaaatggtggcgaatatctatatgcttggttcgggaatgttggatggggttattggctaacttaatggcgctctcattgtcacataagagtgggattttggacacatttaggccatagtctctcaaggtttgcttcatccaaagaagttgagcacaacaactccccgtcgaaacgtattccgcttcggcggtggatggggcgacggagttttgcttcttggaagaccaagaaacaagggacctacccaagaattggcaagtacccgatgtgcttttcctatccactttgcacccggcataatccgcatcggcataaccaatgagatcaaacctcgctcccttaggataccaaagaccaagattaggtgtgtgcactaaatatctaagaattctcttcacggccacaaggtgacactccttcggagcggcttgaaatcttgcacacatgcacacactaagcataatatcgggcttagatgcacaaaggtaaataagtgagccaatgatggaacggtataccttttggtcaacgtctttaccttgctcgttgaggtcgaggtggccatttgatggcatgggagtgtggattggcttcgcattctccattccaaacttcttgagcatgtccttcaaatactttgtttggcaaatgaaggttccttccttgagttgcttgatttgaaggccgaggaagaactttaattcacccatcatggacatctcaaaacgtttggtcatcatcctactaaactcttcactaaaagacttgttagtagaaccaaatataatgtcatggacatatatttggcacacaaaaatatcattatcatgtcttttagtaaaaaaagttgaatcggctttcccgatctcaaagccgtttttcacaagaaaattgtgaagacactcataccaagctctaggggcttgcttaagcccgtagagtgccttgtggagcttgtacacgtggttgggatacttcggatcctcgaagcccggtggttgctccacgtataccaactcgttgatgggcccgttgaggaaggcgctattaacatccatttgatatagcttaaaattgaggttagtagcaaaagcaagcaatatgcgaattgactcaagtctagctattggcgcaaaagtttcaccaaaatctaatccttcgatttgggtaaacccttgcgccactaacctcgccttgttccttattacgaccccggcctcgtcttgcttattgcggaagatccactttgtgccaatcacattttgccaaggtcgctccaccaaagtccacacttcattctgggtgaaattgttcaactcctcttgcatcgccatcacccaatccggatcattaagagcttcttccacccttagaggttcaatagaagacacaaacgagtaatgctcacaaaaatttgcaatacgagaatgagtggatactcccttgttgatgtctcctaagatgttgtcggtggggtgatctcgttggatactttggtggattcttgggtgagctagatttatcggagagggtggcacttgctcgccttcttcaccttgatccaagcttgaagtggagggattgtcggcttgggttaatgtaggtggctctacttgtgttgaggaagaggccccttgttgtggctccctaggacgcacgtctccaagagccaatcttttgattgcttcgctagggtcctcctcttcacctaacacatgtgagtcgacttgctctacttgagagccgttagtttcgtcaaatgtcacatcacgcgcgatctcaacaataccggaggtgttgttgaaaacgcggtatgcgcattcatttgacccatgcccaagcaagaacccctcatcaactttaggagcaaactttgaggatctagccttcttattaagaatgtagcacttactaccgaaaacacgaaagtaagagacatttggtttgttaccggtaagaagctcatagggagtcttcttaagaaggcggtgaagatagaggcggttgatggcgtggcatgcggtgttgacggcttcggcccaaaaacagtccgatgtcttgtactcatccaacatggtcctcgccatctcgatgagagtcctattcttcctctcggctactccattttgttgaggtgaatatggagccaagaactcgtgcttgatgccttcttcatcaaggaaactctcgatgcacgtgttcttgaactccttgccgttgtcggttcgaatgttcttgatcttgaggtcgaactcgttttgggctcttcttgcaaacttcttgaagattgcttgtgtctcactcttgtcatgcaagaagaacacccacgtgaagtcatcaacaataacgagaccatatttgttacctccaatgcttagataagcaattg

SEQ ID NO: 11823 - DNA, 9859 bp, Oryza sativa
tgaggcagaagaaaaaccagaagacggaaagaaacgggtgagtgaaaactcgctttgggagatgggagaatgaatgcggtcgcgatgggcgcggggacaaacctgcggggaggtcggctaaacgaccacctcgggggcgagatgaggttcccccggcatggctcggtcccccccatcttgcggagccgtttcttctttcgctccccttcgggctgcggcgtcggcacagcaccctccgggcgcttgctgttggcacgcaccgccccgccccttggggaggagatggggggggcgtgccctcttgcttcctctttccccgggcgtcggcaggcggctgccccccgggcccccgtcgcggggcccagaagcgtgaccccctcccggggtagattgtttccctctacggttcccgccggcgccatcgtggcttcgggggacccgctcccccgacgccccgactgcctgcatgatggtcaggatgttggcgcgatccggatcgctgcagagggggaggacaccttgggggataagggatgcctccacggagctgagattcagcacccgttggaccaccatcctgaagtcctcagggacccagtcccatttgcgcccctggtgggtcctcatgaagtcctcgggcccggtgtactcccaggcaccccgggcgcgccgctggagcggcgcgatccggcgacgaaggtagtcgccgaaaaccatggcccccgtaagcccttgggatcacagacccgccaggcggtcaagaacggcgtcgtagctgtctcccagatctaccgtcgcccgccagctggaggcctgcgccgggggctggctcggaagtcggaggcgcgcttcgtcggcgaggggggtgtagaaccaattgctcttccagtcgtcccacttcttgcggaggacgcagggaatgtagcggtgcagcacctgcccccgcggctggaagtagcagccaccgaccaccgtcggcggcgacaccggctgtacagtgaagaaccaccggaacagccggagagatgggcgcaccccgatgaacatctcgcacaggtgcgcgaagatggccagcgtcattattgcgttgggggtgaggtgcgccatctggagatcataaaactccagaacatccatgaagaaattagagaatggcgggaccagcccggccattgcgaaagagaggaagaagacggaccgccccgggtagtgtggcgccaggcatccctcgcccagctcgaccacctcccggccggtggcagattccggcatgaatcggcgcggcagcccggcctgcctctcgctcacgatgcgggaaggcggcagcacgctaccatcaagcggtgcggagccccgtgccatgacgccggcggaggaggagcttgagagcgagcaagtgcggcgagggtagggcacaggaaacgaagagttagagcgcaagtggcgaaggcaaggggaatagtggcgagaggaaggaaacgaatcccttcctcggcgtctttattcccttgccagcgctatgtccggctcctcgcttcccgtgcccactaccttgccccctcgtttctcgcgcccacgcctccactaaccccactcgcccgtttgcggcgcacgcggcagatgtgcggccgtgacggttgagatggggcagatcgtgcgcgcattaactgcgttcgccaaccgagaagagcgccatcatcatgtctccaggcgaaacgaaccggcttgtcccgattcgcgcgctgctcgagtaatgcagcggtcttgaagagaccgctcattattgtcgatcggttttcccttgccgatgcgcgcgatttacgaccgctgggtttctgcccgcctgtagagaccggccccacctgtcaccaggcctaaggagtggcgtcacgcccgagcgcttccctcgaggggggcgatcgccctggcgtaacgccgggggctactgtcggtgacatgggaccgggggtatcgtgactagaggcttgggtaaccgcggtcgcccacgtggcctgaccccctcggggggggggggggttcgggcccgagggtgacgcggccacccctccctctgtctccccgaggggtcgggccgcacccgtttcggccccgagggctggggcgccccgaccccctgtggttttggcgccacgtgtgtgggttaggtgagcacagcaggcgctcacctaaccgcatttatagcgggttagacgagcgcgccacgccgcattcaatgcggcgcagcgcatgcttatccagtccgtgaccagtcgcggtgtgtgaccggtcaaagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagattcattccagacttcagcgcaagaatggcaaggaagtcgccggccattaaatgaagtttgaaatgggcgtcctccggaaaagctgacgagcggggcaggagacgtgcgcactgcttgtcaagggtcacttccggctgtagactagccctcattgtaaaaagcatgtttcctttcttaggcagctagaggcccctgtggtgacccctgaccagataaaaaggaggcccaggcctagaagaagggggattttcttgggggatttttgaggaggagcctgaactctctctggctctcgagctctctgtattccttcacatacagatccaccagaacacaggagtagggtattacgcttctcagcagcccgaacatgtctacgtcgcccgcgtcttgtgcgatccttctcgctgacattcctctgatcgagggcgaagaacctcacatagcgccctcggccgaaccggcaaaggggggcctgcgcggtcttccggtgaggggccccacgctccgtcatctggcgcgccaggtagggggcgcgcgtgtttttcgaagccctcgtcctctttcgtgtgcgccaagcttctcccgctcagcccaatggccgaacgggcagtggcgcacagcctctctccgaacgctagcggtgacgacggggagcagaacccgcgccgtcgggctcgcaccccaccgtccccctctcgccgaaatcttgggcggggggaggcgctcggggaggtcggaggatccgcgacatcgccgcccgcgggcgacgggggaggacggcgagacggggcgcgtcgccgcctcgactacggcgatggcagcacgccccagggcgcgctccaggctgcgggtgcgctcttgcgtcacccgcccgtcgtccccgatccagagactccagcccgacgttggctggatgacgtggccgacttggtcatgacggcgcagcagcgcctaggcgccggtgggcggccctccgcccccgaggcctctggcgctgccgccgccggctccacgtcgtcaaggcggagggcgcggcgagcggcggccgtcacccgccgttcgtccgccattccctcgtcaacgcctccgacccaagaagatgagcgtggggggtcggatgcccggctcgatatcgagcgccagcgcgacgatcgtcgcgccgcccacgcaacggagggcgctttctcgtccggagcgccacttcggtccgggcacgggggccggcccccgtgtccccggttggcggtgccggctgtcgagcctttgtggcgagccttcggaacgtccgttggcccccaaggttccggcccaccatcaccgaaaaatacgacggaagcgtcaaccccgccgagtttctccagatctacacgaccgggatcgaggccgccgggggtgacgacagggtcatggcgaatttcttccccatggccctgaagggtcaggcgcggggttggctaatgaacttgccacccgcgtcggtccactcctgggaggatttgtgccagcagttcaccacgaactttcagggcacatatccgcgcccaggcgaaaaagcggacttgcatgcggaacagcgagggtacgatgagtctcttcgctcgtacattcagcggttctgtcaagtccgcaacaccataccgtgcatccccgcacacgcggtgatctacgcgttcagggggggcgtgcggcacaaccgcatgctcgagaagatcgcctccaaggagccccagaccaccgcgcagctttttgagctcgcggaccgtgtggctcgcaaggaggaggcctggacctggaactcctccggctctggcgtggcagctccggccgcccccgagtccgccgctcggtcagggcggcgggacaggaggagaaagaagaagtcggcccgttccgacgacgagggtcatgtactcgccgtcgagggcgcttcgcgggccccccgaaaggggaggcctgcgagcgacaaaaagaaggaggccggcgctcccagcagggagcgcccgaccggcaagtggtgcaccgtgcacaacacctccctccacgacctcgcggactgccgcgcggtcaaaagtttggctgagcggacgaggaagtgggaggaggagaagaggcaggagcgccgtgaggcaaggccccagcggctcccgccggcaaccggcgaggtgaggccaagcagaaggcccccggcgaggatattgacgatggcgactatgacctggggttctaggagcctgaggccaccatcgccaccgtcgatgggggagcgtgcgctcacgcttctcgccgaagcctcaaggccatgaagcgagagcttctggccgcggcccctacccatgaggcgacgcggcgggcgtggtggtcggaggttgccctcaccttcgaccagaccgaccacccgccatgcgttgcccggggaggacagatcgcgatggtggtttcccccaccgtttgcaatgtgaagttggggtgtgtcctcatagacgggggtgcagccctcaacatcctttcccctgcagcctttgacgccatcaaggccccggggatggtgctccggccgtctcagccgatcatcggtgtgacgccggggcacacctggccgctgggtcatatcgacctcccggtcaccttcggtggctccgccaacttccgcatggagcgggtggacttcgatgtggcggacctcagtctgccctacaacgcggtcctggggaggcctgcattggtgaagttcatggcagcggtccactacgcttatctccagatgaagatgccgggccccggtggccccatcaccgtccatggcgacctcaaagtcgcacttgcttgtatggagcagcgcgcgtaccacctcgccgcggcgtccaagcccacgggtggcgacgaaaggctcggcacctccgtccccgccgccccgaggcagcggatggtcacgtgcgacgaggtcccggtcaaggaggttgccctgggcgacggcccgtccaagaccacacgaatcggtggtcttctggacgataaataggaagacgcgctcgtctccttcctgcgggcaaatgccgacgtcttcgcctggagaccggcggacatgcccggggtccccagggaggtgattgagcaccgtctcgccgtgcggccgggcgcaaggccggtccggcagaaagtgtggcggcaggccccggaacgtcaagccttcatccgcgaggaggtggcgcgacttctggaggccggattcatacgtgaggtcatccatccggagtggctggcgaacccggtcgtcgttcccaaggcgaacggcaagcttcggatgtgcatcgactacaccgaccttaacaagaatgcaggtcctacttttcaacgtactactcgaatttctttgggtagccaaataggacgtaatgttgaggcctatgttgatgacttggttgtgaagacgcgcaaccaagagaccttactctcggatctagcggaaactttcgaaagtctccgctccgcccgcataaagctgaaccccgacaagtgcgtgttcggcgtgcctgcgggcaagcttctcgggttcttggtctctgcccgaggcatcgaggccaaccccgagaagatacgagctatagagcggatgcgcccccccagcaagcttagggatgtgcaatacgtcaccggctacatggctaccctaagtcggttcatatcgaggctgggagagaaggcgctacccctatttaagctcctcaaacgctccgggccgtttacctggacggaggaggctgagcgggccttcactcagttgaaggcgtacctcagttctcccccagtcttggtcgtcccggagccagatgagccgttgctactctacctggcggcaaccccgcatgtggtcagcgcggcgttgatcgtggagcgcgacgaggacaaccctcactccgcgcatccccaccctgtgtcgactcgacccgggagagagcagggaagagaggcccccgagccgaacggcggcccgaggcccccgacggccggagctggccctccgcctgcttgtccgacggtgccaggcgcccccaacccccaggatggccccggggccactgcgggaaggccgcgcctgtcgccctctgaccccgaggtcgtcggcacagaagccgagtgcgccccgcgtggcctctcggacaaagagcgccctcgagatgcggcccctggcgaagaggatcggccccgccgaaaggtgcagcggcccgtctacttcgttagcgaggccctccgggacgccaagacccgataccctcaggcccagaagatgctctacgctattctgatggcttcgaggaagttgcgccattatttccaggcgcattgggtcacggtggttacgtcttaccccctcgggcaaatcttgcataaccgagagggtactggacgggtggtgagatggcaatcgaactctctgaattcgatttgcgctttgaaccacgccgcgcgatcaagagccaggccctcgccgactttgtggcggagtggaccccagctcccgagcccgtctccgcccccgaggccacctcggactcctcgcagctgcctcacaccgcctactgggtgatgcagttcgacggctccctgtctcttcagggcgccggtgcgggggtcacgttgacctcaccgagcggagacgtcctcagatatctggtccgcctcgactttcgggcgaccaacaatatggcggagtacgagggactccttgcgggactcagagtggcagctggactggggatccgccgcctcctggtgttaggcgactcccagttggtcgttaaccaggtctgtaaggagtaccggtgctctgacccgcagatggacgcttacgtgcgccaggtgcggcgtatggagcgccatttcgacgggatagagcttcggcacgtgcccagatgggataacgcggtcgccgacgaactctcaaggctcgcttcctcgcgagcccagaccccaccgggcgcctttgaagaaaggcttgcccagccgtcggcgcgacccgaccccctaggggagacggacgcgcctgaacggcccccgaggcccgtcggagtccaggcctcgggacccgaggggagcgctcccaactcccctagattgattgcttggatcactgagatccaggcatacctcgcagataagactctacccgaataccgcgaagggggtgaacgcgtccggcgcatctccaagcgctacgtgctggtggaagggaccctctatcggcgcgcggctaacgaagtcctcctgaagtgcattcctcgggaacaaggcgtcgagcttctcgccgatgtccatgaaggcgagtgcggagcccactccgcctcacgcaccttggttggcaatgcctttcgccagggtttctattggccgacggctctcaacgatgcggtcgacctggtccggcggtgcagggcgtgccagttccacgccaggcaaacccatcagccggcccaggccctgcagaccatacctctttcatggccgtttgctgtctgggggctcgatatcctgggtccgttcaggagggccccgggcgggttcgagtatctgtatgtcgctgtcgacaagttcactaagtggcccgaggcttatccggtcatcaagatcgataggcactccgtgcttaaattcataaggggcatcactgctcggttcggggtgcctaaccgtatcattacggataacggcacccagttcactagtgagctcttcggtgactactgcgaagacatgggcatcaagctttgcttcgcctcccccgcccaccccagaagcaatggccaagtggagcgcgccaacgcggaaatcctcaagggtctcaaaaccaagaccttcaacatcctcaggaagcacggcgactcgtggatcgagaagctgccagcggtactctgggcgaaccgaaccacgccaagccgagcaaccagggaaacgcctttcttcctcgtctacggcgcggaggcggtcctcccatctaagctcaccctgaggtcccctcgggtatccatgtattgcgaggctgatcaagatcagcttcgccgagacgacctcgactatttggaggagcgaaggcggcgcgcggccctccgagctgcacgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgattggcgtcccccggccgggctccgttcggctggccacgggcgacggcacagagctgcctaacccgtggaacatcgaacaccttcgtcgcttctacccctagggggggtcgggtgtcatgtcttgggctcgggccaaccccgcacccctcttgggcgtgcagggttggccgggggctaccacatgcatatacttaccttttttctcttccgtatttcaataaaagcactttcgattccctgaggactgtgtctgtgccatcgttttccttttgaagaatcttggcttgaattagcacgctcgtgctcgaccctgccctcggtggcccgggccggctaaaatcgccaaacggggcccagaaccgagccgtgccccggggcgtggtgaactccggggggggggggaatcggcaaaggcccacaatcgggtcatccataaccctcggtcaccacgctcccggcctggccagtctcgacacgtggatctcctcaggcactagccccgacccgcgccgcttgaggctggggcctgggcacgagccctcgttcaagccaagacacagaaggaccgcggcacagaccaacctcgtctcatacatacaacaaacagaactgacgtagaaattccctctttatttgattacagattaaatcagtctatacaagaagggggcccgaaggcctcggaaaaagaagaaaaagttattaagattggcgggggcctggggctcactccgacgcgcccgggtcgccggcctcgtcgtcgttgtcgttcgcaccgtcgtcaccgccctcctcgtcggagtcgagggcgaacgcgagccgaggggccgtaccctcgaagctgtggacgatgtggtcggcggcgtcccggacctgcgcgcgcgcgccgtcctcggttccgggagggaacttgtccagcgctgcccacggggagaagtcagggtccctggcctggtagcttgccagtacgagctccaccgccccccgggcaaggtccctcgaggatgacttgatcgtctcttcgagctcctcggggagccgctggagggtcccggccatctctgagaggcgctgggcgacgcccccctggttggcggtgaacttcacggtccgctcgccccataggcccacctgccgcccggcgcggtctaaacgggaga

SEQ ID NO: 11824 - DNA, 990 bp, Oryza sativa
tgtgcgctctcgcgtccagctccttcgcccgcgcctcgagctcagcagcccgctgatccagcgcggccctctcggcgcgggcgccttccagattgcggcgagcctactcctcccgcgccgcttcgcgaaggaacaggctgtccgccagccgctgcgccgcggcctcggcttcctcgagagctcgcccccgctcggtgagcacgtcctcgcggaggcggagcgcggactcctcttcggcgcaggcggcctcgtgcgccgccagtgttgcctcccgggtggcgacagcggcctcgcggtctgccaggtccttctccttcgtgtccagggcgcgggcgcgctcctccagcgccgtggcgcgagcctcaagggcctcttcgcgctgccgggacgccgcctcgatctccgccgcccgccgttcccgggcagcggcggcgtcaaggactccccgggtggcgtcgagcttcttctctagctccgccgcccggctcccgtattggaggcagaggtcgtcccgcacctcctcaagtacggcggtggcgatgagggcagtctcccgctcctcctccacctccctggcgatctccgccaggtccctacgacgggcctcgagctcggaggcgtgccggcggtgtgccttgcggcccgcctccaccatggcctccaccgagcgtcgcccctcctcgacgcgcgcccacgccgcgtcgagctccgcccgctccgcctgcagggcctccatccgggcgcttaacccgtccagcaccgtgctgttcacggcgactaaggcctgcaggaggggctccgcgctcagtggggcagcggaagacagaggggagagccgcctcggtgtgggtgccgcgcggctcggcccgccgatcgacgtgccggacccgggggcgtcccccgaagctggctcgtcccaagcatcgcccgaggggtcgggcccgagcggcgcgtccgcggcctcgtcgtgggtggcctcggaagtcgtcg

SEQ ID NO: 11825 - DNA, 1475 bp, Oryza sativa
atttccaaactttcctgatgaagcatctcttggtgggggagcacgaatcgcaaagcactacttcctccgtcccataaaaaactaatctagtatcagatatgacacatcctagtattacgaatctaaatatacatatgttcagatttattatattagaatatgtcacattcggtgatactgctatcttatttccccaagctcatgaacttgagaatagaaaaatgtcaaaagataacagggcttggtgtggcagggcaagagatgatggcaacgctagcatctccaccatcactttcttataataagtctgaggatgcacagattgggaatgatcagcaacaaccaagaggagacaatggaatagcatcggtggttacaggactactgctcttgcctcaccaactacagaacttggacatcagacactgctcaaagctgatcctgcagctcgattcatttgtaggcgacacaacacgcaacctaataagaggtgtaggaggaggattacaatacctgcgctccctccaatcattgtgtataaagcattgtcccaattttctctcctcctactcaccctccttgtcttgtttcccatttccatcctcccttcaagatctggctattattgattgtgtgagaggcatggaaactctggtacaaaacctcagctctctcactagattgtccatatgggactttggggatttaagaagcgggagcatgtgttccctcctcacccaaggccaccttagagtgctggctgtccataaaactcccgaatactttgttgggtccaagccatcggggctgcacagctctacatggatgacatcgtaggggtatttgttgagcctacttgcaggcttctctcttcatcactcaccaagttaagcttaagcatgaaccacaaggtagagcgcttcaccaaggagcaaaacatggcccttcagctgctctcctccctcgaggtccttatatttgtgcaatgctcgaagctgcagtctctccctgctgggttacatagactcaccagtctcaagagattagagatcgcatactgtccaaacattcattcgctgcccaagggctgttttccgagttcactagaagtactacatgtttatgaaagccaaagcgaagagctcaaaaggcagtgccgcaagctaaaaggaacaattgcaatcatcgaagatgaagactacttggaactggtaacaaatactcacttatttgacttagcccagttcacgttttgtttggcacaacactagtatgtcatagacgagcgcttaacatttttttttcaattagcgtgggaacttgtgacttttctagttaatatgggagctcccaagcttctagaaatagagttatgtgagaagtacacaccaaatctatgcatgctgagcttaatgaaagtaatatggtcagaaaacaaatatttacagatcaatgtatggacacaggatgctgaa

SEQ ID NO: 11826 - DNA, 1550 bp, Oryza sativa
  unsure (1)..(1550): unsure at all n locations
nnnnnnnnnnnnnnnnnnnnnnnnnnnnnnnnnnnnnnnnnnnnnnnnnnnnnnnnnnnnntgctactaactctatttctttgagtgctttgcaaaagcaaaatgagaagtttatgggactccttcacaatggcctacttaagtgccatatgggtagtaaggctctaaaagagtacctagcctatcaaagggacaacttcaaccatgagggtcttgggtatgttcctccaccaaaaggaaaggtggacaagagtgtgatgatcaagagaccccaaggtcttagcaattttgttaaggccaaaagtatccttcctaatgattatgcttcacattgttcttttgatgcatcttatgttcttaagaagaatgttagtggtcgtgttgttgctaagtatgtaggcccgaggggcaaaaatgtttccatcaagagagttctttgggtgccgaaggcacttgtcactaacttgagaggacccaagcaagtgtgggtacctaaaactagaaattgatctcttgtaggaatatctctccggtggaagaagttgggtgattgatagtggatgcacaaatcacatgaccggagaagaatcaatgttttgctcccttgatccaaatggcacttcgcaagagaacatagtctttggggacgatggaaagggaaaagtaatgggattgggtaagattgcaatctccaatgatctttccatttctaacgttctcttggtaaaatctctaaactataatctcttgtccgtttctcaattatgttccatgggctacaattgtctttttaccgatgttgatgtgaccgtatttagaagggatgactcctcgatagtctttaagggtgttctcaagggcaagctttatcttgtggatttttcctcaactaaagccaaacatgagacatgcttagtggctaagtccgacatggggtggctttggcatcggaggctagcccatattggtatgaggaatcttcactagcttctaaagcacgatcatatacttggtctaacaaatgtaccttttgagaaagatagggtgtgtagcgcgtgttaagccgggaaacaaattggagctcatcacccggtcaagaacgtaatgacaactacaagaccgttggaacttctacacatggacctctctgggcctgacggagcgtggggcccctcaccgggagaccgcgtaggcccccctttgccggttcggccgggggcgctatgtgaggttcttcgccctcgatctgaggaatgtcagcgagaaggatcgcacaagacgcgggcgacgtagacaggttcgggccgctgagaagcgtaataccctactcctgtgttctggtggatctgtatgtgaaggaatacagagagctcgagagccagagagagttcaggctcctcctcaaaaatcccccaagaaaatcccccttcttctaggcctgggcctcctttttatctggtcaggggtcaccacaggggcctctagctgcctaagaaaggaaacatgctttttacaatgagggctagtctacagccggaagtgacccttga

SEQ ID NO: 11827 - DNA, 1800 bp, Oryza sativa
tcaaatctgagggcagtaccagtgcaagcaacgcataacgtggctttagctcatccgtacagtgaaatcagtccaaagtcatctgtacagcaacgcataagccatgcagtccacaacgctcgtgatcttttttgatggctagaatatctgccgcacgcgaggcaaaagaaacatatgcgggggcacgctctcagtaacgcggacgcgtgagacgtctcctgcgccgcgcgtccttgcctgcaggcgaaggaactcgcttcccaactaaggcccgagcatctgagcagaggcacgcgttttgtcaacgtgtagatgattatccgagctggaaatctgaaggaactggccacgtcctcccactgtgaagggcctgacattgttttattgtcacaagtgagtatcgctcgaaagccactgtgcagatggattttgataaaatatcactttttaacgtgtggctagacgttataatactactccatttagaactgtatggtgacgacgaactcatcctcgtggcctgccacggtgacggttgcgggcctttcgtcgtcgcatcccacgtatatatatcacgggtgcctgctccatcctcctgttgcgggcgcccacgcggtcgctgcctgtccccacgcggtcatggcgcaacacggctcccacctcctcaccgacagctagtccagccacgtctacaccatcgcgctcctgtcccgtggcgacatctcacttcttgttataaaatcagccccgaaatcgacattggtagctaaacgcggaagaaaatactataggagattcaaaacgatgacgacaccgagacacgatatttggtaacggagttcagccgtagcctacatctccggagcactgattacgggcgctcctccccgatccagcatatacagcgtatcatagttacaatgactcacggccggtcgatgccggcagccgctccctctcgctatactaagtctccatgcggttacaataggcacgcccctctatttatgagggatcctaggatagagtccgactcatactctagtcctaatatcttttacaactccaagtcctaaactttaaccgactacgtacacatattcgacgcaaactctaacaaactctaccttggcgaatatgccacaccaacttgaatctgttacttgctcgaacctccgtgtaccaggacttgagttggttctgccgcagctcacaccgagccgctcgactagcctacgccaggcttgccgccttcaggatcgtgcacaacaacaccagcatacccatcttccatgactccacctgcaacagcactcccttgtaacttgtacaaacatgaacttgtcctctcaccagtcataacagtcttgccgtccttcatgatattcatggtcttcctattagaatccacctgatacaaccaacccgtctcatgtaggctcccaagcgaaatcaaactcttccttagtcccggcacgtgtctcacatttgaaagtagcacctcgtttccatcatacatcttgaacttgacatcgcccactccaacaacacgataactcgtgtcatcgcctaagtaaacaacaccaaaatcaccagatttgtatgaagagaaccactcccgcttcgatgtcacatgataggaactagctaagtccaacatccacgcttctccagacttctcgttagacactgtgagaatctcatgactgctgctatctgaatcatcaccacaagctgctaaacttgcaatgccacctttcctcttcttcagtaacaggcaattcctccttatatgtccaa

SEQ ID NO: 11828 - DNA, 1847 bp, Oryza sativa
aagtggtaaaatcttgatatgatgttgggtagacttaattctgaaaattttcctcaagtgttaaaatcttgatatgatgttgggtagacttaattctgaaaattttcctccattgatccttaagtagcgtagatggacaagttttgaaaagttatgcaacatactgactatagcataagatggcatagacaacaagactatgcggagtgcacgtgcttttcttaacaaatcactgaaaggggtgataaagcttccatggtattgtccaaatagcatcaatgagtgcagttttccaacatctagtctcttacttaatgtgatgaaatccttcttgatgttttcaaaagtcactctatcatttacgtccatgtcatcaaccacaatagataagtgtcttatagatggtagaatttgtatagatttgacatttgaactacatatggtaagacattcatacgatgaaaccttcaatgctaactcatgtagtaggtcatgcataacgtagtatgaagacccatcttctacatgtttttcaaaaaatccatagctaaccaaatcattcaatcggctcaatccaatgtcttcaattttctggttttgatcctgtgaatgtaggatgtctagtcctatccataagtgaattatctcatcactagcaaatttatggtcttcagggaacataccacatatatgtaaaacattgttgcaaatgaaaagggaaataatcgtagctaaactttaatgctggcataatatcattctcaccggtttgtaattcccattctttactttccaggacacttgtccaatgttccaaatcaaggtgatttttcagtaacctcccaactgttttcgctgccaaaggggaacccttcagatttttttgatatcatttttccagtctcaagtaaattagcatgatcatttgctgatttctcatcaccaaacacagatgctttgaataattcccaaaactcttgaggatcaagcccttttagttgtattggactatcaattgttttaaccatttctaccactgctagaaaatgagtggtgactagaattatgtttcccttggtttgtccttttttgagagatgctaatagatatttccattcatcctcgtggccacaattccacatatcatccaagacaagtaaaaactttgatcccaagctttgcacaatcaaatcatgcggaccactgtttttctcatctttgagttgagggatcgacttggcaatgtcttctttcaatctatacacattgaaattgggagttacacaaacccagacggtaacatcaaagtagttatgtacttctttgtatatatactgtgcgagagttgtcttccctatcccccctggaccaacaattggaatgatggtcaggtccttgtcacagtaatcaccatgagtaatgtttttaatagttgtattttttttcatccattctcccataaactgtaggatctgtaaactctgaagtggtcataggccgactgatagcaaaaccgcttggaagaacaggtgcatgccctggtttcttggaaaactcggcattgagactcatggcaatgtactggccaatgctgcgatttgattccaacaactctagattgagtatggtagagactttggcacacaatggcttcagctgttcgacaatgcgcttcattctttgggacagatccaccctatcgaacttcagctttggtgttttcatcgtatcctccctctgcaataccctgccgcaggaacaggtgcagcggaggaactggcttcctgcatgtgcacatgacgctagagttagaaaacttgtacagtacaatatcctagcagtatata

SEQ ID NO: 11829 - DNA, 5194 bp, Oryza sativa
atttagtactggatctcatcgtgcactagggaagaacgttgctagagcgatttgacgagcagcgaggtggctgagcccggccaagaggttggcgttcgcggcggtctggcaggctcgccgtgcgctcgtccttttggccgagcctcacggctcattgctagacacggcgacgagctgatgtatatatggtcaagagcaagggctgtttagcagggtgtgttctttatttcttcactatttttttttcacgaacgcgcaaaaagattgcacgtcaatatattagaaggaaaagagttcttattacacaatgcaatcagctatataggcttatgccaaggggggaagagagaaaaaaacaaaaccaaaactgcagctaggtttactatggcggctaaacgcaactccgatcagcgggaaaggatagagccacactacttatttcttcactataatctggttgtttacccagagagacatatttgccttttttttcaaaaaaaaatgttttaaaaagttttactcattaaatagggaaaaggaatcaatctacaccgttaggtcgtcatactggaagtataaattagaattgaattgtactctagagttatcaccaccgtaccgtcatgttaaggtgcaaaagagagggcatggaaagtgtttaccgatgtgatgggtgttgccgcgagcactgggagagagcttgtgcatgcagcagttgctggcaacagcctcctcgtcggcggcggcgtggagagtgcgcgacggcgacgagccgatctgacggttcatcacttgaccaccaccagcacacgaggagccgatctgacggttcttgtcttctcccgaccgccgaccgtcagcgtcagggtgatcatcaccagcgcacgggaggagcactaggttgctcgcgacgctgagggctgtatggcgagtgttgaggaagaggttgtggacgacgcagcccttggcgtgctcgtcggcggcctcgcaggtgccgtcgagctcgtcctggatgcggaagtagtcgagctcgtcgagcacgtcctcggcgtcgacgcgtcgtgggcgaggccacgcagctccaggagcagctgcctcagcgcggggctgcgggcctccctgccgccggtgccacgggcgttgtcgagcatcccctgcgcgtacagcagctccattttgacggcgccgacgttggggcagagttccttggtggccacccaggcttccacgaaccttcgggacagcgggctcagcgccttgctgaccacccgccgcgcggcgttcacggccacggattccatcgctcgatctcccccccggcgccggcgattgagcggccggagagcgcagaatgtcacggcttcgatcgtccacgatccccggctgccaccaatctccaagaatgtgcaggaacgaaagagacgacaatgcgcagagaatagtagtggcaaagcacaagcttaagctttcgttttgattccattctgctctgcacctttactctgatgaaagacaagcccccctggcactgcacgggatgccggcatcggcatctgttcgcttcgttcgagatggtccatgtctgggcacccgatgccacagcaagccaacaagcaagcgcctgttcgatgccagctccttccctttgtgctgcgtaaccaagaattttttgttcatcttcaggcttcagctgcttctgaggaagatagacaaagctggtttgcacagtacaaattttgcctgccttgagagcagcaatggagcctccttcccggttcgagaccaacaaagttgtttcacagtagatgaggcgtttgtgcaaaagtactgcagctaagcttctgttactccaagcattatccataagttggctaagataatggctcctacctaagctaaacttcagaaaatgacacaagttattgtgaaaagcattgcgacgccgaaattgtgacggagtggctatgtgtgtctggaatttgaaaaaagaatcagtagaatgctcttgaatgtatagccaaatttctttttctactagaaattgggctagttgaaaaagattaaattttctgattctggcagacaaagccagcaatagagatatagatagatctgtagaaaccaaagtggaagccagcaacaatggaaggcgtggacatgggtaaggtggcatcagttcttgagccattagctgctgaggttgagttaaatgtatgattttcacagcaaacttgtagtacctgggatgcctaaacatgccgaaacttaccatctcacggaatgtttgggctttatatccgactcattttctcggcgcgggtttgttcagcccatgagcctcctacgacgcgtaagcccattggtagcgatccaatcttggctgtttacgatggactccaaagcttaaccggaccatttgcccatcatgcggccgaatggcgctcaacggctcaacccaccagcggcgccgcgggacgctggttctaccacttcggctgcgggccgtgatcgaatggtcgtgtgtagcaaaattcctgttgggctatcgatcgccctgggcgtaggggtgggcattcggtcagaccaaaaattcggtttaggtctttggtcttttttgaaagtttggtcatctatagtgcaagaccgttcggcgttgaaaaatattgaagaccgatcaattcggtctcagtctcggttagaccgaaattttagaaatattcagaagaatcgcacaaatcctcaataaatttcagatccaaaaaaatcatacacatcaagaaaattcataaaaatcctagatcagctttcttcactatcatatactcatctagatcggctttggcaccgctcgtcgccgtcggagtggaggaggcaccatcggatgtgcccccggggtggagcctccacgcggctcgggcttggctgttggggcctgggtgtccactgaagccacgcaagaagaggaggtcgtcgtggtgtcacttgtgaggaggaggaggaggaggaggagatgctgggacgctgcagtcgtgcagaggcaccggcgacggaacaggacgccgatgtgcgagagaaaacgaggagcgctcaggtggggagagcgttaaaaaaagaggagcgctcgggtgtggcggctgggtggatgaggagaaggaaacagagagggagctagggttttattaatgttggacttgctttcttgggctgatattgggctttctgtgaaattcggtcaattcggttaatcgagggtgatgaccgaattaaccgaataaaattcggtcatctagcacataagaccgaagtactgaccgaatttctcggtctccgttttttcggtttggtctttttctgcccacccttacctgggcgatcacccctccccatatggctggctttcttttttgacaccgcattactttcctattttagtaaatttatacacctaaagtttgtacaccttaagtttacacatctaaagtttatacacctaatgattagagattcaaagtttataagtcaaaagtttatatacccaattcaaatttgaatttgaattcaaatactttttatatatagtatttctatacatctaaagtttatacacctcaagtttatagacccaaattttataagtcaaaagtttatatacccgattcaaatttgaatttgaattcaaatattaatttgaatttgaattcacatttttttatatatagtttttctatacacctaaaatttatagacccaaagtttacatacccgattcaaatttgaatttgaatctgaattcaaatattagtttatagacccaaagtttataagtcaaaagtttacatacccgtttcaaatttgaatttaaattcaaatattttttatttatagtatttctatacataattttttccaactttatattttttatttttttaaaaaaattatggtgtagtaggaagagaagaaggggaggaggaagggggagaggagcgtataggggatggggatcgatcgcccattagcgtcgccccgtgtgtagagcgcttggatgaaggagacaacgaccattaatcgagacaccttcttttctcgattccatcaatttacaccttcgtagcgacttaaaagccaatacttaaaaaaattaagttgaaaatatcttaaatttaagtttatttttctccttccaaatgttccaggtggtagtagaaagagcttcataaaacaagagtgaggaaaggaaatcctctgagtttgatgcacctctttactttggattggcatagggtcagagtttgcaatatcacgcgaatacgagcctcattacttacccatattttctaataaggcaaaatagtttattagaaaataaaagttaatttctaggttaaacttttatatatttgttcgtaacgacttaaaaaccaatgtttaaaagaattaagttgaaaatgtattaaatttaattttaaaaatttaaattttggcttttgttttgatttattaggccaaacgatgaagttctacctcgcttatggcaatcatgtttaccgggtacgatattcttattagtttttgaaactatacggtttttgggaaatctgaatttggtgccgtccgatgtagaagccattaacatactctgcttcacggttttttttcttactccccgtgtgtttagttcacgctaaaattggaggtttaggtaaaattgaaacgatgtgacggaaaagttgaaagtttgtatgtgtaggaaagttttgatgtggtgaaaaaattgaaagcttaaaggaaaagtttaaaactaaacaggctctgtttgactttgacatactctgcacttctgcagtccgcttgtttggcttgagaccaacggattcgcagttgtcactcaccgaactcattctttattttgagctgtagcgattttatgaacaacgtggcaaaccttaggacgctctcttgttttagctttgacagcagctagcttctgttcttccaagcctatccatatgttggctaaagaatacgcttccaacataagctaatcctccgaaaacgacgcaggtttgcggtggctttcaacggaaaggggcggccgctgctaggaacggatcgaaaaacgggaaaacgaaggggagaaaaacagcgggagtcgtaacgaaaccggcaggcgcactgccgagcggatcgaccc

SEQ ID NO: 11830 - DNA, 2939 bp, Oryza sativa
cttcgttttttgattccatcgctgttttgggtcttttaaattttttagcatacccacgtcccataatgtttgatattggttaatgcactaatcaacaccaccgggttagccatactctgtttgccagttcgtattgcttgctctgtttaacatactctgcagtcagcttgtcttacttgagaccaacggactccagataatatcactcagtgaactcgttctttatttcgaactagctggttcaatgattctagaaacaacttggcaacccaagctcgtctcccatttcggtttgacggcagcaaggcttctgttcttccaagcgttatccataattccatatgttggctaagaatacgcttcttacttaagctagacttcggaaaaagacgcgagttattagaaaagattgctgtggcttaatggcgtggcaagagacagaaatcgcaggctcccagcacactcccgtcataaaaaaaaacgaagagaaaaaacagcgggagagccgtatcgaaaccgtcaggccgtatggtggatccggaattccggatacataagcgctgtgccgccgccgttcgattcgatcgatccgacgcgcgcgccgcatcaccacgcgcgattgcgtggcaagctagctagcgaccgctccgccaccgttcgtcaatcgtcacagcctcccccgcccacgacggcgacgcctcgtcgcgcgcctccagatttttcttttttacccttccccaccgctcgcgcgcgcgagagccagccagaatcaatcgcgagggtgaggccggctgcgcgagacgcggggggcccctgggccctggcgtggcgagacgagacgagataaggcagcgcgagcgaggtgggattagcggatagggcttaccacttcccgacaccacccgcgaacgcgcgcgcggtgattccgttccacttgcgttactaccgggccctgcgagggcaactaggcaggcatgcaggcaggcggctgtccggatcaccggagaaacccacccgttgtttttctcctcccgtttattttctttcgctctctaatagtctaatctcgcgtacgtcgctgtcgctaaaaatcccgggggcggcgcgacgttgcgcgtggtgtagcggaactgcgtgcacagcacaggcacagcaaacaattctcggtgtggtcatgatgcctagtactactatagtaatccttcccggtcccggcgtttagcaatgaacttgacacgacgccgctagttcggcagcaagcacgttcacgcgccgtccggctcgctggacttgacgtgtggcgccggccggcggccgcgcggctgctcgatcgcgggatcgatccgttcgttcatggaggcaggccgaacccggtctgaccttagcttggccgcggcggcttctgctcctgacgccgtgacgcgtgcacactcttcggcaataatgagcctccgagtctccgacgtgtggccaggaggagagaaaaccgtagcgttcagagacggcacccggctcgccgcaaagcgtatacagcttcacgggacgcggcacatcaacctgttcagtggcgcgactccacgggcggcacgcgcgcgatacctgcgctgagccctacacgtgtgcgactgcgtggagaggagacagtgctaaccgaaataaaaaccgtgctactagtagtagcagtagtgaaattgaaatatggaaacatgattgcacagagcgtgtttactactcttattgctactagtacgtgtgtttgtagaagaccggcggaaagtgtgaggagggtgacaaggggaatccggaatccccaaatccaagcgcacggatttttggaggtcatgtgggcccaatttgttggcacaggtgtccgtagaactataacagctcggtcttttgttgcatttgcgtgtacagtactactagtaaaattgtaatggtcgtgtcatgtcgttcttgttttacttcctgtgaagttggcaacacccgacgaaggatttttgctgttttcctggtgcagattgcagaacgaagcaacagtttccatgtcgtatagtggagtactaagcagttcgttagccaaacgaagttgaactaagcatgacgacggttgagataaacctccacacaaacaggcaattcccacaaacagcctcatccctttacctcggccaacataaaaaggatactgcatccgatgtggcattcttacccgaaacagagtctcccaaaataaaacaaaccatatcatctactggtagattagtctcaaaagagctaatctactcaattttacacgtcacagagtcaaaaaaaaaactagaaaaagccaaactgaaagaaacataaaccatagccgtgcaagcaacggggcccacataaaccccccaaaaaaatcacgcaatccatccatccctccatccgcagtccgttcccttctttccccttgtataagtagcggatgccactcccgccactctgccttacacaaaacacatcaaacacaccaagctcagacaagagaagagaagagaagccaagaaatcatcatcatctcacgcatttcttgctcgaattccagctcgattgagcatcatgggttacaacgagctgattccggggttgccggaggaggtggcgagggagtgcctcatccgggtggggttcgaccagctgccggcggtgcgccgcatctcgcgccagtggaaggcggaggtggagtcgccggcgtacaaccgcctgaggaaggcggagggcctggcgcgcccggcgctcgcgctggtgcaggcgcggcgtgagctcgccgaggcgggcccggcggcggacaagcagtcgtcggccggcggtgtgccggggaactcgtaccggatggtgctgttggacccggcggaggggaggtggacgccgctgccggaggtgggtggagcgagtgggaactt

SEQ ID NO: 11831 - DNA, 6986 bp, Oryza sativa
gccatctcctccgcccccgcggcgtggcggcccgtggcgccggtgccggaggacgcgcgcaccgcggcggccgtttccgtcatccccgacggccgcgtcgtggtcatcgggtccgactgccacggcggcgaccagacggtgtacacgctgcgggaggaggccggcaagcccgcgtcgtgggcgcgcgcgccggcgccgcccgagttctccgggcacgtccaggccgcctgccttctagaaatctgaagcgtattacagaaactaaattccgtgtataattgtgtatccatctatgtacatatcacatatgtgtgagtagcagagttcgagtttgtacagcaacttttgcgaggaaaaaaaatggttaaacgagtgtatcaattttgaaatttttgatcaaatgacagtgtgtgtttgtaacaaacacacgccttttcgcagcttgtgtttgtttgtttcagtacagttggaatgttcgtggcttctagaaaccgtttcgttgcaaaaggcaagctgcttacctcgagcggagacgctctgcttcgagatcgcagtgtttggaagcttctggaatggctcaagcacagcgaatctgacaatacgacgaggaagtaatgaatcccctttgtcgtatccgaacacatcctgtgtcgtcttctcgccgcatttactgctgctcctttctttcccattcattttttttccagggccaaattcgcactgaattcatgcccacaagtacagtactccctactcctgaaacacaggaaaaatcccgttgtgcataggccatgtttagttctaaattttttttttcaaacttctaactttttatcacatcaaaccttttcatacacacaaattttctatcacatcgtactaatttcaaccaaatttccaaacttcagtgtgaactaaacacaaccatagttgaaatctagctaaataaaagcaattttacgattcttaagaagatgccatgagataccattacctatttactatgagactctaaatatacagtagaaaaagtacgcagaaacccgggtgtgtggtttcctgtctagtggaggtgaacatttttgactcaaatctgcaattaacccggtgaaagagtcggatccaatccactgcacccgacacctgagcagcgcggcaaaaccgcgcgcgagccaccataaaccgcgacaagtgggaagaatgcgatagggacaccatcggtgaagtatcccttccaagccgccagcgcttgctttgctagcttgcttattatccggttttttggaacggcggctgctgctcgacggattggtcggcgagaccaccgcagcgcagccaaatccacatccactcgcccgccgcgtacgtgatgacgacgccgctggtcgcggtcgggtggatggatatgcgccgggaaacagccggccgatctccttctccgtgtgtgctcaattaattccgcgcgttgtttggatcagatcgacgtcagtgttttttttttttttggtctgattggcctggtgagaatacccacaggggtgaaaatgaggcactgctttgactgagcactggaccagtgtggtcggccagcgtggaggtcaatgacacgtgataacttggaattcgcgctgtactacgacggattaactctactcccttcttttaaaaaaaaatcgaactaaaagacgaccccacctggtaaaatagacaatcttttttatcgagatttgctatataaaaggggttatattttctattaagtttttttatataaaaaaagtatttactctgtccttataaaaaattaaatataatatatgatatttagtactacaaatgtgtacaatcttttatacaatcaactgcaccaaccggcatgtaacctacctgcacaattgcacaaggcctacccgtctgggtgaccggcacaccgaggaccgccgatggcatgcgtgcgcacagggagcagggaacaataaacttcgatatgtaagggcttgtttggtttgaagtcaatttttgccctaccaaaatcttggtagcgccaaaatattggtaagttttagcactaccaaattgggtagtgttgaatttaaactattgtggacaaaatttggtaacaaaccaaatatgcacttgctattattaaagttactaaaattttggtagggcaataagttgatattaaacaaaacacgagataggggtgttattggctgatgattaggattggccaaattatgtctagattttttttaaaggacgaagttagtacagtattgtttatatgcccggttatgtttagccgtttacggcgagcaaagaatcagaaaccgtaatggataaaatgaatactccctctgtacgtatatataagggattatgctattttagaaagaattaagaaagtggaagggggtcaaatcattgacaaaagatggtgatcattgaggaaataaacaagtaaaagtaaaggttggagtggtatttaaactagcacatgagttgatggatggaagataaaatattgtctagggatcccaaaattccttatatatttagataaaatattagaacaatatcctttatatatttggacagagggaatacacatcaataaatagcacgtgtgagtcagtgagtatgcgacaaatttcataatgaaccgcatcaaagtaattactacctccgttctatttagatcctaggttagtacagtatattttaaaatggagaaaatagtactcccatataaaaaaatataagaagcaaccatttttccgatgttttataatacaagacacgtatatatatacatgcaattaactaatactttttttcctataagtttatttttctaaaatactccacccttaacatatctaattccattagtgtatgtggtgtatatcatggtgatataataatatttttttaatctttagcttagtggcagttgcgtcaaactccctccgtcctaaaatataagagattttagaaggatgagacatttcctccctgtctgttcgtccaaaatcgcttatattttaggactaaggaagtactccctccgtcccacaaaaaatacattcctagtatcccgaggtggaattagtggatatagagaatgactaaaatacccttaataattgaaaaaaatagtaagagtgatgtagataaagggtattgaagggaaaaaaattctcgttttacgtgctaagggtgggtagaatgatagaagtttttttttttgataaaatttaaactttagaagttgaatttgattttttttggatggagggagtatattttattttggttcgaaggaagtaccgtgctaaccatactgtcaaagcatgcagcaacaacgacaaaggtggacctcgttttttgagcggaaaaacccactatagtttggattgcaacctttggtctatactagcgctgggctttcttgggagggtgcgatctatcctaaaatctgactaaattggcccacggcaccatattatccgctctttgttttgaatgggctacgaatgtttctggtccattaggccggtagcgaatggaaatttaggtgggtcgcaagcctgcaacccccaatttggattagaaaattgggagtaagtccacttgccatccctcatctttacgtcgattttaaattgattaactaacccgcattactaaaaatttccaccaatcatcttgacaaagccactcgagttaggtcccataacagtatggatggttcttttggttgacgtggtatcctagtcgtttaaaaaaaaatatacaacatgtggggctcacatgtaatgggactcaaacctctactcgcgtatcccctctcctccccacccctctacctctcccctctcttccctaggagttcgttggcggggagaggaacgatgaccgacgagctcatccatgagaggcgacatcgacggtgggaggtcggtgacaaggggtgtccacagtaagcgatcggtggcggcagacaatcatgccaagcgtgaagaacaagcggtgggacgcaccaaactaggtgcccaacgattttcgttcctgcccacccacaccagagccatcggacgcgaggatgaactccctcaccgcgccagtgcgcgacgacaagatggaagaatgcaggacgtacctccccatgatggagacgttgaacagtgccgtggaaaggtcgcccgattgtgatgcgtaaggtaagaagtgaaggcggaggactagagttgtgttgtcgtcgggcaccacggtggcaggtagccaagccagtataagaagttgctcgtgcctacacgcattgtggctaaagagtgtacaaatggctcgcgtcggggttactgaacctggtaacgttgtgggagaactttcctaatagattgccatcgtttgggatgaatgtgcgctatggtgaatcggatttcacgacaacattccaaccggcgccacaggagagttagatggagaattgtgaagagaaggttgcctgcccattgaaagctgaaaccaagctcagaaagagaagcaacaacacgatcacaacaatccgcacgactcatccaccgtggtgcgagatgtggcagcccctggcgacggcgagtgcaagtaaattaagctcatgagctacctaattgtccatgctgttgcggtggtgatgtcagtcatggactctatgtcaacaaaaaccgctctaaaaaccattgagggagttattttgcatgattttaaattgagggagtcgttatacctgtttttacaattgagggataagaataagatctaacatatatttgagggactcaaactggacttattccttcatttaaccagtggacagaaaaaccacggcctaatagacccagacgccatgttatcagagacgagcgacatccgccaagcagacaagggtgggagtgaaaagagaactagtgaatcaactactataaagcagcaggttttataggctccttcagtcaacgccgcgttggtgggattagtgatgcgtccttttcatttgctgacacttcttgcagttacaatgattcttaattagcggttggtcaaaaacagggaccctaattagcccatagatatacatacttatttgattgcaaactggagtgttttatgaactcatcctgtgtgcaccatcttcttttttttctccttttcatttttataaaggaaagataagcaatgctgtatttttttttcaattttttgaacacactaacgacagcgcagagattcactgtatatgcagtctactattacataccaaagatatagtaaaaatttgcagcttgcatttgtgttatggatgtgatcccgttagcaactaattaattaagggcttgtttagtttgagaactgatatggtgataattttttatgattggtgggatggcatgcaatgatgcaaagggtcatctagtggcagagcccgcgatatcgttaaatccggatgactaatagtgtttttcggtgattgactagtttttaactttttataggtgtcgacggctattgataaaggagacgccagcagtcaggggcggatccaacgtgggtgcaggggggattcgagtcccctctacacaccagacccatggatacccttggagcacccctttcaattttttcaccatgaataataaactaaaggtccctatatgactggagtttaaaaaaactgtgtaattgagcccctcaattttttttttgttcctggatccgcccctgccagcagtggagctcgggtggccacctaacctgttccggaggtcgctctgcctaaaaataacatagagaatgtatatcttttgaatgttgctcacaatttgtgattttatttcgagatattgtaaatttaatttaactatgcatgttttacaaagtgatatatgatgataattaacgtctaatttcaattttctttgtaatttactatagctttttggatgtcatatgttaaaagggttaagatctgaccgaatataacatatgtctttacaagtcaaaatataattaatactggttttgaactgttaattttaaccgtgatatgaatccaatgatatagaaggacagaaaattcaataacaatttaaaaattgtgattgttttaacttttgtttttgttatgtgatgattattggcttactgcatcttactaactacttctactgtatagctaaagaaaaggaatgatatgggggaacaaaggggaggggtgcgtgctttggaagggtgggtgaggtgaaagatcgaattttggatcttttctagtctagataaatctaatgatttaaaataattagcctattggtccactctctttgtttcatattgtaaaacgttttgaattgtttttttatattagacttctttaataagtttcatcaaatttaaaagaaaactattttcaacacaaaatattaccatcaaaatattttcaatgctagattattcaataaaaatagtttagtgttatagacattgctacatttttttcataaacttaattaaacttaaacaagtttaactttaattaaaaaattaaagtgtcttataatatgaaacttatgaccttttttttaaagaatttctttctaattcgaggcatgacatgtgacagcataggagtgcccatgaggatgtttactggacttttgatgtttaccagactttatgagaaatgaatttatctcaccaaatgtgggcaataatcccataaatgatgaaccaaaagctactcctgtgatctccatgaatcgggcaccctgacgtacggaagcatattgcctcgaaaagataattattatatccattgaccatcgtcagcgatcaaaccaaagtgtctaattaaaaaaataactttcacaattcgaatgttgtcacatgtttctcgttctattttacataaagcaatacagagagagacacaggccaaaataggccat

SEQ ID NO: 11832 - DNA, 1209 bp, Oryza sativa
gcgctcgctgcctccgccgtcgccgaccgcccacactgaccgcccgtccccgcgccgtcctcgtcgtgcgcgctgcgcgagccgcgagagaaaagagcgagagagagaatagagagagaggaagaagagtatggcaggcgggtcccacaattttttattacaaaaatgctgactggattgccacatgtgcgccacgttggacaaaactactctgaattggttcgaggggggtaattcgtccggtttgcatagttgggggtgaagaatatccggttttgtggttcagggggataatttggacgaccgcgattgttcgtggggtaattcgtactttttccttttaaaataaatatgtgtgggacccacgtgtcatcctctcgggatggccctcattccgggctggataattcgggattgatttgaggcccatgcaaacaagagtttaaggtttggttaattacaatgcatggcaagcgagtcagcgagcgacgaaattacgatgcatatgctctgcgatgcgaaattaatttcgctacttacatgtcatctaagttctcctcgctagcatagtcacttccgtggcgagcggcgacggcgaggacgacgcgtccgtcgtcgtcgggtaaccctcggttcggttgttttggttgtcatggcgaccggttggcgtcgagcgcagccatcgcttcactggaatgcagctattccttcaccgtcgctagtcacatcatccaagaaccaagagctctccgccttggacgtacacgccggtgactgtgagccttcccacgtcaagctccaacctgaccttgatcctagggtcggaccgcagccacccggccaccacctccgccgcccccctgcaccgctgccgccacggcgcccagcaccgcgccttcttctccgcctcgacggcctcctccatctcccccacgaggtcctccagctcgttcgtcgccccgtccagcctcagcttccactccacgcgcgccagccgcaccttggggtcgtcgtcttcgtccacgacgtccagcgccgtcgccgcgcccgccgagcggaagcgcgcggagttgtgcctccacgatgtccagcgctgtcgccgccgccgtcgggacggaaggggccgacaaccctcggccttcacacgccgtccccgctgccgcgcccacgccgcttccaccgctccggcggcctcttcagggacttggg

SEQ ID NO: 11833 - DNA, 653 bp, Oryza sativa
ctggatacaaatgctcagtgataacagaaccatggtacttctttaggaagttagcatagaggtgcctaatgcattctctatgctcaacatgatcactaaatgcagcactaacagccttttctaaccccttgcatgcatcggttgagataactaacccttcaggacaaccaatagctctattcaattgtttcataaaccacaaccagttgttattagtttccaaatcaaaaattgcatatgatacataaaaaagccagttgtgaccatctacagaggtggctgaagctaactgtccagtgtattttctagtcaacttagttgagtctacacccacatatggcctacacccttgcaaaaagccatctatacatggttttagagctacaaacaaacgcttgaagcacattttatttcctaacttctccaattcaatttcaactatactacctggacacttcctctcaatttcagccttccagttgaaaagcaactgaaaactttcctcatatttaccatgtacctgttctagtgctaacttcatacctgaccatgcctttgaatacttcaacttgatctcatactgttcttgcagcttccctcttgcatccttagcacccttctttggattgttcttcaaccaatcaccaagccta

SEQ ID NO: 11834 - DNA, 2218 bp, Oryza sativa
gcttcatcagtgacttctacctcaggagcttcaacccctgtggcagcagtctgagaggattgaccactaacccctatggcagcaggctgagaggattggccaccaaactgtcacgtcccaaaacgactctaaaatacatcctctaaattatgcctagaataattaaaatccgtgtgaaagcctccaaaaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatggttttataaaaagaaaaaccctaaaggtcccctttccctccctccccctcttgggccggctcggcccatctcctccccctctctctcctctccccgcggcccactcggcctctccccgcgcgcgccgctgacgggcaggcccgcccgccaccctcgctgacgggtggggcccacccgtcatccccttcctcccgccgctcatgccgcctcgcccgcgccctagcgccaccgccgccgccgaatccgccgcatcccgtcgtccccgcgtgcaatcaatagggggatttattccccgtgattccctctccctttccccccatttttccctctctctctatcgagttcaaacgggcggacttgcccccgcaaatctcgccggcgccattgatggcggccgacctcccgcgccggtttccttccttccccggccgccctctctcgccccggctctatttaaaccctccccgtacctcctccgtccgtttccgcctctcgccgcccttcctcctcgccggaatcgagctcccgccgtcgctctctctctccgccgtcgccgccgagctccggtccgccgccgtcgtcgccccggaccacctcccacctcagcgccgcctccttcggcttcgccgcatcctcgccgacctcgtccaccccttcgtttcgctcaccgaccgccggaacgccgtcgaccccgtcgacccgagccgcgccgccgccttcctccgctcccgccgcctttttcgtcgtcgccgtcgacctagggtgagccgtggaccgccgcctcttttcccccttcccttcccctctctcggccgccgctccgccgtgcctatggccgccgccggcgaccataggggcgcgggcgccgcctcccgcctgctgcgccggcttggccgccctcgggcgcgccgagtggctgccgcgtggggcccggccgtcagccgcccgcgccctcggttgcggctgacgcgtggggcccacggcgccggccggtgtgagcccgggtgcacccggtccaccgtggaccgtgaggctaccgcgtgggccccactcccgtggacccggtccgcgcgtcccctcccctcggctgacgcaataaacccttttaaaattaaaatttaaatgaagaaattcgcaaatattcatttaaagagcatataaacttcaaatggccataacttggccatttgaactcggaattggaccattcaagtctctaatttttcctgaagaagtcaagaacccatttttgtgctttgttcctgcttgttatatggagtttattagagtaaaatccttttcttttccgttggtcgtgtaaacgctgcagcttcggaagatccgctcttcgtggaggttgaagccgacgtttgggaaagcgagcaaggcaagtcacatcatccttgaacatattgaatcccagtttataaaattattttgatttaaattattgcattaccgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctgattaattaggcaacattaggtggttttataactctagactttgggaatattctcatcacctggacactatggaatggttggattattgtggaattggatttgcacctccccctctattcaaaaccctcaaaatggttttaggctaggctcgggtgcatggttttgatagtagcacctcggccatataaggaccggtcttcgggcctctgttgcaaagcactaccgtacttctacatgtctagtgggta

SEQ ID NO: 11835 - DNA, 1153 bp, Oryza sativa
gcgcccttggttatgggcaagccgagcaatgtacccaaggtagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgcatagctctagaatcgtgtttacaaaatagctttgagcaactaagtgtcttttaatgctgtttactgcaaacccccttgtactcccttgcatttattctgcacttgtgggtgtgtcttgttgagtacggtggttgtactcagtcttgctcaatttttcccaaacccagaagtggagttcctagaagatgaaggctttggtgtctagctcgtgcctgccgtcaagcgcctgtggtcgtcgccctagtcttcccctctttcccgtttgtctttgtgtgtgctgggccttcgccgcccatgtaataaattaactatttacgcttccgcttgataaactctgaaatgtatcaacttttggtgtaccttgcctcctgggacaaggaataatacatgcacgtaaggaacgcccgttgggttaattccggtcgtgacacaaaccctgtggcagcaggctgagaggattggctagaggtgtcaggtggctgagtaggttttggaggcagatacaactgctcatcattaacaccaacatattcttcctaattatcaaacatgtcaggctctctaacatctgcttccactgttgtaggctgtgcagaaccatcattagtagcagcttgtctagaaccatcattgtgggaagggttctcaggtgggatgatagcaatgggctcatgcacacaacacacagaagcaacatccatgctttcctcaagaactgctacaagtaagtggaaactggcctcggttgcatacatctcgaaaatatctggcaaatcagtgtcccctatgagcctaacatcctcacccaaatttttgttaaaataccacactgagggagactggttcgagccccacttaaactcaaccctcaaactttccattaggaaatcaaacgaaaaactctctgaatcgattacccaatgcccagtgcctcctttact

SEQ ID NO: 11836 - DNA, 1308 bp, Oryza sativa
tacaagaattaaggagatttgaggtcaaaagacaagttaaggcatttgcactaagccaaatagggcagctggatgagctaaaaggatcgttgggaatttatgatcttgaaaatgcaaaggcggcagaggaggcaaaacttttaaacaaaagtcacttacacaagttaatattagattggaatgttaaccattctacaaaggattattcacaagaagaacatattcttgaaaatcttagaccacatagcaatcttcgggagctacatattcaagggcatgggggtaccacttgcccttcatggttgggtcctaacttatctatcaaaggtttgcaatcactttgtataaacggtgtatgttgggacaagtttccacctctaggggggttgtggttagttaacaagcatggtgaaaaattcctggcttgtgcaagtggccgcagcttccagtatttaaaaaggttagagctagttgctataccaagactagcaaaatgggccggaaatgatgcttgttgtgtgctctccctgttggaggagtttattgtaagagagtgcccagaactcatagagttgccattttcacattccacttgtccttggtcaagacaggagatgaacttgtctcaattctccagactacagaaccttgagattgcaaaatgcccaaagctattaccattgtctccccttccttggacaagctctccatgccatgttctgattaaagaagttggatcgctttttcatctcttggattatcagaaaaacaaccaatctgaaccagggttacaaattgagggaaaagatggccctctggatagtacattctggaagttattggctttaagtaatcttacagaactaagagagttgaagatgaagaaatgccctcctttgcctctcaaacatcttaagttgctatcagctttgaggaggctctccattactgattcaggtattgccttgttgccgactgattgtgaaagcacagtcacatatcattttctagttgagcaactcgagatctatgagtgcagtgctagtgggatagaaatgacacaactgctatcttatttccccaagctcatgaacttgagaatagaaaaatgtcaaaagataacagggcttggtgtggcagggcaagagatgatggcaacgctagcatctccaccatcactttcttataataagtctgaggatgcacagattgggaatgatcagcaacaaccaagaggagacaatggaatagcatcggtggttacaggactactgctcttgcctcaccaactacagaacttggacatca

SEQ ID NO: 11837 - DNA, 3974 bp, Oryza sativa
gggggggggggggggtttgaatcctagggttagggttaggtttcgggtatatttatttaggttaggattaatctggaccgtccattcgattggacggctcaagctgctcccacgtcgggctgcctattgggccgccgaatggaggacacaaaatggacatcaacgaagaaaggaaacaggccagaaacttaggctgcgttcgagcgcaggagaaagagagaaagatagttttgttttccgcgcgcacgcttcccgaactactaaacggtgtgttttttgtaaaaaatttctataggaaagttgctttaaaaaatcatattaatccatttttgaagtttaaaataattaatgctcaattaatcatgtgctaatggctcacctcgttttacgtatctttccaatctcctcaatcccctctttctcaaacacaccctcagggcacccacaatggttatctatagactctctataaaagatccatgtaagcatatttttctacttggaagagattaaatgaagagagagagcaaagctatctactaacctgaagatagtttatagagaaaaacgaggcaatttattagagagctatagatacccatgtagacatactattgagattgtttattattaatctagtctattgctgagatgtacatgttttatagatagcaccttactttaccattgcgggtgctcttagaatagataaaagggaaggaatataaacttttctatattcggcccaaacctaaaagggaggattttgattcctttttccaattaaataattgttaaatgatgtttgtattatttaaattagcaattaagctctgaaaattccaataaaatttcaaagagtgtaactaatcatggagaatttaataaaattaaatttaaccatgtcattttatttctcacttactttacttgtaaattgatttaattatacacctacctacttaaaaataccaaatatttcagcaaatttgtattttaattaattacataatgtaaatttttcttaacttttcctcaattttttggtctgtacattttccgttgcaacgcacgagcacttttgctagtatacaatagatattaaaagtagggaaaagctggaatacggtgcccccaactgcattcacaatttcatcctgaccgccctgtcacgcacgtgagagggaaaacagaagatttcccctttcctctctactccacgtggcctccaccgccagttgcacttttcccaccgtcggtgcaagaaaatgctcgacatcaaataatactcctgttcgcgtggaggtcagcttccgaaccaccgaagaaatcgatttggatcggtttttaaagtaaagagatacgttatacctagctttgtggttgagggatacaatttgctggtgagggatacaatttgaccggcaagagatgaggaaggcaaaatagacttactcctaacaaaaatgacaatacattgctagtacttcagtaagtcacaaatactgtaatcatgatattatttattggctcaataatcatcatttttatccttgttatttcttattgcaacataacagggaaattgaagagggtattccggtaccaataatattacatgtttgctgtgaagatcatacatttaactcagcctcagcagctaatggttcaaaaactgattccacctcacccttgtccacgtcttccagagttgctggcttccactttggattctacaaattgaaaaggaaatttagctatacgtttagtaaatatatatctatagagttcatctccaccaagtttagtaaatattatttctctcctctcttattaagacacatcacctcgattatttctagccctttgataattgatatgtggtccaaataatttccctccttttcttctcttataaagtcataccaccttagttttgtctttgatgattaatctatgttactttctttttttttttccttctctcatctagccacatcacgtaagttttgcttttgattgatcaatccatatatgatttaaattgttataaaccacaacattttaattgtttatagctttcttttttaatagtcgatcatagatgaaaattatacaaagtgtagccatcttacatgttatttcgactaatatcatacaaaactccgcagcaatgcgtggggttttatctagttctattaatcctaactctagagacataacaccattagttaaacaaaacacaccacacatgtaactatgtgcctttttatattattactaggtatatggaaaaagaacagctatgtgcctatgtctagcaaggcaaaggagagtgaactttgcaccgtgccacacatgctataatgtctgtatccctctttcccagaagtcgcacagtgcgcaagacatggttgaattctaaggtctacctctactggtttacttcttattaacaactcagagaaatgttcaaactctgtagtacgaagtgttcttcagaatttcattgacagaagtttcgatccattagtggatagctccgcgaaaagtagctcaaggcttaaatattagggagtggcaaataaacaattgattttaaacaattaagcttcttaagtttaattacaagttgaataagctggcggatgatacgccacaaaagcaactatttaatgtgacattcatagtttgtaatttgcaacccatgtgctagacatgtggccctgggacccacagacacaggaggtgtctaattatcactatggagaggcaaatgtcagaagatggatgtcctttgaattatgggaatgtgatcctaaaacatttactatacgctatggtgattataaattgtccgccaaacaatttaagtaatcggagagtaaagagatactaagtcacatggataacttgcctggtccttgtcaactaagacagcacgtacaccttcaacaaaatcatttcgaaccgatgacctcaaggcaattcgatattcaactttcataacaccagccaactgaacaaaccaaatgtcagaattagcaatgtccttgcaaaagaaaaagagaagcctgaaaataaaatagttaaccaaataaaagtattcaattgtacaggatagcagtcataccttcgatagatagtgttcattattcctatatgctgatgcaacttgagaaaaatgtttttgagttaaacatagagaaaatggagccccttttttgagtcctgccaaggcctcgttggcccattctgccactgcagacaacaatgaaaaggatacacgtgcaactagtcagtactaaactgaatttataaaacggtctcaatatagaaacactgttggcacttgtgcataaatataacaacattctcttgacgccttagcttaaaagcagagtacctgcagcatcatcactttgactacacttcttaagctcttccacagattcagcaactgatttgtcaggaccaaaggaagaaatgatatatggtaaaaacttatctagctggggccctgactctggctcgttcttgaactttgtcagcaatgactcaacatctctgtgaggatcatctgtgctgcaaaaataaaaaacacgatatcagatgtcaagacactatcaaacagaattataaccgagttttgaatgtgtcactattattctattaatgaaaaattatggaatttatacttctttaaaagaatggaatggtggaggcagtgaatctgacatcccacctactcccattgtaaattttgcaaattgccccttgaatctaaatggatagccacatataaaatcaaattaagatggatgttccctatagaaaaaggatgggtaacacatatcatggaaaatatgtttttatttattttcagtagcaaagcaggggcattcagctagtagtaattaaaagaacataatgatcttgctagcatttagtaagtttttaccaaataacagttt

SEQ ID NO: 11838 - DNA, 3837 bp, Oryza sativa
cccaacagcttccctcccagcagccgccacctcaccttcatctagatctctctcccccattgtgcagcacggctcctctcctccacctttcttctctccttgtgcacgatgcagcaagcatacaccatcatcctatcctttctctcctctattgcagccagcagcctcctctcctccaccttttctctctcatgtggcacagcagcagcaggtggtgcctctcttgatctccctgtactccccatcagcacaagaagggagagggcgatgctagggaggaccagcagcaagacaacagacttttcccctctgctctcaccctctttccttcagtttatgcctgtaaggcggaggtagcctatggcggaaggatgccttgcccttctgggaacgtcacgatgctatagcgacgccttaataaccatggcagtgaatagaaggaaatgaaaaaggcttttacacatttggagcagcaaataatttaggagagcaaataaagacagagtttagaaccaggttacatatcttgcaaaattgaacaagaactgaataatatgcaatgtccagaactcatagctcagaactacagaacaattcctatgttgtcaagctcaaaatgagttatgatgatagattattaacaaaattagtagcggaagacatggttctacagggttactgaaacaagatagtcaagaatcttaccaacagcaccacctcctggagctttggcaccaatgtaagcaaagccaacgtccgggaacaagccaataccattttctggcatagccaggagcgtcctctgtaacagtagtgcatgcgaacattttgagccttacaattcaaatactgagaatacaaatgatgaacataaaatctaaatcagagttacagaaatttcaaacttgcctcagtaataatgcggtagcggccatgccctgataatccaattccaaatcccattgtcacaccatccatcaggcatatataaggttttgtatactcatgaatcttacaaatcaaagagtactctgctgtgaagacctgaaaacaaataaagtaccttttcagtgatgtaaattttaagaacattttggacagaggacatatcaactacatccattttcccatgcaacaaaaaaaagggggaagggggagggggggggaggagtagaaaatgtgtgctactgcctactaggactaatcatgcctatagccctgtaaacaccatttgttgtgcaataataagatgcaaatggtgtctcagtgctcagcagcctaacctcaagtcatttgcaaaccagctaagcatgctgaatttcagttcccatggtactttaattaaagaagaagaaactagcatggaataaggttcagaaacccctctacgactgactactaattacctaaagttggcatcaataattaaatatgccaccagagtcatattttagattatttatgtacaaatcagctggttatgaatcatatagaagttgttctgcatagtgtgggggaaacattaagtaatttacaaaaataccattccatttttttttcaaataagtggaaatatgtttggcccaagggcatgtatccatacatgatagatgtattatgtgaattaggcatggttaatccaaagcaggttattggtcacaagtcataaccagttattttcaaacaagtgcatgcatcaaggagcacaccaaacaccgcttgtagtttgcagcagatagaagtgattgtaactgtgttggaaaatgatagtgcttcaaagtgagttggtggcggatcaaatggtgttagaaaagaaaaggatacaacagactacgatggattaaacaactgaagtctttcaactgtatgtgcattgcacaacttgagaagaataaataataaatgtcagttactaaacccacagatcagttccttctttctttttatttttatgggtaatatgaacgcaccaataatatgttttgacaacataatcaaaacccaccaataatatgtgaaaacaatgccagaatttttagatcctcatgtctcagtaggagcaggaggatgtacttgtatttttggatattgcagaatcatcagttaaatttaattatgtgttaaatctcaattattgtttagatgtatcaactacaatattaaactgcaaatcaaaattttcagaaaactatttcaatattgcatgactttcagttcgttatgaacttcatatacaaaaaacctattcagctctcctctcaaattatgattgcaatatcaattccgatatcttatatacactttttcagatacaaagagggcattataatttttagaaaatcagagcaaaatagccgcaatcaacaaaaggttttccatcatgcgatggaaactatctccaggaaagcattaatcatgctattactagacctctattatctctggcattgtgcaatcattagcaagtctcttcacatccccacctgcagtttacactaaacaatatcactatctgagcaaagcaacgattgttaacaacaccgttatactgtcacataaactgttgaacaacaaatagaaaagaaatatgagctttaaaagtaaaatcagatcaaaaacacacatgacaaaggtaaaaaccttttgcacaagtggtgtgctcttgtccttttgaatttctgctgcaacacccttaatatccatccctgcattggtcatgaatcttatttgcaaacatctccaatgctccggaaataaaaaggcgcaaaacagcatgttcaatgtacaaggcccagctttttcaacgaataaaaacagagaggtgatcaccagctgagaaggcacggggtgaactgctttccacaagaacacacttgacacttggatttgtttcccattcatcaagaaatgccttgtatcgaaggtccatttctgcaatcatatgagaccttaaatatgtgagtgaacctcagaaagctaccaatgtactcgatacacagttggtgtgcatcatttcttcagaaggttagtgtcacttatatacaaaatcaagaagggaattgttgagtaaaaaacaagggatgcttgttaaaaataaataaatatgtaatctacttttctgcaagtgaagaggacataactatcaataccataaatttatggtgtatctattagtgtctacatgacagcgctagaattgtacggagtacatgaaacccatgtaagtgcagtaagctttgcaaattcccagctccaaatgtgggtctagggctctatgctactaaccgaacgcatgaaatctgtaactgagtgtcaattttcaaaacctcaaactaaaacaatcaactggatgaaatatttaacatgcattttgactagagtgccaactgtaccaaacttcacttagctgcatgccattgagcagcaaattattttgattgctttcccatcaccactttgagctcacaaaccggactaaaaagccgcacagcatccagttaaccactaacactgtacagacatgttcaccgcacgagcaacactgattttaattcattattcgcaaccttccaaactagtgggaacgccacaaatcgtggagacctccgccgcccggcccggtcgccctactcccagtaacccaaataggaggaggaagagagagagagagagagagagagagagagagagagagagagaggagcgaccctcaccgaggttcatggcgttgagggccttggggcggtcgagggtgatgacggcgacgccgttgggggtgacgcggcccttcacgaactcctccgcggcggcggcggccatggcggcgaagcggcggaa

SEQ ID NO: 11839 - DNA, 9213 bp, Oryza sativa
tcttacattaaatatattttgataatatgtttgttttgtgttgaaaatactgctatatttttccataaacttataatatgaaatgaaggggtactggtttaccgctaatgctaaaagggagcaggtcctaagcgtcatccacaatgcaatgataattaggccattcatagtacagatcctctacttacaggtcactaatatgtggatccgctggtagagggtccatatgtcagtgacacaagttagaggatctcaatccttgcagtgaggtggcgtttggtctaaatacgccactttcgagattcccttccacgtaagcagatgttgttcatagtgagtccctcgtcctcctgttaggatttggtggccttgttagagaaaagtagaaagacgtccagcgaagcagaaaacatgagagagatgttgccatcgcggagctcccatctctgccaccctgcttcgccggtttgccgttgatcttgcctagccaaaggtgcctccggcagggagtgccctcaataactagatctcgcccgatccacctttgagaggttgctgccttgatctaaattgggaggacctcgtcaacacggtgccgcttggcatcctcgctaccgccataatgtggagagaggggagaggaggaggcaccaccttgatccgcactggctaccccgatgtgcgaactgtcatgagtttgtcggccgcaccgccacaaggctatccacctcgctctgccgggccgagcgcaaatgctaacattgtcgacctgcgctgccccgtctactcattgctccatctgctccattaggaagaagggggatggttgaggcaagaaggagtggcaaaaagggcatcgacaagagaccgctgtcctaatctgtgagttgttaggagcttattgggagagggaggtgaggaggttgtcggcatcatcgggcagccgggcaggagggatagtggaaggagatgggattccattgttctgtatcacaaacaggtggggcagcagagaacatctttgatatatttttgtttagaaaaaggtcctttatgtaaagatctaactagaaaaaaaatttatatataacaagggttgaaacaaaatatgcatgggcttaaatgacaaaattgcatgggccaatggaaacacggtgcaccgtcgagatgtgtggttctatttactttcttattatgtagaagttgagtatccagttaggtgtagactacaatgtgagtactcttatctagtggtctcatgttgccagctcggagattctaatccagatcagcactgcgtgccccacgagagcgctcgtgccttgcaggggcacggatgccttgacagccgtgcaggtctcctcctctattgtgcacgtttctttcgcgagatagctagagagagaagttgcggccgaaaagggaaaagaaaatggccggagaggacagagacaggtctagaacaacctttaaacttatcaaaatgaccttaccaccgtcaccgtcaccgggtgttgagctcgctagttggagctgtctagttccttttacgcggatctggaagtatacgacgcatatctagtatttaaacggtggcgatactgatgcaacacctacacagtggtgctcaatgattggatgaggcaacgccaacaacaatgatgcgtggaaggtcggagacggtggccctcgcctatgttcaaccttctcattgaccgcgcggtgcactaggcgagacccagcatcaactccaccaatcgccttcaactgccattgccattgtcgctgggttttaggtaggagataagcaccatggggaggggagaggagaacgatggcggtggaaagggaataggataggtgccagtcggagcccaaaggggatggggggacgggggaggggggaaggggcacgggagagctaataacctagagatggggtgctatgtgcaagcgtgctatattcaagcgcatgccccctattgcttgcctagctgcttaccaatagtacaagcgtgctacatgttagcttatgataagtgttgactgtcaaaagcctagagacaaggacaccgaccctttataattgactaaatggtaagatttgtttgaattaaagaccgtgttttttcatcccatcccagggcaccaaaacctaatggttgttctatactcaacttgtccaaacattcagcacatgtctctcctcacattacattagtgcttgagttgtttaactaggcaagaagcttaatagccgagtaggcagacgtatgaagagaagatcggtccaatgtataatactctagacttattttagtcatcgtaggtaaatttagtaattagtagcgaggggaaaagtctaaagtacttctcgttaagaatagaaaattacgtagtaggagtatcagtgtattaccacgtgataggtaagtgatattgaaagtataagacttctcgattttgttgacgtagttaagagggtagaaattaattaacttatttttattaattttgaatgctaaaaattatgttactaatgtacaatttaagattattttaattttgtcactaacttcacgagtgtattcccgcctaactaccgcatatccatttgtggtgttcattgatcttatagccaaaaccaatcattagacgagacttgatagctccattgcatccaatctcacttttggaaaacggtagttggaacctgatagcttcatctgccaatcaaggcccccccgtacgttcgtttggtcaaaaagagatacatgttttccttactagaaaaaaatgtttgtacgttgcaacgggtaaaaatattttttatcctacgcactatgctccctttaatgcccatgcgttttggaccaaacgaacgcacattccttctgtccttttcagctctagtcctagtacagtccgttatctttctctgctcggtctacctctctttggctcagtccataaatggagttgtaggcccaagtcgaacagtattatgtccgtaccattacaaagccgatcctcccatcaaatccggtaatccgctcgagctcccatagtcttataccatgacggagccgatcctcccatcaaatacggtaatccgctcgagctcgcatagttccgtacccatacgatgactaacgaagccgatcctctccatcaaatccggtcgaatctttctccatatccaaaattattgagggatttttatccacttgatcttccttttccttttttttaccaaaattaaagcaatcagcaaaacttgggataaaaaatgacgacgattaaatggttcatcaaaatcgaagcaatctgcaaaacttgagataaaaaataactatgattaaatggagattcaatctgatgaattaaagctgaatcaaaaggggaattcatggggaaaataatgagagagtagtggggaatcaattattgcaacgaataggaggaggaagcatatggggagtaaaatcaacgtggcggcggcgctgggtttggcccgataaaaaaaccgcaaaaaaatatagcgataaaagaaataaacagaaaaattggtgaaagaaaatacgcaaagaggggaaaaagaaaacggacaaagaaaacaggaaaaaaggtgaaagaaaaaaaaagaaacgggaaaagaaaataaaaggaaaaaaacaggaaaaaaaaagaaaacgaacaaaatgtagttttcttttattttcgccactttcttatggggaatcagacttttttattttaggtttttttttctatttttttatttagacggacgaaggaaacatctcttaaaatttttaagtagtaatagatacaagataatgtaattttttttattgaacttgatgattacaccaaggtaatatagaccggtggagaactcatttttattcccggttaaaaacccccactagttccggttataacaccgtgaccaacaaatcgagactaaagatctcgatcttcaagtatcgactgaaataaccggtactaaatttgcatatcaagttaaaaaaaatatgtgggatgtgagagattcgaactcaagatctctcacctcatcctacgttaccgtccctcctactacacacatctaacttggatagatattaactaaccctgtagacatcttaccggtattaaaaatatctttagtacaccaaccgagactaaagagctaccaaccgagactaaagagctagagagctctttagtcttggttagtgttaccaactggtgctaaagatgcatttttagtactagttggtaacaccaactaggactaaaaaagtttccatgaagttaaatttttagaaccgatactaaagcatatttagtaccggttcctaatctaatcaagatatttgtgattttggggaccacaataaaagattaattctctagtagtaataactaataattactccgagaatgcgctcggcctttgcctaactaggatgtatgtagctataacagaaaccaacaagtttaaaagaaagaaagtacaagcagcattaacgactaggcaaagtttgctacagaacaccgcgacttcgtggttttagctgtaggacaccgcacgaagtcacttttgagggagcgcactatgtaaatgtggtaatttaccaagggacactacatctattaaattaatattttcgtgctgactagacgagagggggcccacttttttacacagcttgaccaaattacccctcttatctcattctgatcctctcttcttccttatctattcccatctctctttcattctctcttttacacgacagcggatgcccacttagcagcggcagcgtgtgtggcctactcggcggcggctgcggcggcctgctcgacggtggtggcaaagcccggagcacatgcagcctactcagcggcggcgacgcacgcggcggtgccaagagcgcggcctactcagtagcggcggccggcggtggccgtggaccacgccagctgcaacgtgcaggtggcctagtgccggacgagcacccgctgctccagcgtgtgcttctccttcctcaacgcgacgacctctgaccgcaaccgtcatagctcgtcgcaccggtggagctcctccacggccgcccgcttcttccccgcatcgtttctcgcgatgatggtgtctttcgtctactcgacagcacacttgaacggcggttcttggccgcggccagctcgtgctcttcgccgagcggcatggaggaggggatagagagagaagagagataggagagctgatatgtgggctgaagggcatttttgacatttcacgcgatttatctctcatcttcgaccggaaattattattttaatgagtaggatgtccaccagtaaatatttaacttttgagagtgtcttccctaaaagtcacttcgtgcggtgtcctacagctaaaaccgcgaagtcacgatgtcctgtagtaaaatttccctaacaactatcaatcgtaatattagatcaccacacatgtccctgttaaaacactcttgaccacatgctccaaacatagatatgccggcaataatcaaatcctgcaaggtgcaagctgggtttctatagtataacccaagtgcgtagccaatggatagttaactagatagcctgcacgggagcgaccgcacttgtatcagaggaacatatcactccaacataacttaagcaaccagcatatacttaggtggggtttggttggagggactaaagtggggctaaactttagtccctctcacaaaaatataagtccctatacttttgtgagagggactaaatttagtccctagttcccaaacacccccttaagcaaccagcatatagcagtcgcccctaacaagatatatatggttgcagatcttcttgaacaccccaaatccaactagtgaattagcgtgaaatactaccagatggaataattccttactccacactaaatgggctaagtggcattcaaagaaaaagggtttaattgtcttcttcttcttgtgaataacaataattttaattgccttgtcaattatgtttacataaattatctttggttaacacaactccgcgacgaatgtatcaatggaaaattttaaccttcaaaggcacttttagttttcagagatttgggatgtcactatggacttcacattcaaccgtccattaagggttaagttccatataaactaatattgctcctgaattaaatcaatattagtgatgtgtgataataaattattccatgccagtaattttgatctagttagatctgttctctaaaacatctgcaatagttacctatttatacctaacaacactgtagaggaaagtgtactgttctcgtagggttacatctcccaatcatttgtctttccataatctaatttaatttagtaaccattcttaattatgtaggatccaagacaaaagagatctcatttcatcttcattaggctgtctccggccttctactgaacttgcgtgagcggctgtgaactcaaatacttattttgtattagctgtttccaaacatcatctacagtaagcaactgaaatagccacttactgagtaatactgaatttctaaaccaccttatctttaaggcggcatagtatgtctcacttggcttttttttttaccatcactctaacaacaaaaaccagagcaaaaatagtagattttttttaaaaaaattcctctcgctactgtgaagtacttcattcatgaaaaaaaaactcaatctaaatgggatgtgacatactccatccgtttcacaatgtaagtcattctagtatttcccacattcatatttatgttaatgaatatatatatatatatatatatatatatatatatatatatatatatatatatatatatatatatattcatatacatgaatacaaatatgggaaatactagaatgacttacattatgaaacaaaagaaagaatatagtataacaaatctggatacctttatatctaaatccattataccaagttggtcgtgtcacatcccccaattagattgggtcttgttttaagacgtgaataaacactaagttaattagtgtgagccctccttcaatagatagaaattttcctttccaactatggaagagatgcatatgcgtgtccaaacaccaaataatagtacattagcccgggagcaagccattggagcatactccctccgtccaaaaaaaaccaacctagaaagagtttgtttagattcgttgtactagaaagggatcctttaaggttgtcttaaaaatacccaacctaaaaaagatttgtccagattcgttgtgctaaaagagaaccctattagacttgtttttttttatggagggagtacgagactaactacaaaattttcagtctagacaatgaccaagcgggggggacatatgtcgctggactcaaactccacgacggaactggcaaacagacgacaagatctcgaccgaatctgatcgacactgggtaaggtcaggaagaacagtcttactcgtcttttttctaatccaacttaagctcagtgatgacgccaactaatctggaccgtgtttagttgtttaggtgtaaaaattttaaagtacacgggcacacatttaaagtataaaacatagactaataataaaacaaattacatattccgacggtaaactgcgagacgaatttattaagcctaattaattcattattggcaaatgtttaccatagcaccacattatcaaatcatgacgcaattatgcttaaaagattcgtctcacaatttacatgcaaactgtgtaattggtttttttcgtctatatttaatgctctatatatatatatatgcccaaacatttaatgtggtggaatttttaaaagtttaaaggtaactaaaagcaacgctggttgagttcgtggatgcgacactgccatctcgaactcttgtgcactcctctcgctcgccacacgaaacgccacaccactaacagataaaaaatagctggccaattgccacccattttgcctatgcgccatagctgagctgagctagagctctcactacagctagctaaccgagagccacacgtcggtgactcgtgacctgtggagccatgtcgccgacgccgaggccgcacttcctcgtgctcacgttcccgctccagggccacatcgcgccggcgctccgcctcgccaggcgcctgctcgccgccgcccccgacgcgctcgtcaccttctccaccgccgccgccgcgcaccgccgcatgttcgccgagggggagggcggcgacggcgacggcaggctcgagctcctcccgttctccgacggcaccgagaacgggttcgtcaagcgcggcgacgccgcggagctcggcgcgtacatggcgtcgttccacgcctcgggccggcgcagcgtcggggagatggtcgacgcgctcgcggcgcgggggcgccccgtgtctagcgtcgtttacacgctcctccttccgtgggcggccgaagtcgcgcgcgaccgcggcgtgccgtccgcgctttactggatccagcccgtcgccgtggtggccatctactgccactacttccacggcctcggcggcgttgtcgacgagcaccgccgcgaccattcgtttgtcctggagttcccgggccttccgccgatggcggccggggacctcccgtccttcctcaccgaagccaccgacccctccgactacttccacagcatcttcaccacgttccgcgacctgttcgacgccctcgacagggagacacccaaggccaccgtgctcgtcaacgtgttccaagaactcgaggcggacacgctcgccgccgttggggcgtacgacgtgctccccatcggcccggtgctcccgtccggcgacgacgccgcgctgttcaagcagaacgacgccaagtacatggagtggctcgacaccaagccggccggctcggtggtgtacgtcgcgttcgggagcttaaccgtcatggcgaaggggcaggtcgacgagctgctccatggcctcgaggagagcgggaggccgtacctctgcgtggtgcggaaggacaacaaggccgccgtggcggagacgggcgacgcgacggcggcggcggcggcgcgcaggaacggcgtggtggtggagtggtgcgaccaggtgcgcgtgctgtcgcacgccgcggtggggtgctttgtcacgc

SEQ ID NO: 11840 - DNA, 1453 bp, Oryza sativa
acgcactgcggctggaactcggtgctggagagcatcgcgtcgggcgtgcccatggtgggcgtcccgcggatgtcggaccagcagatgaacgcgcggctcgtcgagcgcgactggcgcgtcggcgtgcgcgcggaggtggacggcggcgacggcgtgctgcgcgcggcggagctgaggcggcgggtcgaggaggtgatgggagacggggaggcggcggaggtgcggcgctcggcggcggcgtggaagcgagcggtggcggaggctctagggaaaggagggtcgtcggatcgtaatctgacggccttcgtggagggtgccagaagtgtcatttgaaaacgacataatttgaaaacgttataagatgtattttaatttgaaaacgatttggggatcctagggtcttcccttgttggtttggctgtttgttcacttgtatgtacaacctctactgaactactccctccgtcctatgatataagggattttgagtttttgcttgcacggtttgactactcgtcttattcaaaaaaatttggaattattatttacttttttgtgacttactccctccgtcccaaaaaaaaggtaaaccctggattttcgtatccaactttgactgtccgtcttatatgaaatttttttataattcgtatttttattgttgttagatgataaaacatgattaatattttatacgtgacttgtctttttaatttttttcataattttttcaaataaaacggacggttaaacgttgggcacggaaactagggtttgtctttttttggacggagggagtactttattatctaaagtactttacgcacaacttttcgttttttatatttgcataattttttttaataagacgagtggtcaaacactacaagtaaaaactcaaaatcccttatattattggacggagggagtagctgccaactgggctctcattttttatgggcttttgctatattgttgggccaaattattaccaccgaactgaactacctgttgggtaagggaacatgggctttctctggtgtactttctactttggggtcccgtgggtaatataccatccctgccctcgcacccagaaatgaccagggcccccacccgcttcccctgcgggttagaattcccacccgtccctgtaggggcgggtactcaccgggtccccaaccccaaccccacgggagaaattaccacccatatatccaatcgttcgtaggctcgtagcatgtttgttctgcacaacccagatatctaattgatgacagtttgctatagttttactagctaggctatttggtgagaagccgacaagtgaacggtgcctacacattcgtagcccaataccctacctatgtactcaaccaagttcttctttagtccatggccatgtttggatccggagggctattaaatagccctccggaaccatgcttggcca

SEQ ID NO: 11841 - DNA, 2379 bp, Oryza sativa
aaatctcaaagccaacacaacccccacagatctagtcgaaccaactcgactacgatcttgtcggatccatcgaattccattgttccctttgtaacctgtgttttccatcatataatcccacgtcaactggattagggctattacctatcaaggggcctgaaccagtataatcttcgtcttttgtttgcttgatgtcgtattacgtggacccttgtaacaacgtactccaataccctctatatccggtctatgggtatcacccgtcgatagtggcgcgccaggtaggggcacttggtgctcaaggttctactactatgtcatccagcttcgtcgacaacagcgtcaacaccaacctcaaccaagtattccctgcttcaacaatgctggtgtagactcaagtcggcaaaatcgtcttcccggtttacaccacgatgccgatctcagccggtccatcagtgaccggaaacgagaacgcagtggatacaaaccaagacgactccatgtcgaaaaatcctcccgccgaggcagagaacggaacatgaacgacatctgagctcgagaaggattccaaggcgaccaaagcttgtcactccgacaagaaccacgagccgacgaggatgacttccaaagcgacaaggtcctggtgtcctatccacaaaaccaggaaacacactttgcaagcctgctgggtttttctcaacgtccgcgctgaaattcgctcctgcaaagagcgtggaattcagcgtatttctccaactcgtgatgtctattctcctattcacaagacaaagaatcacgacctctcaagctgcaaggtctttctcagcgccatgaaggcgccatctcctaaggtccaacagtcacacatcctcatcagggataaagacaaggaatgaggagcgacgccaacttcggatcgatttgttggggtaatcgacatcgatccccacgaaccatcagtcttgcacctcctcgaagactatggatcatcgacaacgagcgtgccacgggagatattggctattgatgatgtcggcacgtcacagcgcaccaatgcagaagcggagaatcaagtagccactccggcccaacacatcagagccgtcaacgctatactgagggaaaccccctacgatcccgttctgaacgatgatctcgcgcgttggacagaacgactacgggaatcagtgaccaacctcagcaacgcgttcgaagaggccgctgccgcagcgcacccagagcagccaccaactggcgatgccaatggtgaaaaccctgaacggagggaatcgcctcaacgagccacccctccacctcgcggcaccggcgatctccgtgatcacctcaacggcagccgagaggcacgacgcacacaagacaacgagaaccgttcccggcgtcatgtctcttctcggggtcatgataacaaagatcgaggagaccgttcaaacgaagactgagacggtgataaccgccacgatcacatcgatcgcgaacagcgggtgccaggcgatactggtagaggacgtccccataatgacgacgatgatggagaccggcgccgagacaacagcgggagacggcgacaggattctcgagagccaggccgacaacctcgtaatcgtacactggaaccaagcgacccatcgtcatcgtcattatcctcgtcttcctcatcatcagatagacatccatgaaggacacacgatcgccgataacccaccgcccccagcgctgggtgtagagctttcagtcgttccctgcatgatgtccgatggcctgagagattccgacctggagcaatagagaagtacgatgggagcaccgacccagaagagttccttcaagtctactccacagtactctacgttgccggagcagacgacaatgcattagcaaattatttgccaaccgcgttaaatggctctgcacgttcatggctgatgcatctcccgccctactcgatctcttcgtgggcagacctgtggcagcagttcgtcgccaacttctaaggaacctacaagcgccacgcgatcgaagacgacctacacgcgttaacacagaactcgagtgaatccttgagggaatatgttcggcgcttcaacgagtgcagaaatacaatccccgaaatcaccgacacttctataattcgcgccttcaagtcctgcgtcagagatcgctatactactcaggagttggcaacaagacgcatcacaactactcagagattgttcgaaattgttgagcgatgcgcccacgcagatgatgcgctaagacgcaagaacgataagccgaagaccgggggagagaagaaactagccacggacgcacctgagtcaagcaagaagaaaaatcgcaaaaatgggaaaaggaaagctc

SEQ ID NO: 11842 - DNA, 14555 bp, Oryza sativa
catggtgccccatacacaaaacggacagacattttttggaagattgccttgtttcaaaaagtcgctcgagaagcacattgcatttgaaaaaggcaagcgagtacgcgtggtcgaaaaggatgcggaaccggctcccaaggagtcggactcagcatatccagactctgacctccacgtttcacacatcttcggaggttccacaacgtactcctcaaagcgagaatacaagaaagtggaacgtgaagtctgttcgacatggcagggggctgcacccaagatgaagtggtctgaacagaagatagaattctcggaagaagaccaccccaagactgccgtcatcccaggacgatatccgatcgtggtcgaacccactattcggaacatcaaggtcacgcgggttctcatcgatggtggcagctcaatcaaccttcttttcgccggcactttggacgcgatgggaattccgcaaagcgaattgacaccaaccgattaaccctttcatggaattactccccagtcatcgtccaaaccattgggcaagattacgttgcctgtgactttcggccaagctaacaacttccgaatagagcagatcacctttgatgtcgctgaattcgatacagcttataacgccatcattgggagaactgcacttgcgaagtttatggccgcatctcactacgcgtatcaagtgctcaagatgccgggaccgaagggaataatcactatttaagggaatgcaaagctggcggtgcaatgcgacaaacggagcctcgacatggtcgagcaaacgcccagcccacccgccacgaccaagccacccaagaaagtgagcaagacaaacaagacgccgaaaccggacggcgcaatcaagatcgttccactctccagtgccaatcccgacaagaccgtcaagatcggggtgacactaagcgagaaataggaactcgcgctcatcaccttcctccgcgacaatgctgacgtgttcgcttggcagccgtccgacatgctgggggtccccagggaggtgattgagcacaaactcatcgtgcgacccgatgccaagccagtaaagcaaagactgcggagatttgcaccagaccgaaaacaagccatacgagaagagctcgacaaacttctcaagcctggcttcatcagagaagtactacatccagagtggctagccaatccagtcatggtgcgaaaggccaacgggaaatggagaatgtgcgtcgacttcaccgacctcaacaaggcatgtcccaaggatcacttccctcttcctcgaatagatcagctggtggactcaacagccggctgtgagctgttgagctttctcgacgcttactttggctaccaccaaatcagcatggcaaaagaagacaaagagaagacaacattcatcatgccattcggggtattttgctatgttaagatgccattcggactgataaccgcagggaatactttccagcgcacggttcagggcgcacttagcgaccagctcggcaacaatgtcgaggcatacgtcgacgacatcgttgtcaagaccaagacaagcgactcattgattgacgatctgcaggaaacgttcaacaacctccgacgatatcgcctcatgctcaatctagagaagtgcacgttcggagtaccatcgggcaagctgctcggattccttgtctccggcagaggaatagaagcaaatcccgagaagatcaaggcaatcgagaacatgaagtcgcccacaagactcaaggaaatacaaaagctaaccggatgcatggcagcactgaacaggttcgtcgttaggatgggagaacgagggcaaccctttttcgctctgctgaagaaacaagacaaatttgtatggacacaggaagccgaagaggcattcattgcactcaagcgctacctatcaaacccccctgtacttgttgctccccaacctaatgatgaattattcctctatattgccgccacgccatattccgttagcaccgtcattgttgtcgagagagagaaagtacaacgaccagtctattacgtcagcgaagctctccacgacgcaaagacaagatatccacagatccaaaagctgctttacgtggtcatcatgacatcaaggaagctacgccactactttcaagcccacagagtcacagttggctcctccttcccgctcggtgaagttgtgagaaacaaaaacgttgtcggccgcattgcgaaatgggtagtcgagctgagccagtttgatgtccactttataccacgaacagccatcaagtcccaggtactcgccgacttcgtagccgattggactatgcctgatgacaaatcagacaaccaagtcgacaacgaaacgtggacaatggcgttcaatggtgcactcaacagccaaggagcaggggcagggtttatcttgacgtctccttccggagatcaattcaagcacgcaatccacctcaacttcagggcgaccaataacacagccgaatacgagggattactcgccgggataagagctgcagccgcacttggggtcaaacgactaatcgtaaaaggagactccgagctagtcgtgaatcaggtgcacaaagattataaatgctctaaccccgagttatccaagtatctcgcagaagtcaggaaactagagaaaaggttcgatgggatcaaggttcgacacgtttaccgcaaggacaacatcgagccagatgacctagcatgacgtgcgcctaaacgagaactgctcgagcccgacacttttttggacatcctgacgaagccatcagtaaaagaggttagcggcgaagttagcccggccgccccagacattggcgcggaggccacaaaggcagaacgcgccgttgccgatatcgagatcacagatgactggcacatcccacttatgaaattcatcaacagcgaggagttgcccgaggacgatacagaggccgagaaaataacccgtaaagcaaaaatctaaagtgtggtcagcaacgatctatacaaaaaagcgccaaacggggtacttctcaaatgcgtctcgtccgacgacggcagacacctcttccttgatatacatgaaggcatctatgggtcacatgccgccggtcggacattggtcgggaaagcttttcgacaagggtttttctggccaatcgccctcaaagatgcatgcgacatggtccagcgatgtgaagcctgtcaattccacagtaaacacacaaagctacccgcgcaagtgctccagactatccctcttacttggccattctcgtgctgggcgctagatatactcgggccattcccacgaggacagggcggttacaggttcctattcgtggcgatcgacaaattcactaagtagatcgaagcagtacccacgggggaaatcaaggccgacaacgccatcaaattcatcaaggggatattttgcagatacggactatcgcaccgcatcataaccgacaacggctcccagttcatcagcaccgatttccaggattactgcatcgggctgggaatcaagatatgcttcgcctcgatctctcaccctcaaagcaacggacaagtcgagagggcaaacggcatagtactacaagggatcaaaacccgcgtctacgacaggctcatgtcacacgacaaaaaatgggtcgaagaactcccatcagtactatgggccgtacgcaccacaccgacaacatctaacaaggaaacacccttcttcctcatgtacggttccgaggccatgctccctagcgagctatgacatcagagtacacgagtacagaagtattccgacgaggatcaggaggagtagtgaaacgtcgatgtgaatctactcgaggaacatcgcgaacgagttgccgtccgagcagccaattaccaacaggccctccgccgttaccacgagaagcgcatccgagcacgcatgcttacgatcggcgactacttcctccgacgggttcaaagccaagcagggcgaaacaagctctcacccaaatgggaaggatcttacccgatcacacaagtcttgcgaccaggcgcatttaaaattgcagacggtgatggtcgcgagttggcaaattcttggaacattgaccaactacgtaaattctatgtatgagtcaatgtcatccatacctgtaagacaccttacagcatcaataaagcctattcttaggaccatattacaatcaaagtgttcctgtccgatgatcccttacccagatgacacctaacgttgaaatctatcctcatgtccctttacgccgtcttgacaaggcctccgaggaacctaagggatcttcggctggggacgcccagagccgataaggccttgtcagatcctgtagagacgaaagaccatgtaagacctggtcgtgtaagagttctcgccgtgcgtattaaccaagtcgtgtaatcggaaattaactttccaacttcacggctgggggctaggatcagtgcttattcaaccaaggcaggtcaaaggtccaagagccttatcctctgagaaaactcctccggtgacaaggctgggggctagggagagtgtacgactcaaacaaccgactaaagtcgtgaactgaggacacactcttacacacgatatccggagtaagaaatattttctaaagatagatttcttttctatttcacaaaatactccttacaattcttacacaagtctaaggctatattacactttcccctaagatatctatcacagggtacaaaggctaccaggaaggccaacgccagtccacagattagaagaccttctccgccaatggcgccatcgacttcaccaggtggtctatctctgccagagtcctccgagaacgagcaaaaccttcatggagaaaatcgatgtccagtcgcgggcgatgatctcataggcaggccaacacgtgccccccggcatatcggctcgatcgacgacactcctacttcaaggcttcgtcaatgcgcttgccgacgccctcgagctaagcataggccccgttcagccacgagatgtatctggccgccgactcctcgggatccccacgaggtactcggagctctctacagaccttggccatggacgtgcagcaactcttcaagtacgagttgaaccacacctcacgacctcggagcgtttccacagcttgctccttctttactgctagcattgttctctcaagttccgctacttcaaatttcgtcttccaatattggatacgacgatcttgcccagcaagagcactctcgagatatgctcaatgtgggaataactaagtcaagcttcacttctctttcaagaacacgactgatctaatcggaggagcaaaaagggataaagggaccactaacctaaggaagtcgtcgccatctctatccccgtgggtaggatctggtctacattgtccggcgacgcatgtggttcaaacgcaagagccggaatgatcgccaatgactcaggctgcccacgctgctggacatcctcgtcatcaacatctctacaagggacaaaaagtactcaagatcaaaatgcaagagaaagctagggtaatgactacacgcacaaaggcgatcgaaacccatcgaagttttacatagcacatctaaggagtacaagagatcctactcttcaaaaagggggagaacagattcccccaggtcgccgacttcttccatcacctccttacgcgtgccgctagccgccccctgatccaagatctcgcgcagatcgagtttaggatgcgccagcctcacacacgcaaggacatggcacgcctcggtgtagatcccgttggacgtctcctctccgatcctggccgcatgcttggagggaatctcctccatcgccgccgcgagctccgctagagaagatgtcagcgagaactcatcgggattcgccgggatggtagacttgatgccgcactacccggcgagctggtgcagaccagtataggtgacccgcaacgagccacggatttccgacaaattgttcccgagctttgacatgcggtgctcgagcccctgccattgtcgctcgttgccagccaccaactccctcatcttcttgaggtcttcacgagcttccgccaactcgtatgccagccggtcggcacgctcgtttgccgacgctgccgccgaccttgcctccgcaatctcgcgaccaatgccgcgagcaccagcttcgaggagacaccacatttcgacctggagctcctcccaggtgaggacgacagccggtggaccacgaccagccgcgggatcgctggctgggccgcttggtgtcacctcgcggctcccgggcgcaagcacgacatccgtcgaggctacagcgggagacgcaccggaagtccctccagactcatcctgcaccgccttcgcccgcgccgccctatgagacagctatggttcagacaacgctcggacaaaatcacgaaaacttaaattcacccacttacttctcgccaagtgtcacaagtcgctgttgacgtggaggtgggggagacgcgtccgaggcctggagaacagttgatgcgaagtaaggcgaaattgttctggctgtttgatcagacaacaagatagcttaccgagggggctgatgccttgcgacgatgtccgcttacagaggagaacttcctcccctttgctggaacattgccaccacttgtggtagcagcagcagcagcatcagacgcctccttggcgaccttctctttcaatgatgccaccacctgatggtccgcgagcggcccgatgatgtcagtcagaggaagagcctacgctttataaagtcacaaagcgatctcagaagaaaaacgcagaatgactactgagtacacttacattgatggcggcatcgcgttcggccgcccccttctcgcaaaggggaacgggaacattactcgccgtcgccgggccactgatcatcacctggccgacacgacgtcccacggcttcgttgctcagacctgtgaatcgagaaccaaatttcgatgagccaggaggagcgcgcacacaagcatatcaggataaatgcgagaaagataccccgaggagaaacccgggtcgcatcctccggtccagaatagtcaaaggctaggtgggcttgagcctggagtggctggattcgtctactaatgaagtcaacagcgacttcataccccgacaaaccacgcactcggagatcgtcgaccacatcgatgaacgactgaagagaaggggtcaaagggggttttgcggtccaagacgaaatcttgtctggttgttcctcaggaacaacgaagacaggatccgaatcttctatctgaagatagaacacctcgtctgccatttgctgcgagaggagggacactggaaggggatataacgcgattttaggccatcccgaagtcggaatccaacgcatccagataccctgttggattccatccaacgcaactcgtagtagaagcggaagagatcgagaaagggctctaccccaatgtaggcttcacaaagatgtgaaaaatactaaggctatagaattggggttcagatggagcaaagaaagaccatagaagtttaaaaccaagagaagaaattcagaaggtggagggagaaaaccgcagagaatgtagtcctcgatcacaaccatgcgacctaagatgggctggggttcagtacctcctgcttccctttccatggttccacgacccggaagggcgccgtcctcctgaagcttcttcagcgacacgctagtggaggatgatttgccgagatccatcgccgatcggagatcgccggagaaagggctgaggtcgacgaactagggtttcttgtgggagcggggaagacgaagaacgcttgcaggcgggaggttttcttcacaataggcgggcttcaaaatggatcccccaaaattcctttaaatagacgcactaccgacggtgcgaattccaaggaaaggagagagatagccgccggaaatttctgggtccgttacgcgcggcagtattttggacttcagtttaaattcactcgtgaccgttgggcttcacatggtgttctcgattacgtcctgtctccacggttctcgcaccgggaacaacaatagcctcgacacgagaagtcgcgaatggttacacgagttcatttaagcagaagtcgggggctactgtcagggttacgggttaggtataccctttaccctttgatatacgtcacatatcggtatggcatgcccacgcgcatacggatactctctacatacactaaggaaatctttcacggagtttacggacgaaaagagtcctatgggacaagactgggtcgtcaatgtatcgtgtagggtctgatgtctccgagttctacttggaaaccgcctgacctgcgatataaaagggacccccctggggaggacataaggcatcgaatcttagagccaacacaacccccacagcctacgaagtcgaagcctgcaggagccaaatcgtcgaggatctagtcgaaccaactcgactacgatctcgccggatccatcgagttccattgttccctttgtaacctgtgttttccatcatataatcccacatcaactggattagggctattacctatcaaggggcctgaaccagtataatcttcgtcttttgtttgcttgatgtcgtattatgtgaacccttataccaacgtaccccaataccctctatattcggtctacgggtatcacccatcaacagggtgggcattcggtctaaccgaaaattttagtctcggtcttcggtctttcggtcttttcggtctttgaaaagtgaagaccgaatttcagcgcaaaaatgttaggaccgacaaattcggtctcggtctcagtctcagtcctgaccgaaattcaacaacattttcatatatgcaaagaaataatggaaagtttcaacacaaaaatcacaaaaaaatttcgtaagcacttatgagtaaagactcttgttaggttgcatgcctagaagaagtagggatgtgaaaattagagtttaatcctattaaacatagtggattgtaggttgcatttagacgtttttttgataattctgtcttttcgatatattcggttaaccgaggatactaaccgaatagaccgaacaaaattcggtctttcactgcctaggaccgaattgatgaccgaatttctcggtctcgatcttttcggtctcggtctcggtcttttcagttcggtcttttggttcggtctttttctgcccatccctactcgtcggatcataatctgatgactttcgtggttgggaagtgccagaagtgacatttgaaaacaatttgtgtcaattataagatgtattttaattttaaatttccacctttgtagattttaatgatgaattagtcagataacaagtatatttatacattttttcattttattgattattagtgtgggtgtgggcacgagggagcgagggggagctttctaagaaattataatgtgcctattgcaaaattatcgcccttgaaaggtaggatagaaaaaacacacaagaattaaagttgtattttttaaaaaagtctatagtaaccaaaaacaccggaaatgagaagagaagaaattaactacaccacaggataattttttttctaaaaaaaatcaaaaggtcttatctcttgctttttttttggaatgtaatcctgtggaattagtccgtagaaatgcaattctatggaatatttacaatttctatatgaactaaaggggtctatagaaaaaaaaattagaaaattgaatcctctaaatattctaaaagtttctatgcagacaacataaaacatatattgtatacttggttcgttcagtccataaggtcgcatgctccatacattattgtaggactcatggaagttaaagagtggctgttttcaagacttgatcgtgttgttgactcaataatctccaacgcatagcttgaacattgttagttgtataaatattataccaatagatttacagtgtgcttttacacagcattagtactgctgtcatgaaaagtatgttttctgataaatccatggtcaaaagtttttctagctctagaaattcatggagttggggctgctgctagagtagagttattaaaatgtgacatttaattcatatcttagatcaaataaaagattgaaccattttaattcaatctacaaactctaatttctgcaagcctgcaagaattaatccaggagtttggccatgccaaacaagaatgaactttgttgtgttgtatagtgttaatttgtaaattgtattatgactacaaaagcattgtacagacggtatatatccaagtcactattacatataaaagcattgcaatatataaatgcttttttttttacaggcgatcgggcccatgcctttatttttacatgtctttagtcacagatgacatgatcggtcacctgttaaaacgtgttttggccgcctacgacaaccctatcgtagtagtaagagtataaaaggaattaagcgtatgcgaataatttctgtgcttttttttttatgacgggaatggtcctgaactcctgatccataagttttgagatgcatacaaacaaccatattactccaccacgcaagctgtcatctatggacaaatggtgaatacgtatgtatcttgatctcgtggaggttgagtcgacgtgacacttaccttgttcaatagttgatccatggtgtcgaattcacggcaccttctctttttcacattgtgacacaattttttcttttacaaaataactttatttattttctacccagaccacacataccaatataagtgaaaaaaatagaataccctctattttatcaaatccaatataattgtatcccattttatctagtccaatataattgcttttgaaagatgagttaatttaggataaataagatggtacaaaataaagttatttcggagagagagggagaagtaacctaatgcagatcctagctggagtaacattttttcttaactcctgaatgaagtagtgaatttgaagtagtgaatttttttctacctggcttactaggcgacggccggagatcgctgtctcctggcagattgaacttaattgcttggaggcaatgccgtcgagataagattttaacatgagccgcaggccggcatatatatagctgtgattatctacctgaccggcctgactctttcctactgtttctatcctgtatccacagatcgatataggtcgttttcagttcagctcatggcctagcttatcactataaacatcggtatcgtgttgccggcctagcaagtgtataattaatagtagtataagagttagtttggagcttatgattttttgaaacacagcataggaaaaacgtaatattcaagtgtatttggtacctcaaattttataaatgaaaaacaaagaaaagtattataaatgatcattaaaaaaataccactcttaactcgttactcatagctacaagctagaatactatacatgatcaaattgctttagcctccttccccatcttctctcccaactccaatgtcatatttccctctataaataccatcggcaagccactgaccgtcccgcctcctcaccttcctcctttaagttgcctcggagttggggacttggggcatgccggtcgctgtgtcggagttggaggagcctgactgccgcgccaaggctcaagaatgtcgcggcgatgtgggagtcgaaagaggccaccgttgtctgctcatccctccatcctgctgttgctcatgctccccaaccacgacggtggtgtgccgccacgtgcctctcctgctgcttgtgggcgcggaagaagtgttagagtttatatcgaatatgtgtacgtagtcggttacagtttaggacttggagttgtaaaaggtattaggactagagtatgagtcggactctatcctaggatccctcatagatagaggagcgtgcctgttataaccgcatggtgacttagcataaagagagggagcggttgtcggcatcgaccggccgtaagtcgttgtaactctgatacgctgtatatgctggatcggggaggagcgcccgtaatcagtgccccgaagatgtaggccacggctgaactccgttaccaaatatcgtgtctcggtgtcgtcatcgttttggatctcctatggcattttcttccgcgtttagctaccgatgtcgatttcggggctggttttataacaagtggtatcagagcctgcgggaggtccatggtagaggcgcgatggaggtgctccacaccgcgtagcctgctgtaatgcccagggaggggcattggcgcaaggtggagcacggcggcgatcaacggagtcttgatcggtggatcgaacacttctggcggcggccggaaccgtcgatggctgccttcaacaaggagatgactagacgtggtgctcgggttgatggcggcagaagcgattggcgatccaatcgatgggtcggacacttcgggcgggtggctcggactttccggtgagctactctcgacagggagacgtgcggccgcacgctcgggttgattgaagctggaggcgatcggcgttctcgatcggtggattcgaacactctgggcggggtggcccgggcctttcgaagagttgcgttcgacagggagatggctagacgtagcgctcgggtcgttcggcggctgggaagacggcatgcgacttgtcggcttcggctcgcgactagattgatggcgttcaatcggatgtcggagcgggtggatcctataggctgttttggaggtgttgacaggtatttccacactggaattgcttcaaaagcggcgtattagcggtggatggcagaactaagcgtagggcgtctagactagcatatgtgctagttccaaccctagagaggtctggttctactgtttctagcacagatcaagaaaatcacgatgacaacagatcagtggcactagtcattggtgtagtcggcaagtggtgtttggcagtggtgctaggttccgctggagatacgaagaagcccaggaggtcagggtcgcggcggtgtgcgcgttttgcgtcgaagccgagctggcggcggagatcagggtgatgccgagaaggagcgggctgagccaggacgtgcaaggttcggtggttgtcggattcgtgatgtagaggaagactcggccatggagttatctatgtgtcggtcacggcatggacacgaccgaagacaagctggatggataccgcgttcgacacaggagggagttggatacggattcgatttagactggaaatcggacacgtttttccccaataaaagcagcaaagggaccacgggattgtaacaacgcagtcgaaacaaatcatctagcagagggcgagattcgtacccgattttcgcagaggcaaaggtggtttgggcggcgaggtcacgggcggctggagacgcatcattgcaggcggcgcacggcggcgtggtactcggcggcgttcgtcgcagctcgggcaggagcttgcggcggcggcggcggcggttcccggcgaggaaccggcgccggacttcggtggcgggcgctcctaggtggtaggccggcggcttcccaaggcaggcgacgcggcggctcctcgcagggtcggcgcaagtgacggcggcgggaggcggcggcgccccaggcggtttctgaggcgggcggcgcagtgcttcttgcagggccgacggcgtgaggagcaggaggcggcggcgcatcgggaaaaagtggcgtgggcacggtttctaggaggagcgaggaagccaaaggaagaaggggaacagggtcgatctgtttttctttgactggtggttgaccaagtaaaagaaaccggtccggttttttggagagagaaaaaaaactggttcggtccagctggtactattcgagttagtcggtgggatcaattaatcagggcagatcaatttaacagggcaacagctgttgagttgattatcgttgatggcggcgacggtggtttccaaatttgaggtggtgaagttcgatggcaccgggaatttcgttctctggcagatgaggctgaaggatctgttggctcaacaggggatatccaaggctcttgaggagacgatgccggaaaagatggatgctggcaagtgggaggagatgaaggcgcaggcagctgcaacaatacgcttgagtctctcggattctgtcatgtatcaggtcatggatgaaaaatcactgaaggaaatttgggacaagttggcaagcctgtatatgtccaagtcgctgatgagtaagttgtatctcaaacaacagctatatggtttacagatgcaagaggagtcagatcttagaagcacgtggacgtcttcaatcagttgggtgtggatctaagtaagttagatgtgaaactggatgatgaagacaaggccataattcttctgtgctcgcttccaccgtcttatgaacatgtggtgactaccctgacgcacggcaaggatactgtcaaaactgatgagataatttcgtcgttgcttgc

SEQ ID NO: 11843 - DNA, 978 bp, Oryza sativa
gtccccaacctccttcgccgcgtccccagcctacttcgctgccgccgccgtgaggagaggggagaggagaggccaccggcggggagaagggagaagccgccggcggggagaggggagaggagaggccaccggcggggagaaaggagaagccgccggcggggagaggggaaatgcagtgtcgtcgaggagaggaggggacagccggtggagttggaagagggtgaggggcgtggtgactgagggaggtgggggattcggtgaagtagtatctgtgggtcccacaccggtgcttgccctgtagagaaagtttccttgtagctttttatcctatgtgtcatcctggtgggtgcttgcactgtgaaggcctcgtaatctggaggttgcacatggccacatggatagatcgaagagggaaattttgctccctttattgaactgtttgtagatgatatggcaacatctaaaatttaatgagatctccaattaaatttgctgttacgtcgactaatcaacatactgattgcgtcaacgccacaccaaatgacaaagctattatctgggaatataaaaaaacaacaataatccagccgttgagttcgccatcgccggcggccgccggcggaatcacctgctcgagcacaccgcctgcgtcacggccccggacgcgaacgcccggagattcctctccgacgacccgccggccgcgaccgcctccgcggcgcgctccctccatcgctccgcccgtgcccggacaccgccgtctccgccgcccgccatggcgagctccacgcaccgctgcagctcgccgcgctcgaccacgccctcgccgtccagccgcgcgcgcacgccggcgcccatgcgcgcctcgaccagccacgccaccgtcggctggtccgtccactgcggcacggccaccatcggcacgccgcgggtgatgctctccaacgccgagttccacccgcagtgcgtcacgaacca

SEQ ID NO: 11844 - DNA, 1401 bp, Oryza sativa
  unsure (1)..(1401): unsure at all n locations
agcgcgtcgaacgtgttcaccagcaccctgggcttgagctcgtcgagatcctcgaacaggtcgcgcagcatggcgagcagcaggtagtgcttgtgctccggcgagacgatggacacggcggaagggagctcgtcngacctgaggaacggcatcccggggaggcgcacgacggcgccgcgggcagggtcgttcgcgcaagaggcgaggggcctcgccatggccatggaaatagtggtagtacacggcgaacgccgccgccggctggatccagtagatcgccgaggggatccccagcgcgcgcgccacggcgggggcccaaaccacgaggaacgtgtacacgatgcacgtcaccgggcgccccctcgccgcgagagccgcgacgatggcggagagcgactcggtgcccgcggcgcgggtgcgcgccatgtagtcgtccctcgcgtgcaccccgggcttgtacccgtcgtcgtagccgtcggagtgcgggacgtacgcgacgccggtgtcgtcgacgtcctcgccggccggggacggcagggacgggaacatgaggcggtgcgcggagacggcggtggagaaggtgacgcgcgcggccggcgccgacgccatcaggcgcgcggcgaggcggcgcgccgggttgatgtggccctgtatcccgctcaccacgaagaggaagtgcggcgccggaggagggctcttctccattgccattgggatttctgatcagagcagctttgcaaagcaactgatactagcaagggctacctcaatttatatggtttggaaatggaaatggctgaatattaattgctcttgctgatgataaatccgaagctcctttgaaccctttcttttttgcctggcttttggctaaggatcgcctcccaacaaaacgcaacttgcacaggaaaaccatagtgccgaccccaacctgtgatctttgcaattctgccgatgaaacagctcttcacctctgcttccagtgcccctttgctgtggccttctggggcacgctgaatatgcaggttaatgacgcgacgttagctgagcttgcttctcttcccacaccgattcgagttccctccaagcactttttgggtattctacttgcaatgcttttggaacccgtggaatcaccaccactgggttgtcttcaggcacgaagcccctctttgcgtcgattattagtgctgtgtattgaagatgcgtccctctggagcgaaagactcaaattagaggatcggcatgtaatttcgtcctggaagaccttttttcttgagtaaagtgcacgggtggtctttaaacttgtagcggtgtgtcatataggttctaaattcttaaaatgcatatccaagtcccaaaaattttttatagtgtgtaatctaaatcccaaatcgccac

SEQ ID NO: 11845 - DNA, 6489 bp, Oryza sativa
  unsure (1)..(6489): unsure at all n locations
ccccccccccccacccccagtgaatttttttttataaaaagagagtaaatttcataaaactccatctattatggtccaaatttcatggaataaagttattttggcacgtgacatataaccctaagtgttatgttcgtaaagtttcaggaaaccatgccattaaccaaattgtggcacactctcaaagaaaattaaaaagttttacttacattgatataacatttatattatggataaacaacttacaaatttgagacgtgattgtagaacttaagagtttgatagatcaaattcaaaaagatcactagtgtggtttcgtgaaattttatagtaataatatctgaggttatatgtcatgtctcgaaacccctgaggttatatgtcatgtctcgaaacccctgtgattttactgcaatttagaccacaatacctgggttaggtgaattgagtttaaaaaaagatcctcattcctggtgtgttttgttaattcagttcttttgagttttgatcagtcacaatatgcttttgagggtttttttaatccgttgcctagtcgccgttaagcactgctgggctgtcagatttttgggccaattcgtcctttatcatcagttctccaaccatgatggccgacatccactgctcagtaagcacaatgtcgtactccttgtggagtactcattacataaaaaacaaatctagtaccggatataatatattctagtacgatgaatctaggtagatgtatatccagatttatagtattagaatgtgttatatccggtactaggttggttttttatgggatggagtgagtactccctcaaatctagaactagatgtgatatgttatagtacaatgaatctaaacagaggtgtctagattcatagtactaagttgtgtatttatattattaggttggtttttttatggtacggagagagtacttcactacgaagaaagcaaccatgcggagtagtggagccttcatgtaatcatgtagcgtatttgaacttcgaactgaatcctctttggattaactagtcgacagcaactacaaaactaatactaccacagaagtaaaatcttagagatacaaaatatttttttggccggctagctaataagaaatggagcagttttggccggctagctattaagaagtggaggtcatactcttaatacttcatccgtttcacagtgtaagttattctaacattttatacattcataatgatgttaatgaatcatactagaatatggatatgggaaatactagaatgacttacattgtgaaacggagagagtagttactaatacagagcaatcggcaatcacaatgtagtgtagatttgtttccccatcaaaattgtagtcctctctaagttgaactcacattgtaacataaggattattgtgtatatccagtggattttcctacgtaatcttacatagagttgtgtttatttcacgtcaaaatttaaaatttggttgaaattgtaacgatgtgacggaaaagttagaagtttgtgtgtaggaaagttttgatgtgatggaaaagttagaagtttgaagaaaaactttgaaactaaacagagccctagatgtaaaattggatttgatatatcactgttagcttttgttttgcaatagattttaaaatccaaattggattccatatataaccgtcatcctctatctcaatagatagagttgtaatatacaatagattttaaaaataaaattggtttttttacaacatacgtataaactagacctaccacgatataacaatacaaaaatttcatttttcttttattattaatgcagtaattcccaagtttttagaacgggcgtggtcgccgtggtggcacatttttaactatcttaataatttaatagataatacataaataaaaacagacaaacataacctcaaagcatggcgcgcataaagcgacctgctaggaaggcagctatcctccagagcaaaacctgatacttctgcttaaacagccaaatccgtacagtagttttctccacaagttatcgtagtgtgactgtatgaagtatcagactatcagtggcagaaacataattatcgttttgataattagcgattcctttagggagagaacaaaaatacagggcgccatacaattctactactcagtgcaatacaattcattgcatcttcttcctgacttcctgtagaacagaaactaccagcatttttttagctattaccatacatctcagttttttatcgatgtaaaacttctcctgaatcagtaatgggctgcaataattatctcccatataacccaacaacaaacatgtccaatcgaagctacaaattggaatgagctaaaatattaaactcattccttgtggtctctgaccttctttctcttccatttgagaaagatttgtaaagagagaccagaaaagaccatcacaacactttcccattgcttcaagagagggggtaccactgatgacngacgaatgaacatgctcatgaacttgcgggtgggggggaaggtagtgttaataaaagagccaaatccgctgatggttaggaagatgaaattctgacccacggcaccacacaagcagaacaggaaaatggcccatgccacctctgggttcttctggccaaatctcactgccttaaaaccgttggcgtaaggccaattactgaatagtaatggagcaacaaacataatcacagcattgtatatggtcccccagagattcatgccaagcattatatcccatggattagtctttggatacctgcaataacacgacattactttccatgtagataagaagatgataaaatttccagaatgctttaatatggaatggacagggtgtagttacctagactttatcaaatcttgggtcgaattggtgtaaccatcaaaagctaagttgaggaagcacaatgtgtagcccagaggcgcattagggttagcaagcttcttgatagtcttggagcttgtctgatacataggaaacaaacataatactcagaaatgaaaacacagttaacatcagcacatcacacataaaattttattaggccatctacagcttctaataacattagaggtgcagattcctagttatagtgactttgatgtggctgttttctcttctaatttgtattcatcataatacaaatgactgtaaggaacaaaacatattcttttctactttcatactacggagtgaaacagtgccaaaatgtttctgcttttgctttaggctcgtgggatattggtgaataattgaaatagattaaatctttaccttcaacaacgcaaaggatgatacacccccagcaacaagaaaggtgcaaatgtactccggaaatgtgtacttgacaccatacagtatagttcccatcagcattactgtacatattaaatcattggtcagagatatgcgcacatcactatacagactatgaaacatgaaagggctactgttaaaagttattcttaacactgattgctctattacctacaccactctgaccaccaaatatcagcactaatggaaatgctcttgtcatgaaattgatatggttttgacaaaaaaaatgcaagtattgtcgtactaacagctaaagcagccaatattgtggtgccaaaccaaaatccaattttccagtgtacttttttttttacacagaaactgctcagatgagtatacccacccaagctcaaattaatgatcagaagaactattcagatgtagataatgttctgtaaggtacattacatagcatgcatagatcaatgcaactcacctggaatcatcttagaagattttgccaggacctgttaacatagagcaaataattccttagcggtaatgtgctatttaatcaaatcagcatatattattacggcacaaaaatgagacacaaaaatgatattcagaaaacacaggcttgttgcgactgttccaataagttcaaaagataaatcaaattacattgcgcttgagccaaacacattttgatgtataactgtacattggatggttcaaagttcaatcaaaaagtttgatgaggaaatatggttctgtcttcacccatccatgcgatacagcgataagagtatcatggataatcatattttggcatttgtgcataatactcatggcataaatgttttctacgtataaaaattgctaataaacaaatgatctaaacattgtttatatgttcagatatttctgaatcagcccataagccgtctgacttggtcagaccgaaccaaattcaaaactccaagtatatcagaaccagagagtctgaattcgtaatttcactcaaccaaacttaattttcttctccaataatcactcacacatcataaattctccaaatgaccgtatctatcgcatcaatcaaggcaaaaataaggctatagaacattccaaccactgatttacttagcacagttgaacaatccaaaaatagaacattccacttcgcaggcattatactactgcgttgcctatcacccataacgaaaatggaaacatctaattacagatacaatagctgcacaaaaatgcatagagcaacaaagcaagcgaagcgagacgacaaaagggcagctgcaaccaaacctgagctgggtagctgatgaacttgagcgcctcgatccccatggccgggccgacagtgttggtgatgctgacgccccagtacttccgcagcggcgcgcggccagcggaggagctcccaccactcgaccacagcttgatcactgcgcgagcaaaaccagtgtcacaaactcctcacacgatccgcattctgcgcaatggcatgcgatgcgaccgcactggattccacacgacaggggcaggggatgagagagggaggagaggaggctcacttatgaaggaccagacgaagcagacgacgttctgcgcgaagttgaggaacgcgaggtggtcgaaccgccgcgcctccggcccgaaccgcttcgtcgacctgaacgaacggcggggagagaaaacggcgaacaattttcagaaactcgccgaagcagagcccaattcccctccgttcccgagcaccattagagagagagagagagagagggagggagggagggaggcgggcgcttacagggtttcctggaggacgccctgggtgatgtacgccgaccagatcccggcgacgcagaatgcgagcacggccacgcgcgacaccatgctccctccgccgccgtcgacgacgcgggggcggggagggcctctgcctccgcggcccttgcgcgcggtgaccatggcgcggttcggttcggtcggtgcgccgccggcgaggggggagggagatcggtgccgcggggaggaaggcggaggcgcgtgttatagaagcgggggcgcaactggggagaaggagaaggggtcgcgcgcgtcagaggggtgacgtggcgtgatgcgattggggagatgtgccacgggagacagcttattggttgggttggcgtggccgcgtggcgggggaagggaagggaaagagatccgagcgtgctgtttccgtttggtgtttcatgggccgttctcttttggattaagtccaatttgactcccttaactagtggatgagtctaattcatatccctgaactacaacaccggatatcataaccctctaactattaaaaccggtgcaatttagctctcttgacggttttgcagagcgatttcgctgatgtggcgcctacgtgacggtgttgaactggtctttatacaacgtggtgttgacgtgtcacttatgtagcattagaattaaaaaaatatatgggtcctatttgtcattcacacaaaaaaaattgtgggatccaccgccatgtaggtccacatgacatgtgccaaccactgcgcgggccatggccgtgccaacgacgggctactcctctcgccgacctccatggacctcatcgccaacacctcctcctccactccgtcgtccctgacctatcgttgccatccccgaccacctcctctctgccctcgatccctcctccctactcaacaccttcgcctcttacccggtcctctcccccttcgacttctcctccgctacgctcttcttgggcctcgccgcatcccgcatcgagcaaattcaaagaggttatccgcctcctccacctagggatgacaattttacccatgggtccaggtatccacagatacccgacccgatgggcatgggtgtgagtgtgactttttacccatgggtacgcccacccgatacccgaagacgtcatgggcaacaggcgggtttcattttttacccatgggtaacccatgcccgacccgatacatatgtattaagctaattttgactcatttcttaattcttataccctttctattggttcatttgtaatgctaactgatactaagttgtgatgtaattcaaattattgttggtaaccaataatttcgtaa

SEQ ID NO: 11846 - DNA, 3462 bp, Oryza sativa
cagagaatatgggcatggctaatggtgattggatgtgcctccgtggagcctgcaggcagcacgtgtattgtgtggtgtgtcatgtgtgtgtaagtgcaacgagaaataactagctcatgagggcaatttgttctataaattcctcctcctcctcttcttcccaacacaaaaaaatgcagcacaaaataaacagagcaacatagttatttccctcccacagcaaaaatgtggggtgatactcgtcggaggtcgacctcgtcgagacccccgcaaagacgccgccaatgctcgcctagtcttgaccataggtcggtcgatgcccaccaactatccccgggtatggacgactacaggatggatgaccgccatatggatggtttggagggagatggggatgatcctacggaacagcccatccctaaggccaacgatgacacagtcttgcccatgccgggaagcgaggccgagccatccgcaccatctacagagagagcggagtgttggcggcacttcgaaaaaatcagggtaatggtggactacaacattgtggaaaaactttgtctgcatcttctagttcaggaacaggacatctcaaacggtattatttgacgcacctcaaggataaagcaccggcaggagcaaggcaaacacagctgagcttcggacccgacggttctgtaagtacatggacttatgagccacaactagctcgagatgaaattgctcgttacatagtttcggaggacctaccgattaggatgggcgaaaggaaaaattttgagaggatgatccgaaatgctttttgtccacagtacacccaggtttcaaggaaaaccaccaagaactttattgtttcattatatcgttctaggttggatgagttgaaacgcttgttcagtattgttagcttttcttttgttgtgacatctgacatttagacatccaagcaccaaagaacctcttctgttagtgttgttgtgcattatcttgacaataatcgcacactaaataagagggttatagggttttaaatgatgtcgtcacatactagacgagccattgctgccacactactagatatactacaagaattcaatttacaatctagggtggtttctattactcttgacaatgcatcagcaaatacaatgggcatgacgattttggagccaaatctgcaaagctacattggaggttatgttatccatcaaagatgcatttgccacatcatcaacttgattgtgcaagcaggtattactagtcgttgagaatttattgaaattcattttttagtgcaaataatttatcaattttaatgcatatgtgacaaggaatttattatctatgtaggatttactgttattaccaatttacacaacaagatccgtcaagctgtttctatcatcgagggtcagtcagtgatgaaggagagattccgggactattgtcgagcaaaggataaacctgtgaggatgtttggcattgatgtgaaacatcggtggaacacaacatacctcatgctgcgtcaattgaaagggtatgaggaaataatttctgttttcattaattcattgcactttagaagtaatgataccgatgaggatggtgattgtgagattttgcttcttactgaggaagaatgggacatagcaacatgtctatgtatattcctaaagcctttttataaagctatagtcctactatctaggatttactatcctacttcttgtttggtgcttgaatgtctttggaaatcgtcccttatatttcaagaaaaccgacatgatagagttttagcttctgctgttcaaccaatgaaggaaaatttctcaaatacttcactactattccacacctttattgttttgctttggtacttgatcctcgtaaaaagttggaggtcgtggaggctgctttcatatcaataggtgatgcagtgggtcttgattattctgaagcttatcaacatgctagagatgagttgttcagggttttccgtatgtaccaaactaagctaagtgttgttcgttgggtgcctgaggaaaccccacaaaaaaagtaaagcaaatcaagtgcaatgaatttgtggaagaagatcaagggcaaggaacaagcttcctcatcaggtagcaggtcaaattggaacccagatgcggagcttaaccattacctcaacaccaatcgcacagaacatgatcgaacactagatggtgaaaatgttgatctgtttgagtggtggaaagagaaagaaaggactcttcctgtgctagctcactttgcacgggacgttctattggttctggcttcctgtgtctcttcagagcatgcattagtgaggttggaagaattatcgaagaatggaggtcatgccttgcacctgacatagttgaggcaatcttttgccttaaagacttgattgaagcatatgcaaggacgcaacaccggctagaggatccagagattgccgatgcagcggcagacgcgttggcggaatttggcatatccactgattgcggcggtgctaatcaaaattagtaatgtaatttatgtaataatgtaagcaagttgttatactatttttcttaccggggaaccctactctagggtgtaaggtttttaacgaagcaacaactttgcatccctattctgaataaatttgttttccctcaatttttacatctcaggttatttgcattcggtgtgagaacaaaaatacaatacatatttttagacgaggtaataaagtattgcagagccatctgggcgaaaaaaaagaagagtgtgaccatattgttttccctactcccaaaaattccctcctcttttcagatttccatcccaaaatttccctcctctatttcatattacaggctgctacagcagtgcagcatgaggtcattagccatcgctaagggtgcaagcggctacccacaaaacccacttataaactaaactaacccgcgaacttgtttatttcgacctataagtgggttcgcgggtgacccacttcacccatcacccatccacggtcaaaacttcccatgcaggcatgcagctagccgctagcaggtagcagcaagtagcagctcttcttcatcgcctcatcggtggcaggtagcagcaaccagcaagccagcaccagcagttggcaagattgttcgctgactgacgcggccacgtcgccgcgacgagccgacgaggaggagcagggtgcgcgtggccgtcactgccgcgtcgccgcgacgggacgacgaagccgcacgccaccactgccgcctacctgcgcccatcgccatcactgccgccgccggagtttcttctcagcgcagccggcctgctccctttcttttgggctgtgcttgtgccggcccggcacgaataggcccatcgggccattgggccgtgcttgggctgcgtccctgaagaggccgtgctagcacggcacgacacgacgagtgggcc

SEQ ID NO: 11847 - DNA, 3708 bp, Oryza sativa
agtcgacggagccggcggggctggggcgcgtgggcgcggaggtgcgcggcgcgatccagaaggcccgggtggcgaaggggtggagccaggcggagctcgccaagcgcatcaacgagcgggcgcaggtggtgcaggagtacgagagcggcaaggccgtccccgtccaggccgtgctcgccaagatggagcgcgcgctcgaggtcaagctccgcggcaaggcggtcggcgcgccggccgcgcccgccggcgccaagtgaatccttcgtggccggaatcgcacctccgatccctcctagttaggcgttgatccgtttgtgaatgtgcagtttgtttgtgttcttggcttaattttggggggaaactatgatatgctaactggctcagacgcatgtgaagtgatgatggctagaaattgaatttccgttggatttgtgaacacatagtttagttgaagcgcttttcgatccggttgtgttcaatcgtcgttgtgctctgcttctagttgtgactagctttgttctctgctcatatttcattgattgatccaagtgattcttcctgggaatcgcaagttcgcaactccgggcctccctaagttcctagttataggcgttgatccgcgttgtgaatgtacagttcgtttgtgttcttggcttggtttggggaaaccatgaatccatgatgctaactaggcgtatgtgaagtaatttctaatagaaattaaatttaccggccgaatcgttgtgctctgcttcttgtgtgttgtgcggtgcctagcttgttccctgttcatgtctcatcgacagctcaggttgctgctacctgtccggagctttggcggtccgtaaaattgatcgagtcactaactcggtgggttcaattaaccaatgtttattcgttcatttttctcggcttgaaacggatgaactccagaagagcatttttcggcttacatatttgtaacaggcttcacggctgagtttttatcttcacttttccaaccaacatctctcgtttttaaactgctaaacgatataatttttttaaaaaaattctatataaaaattattttaaaaatcatattaatcaatcgattttttaaatttattttaaaatatttaattaataatacctaaatgttgttttgttttgcatgctaggaagtgaggttttcatccctcactttcgaacagagccttaaagtatgttgattacagccactggtggatcgctgctctcgcaataggccttgtcacttaattctgccaaattatggactagttatgttttttttttctttttggtacgcagaaaaatatgtttggtttgctacattgacaaaatatgactatgctaaattatgctaaataatatttgtgtattatttgtgcggtattggaagtattggtagtagtaaactaagcgttgccaaaaattaatgcttaaaatgcaaatattttggtatggcaagttttgacttccaaggtaaaaaggagaattttggcttccaaaggtagtataaaaaggaggagaacaccaactggcatatacaaggaaaataatggataatgcaacttattgactctctgtaataatcttccaccgttacaaatactccaccacccagcaaatccaacaacaccaacatgtgtacatacgcatggccgactcgatcggcgacgagatccagaaagaactcagaaccagggggagccatggacgggggtgacgacggacttgacggcgaggaacttgtcgagcgcgtgcatgctgtcgtccttgccgaacccgctcatcttgcggccaccgaacgggcagctcctgtccatggcgaagtagcagttcacccacaccacccctgcccggatcgacctcgccatccggttcgccacgtcgatgtccctcgtcaccagccccgccgccagcccgtacctcgtcccgttcgccctctcgatcgcctcctccaccgtcctgcacccaaaattaatctctcttaccactatagtagtttcttagataataaacattttgaattgatatgacatatcatggtcagatcctctgcgatcgaaatcacgtaactttgtcacttacatgtggatccgatgatccctggatccacaagttagtgataaaggtaccgtgtatttgactagagaggatggcgatccatatatatagctgggtttacttgaacttcatcaggcacatgacggggccgaagatctcctccctcgcgatgaccatgtcgtcctgtcgttcagaatcgcaagcgaatcatcagagataagactgtgaagacacatggtgtgtccgtggtaaattttaaaggttaatttattttttatctttaccttcacattggtgaaaatggtgggctcgatgtagtaccctttcttaccgcaaggcttcccttccgtgaaaacagttgccccttctgccttgccttgctcgatgtacccgagcaccctctcatactgagccttgtccacctgtatgaacatagtagcagggcaacacagtacggtgatcagtctctggttcagatagttaatcaggcctgaatcatcactgaattattggaactcacaagaaaaaaaatgctcgttggatggatgatgattcaaatttttcggaatttaatttcagactcactcacctgtggtccttgattgaccccaagatccaaaggggcccccaccaccccactttttattggggtccgttactttttgttcaacccggcctaaattcccctcttgcacaaacacccggttcccggcaacccaggcttttccttgcaaatggatcagatcacggctatggctctcatcagtcaattcaatcaagatcacggcaatgcatggcgctctgccaattcggatgctcaccttgttgaagaagttcccgccgatggcgagctcgacggccttgtccaagtcggcgtcgtcgaagacgatgaacggggacttgccgccgagctcgagtgccaccggcttcaagttgctcttcgcggaggccttcattataagccgtccaacctcagtagatcccgtgaaagccacctgcaaaaaaaaaaaaagttgtgagaaaccgatcaatgttcatgtgctaattgacagctgaatgtatgatatcttaccacgtcaacatccatgtgagatgaaattgcagctcccgctgttgggccgaatcctgtcaccacgttgatcaccccatccggtactcctgcctgaatatcacattccgaaaaggtcagagatattcagagttttagactaccagcaatcacacagcacaaaatgcctgatgcaagaacagagctactactatatcggttttcttttttcaattttgcgtcctgttctaaattgaagaatggattaactactttcttgattttcattaacacgttttccaaactatcaaatggtatgttttgtatgaaaattttctatataaaaggtactttaaaaaaataaataaatttatttgtcaattttctataattaataattagttaatgttaatcacatttctcgtttgtgtgactaatcttacttgcttattttttttttaaaaaaaattcttacttgctttgataggtgggcgaggaacagggcgctgaggggcgtctgctcggcgggcttgacgacgacggtgcaaccggcggcgagcgccggtgagactttggagaagaacatgatg

SEQ ID NO: 11848 - DNA, 1630 bp, Oryza sativa
ggtgatttgggggaggcgatacgccgattaaagagaagcgtgcgccctgccctggccaggtgctagttgggctagccgtccttcaaatttgacagttttttttcccattcacagatttgactggtctagctgactagctagtcctttaaatttatcctaaattatagatgattttataatctgaagatgatcatttattgcccatgtacccacccctccctcccatttcaagcgcaaacatgagttgtcaaattttaattgtacgtcttattttattttttttgaaaaatagtacttttaatgttttatcatctgataataataaaaatactaatcataaaattttttaaataagacagatgattaaagttagacaaggaaactcataactacgtttaatatgggacggagggagtatactttatgagtctattaggttgatgttattttaaatctttttggtaaaattgagaaatacgtggatacatttaatttattcccaaacattggtaatgcctagataattttggtaacaatacatctatcctatcctattaaaatttgataatattaccaactcaccaaaactttggcattaccaaaattctagaaatgtttattttggtaataatttgagccagccttatatctcgcttatccactcttttatagtttattcctccacctacctatttttactttacttaatcctcacctatcatctattattcccattcgttctaaaataaacaaacatatcacacccctgtattaggtttgtttattcggatgaaaggagtaatacattattttatctcctatcatcatttttcatcacttgtacttttgctatctccttaataatcattaaaaaagggaaattattctatttgagacgagggagtatttccatcaccttactttactccaagacggcaaggcctgacaggcacccgcacatgggaaacaaacggacgagtcaaggagtgtactcatgtagtgtggtcgcgcactcacgtgattacctgaagaacttgcaaggattgggatctggtctctttttcaattcatcatcgatatgtatatatagagaagggttaattggatccatgccacgcgaattgtggcaaatcaaaaaaaaaaatgctacacctattccggaatccgggtgcaggccacaactgttttcgtcaaattggaaccatgccataatgtacgccctgcgcgcgctttgccaccgttttagggtaccgtattttcgtatggacgtttctgccctcgtgttcacgtgtgcttagaccagcttccggtccggctcgaacaacccggtcgccattcgttccccacaccgaaaccctagcttcttggaggcggcccaggcgacggcgccggcgcaatcgacggcggcggagcaggcttcggtgccggaacaaggcggtggcgcaagtcaaggcggcggcggagcaaggcggcaacggagcagggcggcggcggaggctacgacggccgaaggggaggacctccaccgatgggaggatgagtgcgcagggggcctacgcctgcatcccccaccgcgttggcaatgtatttgggcgaatcccttgtacggttgcttccaaaccgtgagtac

SEQ ID NO: 11849 - DNA, 9616 bp, Oryza sativa
  unsure (1)..(9616): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctggaagatctcctgacagagttgatactcgctccgagaaagagcgagatagaagaagactccgggacaggctgtctccagttaggcgcacggaatttcagggtaccaggcatagggaggcaggacaacatgaagagcagacccagcggagatcaagtgaacttgctttaggttccaggaatgcagatggccagcatttgacaaaggatgtgcctgactcacacaacttccctcatcgcaaaaactcgagggactccagtaaggccaatggaagtgttgagcctgaagcatcgcttgattttgagggcccaaagccccttagtgtcatcttacagcggaaaagagaggcagcatgggccaatggcacatctgcctgtagccccaaacaagataaatctgccgaggtctcacacaggcaagcttctctggctgaagctgagaaggaaggtgacaacataattagttctgatgaatacaaaagtggatctggcgatgaagaattcagagacgaaggccacatccctgtggagggccatgggcaatcttcatctcatggtgacaaacttgaggctgaagatattattgaggtggatcccgtggaaaatcaagatgctgataattatgaccagagggagggggagtcctactatgagcctatcgaaggccaggactacaaatccgatgacgagaatgcttatgaagatgatgatgaagagtatgatgacgatgatgattttgctcggaaagtaggggttgttttctcttgagctctgtgggccttctcctggttttgttgcatgcagcaaagctgaaaatgcttgccttagtgaatctatttggataaattcctctggtgctttgtgttttgttcttgaagttcatagtgccaaagcctttatttataaggctgataactgataagtataggtcaggtatgaagcgggggtaggattcataaattaaaagggctttacgtgtaaaaactgctgcactcgttgtgttcagcatatatctgatctatcctgaaactattgtattgtattagtttcctaactaacagacaagatatttctttgataaattttttgcctgatatgggtaatataatcagccccattttggaggggttcttttcttcacgaaagagtaatgtgtgattgtacatatgtggttcctcagttttcctaagattcttaagatggcatcagcctctgaacgagggaaggaactattttatcaggtcaactaatttggccgtctgggactctgtaaaattttgctgcttcattcaaatataatcatcttataatcataacgaactattttatcaggttaacggagtgtgattctcaactcacgatcatctctatctctactaattgaaaatgtttttgctagtactttaatatatcatccgtgtatgagtcggtttttaagtttgtttgattttggaaatacacatccgttcagtcgggttttaaattcgtttgcttttaaaaatatcgaaggagtcatataagatatctctttaaaaatctcacatgctaacttgagatgatcaaactcctaattgcaactcatgattttctagaaaaatatatatccaagccgcgaattcctagagtgaatatcatcttaactaataaatcgtataacaacaataaattaaagagtaacgtgtacgaacattccttaaacttgtaggggtgtgtcatctaggtccctgaactctcaaaatacatatccaaatcctagaacttgtcataatgtgttatctaggtctcaaatcgtcataaccccttcaaaaatctacgaggcattgatgtgacatgccacacagacatgacatggcattattttttctttttctttttttcttctcttttttcccatttattctcttttctctatgacccgtgtagaaaaaaagaaaaaaaagaatgggaagaaaccgaaaaagaaaaataaaagaagaaaaaaaaagagaaaaagacatgtcacgtccatgtggcattgccacatcagcgtcacgtaggattctagaggggatgtatcaatttgggacatagatgatacactttgacaagttatgggacctggatatgtattttgagattttagagacctttataacataaccttacgagtttaaggactgccaatgcactttactctaaattaaaataaccttcacccgttgtaacgcgcgagcttatttttttctctagtcttaattagtatcttttaaatatactcgtgatcgtgccgcgcctactggatctctgcttctgaccaaaatgttccgcattgaatcatcacaggactgaaaatcaatcctcgcaaaccacgagattatcagtatattaagtctcctgggaagctcacatgtatacccttgcaaactgtactgctatatgctaaattatctgcctgcatgatcattgaacgcaatcgtgagattctatggccttcttaagagcaacaaatgcacacctttctggacggggaaaccaacaaccaaatgcatatattgttgcacatcatcaaatgcccttcaaaattgtattagggcgcatgtgtatttcttccgttagatcaaaaattacaattcaaattaaaattcaaaaagagagagagagagagagagagaggattgagagagtaatcctgaaatgcaatgttttctgtaaaatacaatcggcttgtggtttttccccaaagaaacaacattggatgttactcctaattaagaatttcggcatttagcaagtactaaaaaataccagtaacaatttcattataaaaaaagataggataaatcacgatcgcaaaaactgaaaaagaaattctcaaaagaatgaaacagtttgcatcatgagaagaagaagacaagaagaggatgagccttcagtggcatatataaaaactggattactactgtactactctcagtctctcggcttctagactagggaagctcaccaacccaagaacaagaagtgatcggagatggctcccaagaaggtgctcctgctctgcggagactacatggaggactacgaggtgaggcaaatcttcctcttgttccgtgtcttgtgtgttcgattcgtgtcctcgcgattccaatggggttttcttggaatcttgtggatcaggccatggttccgttccaagcgctgcaagcgtacggggtgtccgtggatgctgcctgccccggcaagaaggccggcgactcgtgccgcaccgccgtccatcaggggattggccaccaggtacttggaatgattcgattccgctcgatttggatagggtttagtataactagttagggcttggtctgatgaattgaacatggcggattcccattctagagtggtcaggaatatcttcgctttcttgcctttgagtaattttaggatgtaatttctaggattaatacacatctgctcatcgcaattggcagaagggggaaagaaaaggagagtacacacagtcacacaacgggacagggaaaacatatgtgcaactaggtttatttttgagagctcataatgaaatgacagatttcttggtatgattgatccattagctttatctgttattctttctattctccaaatatctggtttagcattgcgagataagtttgacggaataatcagtcatgagcagaaatattccttaactgtctacaaaatgggatagctcttctgcatgattgaatggaaaaatcatttgaacattttggatactgaatatacttagacagccattcttatttctttcgtcacttaagtgaactgttgattggttcatgatttgggggttaactgttgctgtagagatttcttataaattcatatccttgtctgtttcccatattattgcattagttcctgcttctctttagatggtgttgcttctttcaaaactaatttgggggtcctctttgtctactggactactactccctttagtaatggaatctttgttttctctgaagcactcgattataaggatcgtctgtattgttggttcttttaggtgtgatagtatggtggtacttttcgtctttctaacataagtttgctttgacaaattaaattagattcattttgattcatcatgcagacatatgctgagtcaaggggccacaatttcgcacttaatgcttcgtttgatgaggttaatatcaatgaatatgatggcttggtaattcctggaggccgtgcaccagagtatctcgccatggatgaaaaggttcttgatttagtaaggaaattctctgatgcgaagaaacctattgcatcagtttgccatggacagttgattttggcagcagctggagtagtccagaaccgtaaatgcaccgcatatcctgctgttaaaccagttttggttgctgctggtgctaagtgggaagaagctgatactatggacaaatgcacagttgatggaaatcttgtcactgcagtggcttacgatgcacatcctgaattcatcagcctttttgtgaaagcgcttggaggctctgtaactggctcaaacaaacggatattgttcctttgtggggtatgtttagggaaatttcattcaattgaattcgtatgactactttcttattttcttcatttttcataagtcataccatctctgctgaacctctttgcttaactacatgcttataacaggattacatggaagattatgaggttatggtaccatttcagtctcttcaagcccttggttgccatgttgatgcagtttgccctgacaagggtgctggggagaaatgcccaactgccatacatgactttgaaggtgaccaaacatacagcgagaagcctggtcacgattttgctttgacagcatcatttgacaatgtggatgcatcaagctatgatgcacttgtaattcctggtggacgggctcctgagtaccttgcactgaacgataaagtcattagccttgtgaagggcttcatggataaagcaaagccagtcgcctcaatttgccatggccaacagattttatctgctgctggagtccttcaggtacatgataatgattaattttctaccattgctctacattaatcgtacttacttgattacttctatacctagtgttggaatataaagtgaattgtccgtctttcctcatcagcttaagcttttggattgaactggtcggtgcatgcaactcaatacctagcgataggaaaatttaccttgaacaaaacaaaaataatgcaacaatatctattcttgattaatggataattaaatgattaaatcattcctgcaaagtaaaagcattttcatagtgtggtaaggtaggcaacaagacgtactattacagtatcagtatgtcactatccttcttagcgtagttattcaggatcactgaattgcttccgaaaatctcacacaaatggacacaaacctgtttgatgcacgcagcgatgctccccagtctccctaattgtggatgataatatgatatgcagggaaggaaatgcacggcgtatcctgcggtgaagctgaacgtggtgcttggcggggcgacatggctggagcccaatcccattgaccgctgcttcaccgacggcaaccttgtgaccggcgcggcatggcctggccacccggagttcatctcccagctcatggcattgcttggcatcaaggtctccttctgaagcaacgagaggtcaggtcccagcgtttttgcacgcgatatagcaagacacagctttgggctttcgtctaagatatatacagtcttaccgatactgtaccagtctgctgtcgttttttgtgcttgaaataataagataattactaaaagggtttgcgtgtttatagtattatgtctgtacgagcagaaggagctgcacctggggattgcctgtgtatgatatgaactgcagttgaatttcatgagctctcgcctctcgccgacctgggcagtacttcttgggccgtgcttcaccgtgcggcccactaaagtcagcccatcaccgcgagagcgatcggagaaggaaaaagtccaacgctactccctaagactgagtttgaggagaagaggattgagaagattggaaagatacgtaaaacggggtgagccattagcgcatgattaattgagtataaattattataaatttcaaaaatagattaatatgatttttttaaagcaacttttctatattttttttaaaaaacacaccgtttagtagtttgggacgtgtgcgcgaggaaaacgatgtgatttctcactcaatgtcacttgaacgaacgcagccatataggttgaatttaatttgtatcccttgaacgcagctatgacgacttcttaaaccggtataaaataacttcaaagtagtattgaaggtggtattcactgacggcatattgcccttggtcaaaccacctgagttggctgttctcctctcctctgatctccatctctcagggcctattcatttttttttaaaaaataacacataagaataggagaagtgaaggaataggaatgcatgcgaacttcaatccataggaattttccaattggtcagagcggatgaatttttttatgttttctttttataacttgtaggaaagaatttttttgttttcctatatctagatttcttcgaaccaaatggatttcatagaaattaatccttagaaatccaagtcctttgaaattccccttagaggctatggcgccgggtccttctccctcttgctttttgtaccttccttctcgacagacgtccaccaccctttcccatccctcctctttctgcaggctacagagcttgcagagcttcttcgatcgatttgctctttataccatttcctccgtttcgtaacgtaagactttctaaaattatccacatttatatagatgttaatgaatctatacacatatatgtgtcttacattgtaaaacggatggagtagtcattctagcatttcccatattaatattgatgttaataaatctagactgtgagaaatgctagaatgacttatattgtgaaacgaatgaagtaaaagattttgggtggatgtgatacattctagtccaaattagtacaaatgaatttggattatttttagcagggagggagtaacagagtaataatagtcacacctatgtataaattaatcgtctgaaactctgaatcttcctttcatttcatctccaatattgcaaaaattaggtacggcgctgttaaggtttgggtaaagcgcatggcaccagcgccacctgccgatcgatggaaccaaaagcggcaggaaatgagataagcagagaaaggtcaccacgcaagcacgcactacatcacgtatgtgtgcctgctccaagctaagctactctttctagctaagctttgggcttaatttgccggcttttcgctttttcgtgaacgcgcaaaaagattgcacctcaatatattatgccggcttttcgctcatgcgcggcaacgaaataaacactgaattgatgatgatgatgatgatgatctgaggctgctaatcttgccacctaattttgcctcaagaaaagctcgccacttacgctaaagatggcgacgaaacggcagctccgagccctttaatcctagcgtgcccttggcctttctgcgctaccgcttcttctaccttatccttctcacacgccattcttccagaaaacataatgctattcttaggtcgtgatgttcagttatgtttttgaaaaaaaaaacaaaaaacataagtgatcttcagttacgttattacgtcccctgtaactgtaagctgatgaagcctgaagaacctctcgccaaaagatcgaatatggtgtgtaaccgcttattgtactttctgaagttttggagcattcaccgacgaatctgtttcactgctcctaactgttactgacattgatgttacactgagactggactgaagacgtggaggctaattacctaaaaacgcaaatattagaaaatgacctaatatcaaataaatataagatgtgagatttcgaacccaagccgactagccctccttatgaagttagccggaagactgatgggcgtttctccgatctggaggcttactaaagctacacataagacatagctctagctggctctgaggctggccctaaagatggatgatctaatcccacacacgcaaacagctttcatcagagggagaaaccttcatgaaaacttcatttttgtcaaaggtttggcgcagcaatttcacagaaggaagaaagacatgatcttgctcaagctggatatatctaaggcattcgacaccgtttcctggagtttccttttggagatgttagaattcaggggatttggtgctggttggagaagatgcctgtctgctctgcttctaacggctgagacaagtattctgatcaatgggatcacttctgatccggtgaagctggcgagggggttgaggcaaggtgacccgctgtcaccccttctttttgtgttggttatggatacgcctgaggctatcatgacccaagccaggacgacgggattgctctctcctctcaatgctgcgagatttttgcccagcacttcagtgtcttcttccgcccggtgactcaggaagcgttggttattcaggctgtgctggatctgtttggggaggccactggattgaaaacaaatctcgcaaagagtgccatcacgccaattgtgaaaccatgtgtggttatagttcttttgtgatgggaaattgacaagtaccggatgtgcaagaagtgtgtgtgtggactaacgttggtcaggttgcgacatctgtgccaagacaacggttgtttggttcatgtgtgtgcaggtgatcggggtcgatcttggtcaacggcggatcgggactagactcagggaggagttgaggtccaaagcgatcaaggatgccgggtgacaagattggacacaaggttgcacacggtggacgaacaccgtgtgaaaaggtctttgcaacaggcttcacaaggccaagtgtgcaagcatcggattcgcgaagaaatcagaagggactgtgcaagtgcattgctgctacagtacttgctgtaggtagcatacatgcatgtacacgtactgtacttgtgcaaggaggagcttgcactgtactggttgctactagcatggctcggtggaaaagtcaagctagctaggctg

SEQ ID NO: 11850 - DNA, 31129 bp, Oryza sativa
  unsure (1)..(31129): unsure at all n locations
gaacaatggatggaccagatctgttttaagttagggtttcgccctaggggtatttgagacaatgtcttaggggtcttaggctatanatagagagatggatgcaagggtggaggttgctccttttggtaatcattttgagatgctcggtgagagagtttccgtgtgagtttggagtgtgtttgcccgagaggcttttgtattaggattagtttggagtgtgtttgtccgagagattttaagtttgtgttaatgttcctctgaaggtgtatgtttgctcctagttgagcggttattttgcatcacctataaatgaaatgatttgaaggatttcatttttgccttgtccatttaaattccgcaatttaaattccgcttgcaatttgaactttgcgatgatgagttttgctctctctttctcacctcacttctagtttcgggaattccttttctcttcctcctctagtttcgggaattccttttctcttctttttctctcttcttttctagatccggcttctctaatagccgcgattctagtaaggattttgagaaatccggcttgatgagtattttcgggggcaagatttgaattgctatattcacccccccctctatagctgttcttggtctttcaattggtatcagagcccggttaagttcgttgtaacctaaccgtggcaacgaacgcagctatggaggaaaaatactctgcgaaaccatttgttttcgatggacacaattttgtcatttggaaggcacgaatggaggcctacctccagtcgcaagggcataatgtgtggaataaggttaaatctccttatactgtgcccgatgatgctgacatcacgcctgcaaatatggctcaggttgattttaattatcgtgcaagaaatgcaatcattggtggaatttcttctggtgaatttaatcgtgttcaacaccacaagtccgctcatgacatgtggactgctctgtgcaatttccatgagggaaacaatgatattcaattggttcgtcagaatcaatttcataaagaatatcaaagatttgagatgcacccaggagagtccattgattcttatttcaaacgttttggagaaattatttcgaagttgagatctgttggaaaagaattttctgataatgataatgctcgccatcttttgaattgtcttgattatggtgtttgggaaatgaaagttacttccatcacagagagtgcacctctgagtgaccttaccatggacaagctttactcaaagctaaaaacccatgagatggatgttttccatcggaaaggcctcaaacactcgatggctttggtagctgatccctctggtagtacttcttctaatgactcagcctttgtgtatggtggcttctctcttgccgctttacactcagtcactgaggagcaattagagaagatccctgaagatgatcttgctctttttgctagaaaattctcaagagcttacaaaaatgtgagagatagaaaaagaggaaaaaccaatgaaccatttgtgtgttttgagtgtggagagcctaaccacaaaagagtgaattgtcccaagttgaagaagaagagtgacaagacgaccaagaagcccgagggacaagggcgaaaggggaagaaggatttgatgaagaaggcgatccacaaggtcttggcggctcttgaggaggtgcagcttagcgacatcgactccgacgacgatgatcaagaaaagggggacaaggacttctccgggatgtgctgtctcgccaacaacgaggacttcatcaacctgtgtctcatggcgcttgaggataaggatgactcatcggagcatcctgaggtatgtcttgatgatatcccttccttggatggttctctttgtgatgattcttgctcagataatgactctgttgatgatgaactaagcaaagaaagaatggcacacttgatgattgaaattagtgataagtataggtcttctaagtataaaattgagaaactaaaatctgaaaatgatggaatggcgctagaaattgctaggcttcgatccatgattcctgaggaggatacctgttctacttgtgcttcatatctttctgaaattaatctcctcaaggataagttgaaatcatgtgctttaggagctgggaatccttctagtgctagtgctgcttgctctacttgctatgaaatgaaagttgatatgggtttgcttgagatggaattgaaagaactaaaagaaaaatttgttcatgataggattggtaggtgtgaaaattgtcccattctcactagtgacaatgatgaattaagacaacaagttgccatgcttaggaccaagaatgatttgttagaatcttttgctactaaggaacctattcattcttcatgtgctaattgtgctatcctggaaactgaactaaaagatgctaaaactgtcattgattctatcaaatctattgattcttgttcttcatgcatttctctgaaagttgatcttgagtctgctaagaaagagaactcatacctacaacaatctttagagaggtttgctcaaggaaagaaaaagttgaacatgatcctagaccaatccaaagtgtccataaacaatcaaggtataggctatgattttgctgagtctttgaggataggtacccatgagattttaggtgtcacagatgggatgatagaactagctcaaaaacctataaccttcaagtctgcaggtttcattggaaacactagttctagtacacccaaaacctcagaaccaaagatggtacctatgactagcaagtctaagcctgtagagttacctagacccaaaaatccaaaacaagttgagcacaagcaaaaccagagacaaaccaagcctgtagagaaaaccaagtatgagtgcacctattgtgggaaagctggtcatttggtaggtttctgctttagaaaggctagaaaagagcgacaagaacgtcttaggactagaagagctactagagtccctgagaggttcgagtgtgcgtatcattgtcgttcaagtggtgtatctcgctttcctcgccgagatgtgcaccctcgacgtgacctagcagggttggggcaaaacagacatggtcatcttgcatataattctgctcataacactaaagatgcttgtacttctcgcatgattcagtactggattcctaagtcatttttcactaaccccagtactgaatcatcgagatctgctgtgtctttcttgtaggattttggagtagggagaagtaattcttggcttgtggactccggttgctcacgccacatgaccggtgaagccaagtggtttacttctctcactcgtgcatccagtgatgagaccatcacttttggggatgcgagcagtggacgcgtgatggctaaaggaacaatcaaggtcaatgacaaattcatgctgaaagatgtggcactagtaagtaagcttaagtacaatttgctctctgtttcacaactctgtgatgaaaatctggaagttcgtttcaaaaaggacaggtctcgagttcttgatgcttctgaatctcctgtttttgacatttctcgagttggtcgagttttctttgctaacttcgactcttctgctcctggtccttctcgttgtctcattgcctcagagaatagggatttgtttttctggcatcgacgtcttggtcatattggctttgaccacttgtctcgcattagtggtatggatttgattcggggtttgcctaagttgaaagttccgaaagatcttgtgtgtgcaccatgtcgtcatgggaaaatgacatcttcttcccacaagcctgttacaatggttatgacagatggaccgggacaactgcttcacatggatacggttggtcctgctcgggtccagtcagttggggggaagtggtatgtcttggttgttgtggatgatttctctcgctactcttgggtctattttcttgaatcaaaggaggaaacatttggcttctttcagtctcttgctcgtagtttggctttggagtttcctggtgctcttcgagccattcgcagtgataatggctctgaattcaaaaattctgcatttgaatctttctgtgattcttctggagtcgaacaccagttttcttcgccatatgtcccacaacagaatggggtggttgagaggaagaaccgcacccttgtggagatggcacgaactatgcttgatgagtttacgactccaagaaaattctggactgaagctatttctgctgcttgttttatctccaatcgtgtgtttttgagaactatcttgcacaagacgccatatgagctcagatttggtcgtcgaccaaaagtttcacatctcagggtcttcggttgcaaatgctttgttcttaaatctggaaatttggacaagtttgaatctcgatcattggatggcattttccttggctatgctactcattctcgggcttatcgagtttatgttctttcaaccaacaaaattgtggagacttgtgaagtcacttttgatgaggctagcccaggagctagaccagaaatttcaggtgttccagatgaaagcatctttgtggatgaggattcagatgatgatgacgatgattctattcctccacctctagacagtacaccaccagtgcaagaaaccggttctccttcgactacatcaccttcaggagatgcaccaactacatcatcttcagcagctgaggagattgatggtggcacatcaggaccgacagctccccgacacatccagaaccgacatccgcctgactcgatgatcggaggcctgggtgaaagggtaactagaaatcggtcttatgaacttgtcaattcagcttttgttgcctcttttgagcccaaaaatgtttgtcatgctttatctgatgagaattgggttaatgccatgcatgaagagttagaaaattttgaaagaaacaaagtttggtctttggtagaacctcccttgggttttaatgtgattggaacaaaatgggttttcaaaaacaaactaggtgaagatggttcaattgttcgaaacaaagccagactggttgcacagggtttcacccaagttgagggcttggactttgaagaaacttttgcaccagttgctagattagaagctattcgaattcttttggcttttgctgcttcaaaaggtttcaagctttttcaaatggatgtgaaaagtgcttttctgaatggagttattgaggaagaggtctatgtcaaacaacctcctggttttgaaaatccaaaatttccaaatcatgtgttcaaacttgaaaaagctctttatggtttaaaacaagctcccagagcctggtatgaaagattgaaaacctttttgcttcaaaatggttttgaaatgggggctgttgataaaactctttttactcttcatagtggtattgattttcttcttgtccagatatatgttgatgacatcatatttggtggctcctctcatgcacttgttgcccagttttctgatgtgatgagcagggaatttgaaatgagcatgatgggagagctgactttcttccttggacttcaaatcaagcaaaccaaggaaggaatctttgtacatcagaccaagtactccaaagagctcctgaagaagttcgacatggccgactgcaagccaatcgccactcccatggcaactacttcatcgcttggtcctgatgaggacggtgaagaagttgaccagcgcgagtacagaagcatgatcggctccctcctctacctgactgcgtcaaggccggacatccacttctccgtgtgcctgtgcgcgaggtttcaggcttctccaagaacatcacatcgccaagcagtcaagcgcatgttccgctacatcaagtctacacttgagtacggtatttggtactcctgctcttctgccctttcagttcgagctttttcagatgctgattttgctgggtgtaagattgatcgcaaaagtacttctggcacttgtcattttcttggcacttctttggtctcttggtcctctcgtaagcagtcttctgttgctcaatcaacagctgaggctgagtacgtagctgctgctagtgcatgtagtcaagttctttggatgatttcaactctgaaagattatggtctgtctttctctggtgttcctctgctttgtgataatacaagtgcaatcaatattgcaaaaaatccagttcaacactccaggaccaagcacattgagatacggtaccactttctccgagacaatgttgagaaaggtaccattgtgctagaatttgttgaatctgaaaaacaattggcagacatttttacaaaaccacttgatcgctctcgttttgagttcttgcggagtgagttaggggtgatccacccctatggcttgatttgagggggagttgtttttcttttgcatgcatttgtaacatattgcatcatgtttactttatgcattgtattatacactcttcaattgagctttgcttgttatctcttggtcatcactatgctatggatgtatcactcttatgctagtttgatctcttgtctagctttcatttgcttaagtagcttgtgtgatcatgttatgctgttcaagcgtgttgaaacctgcttaaattaactattcatttgaactcaatcaatgtgcaatgcttgctctagaagtttgtttaaattgaagtatccttctcatactcatgccatgtttacattcttttcgcaataactgtcagtacatgcttatgaatgctcatgcttatgcgtccatactttgtatcaatcatgctttacaagttttatctctgtttttgtccgggctactgagtgcgtttacgcatgagtagtgccgaagatagcactgagacagcctgtaatgggaactctagctggaaaacttgattgaggtcagacggcagtgtttggcacaaccatcacttgctgactgataagatcaggtggaccgtcgtgattgtgctattgtctttaaagaaattaaaaaaaaaatcataaaaataaaagtcatgagaaaagattaaaagctcatgttctatgctttgttatcatgttgatactctttatgaactgggcattagcacattagcatgggttcattgctttgtttatgtaaatcttgcatgattatgagctggtttgcttccttttaagcttcttctagaaatagctttgcacactaaatcactaattcacttgaaagctttttgcttgctggcgatactaacttgatattcatgacttgtttcatacttcttatgcacatgcttagctaggcttgagcacatgcttgtatctgtgtgatccatgtctaccttttgatgcctttagataactctcaaagctctcaaaacctaaaatttgcaagtttcatctcatttttatcttgcatttttgtctcttttgatcttgatggcatcattgacaaagggggagagaaatttgcacttattgaaaattaaaacttgctttaaatcttggtgaaagggggagtttggcacatagggggagcattcttgcatttgcatttgcatcccttttttcttcttgtcacttggtcttgatttttcgcgatttcaaaatgaccaaagttcgcttttgcaaaatggtttgctttgtgaatcaaaaatcaaattttcaaaattttgcttgagattgtcaatgttcccatcaagggggagattgtgaaaccatgtgtggttatagttcttttgtgatgggaaattgacaagtaccggatgtgcaagaagtgtgtgtgtggactaacgttggtcaggttgcgacatctgtgccaagacaacggttgtttggttcatgtgtgtgcaggtgatcggggtcgatcttggtcaacggcggatcgggactagactcagggaggagttgaggtccaaagcgatcaaggatgccgggtgacaagattggacacaaggttgcacacggtggacgaacaccgtgtgaaaaggtctttgcaacaggcttcacaaggccaagtgtgcaagcatcggattcgcgaagaaatcagaagggactgtgcaagtgcattgctgctacagtacttgctgtaggtagcatacatgcatgtacacgtactgtacttgtgcaaggaggagcttgcactgtactggttgctactagcatggctcggtggaaaagtcaagctagctagctgtgcatgtgcgctgtgattggttggcagggaggccaagccaatccagccgttccacgtggcccaagatggtgaatggctcggctcggcaggcctgcatcgtccaagcagcgacggcccaagacggcggcccatggcgcatgggctcaggaggtgcaggcagcttgcatgcgcaaggacgcgcgcggaaaaaccgtacgcggcaacccccgtttcgcgtgactcgatcggaggcgggtgcaggagcgcgggacccacacgcgattttgcaagcgcgcgcgggagcggctcagcgggacgcgtggcggcttcgggctggttgggcgctggcgagcgcgcgctgaggaaaaggagacggaacgcgcacgacgcggctgggcaacgtggcaagtttggattcgtcaagacggagagcacgcggattcatcagcaagaagaccatgtgagggttcggatcgatgaggtggcaatcatctggagcttttcctttgagtagaaggaacaatggatggaccagatctgttctgagttagggtttcgccctaggggtatttgagaaaatgtcttaggggtcttaggctataaatagagagatggatgcaagggtggaggttgctccttttggtaatcattttgagatgctcggtgagagagtttccgtgtgagtttggagtgtgtttgcccgagaggcttttgtattaggattagtttggagtgtgtttgtccgagagattttaagtttgtgttaatgttcctctgaaggtgtatgtttgctcctagttgagcggttattttgcatcacctataaatgaaatgatttgaaggatttcatttttgccttgtccatttaaattccgcaatttaaattccgcttgcaatttgaactttgcgatgatgagttttgctctctctttctcacctcacttctagtttcgggaattccttttctcttcctcctctagtttcgggaattccttttctcttctttttctctcttcttttctagatccggcttctctaatagccgcgattctagtaaggattttgagaaatccggcttgatgagtattttcgggggcaagatttgaattgctatattcaccccccccccccccccctctatagctgttcttggtctttcaccaatacagtgcaacccgtcgcagatacaagctgtggaggctattttgcattgtcaggttcagcattttccaattacctacctaggcctccctctttcaaccagaaagccgactaaggcggagattcaaccgattcttgatagattggctaaaaaggttgctggctggaaacctaaactcctctccattgatggacgcctctgtctcgtgaactctgttcttcaggctttgccggtgcacttcatgacagttcttcaattgcctaagtgggcggtgaaagacatagagcgtaagtgtcgcggtttcctttggaaaggccaagaaaaagtcaatggtggtcactgtctggtctcctggcgcaagctctgtatgcccattgagaaaggcggcctcggggtgatggacctagatctgttcgggcaagcgttgaggttgaaatggcatgccaagagccttgagcagaaaggaaggccgtggactctggtttcctaccatctgggtagcgacgtcaatgctatcttcaattgagtggcggatttcgtcatcggcaatggaactgacactaacttctggacgtcgaattggacgggaaagggaggtttcgcttggagatggcccatcctgttttcttatgttgggagatcacgtctgacggtggctcaggcgatgatcaatcacaggtgggttcgttgtctgctgcggccctatgcgagttctttcagctctgggacgaggtcagaaacaccacgctgcagaatggtgatgactctatccgatggaaggtctctcccgacgggcaattctcagcatcggcaacttacaacttctttttcacgaccaaagaggactgtcctgtgggcgacctcttgtggcactcaagagcaccttccagggttcgattcttcatgtggctagctctcaaaggaaaatgcttaacggccgacaatcttgctaaaagaaattggccccacgaggatcactgcgttctttgccaaagagaagaggaagattgccagcacctgtttgctgactgcagctttacctctgcggtctggggattgatcaggagcagagtgaatttcaacttcccgattcccaccgaggaaaactgcccactaatgtgctggtggcttcagccgagagcccgttgccgggtaagctacaggacagattttgacagtctagtccttcttacttgctgatcaatttggaaggaaagaaacgctaggatctttgagcatcgttttgaacggcgaaccatctagtggaagacataaaagaagaagcgttgatgtggaaggaagccgggattttttcccaagagtgcgagtagtcagtgtcccgtttgtttgttcccctaggctgaactctgtttcggctttcttccccctcgacatcctcatgtcgatgtaaatcttgtaatttgtaacttattttttctcctatcttaatgaaattggccggccatcctttggccgtcccggcaaaaaaaaagacacagctctagcttgaaattaatattcagggattctgaaggtacgcacaacacatgcaggatcacagatcgaattgcaagtgggttattggtgccggacatggtccaagatggacctctggctagctagccaaattatatgccatcaatcagaccatgcattcacgggcatattaagcaccaaaatatcctactcctatcatcatccattttatgcagatccaatccaccggcctacggaatattgcattattggtaataaagatgcagtcaacatctagctgctgattgatcattgctgatgagacatccagcctctagaaaactgcaggtttatcaatcaatgaatatacattttgattgcttagaatctatgataatatactgtacaattgacaaatccaacacataactaccctacggttcaagatcccagcgacaattgactgaggacatataagtttcgatacatttatcgtacacatcaacttaaaaaactgacacaagaaattctaaaaaaaacatatatgtacttctaatagtattgcacatatatgtataaagtctaaacttcatattacaaatgacagcagctagccaacagaacggtttacacttcagctgcacaaattacagttattcgaagtaagtgttacatagaggtaaattgagcagaagagttgcacacatagtaaatcattcagagtaactgcgataattggtagttgcaggaggatctatcacctatggcatctgtcaacagagttacctgggcgtcgtcatgctggatgctacccgtgcagatcagacaaacaacaagaacaggctacaagatacgcaacatgtccatacatatgagtaatgcaggccccagaagggcccttttcgttacaaataaactaatccaggcacctaccctatgaatgggatgtaattcggtatatgcaatcttttgaaacttccttattcattcccctgatatctttagattagaaaagccacaccatatcgttgtcatctcatacatgtctgattgttccccttgctgaaaagatatttggaaagttaacaaccgagaatgatgaacctaatctttggtagctaccctttctgtgtttttcttcaggcacatggtaaattgcctagaatattcagtgttagtactccacccagtccaactgatcttttaaaaccaacttatccataggaaacatgttctttggatgtggtaaaatacgcagaaaagcaaaagaccttcattaacatcctcatctgagcatctaaaagcaaggaaagagagaggttgcatggtcgtcatttcatgcgttgcacatcttacaccactaaatcttttgtgagcctttgctatcgcagttcacatttctcattgatgagctgaaaggtatggaaaccgaataatgctcttcaccggccgtcaactgggccaggatgaatcattcattcacatcattcttctcaggtttttatcataaggattgttactgcactggagtacccttcctccctgataaaagcagggaagatccagatggaatggaacagatgatagctgatcccaaaacaaaacagaagctgccaagttgatcagatacacactacataccctgttgtcggttttaacagataaaactctgaattcagtggaaatttccgctgttagacacagaaaaataggaaacagggtcgaaggaatatcgtccgtcacataaacgtagggatattttcgtctacaccttataaaaactcttgtaagtagtgtaccaggttcctccacccaatacattgatcccattcttgaactttaagatttactaaaacataaatttgtggcacagaatttcgcataagcaattgaatccgtgtgatgatcatgcgaggaagttaatgggtccaaacctgaaaacctgcatctctccggtgaaaccggccgcgggattgtcagctcaagaactcgttaacagcaaatgctctctgtcccgggacctgaactgagctaagcttgctgctgaattgtgacaaccaaaacaggtgtatacagttcgtggtgggcccactttgcagtgatatttttgcagcttgattgacgtggagagaatccggggaaggacgtgggccctacacagaaccaacggacaaccgaaaccagcttccctttgccttccttcctactagctttgtctgaattttctgatgctgctctttcgtctctcacgctgcaagcctgcaactgcagtatggagttgcacaatttgcatttgcacaccctccatcttggaatttggaaaactattgctgataacatgaatcatttcgtcttcatgtgagcgacgctgatgcattctatcttctactgcagtgactgcctcactgcaggtacagtcaccgagagaatcatctcgcaacagctaagctaatctctgaacgtgccgagaaaacacttagagactattcttaccttacgtggcattcatttttctatccagtttctttccctgctaaaactacatcaccatctaaattgaaagcagctgtgttgattcatgaatcagctaaaaaatatcatcgatctcgcgcgtgggccatgacaatcaatccaataattttgatggtggtggggtccggaggcctgcactttgcgcctcctcctcgacaaaacagctcgatcgatccatcaagagccagatgcgatcaatcatacctgcaattaacgtacaacctaattcccctttatatatggctataatcagctgcatcaactgccctggcatggcaatcgctgtagccgatcgccgttgctactgcgattgcctttcttgtttcctctactcttctgaagctcatcgcattttttttttcagtcggatgtgtacagatcacctaatgctaagttaaagatcacagtaaaatcactttttggaaactagctaactaattacttcatccgttctcgaataattgacactagcagtactattcaagctcaaatttgttttttcctgaaatttataaacacctaagggtgttatattagtcaaagtaagatgatcgtagtcatcagtggcagtaattcgagaaacgagggagtaaacaattggctcatatgattggagaatcattgtcatacatgtagcaatgaacgcatggattatacaagaactgaaagaggcagtaacatgctgcatggcacactaactgaaagtctgaaactctccaagagaatacactaccacatcgagtccagaaagcctggctgtccttttctctcccctagaatataccagctaatagatagcacaatttatcaaggaaaagcaggggaatataccctaaatatggagatccccatggaccatgcatgtctggtctacttgccgaatgtggagttgtccgtgtacgtctcggccaaccaccgggtctctcggctactctggagggccattttcttctgcagcttatggtgtctttgaaaccctctattaaacagcgcgttagccacgtggaacgggatgattcattaacatgtaattaattaagtatatattattataaacttaaaaatagatttatttaattttttaagaaaacttatatattaaaaaaaacatatcatttattagttcagaaaacgtgctaatgaaaaataataaagctgtagtttggagttgaagtttagaattcagctgacacaaataaggcggtatgtgaaaattactccagaaacccttgtgattaacaggcagtataatctagatttgacaggccttacattgctcgtggttgatgttaaatacagtactgaagaagtgttctctgtttgtagtgcattcgtttcatactggaccatcagattggctattctgtcactggtgtttgtctgctctgcagcttgattcttcttctcgtccggagaaaaaaaaactgtcacaatacaatactgtgctcttcaattttttttaaaaggaaatgctgtgctcttcatggtacagtatcagactatctacgctgttgctgacagtaacaaaggagcacatgcaccatgcattgagcccagaaaccaaagcacacgtgtcatggtcagttagaagctttcagaaaaagctgtgcgcagccttcgtaaaaaaaatgcgatgtgaagtctttcattctgacatggtcctacacaacactgatgataatgcacgcgtaaatttcataaaattaaaattatgagaaaactatatatttaaatcaatgtatcataaagtatataattagaactaaatttatcaccaaacaacaaatttagcaataaaattatcataaaaattttatgtcttccaccaagtacaaaactacaacttttataattaactttatcataacggtactgctagatatttaaacaatgtgataacttcaatattaaatttgtagttttgaaatacttgatcttaaatatataggtttacgataaattttgaaatacttgatcttaaatatataggtttacaataaattttgtataaagcatacctataattttataatacaacatattaaatatatacttttacgataacttaatcaacttccacacagttttgtaaagtttacccgtaaatcacaatgcatgcaacattgcaacactccaacacacaggattttcagcatcacattttttttaacaatgccgttgtattttggtttggttgtgagaattcacaagagccaagaactctgcatcgttctaaaaataattacaaaaaaactctgcatcgacggagagagtgagagtggatggaccacatggacaggtgcccatccagctcggctgttcaagccggctcgatctacgagccggccgtgtttcgaaataacccaaaaaaaagaggggtcaaaacgcaaaaggggcatcgctataaaaccgcggctccgcgggcgccaatccaccgcatcatcggcttccctccggctcgagccaatctctcgctgtgtctctctcgcgctctccactagcaccggctcggctcggctcgcgcggcggcggcggcggggcggcgtggcgccgagggaggggaacgccggtgtggggagggcggcggcgaggggactcgccggcgacgagctggtttgggtatgagaggggttacccatgcggcgccgaccacgagcgtcccccgccgcggctccatggacggcctcctcatcttcgtcttctacctctcgcttcctatacgtggtggccgcgaccactcgttaatctcctcctctaattgttagccgatctcgcctctcccccacactctctgatcccgctctctctctctgcttcgattcgattcgattcgatcttctccacctcgtcgccgtcgaacgcaactcggatcgggaggataatggaccagccttctaatggcttcgccgccggaggtgcgtctccgatcagaatactcccctgttcttttttttccatttttaggtagagaagtcattttttattttattatttttttgcaaattgatatgttcatcagtgctattcaatttcaaccatgcatacaaatcccacacgcaactttagattactatccaagtataaaatccaagttgattgtgttacggcaaatattgctgtcgacctgtcgtggactggcgtcccaatcgcaatcgattgtgtgagtatgacagtgcagtgctttagtgtcacaaatcgtaggggtcagaatgtttcgattcagtaaatgctgatatggagccatccttttttttctttttttttttggttccggtgaatacgcaaaaggggttgcgtagccatggattaaggtggtgaaagcaaagctaaaatcctatcgaatatgaaatgtgtacatatctttaactttataccttttttgttctatgtaataattatataaatacataaagtaggacccttcattactgttttcttttttaaaaaacgaaatgttgtaaaacgatcctttaattgattggggaccatcccccattgttttaaatcttgcaatatcagatgagtcacagtagtgtagataccatcaatcagcaagaatctagaggaaaggaagggattgtgatggcaatttgctagcaaaactgtgaaagagatgtggaacaaggttccaaaaattgaggtctctaaaagagtaaaaggtcaataggaaaaaaatggtatcccttgtccagaagaagtagcatccgaggccgaattgtttccttgttcttgattgcattttttgcagaatatgctgctgcatcgattaatccagactgctctgcgtcaaataactctatggatcattctgctcaatctaattcgaacatgacactttattgccaaaaaccaactgtaatgaataaatcactaacaaagattattcagttggccacttgtgggctcgaaagcacaactattttcagtcataaatttaacaaatgacacatggttgcactgaatgaaactttaaatgtgcttattcatgtacatgtttgagaaatatgtgatattagttgagctacaattccaaattgatttcaatatttaacccagaaatttactgtgcggtgcattcaggtctttttcttcgtcacattgatgggcaaaatgcctctcccccttctgtcattgtgattggtggagggatttcaggcattgcagctgctcgtgcgctgtctaatgcttcgtttaaggtaaatgctgtcattgaaagatgaaataactatatctctgtcttctatattctattagcttattgtccaaaaataagttaatgttttgatgcttcccgggccctttttcttagatacttttacataactacaggtcacactattagagtcacgggaccgacttggtggccgtgtgcatactgactattcttttggctgcccaattgacatgggagcatcttggttagttgcatcccagaagtagctattttcgccgccttgcaacgtgtttggttttcatctcatggttttatcatgtggttcaggttgcatggtgtatgcaatgagaattcattggcaccactgattaggttgcttggccttagattatatcgcaccagtggtgataactctgtgctatatgaccatgatctggagaggttaggagttattcctaacccataagtttatcctcaacttgatgggctttcattctcttacaattgttgtttttgttcatttagctatgctctctttgataaggatggtcgtcaagttccccaggagatagtgacaaaagtcggggaaacatttgagaaaattcttaaggaggtattgtcatcgtttgcatttcatttgttatccatcaaatgcttttatgcaactcttgtgagcttactttgttaatattgcagacggtgaaagtaagagctgaacatgaagatgacatgcctcttattcaagccatctcaattgtgcttgacaggaatccacacctaaagtaagtggaatttagcattcacctatatctggaatggtggtgctttagcgacggggtgaaatgttctaatgatatgcattcactcttacaggcttgatggtttgcaatatgaagtactgcagtggtgcatatgtaggctggaggcatggtttgccacagatgtggataatatatctctgaaaaattgggatcaggtatgcaatagggggcacttttgtatttacatgcgcacatgaagaattgttgtattcacgtagagcagtggactgacctttcaaatttacaggaacatgttcttactggtggccatgggcttatggtgcatggttatgatcctgttatcaaagctctcgcgcaagatcttgatatccacctgaaccacaggtatgcagttacatatcctcatggccaagtaattcacataagttctgtttcataggtttcatagttataatcccaaatctatagtatcttatctcttaactttcctccagggttaccaaaatcatccagaggtacaacaaaactatagtatgtgttgaagatgggacaagctttgttgcagatgctgctataataactgtccctcttggtgtacttaaagcaaatatcatcaagtttgaacctgagctcccagattggaagctttcatcaatatctgatcttggtattggcattgagaacaaaatagccctccgcttcaatagtgtattttggccaaatgtagaagtgctaggcagggttgccccaacatcaaatgcctgcggttactttcttaaccttcacaaagccacagggcatccggttcttgtatgcatggtagcaggaagattcgcatatgaattcgagaagctatccgatgaagaatccgtaaactttgtcatgtctcagctcaagaaaatgctaccaggagctactgaaccggtaaatcctcaaaattcattttcagaccatgtacagttgagtactgtcaatttcagactatgaacagtagctctaacacttgtgctacacaactgcaggtccagtatttggtttcaaggtggggaaccgacccgaattcgcttggttcttattcctgcgaccttgttgggaagccagctgacttgtatgaaagattctgtgctccggtgggcaacctgtttttcgctggggaggccgcctgcatcgatcactctgggtccgtgcatggagcttattcttcaggcattgttgctgcagaggattgccgaaggcatctgtcgacgcagctaggcatctccgaccttttccaggttgggaagattatcatgagggaggagatgactgaagtcatggtccccttccagatatccaggctgtgaaagaagaacaaagcctgcctatttagcaccgtgtttatcctgcagctgctatggttaatattgtagctgctgctctgtagtttcctaattatctcagatcctgtaccgtttcacagtttgatcgtttatgtgtattcaaataaaaacagaataattatatatcaacagaccttgttctctgaatccatggatattgcttttcatttacacattcccagtcagtactgctgaatttattttagttttcagtgtttgccttgagactggagggctgtagtaaactagtaatcgtctgatcgaacttggcttgcgcccccatttgcttcattttgcatgtatatagggttgtagatgcaggctagttgcagttcaatggtcataaacagtggaggtttttctttctttactttcatacgtagatctccactaataataaaccatacagcatcctgcatattcggaaacgattccaccatcgtgtgaaccatatcaaacgcattcattccactgtaacatctgctgccacaatttgcaatgtccatcccatcctgtagcatcagacttgtaaattgtaatagccacaaacagagaatacattaattccctcccccaccacctaaaaatcattttttttctttcaaaaatacatatttcattaaaaaatctattatttattttcattgtattttgttttatcataaaatgcattttaccatgatttgtattttacatatttacacaaaatatttaagacgaatattcaaacatatatgtctaaaagtcaacaaccacatattaaaaaacggactcaatactacctcctttttaaatagatgacgtcgttgagttttgaatacacgtttgactaatcgtattattaaaaaatacgtaattatcatttaccatattttttagttgttttatcattaaaattacttaaagcattatttatatgttacgtatttgcacaattttttaacaagacgatactcaaacgtaacgttatctattaaaatacaaagggagtatatatattatctgtgttctagtagttcctcttgtaaaaggaagaaaagataaaaacaaactggtgccgacgccaactatttccaccgcatttgggcccacatgtccgggagccaaacgcggctacgcgacccaaacgcaaacgcaaaggcggaagctgggatcccgtgtcgtcgccgactccgactcctcctcctccgctccatataagactcgccccaaccccctcatcaacttcataccaaaccgaaccgaaggaccccacccaaaatcacacgcgccaaccagatcaaacccacctcgcaggagaagagaagcgatctacctctcctcgaggtggtggtgaggatttggagttgaattgtggggagggggacctcgcgggtgttgccggtttggagcccaagatagggttatgagctgcttcgcggaccgccgctgctacgccgccagccgccgccaggacggcctcctcgtgttcatgttcttcatctcgattcccatacgtactagtagcagtagtagtaataattgtaattccagtagtagtattagtagtaatctcctgtaagcggagttcctcctcgcggctgcgtgtacggggacgggaggaccttcttcctcttcgtgttcatcttcttcttcttcttcctctcttccttcggcttcggcgctggcggctatggatcccaatagcctcaaaactggaggtatgaattattcccacttttttgtaatttttttttctgaaattttatctggtaggagtacttggtagtggtgcgtcgtgaaaggtgggaatatttcccattgatcatagtatttttagaaatctatctattgtactttagaattaaattttccacatagggaaggtgatcatcacactttagattttacaagattattagaatttataattctagttgggtacaaattggttagttagttggtaacttgggtatctacagtattatgtagattagtgagcttgatgttcaacgtgatttctctctcttatgattcacatacctgacagtaaaaaacattttttgttcaggcctcttgcttccgaccattgagaggcaatgtgcttcgcctccatccgtcatcgtgatcggtgggggaatttcaggggttgcagcagcccgtgctctctccaatgcttcgtttgaggtgactgttttggagtccagagatcgcgtaggcggtcgtgtccataccgattactctttcggatgcccaattgatatgggagcctcatggtcagtctcaccctgaattgttagtgtgagaaattcactttagattctgttcatacaagcttacttactgttcattccaaaaattcaggctccacggcgtttgtaatgagaactccttggcaccattgattggctatcttgggctgaaattatatcgcactagtggcgacaactctgttctgtatgatcatgatttagaaaggtaatcttttagctcttgatcttacgcttttctttaccgatccgcacaatccttgttgattcttacatcaactctgtcaattgattctgttacagttatgcactctttgataaggctggccatcaggtctcaaaggagacagttgctaaagttgaagaaacatttgaaagaattcttgatgaggtacataatgaactcatttatacttggtacttctggtgccgtttgaagagcatgttcagttcactatctaatttctgttgcattaatgttccaaaaaaaattttctgttgcattgcagacagttaaagtgcgtgatgagcaggaacatgacatgccccttctacaggcgatttcacttgttcttgagaggcacccccatctgaagtatgcacattcttgtaccatgctatcaatttactcacaacatacttaataaattcctaggatgcatcatgagaggttgactgatatggttaccattatttgtaggttacaagggatagatgatcaagtcttgcaatggtgtgtctgtcggcttgaggcatggtttgctgcagatgctgatgaaatatctctgaaaaactgggatcaggttagctgaaatcagtctatattagcacactgcacattcttatagtgacattagtttgcttagtgaaggatattggtaaattacatcgaattgtttgccatcttgcatagttagttacttatgtttgtattcctcttaactatgcaggagcatgttcttaccggtggccatggtctgatggtgaacggatactatcctataattcaggctcttgcacaaggtctagatatccggcttaatcaaaggtgtgttcttttacctcccgagcatacaaacacaacaattaatttcagcatactgaagtccctttttcagtgtattttggctccacaaaattacttgtcgtttcacttgtcaatattgctaaacagttttgcttactcgcttttgctactgctaaatcttcagggtaaccaaaattgcccgccaattcaatggagtgacagttaccactgaagatggaacaagttactctgccgatgcttgcatcattacagtaccgctcggtgtgctcaaggcaaacataatcaagttcgagcctgagttgccctcatggaagagctctgcaatcgcagaccttggtgtcggtatcgagaacaagatcgccatgcacttcgatacagtcttctggcctaatgttgaggtgctgggaatggttggcccaacgcctaaagcatgtgggtacttcctgaacctccacaaggccaccggcaatccggtcctcgtctacatggccgccggtagatttgctcaagaagtggaaaaactgtcagacaaggaggccgttgatctggtcatgtctcacctgaagaaaatgctacctgacgccactgaacctgtgagtttgccatctcagatcatggccacagttagttccattttcgagttcgcattatctgaatgaattcgttgttcttgcgactgacaatttgcacttgttgatttgtgttattgcagacgaagtatttggtttcacgctggggttctgacccgaactcgctgggttcctactcgtgcgacctggtcgggaagccggccgacgtgtcggcgcggttcgccgcaccggtggagaacctctacttcgccggcgaggcggccagcgccgaccactcggggtccgtccacggcgcctactcgtcggggatcgccgccgccgatgagtgccggaagcgcatcctgatgcagaagggcatccctgacctcgtccaggtcaaggcctacgaggagatggccggagtcattgctccccttcagatttgcaggacctgaaaaaactgaacctgctccaccctgccattgtcatggaatctggattgattcaattgccatgcctatgccctggaatcttgatgattcaatcactcatacaagttcaagttcatgtaggggattaactgcatgaatcaaaattattaattaataattatgtaattgtcatgttattattgaataaataaatcgagatcatgcttgagatctttgtactgggacacagtttcaattaattaatgctagtaacaaccttggagtgaatgaatgtgagtagttgggctggagttgcttgttcgtcttttgctgctgtgattgcaacctgcgagggagaagtgcacggctgtctcgtctcatgcctttgcttgctttgagcctttgaccgtcgccggcggtggatggcagctgacctcgacgtcgacgtggtggaacacaaatttggcgccacgcatagttctgaagatgacaggtcatcttgtgactacaataaaacgctacttccttaaaaaaaattcagtttttaatacaacatttaactctccgttttatttaaaaatcttctaattagtatttttattttcgttagatgataaaatgtaaatagtattttatacgtaactatatttttaaatttttataaatactagaaaaaatgttcgtgctgaagtatattttaattgggtgaagtatattttaattttattattgttatatggattagttaagatgaaatttattgtgggagttcgcttggatatatatttttttagaaaatcatgagctgtggttaggagttcgagatcgtctcaaggtagtatgcgagttttttaaacagacttcttatatgattccttctgtattacaaaaataaataattttaaaaaccgactcaaatatatatatatatgtatttactccatcgtcacttagagatttgggagggagaccggttgagctgacatgtccacgatggcagaatctcccaagattccacgtggaaccctaaccttccctttccaaaaagaaaacgagagcccttttcctattgacgcacgtgagcgcaccgcttaagccacgctacccacgctacgcctctctatacctaacgctttccccgaactccaagagatcaaaaaaaaaaaatctcaaacggcaaagtcaaaaaaatactactactccgacacgaaaaacaaacagaaaatcgggggaaaaaaatctctgtccattcgttcgcttctcccatggcggcgatctcgcgcgcgatccgggcgtgcgccgccgcggggtcccggcggagcatggcgtcgtcggcgaaggaggtggcggcggccggggcgcgggcggcggcggcggtggcgcggcgcgggcgggagcgggagcgggaggaggacgggaggcgcgtgcagtgggtgttcctgggctgccccggggtggggaagggcacctacgccagccgcctctcgcagatgctccgcgtgccccacatcgccaccggcgatctcgtccgcgacgccctcgcctccccgggccccttctccgagcaggtgaaacgccgcctccgtttctctcttcctctctcttggccttcgcccttcgaggtctcacaatgatggtgatggggatggatgataatgaacaagagagcatgcgtttttcagattccaatttcttgctgtcaattgcttttgttaagttgatggatcccctgcatcgagtacggaaaaggctttaagtactaaattgttcttactaaagtcttattatgctataagtaaatctagatttcctctaacccccatctagttaaatcaagcggttaagatcattgtttgtaagagttatgtaagatttttttgtagtacgtgtggttataacaacgaacaggaaaagaatgatccttagggtgcctaaagagatggcttgatgtgagaatagtaatgtattacttctatgtttttcattgttctgtgtctgatccgatttcagcttgcggagattgtgaataatggaaagctagtgtcggatgagatcataataaatcttctgtcaaagcggcttgaagagggagcagaaaagggtgagctgggcttcatccttgatggttttccaagaaccataagacaagcggtgagctagttatttgacctgactgtaagtatgcaaaacacatacttgcaacttctcagtatacaattatgatttgccttcaaatttgcattttcatatttaagaggtgaaatcatatacatagcatgcaatttgatacacataatgtgtaacttgattgctgaggtagtattaatctttggcagttcaacattaagacgctgtgcctttataatcagcttgatctggttactagcagcattttggcgactagacaaatcaatttgttaacctttgcataagttggtagctatgcattagtttacttaggtgtgccataattccataaacggatcagttaagatgctatttttgtgcctatattgcatatatcgttgaggccaacaatcatcaactacttgttaaatcttatccactggaactattttgtgctttggtaggagatacttgaaggagtcacggatattgatttggtcatcaacctcaaactccgagaagaggctctgcttgcaaaatgccttggtagaaggatgtgcagccagtgtggtggaaattttaatgtagcgtccattgatatggagggcgaaaatggtggtcctcgaatgtacatgcctccactactgcctcctccacagtgtgaatcaaagttgataactaggcctgatgatactgaagaggtggtaaaggagcgattgcgtgtttatcatgatttggtatgttctagcttgtgttatttttatttattgaattcctcacttgtaatttgctagtaaaagactaaggctttgtttgtttgggcattcggcagttgcaaattccttgttttccgttagcatgcttcccaaactgataaacaatgtgtttcttttttaaaaaaaaactttttatatagaaatttctttaaaaaacaaataaactcattttttaattttatttatactcaatttatcatgcactaatggcttgtcttattttatgtgcaaatgaaaagctgaataagggaaagtttacatttagtttactttggcatcgtgccgtcctctctaagctgtcatttttgcagtgtgagccagtggaggacttctacagagcacgtggtaaactattggagttcaatctaccaggaggaattccagaatcatggccgaagttactgcaagcattgaatttagaccctggcaatgaaagatctgcagcagcatgatttttgctttaggaatgttcgttatgtatttgtagccctacgccagaagtagttaagtaatgagtattccttgtacctctagaagtagttcaatcgggttaccaaaattatattgatatagcactcaattgtataggtgattcatcatcgatcttgcatgatgccatgatcgatgagtgtgctggttgttattcttaaatgagaaagcttccaataaaccaatacacatttatttgtagccaactatgcttgttgaaagcaacacaaggcaagccttgtgatgacagtaatattttccttgcaactatgcctgtttgaaagcaatacagagcaaccattgtaatgaaattctggtgctattgacacattgagagtgtttgcacatggttctgaaatttcccttgccccaggttgggtcttatctgaatatgcaagtagcctgctgaatactacctccgtcccataataagtcccataataagtgtagccatgagtttctgtgcccaactttaatcgttcgttttatttgaaatttttttataattagtatttttgttgttatgagatgataaaacatgaatagtgctttactcgtgacttatgtttttaatttttttaaaaaaaaatttcaaataagacgaacggtcaaagttggacgcggaaagccatggctgcacttattttgggacggaggaagtacagcagaggtcacagactcagttcaagtagcaaatctgtcttttcgaatgcaatctcctcacggtaagaaatgtgtctacccttttagcaggaaccaaatagtatctggattagaagaaggtatcacggttaaaggcgttaggaattgttatactacagcattggtagcaactcaccgtcacaacgggggtgtagctcatatggtagagcgctcgcttcgcatgcgagaggcacggtgttcgattccccgcacctccaatcttttgatctttttttgatttccattttatcataacttaaaacctgttttttgtttttcattccaccacagcttcatcactcagaacttccatttcatcataacttaaaatctgttttttgttcttttttttcattccaccacagtttcatcacttagaactttattttcttgtgatgaaatgaaatgaaaaacaaagaacttcgtatttaggtagtacaaaattggaataggccgtagaaggtgcctatgattctgggctctggctgtccgctgatccgctggccgtagaagtcaagcccatctcacagtctgcagatcgcttctttttacaacccaacgggccattttcagaggcgtcacccgtaaatccttgggccaatgtgacccaatcaatttcgtgaaaagtactccgtagcaaacaacgcgcgcgcgttccctgcaaaaaacgccggaaaacgcattgccgagcgagccgtttcagcaaataagggatcgttagactttatcagtgactgtatgaaacttttatatatgtgtgtgttcttacgacttaaaagataatgctgaaaaatttatttcaaaatttaaattttggttttgacttattatatatttttggggcaaccgatggggctatgaggctatgagctatccatccatccatagcgcaacgtgtgacagcgtgaggtgacaagatggaaaaccgtgagccgcgccaccggtgtaaaccccctcccttcacgcgcgtttactttgcaagcaaaggacaaggaaaaaagccgtaattggcgaagaatgttcttggatttgattagcagcggtacggtaacacctctagcttgcatttgcatggtagggtgatttggctaggagagcaggatcatccgtgcattcaattttcctcatttctttttgcaggctcaatagaggagaggaggggcctagctagcaccaagataatgcagcaaaaaggagagaagagaacatgtcatccagtccaaagtgcaaacgtctctatacaaatggaacatatggagtggacctaagcctagttgcttctgtgtcccaagctcccaagtgtcaaagccttaatgtgcaaaaccacatctgtggggactcctgaaagcaaactaaatgattgcaaaagagttcgtttattcacctatttatttatttattttattttctttccatgtgtctgttgtttgatactttgattgatcatgtgctaaactgcagaaaaaaccaacaggcccagagtaccggcgaaaaggctcctcgatgaaaagtgcagggattctgggggagttgccagtgcgccaccgttggatttttgcacacatataaacaggggactctgctgcacctctcacacagtaacatatatagggacggttccaccaagcacgtttgggaaatggttttttgagcaacatctcatgcgaacaatttaggcactatttacttgtaccttcaccttgtacgtgtgctccatcccatagctgcattatttgcatcaatcattttaattgcatatatacatactccctctcgtatttattttttttaataaatgacatctttcactttttatcacacgtcttttaataagacgaaatatcaaacgtatgataaaaaaaatcaataacgccatctattaaaagacagattgagtatatgcgagacatttaattatttgccacctctcaacaatttaacactcgtgtgacataggagtagacgcatagggtaacaaattgctaaacgtcaagtaatctatgagtagcaactagcaaatacttaaatatctcctaatatgttagcattgcaccaaagtctataactatattgagctttgtcctgtccatggtaaagtgtggggttaaagtgttaaaaagctattggtagcagtatctagtatggcgtggcaggccggtgcagataaaaggggccccgggttttgcccggaaatgaggagaggacgccccggcagctagcggacgctttgcatttgcatgcatggtgctctctacttctccctccgttcccacggcaaattgcaaaacgcatgctagtatttggcaccattagcctaaggtagtagtatcagcgtgttacagaaagaaaatagttaagtagcagtaattaattaaagcctgtgattaaggtaaagcagcagtgcagttacaaaccgaaacaaacaagagtcagcgaactgaaaagaagaccgggaagaagaagaagaaaaaaaaagacccgaacagagttttgatgagcagtgtcaggtctgtcacatgagaagagagcgaagtagctcagctcagcccccactcgctcacatggaacgcctctgctcgcctcgactacttaaccagctaaacgctcggttgattaggagaggaaaaaaaacgagggaaaaaacgggtggaaacacacgcaaaaacacaacgccgtgcggccttgtaaatacgggcgacgccgacgcgcatcgctccccgaacaccaaacgcctcagcttgccttggctctcgccagtcgctacgcccgcgacgacacgaccgcgccgcgcgcgcgcgagcgagcgagcatgtcgggctcctctgccgacccctcgccatccgcctcgaccgcgggggcggcggtctcgccgctcgcgctgctccgcgcgcacggccacggccacgggcacctgactgctacgccgccgtcgggggcgacggggccggcgccgccgccgccgtcgccggcatcggggtcggcgccgcgggactaccgcaaggggaactggacgctgcacgagaccctcatcctcatcaccgccaatcgtctggacgacgaccgcc

SEQ ID NO: 11851 - DNA, 23130 bp, Oryza sativa
cgcccacccggccgccaccaccgctcgcgctgccgctgccgccgccgccgccgccctcgccgcggaagcctctcgtcgcgcagcagcagcaccaccatcacggccatcaccaccacccacctcctcctcagccgccgccgtcgtcgctgcagctccctccggcggtcgtggctccgccgccggcgtccgtttccggtaatggtcggtgcgcgcaccgtacacttaatactcatagtagctgttacatcccctcccctccaaaccatttactactgttctctcacactgatatgtgggcccacctcgcagcgagctgagctccgccactatacgttattaaaagcccgcgttatgattgggctagttacgttgttgagttgagctggtcgtaattatttactaccgctacattttttttacctttttaccgtggggttcgggagagggtggtcgcggtaataataatgtcctcaactcaggggttgggagaataaagctgcgtgcagtgtggtgcagttcatgcatgggaaaggtgatgcgaatccggatattttatgggggtttaattgaaagatttactccacgacgatactaccctctactcctgccatgctgcaagcatgcgtaatgcgttacattgcgaaatcactcgctttgaatgaaaaaaaagcctgaaactttggagaaaaaaaaagcaccttttgttttctcctcgtgcatgcatgccgcgctgcgtatcttgaactactttggacttttgtatcgatcaacaaaactatacctatattagcagtaattaatactacatttgtagatatcctttgaccgttctatcttatttttgataattaaaaaaattagttacatttaaaaatgctatttatattttattatctaataacaataagtgtattagttaaatattaaacgttggatatgaatagtttaaaacgttggatatgaatagtttaaaactgtattgttttggggcggagtgagtaattgattgatcgattaattaagtggttgactaatgtgtgtgtgatttatttgtgtagcggaggaggagatgtcggggtcgtcggagtcgggggaggaggaggaggggtcgggcggggagccggaggcgaagcggcggcggctgagccggctggggtcgagcgtggtgaggagcgcgacggtggtggcgaggacgctggtggcgtgcgaggagaagcgggagcgccggcaccgggagctgctgcagctggaggagcggcggctgcgcctcgaggaggagcgcaccgaggtccgccgccagggcttcgccggcctcatcgccgccgtcaacagcctctcctccgccatccacgccctcgtctccgaccaccgcagcggcgactcctccggccgatgatcgccattgcaatcatatgcaatgcagcaaggacgatcgatgtaaataacccatggagatgcatggatcgaggcatcggattattgtttggaatggctgcaagaagaggagtagctatatatttttttttttgagtgtgcatcgccatcgcgtcgtctgcgagtattgggagtacggtgcattgcatgcacaacgcctccgtttcttgatttctttctttctctcctgtgtcctgtgatttttttgttgtttattcttttcgtgcaattagtggagagactggcaggtgtgtggtgtgaatgatcgaaatggttagtgtggctgctgctgctggtgctgttgctgttgctgcgttttttcttctcgggtgttgggtttgtcgtggacggcgatcattagcggcacagtggatgagagagctgagctctagctgcaggtcgcttggtctcgctgcgctgtcatgtgatcactactgcgcatgggggccacggttaccgctatagctgctgcaactgcgtgcgagaacgagctcgtgctgagctatacaagctttgctgctacttctgcttgcttttgtgctatggtggtgttggccgaatcagatcagagtttgtgctaccactttacattcgagattccgcttttgcccccgtggtgtacttgcaatatactccgttcataattaaactaattaacattgaattgaattgtacataacctaatataataaattaaatctgatcatgcatatccaaatttattgtattagattgtgtcacattcaatcttaggttgatttattatgagagtacaaaaatatactccctccgtcctatttttaagtgtaattatgagattttgtgtctaacattagaccgtctgtcttatataaaaaatatgattttttttttaaaaaaagtcacgcataaagtatgttttatctataataaaaataaaagtattaatcaaaaaaaaattaaataagatagatggttaaacttcgttggacaaagaaacacactactgcttttttttttttgacaaaaggagtactagtacagtactacgttcgtgtggtgtaataattgttgagcacaagatagcatgagatcgagcacagcggagtacgtactcatgcaaatcacctgatacgacgacgcccgtccatgtccatcgagtacatggaattgacgtgcattgtaccgatccatgcatgcactggctacactcttctgtcaattaattaatggtatcactagtacggtactctagctagcacaatgttgtgatttgcagatggtaatctgagcaaatgacaattaattgtagggacgtgtgtctctctgcattgccgggtaagccaagtacgctgctcccatttcaagtccggattaatgcaacgcacgcatgcacgcacgcacgcacgcggccaagtgatcaagaccgcgattaccccacagtcccacacgtatctacgctcgccgacacacgcgctaaaccctcactcacctcacctgcttttgctcgcgtgcatgcatgtgtctcgtctcacagcattgaactcctggtcactgcaaacttaactgtggtttaagaaaaaaaaaagtgataagttccatcccttgagggatacaaccttactgtttactatatgttatctaaatagttattaaaaaattaaaaaataataatatagattaatacaaaatatatcacatgcaaaaccaaatttaatttctataagctgcaataaaaagaacaaactaaactgaaaatagttaccgtacattcacgtctacattggttatttttttttacaatttataggagttgaattttaatttgcatatttgtaaagtgatacatttcatattaatctatcttgctaaattttttaattttttttaactatttatatgatatgcacaaaatggaaggatacttcctcgagcggataagttgttctccacatgcataggtcggcggccggatcgaacagccgagctgagcagcagcgaacacacaaccacctctctagtatagctagccctgcatgcacgacacatatattactactagctcgttagtttagagacgatatcgtagacagattaatcatgtggtagtacgtagtacgtgctgattctccaggttaacaaccagctagctctcgtagatgctttgcttacgttacagacagtagtacgtagctcctcgatccctagctagcctgcatgattcctcacgatttgtttcttcttgtgaaaagaatttaattacttatacgaagtacgtagcttgtgttccaccgagaaattaacgcgagaaggaactagtaggggagagattctcttctctggtcgattccactagctactctgctgtgctgcctgtgtggtgggtagcgtagctttgccaaaagctcgcgatcgatggatcatcgcatgggacgcgcgcggtcaaaaaaggctcaaaacgcacacacgattctgcgattctgcgcgggcggcgtggtggtgaggagaaggccgtcgcgcgaggtaggcggccggcgaatcgcggggttggtgcgacggctgcgctttgctgggggatcaaccggcaccgccctgtgctgtactacctgggctattatgctaatctattctagcgagagagggaaggtagagactagagagagagagagagtgggtgtgggtggaccgctgtcttgtcgctttgctcccatcatctcacctcacctcacctcaccgtccccaaaggcagcgcagataggggcatttcggtcttttcattttgggcataaaaacaacctctaattttccattgtcttgcctggttattcaacggcgagaaaccaagttagggagaactgtaaaagaaagtctcagttataaaaagagttaacttctgataataaatctgaccaatatttatcttaattagattcattgttaaaaattagttttttgggacgtaaggtgtacttgtactccttggagatagatttgttttctttctcacatgatgttccctgtttcatgtatgttgtgtaaaaagttaaatttttcaaagaattgaataatacagatcaaaagatagcacatgatatgccactacacaaacatataaattaaaattcaacctataaatttagaaaaagaacccataaactatttattatatattcgtagtcaaatttattaatatttttgcttagcttgtattagttgaatctaatcttataaatatgtttgtgaagtggtatattatatgttgatttatcttattaattttttaactttttaagatgatatattacgacaacacaagttatggtaatctacatcgttcatcaacgctaagcaagcaaacagatcaggttaagatatcaggggtaaagtaaggtgctctcaataaaacatatacatctcagcaatagactagattaataataaaccatctcaatagtatgtctatatgggtatttatacctctttaatccattgcctcgtttttctctatagactatctccaggttagtagatagttttgctttctctcttcatttaatcttttccatataggaaaatatgctgacatggatcttttatatatagtctataagagcacccgcaatgttaaagtaaggtactatttataaaacatatacatctcagcaatagattagattaatagtataccacctcaatagtatatctacacatgagtatctatagctttctaatctattgcctcgtttttctctatagactatctctaggttagtagatagctttgctctctctctcttcatttaatctctttcaagtaagaaaatatgctgatatggatctcttatagagagcctatagataaccattgtgggtgccctaaataactattacggttgacctcatatactgagatggcggcacagcgtataggatagtactcgtacgtttggtggcgatcaggctttaattgattttggtggcgatggcgatgattttggtgtgggagagtgagaggagaggagagtggacaggacactggacactggacacaggcggtggtggtgaggttggcttggagtgctagtactacacgtactactactactactgggagtatatggattcctctccccgctttgtggtgtcagaaaaggccctgacaatctcccctagctgtcatccccgctcagagccgtagtcaaacccccttgaccggacagagtagataccatgccactcaactcactcatatccccgaaatgcccctcccttccaatcacaaaggtatacgtaaccctagttaaggacctgtttcgagaagtttaaaattatgagaaacagaaattaaatggtactctcctcgtttcacaatgtaaattaatttactatttctcacattcatatcgatattaatgaaactaaacatatatatttatctagattcattaacatcaatattaatatagaaaatggtataataacttacgttatgaaatggaggaaatagttagctttaaagaatttaaaaatatttaggtttctcggattctaactcctactttattttctggttctataactatatatatttttagaatctgaattataaactgaagcttcccgaatagggccgagtttagttttaaactttttattcaaactttcaacttttccatcacatcaaaattttcctacacataaacttttaactttttcgtcatatcgttccaatttcaaccaaactttcaattttagcgtgaactaaacacaccctagcatcacgtttagttccaaaatttttcttcaaacttccaacttttccatcacatcaaggtcctgttcactttggtaaagttgccaaaattttggtaatttgctaaaattttagcagaatttcttatatagttaccaaaatttgatagcaaactaaatgtagcaacttttttggtaactttactaaaatttggtaagattgtaaatggcatcaaagtgaacaggtcccaaaacttttctacacacaaacttctaatttttctattacatcgttccaatttcaaccaaatttttagttttgatgtgaattaaacacagtataggtcttaaagctaattccacatgtctctagctagaagtagccactactagtacgagttcaactttgctcctttcaattcacctcaccgatcatatcgatcacccttataattcaccgcccatgcaatgcatagccgcctacgagtagtttttttgacgttacgcttcgttgtcatcttgctgctacagtacagacagggcagtgtgctactaccccctaatctctattgtactacacaatgcattatgcatgtctctaattaagctcaaaaaatcgtaaaatttgtacttctactccttggactacaaatttctcaagagaaaatggtgtggcaacgctggagcaggggggcctacaggtgcgtacttgcaaagagcaaaagcattggagcattggatgctagtagctccactgaaatgggctctagagagagagagagccgcgctctgtaaaaaggcatgcagatgcagtgcgtgggcaggggatccggagctgagcgagctagcggtgcatgcaagctgtaaaaaaaaaaaaggcacagcctgcacgattctccacgcacacacgcacgcacgcacgcacgcacgcacaaggacccccgttcccgttccgtccaacaagtacggtgtacttatatttgccagaaaagagctttgtatgactcagaataaaaaccttaattcgtaagggaatgtttggtggtattttgcctgaattatgtgccacatatacagccccatcgttgggcttatatctggaataagccaaacaacatatttataaacgaaaaataatttataaataaaacttttatatatgtgtccttagtgatctaaaagcacagactgaaaaataaacttctataaaaaaactcaaaatcagctttaaatttaagattaaaaattcaaattttagctgataagtataagcgtaagcgaaaagatgagcccggtagaatggaatgatacatactgtttaactattcattaagaggaagtggaacacgtaccagcactagttgcaaaactgaactttcttcgagaaaaaaaatgtattggattattttcagttgaacacagtatgctctaattaagctagtactgaatttggctaactcaagtacgtatagcagtttttcaagctactaaacaaccccttaatgagccaattgtgagtcagctttaattgattttttttaaaaaagctagtacttcctgaaaaagaatatgaggtgcagctacaaacaacacactgtgaatgcatggttcgacggccagatcgacgagaaacgccgtacctatatagttaagacaacaataagctcatggatggacgtcagaggacgtggtgccattggaggagcgtaggccgggcccctacttacaacaatctgcctatacattcaggacataaattgagcttgtggccatttatttcaggcttttgggttggagccttgcacaaatagttgcattattatattggaggaaaagaaataaaacgaaagcatgaactgctggttatatccgagaaattagtacacacacagtgggttactgatgatcaggtgatttgtaaactagttgaagtgagctgcagaggcaagccgaactgataagtgatatacagtgttcttgcatctaaaaatattagtattttgtattattagtataagactttgactgataaattgctctacttatatactattcatgtgatgaaaagcataatcataaaaagtacttctgaatataaaactattaacaccaatttgatgtcgaaaaattatatgctaatggagtaattatcggtctaaatcatgtcttaacgtaacaaaatatgtcttaattttttgaacaaaaggagcccttaatcttgtgttattagtcgagagatcctggattgattgaccagaatatatagggtcctctagtacgacagtagcatagctagctagtcatacaagaatagaattacgatgctatcttaaacgaccacacacaggagtaattgaaatggagtttactggcagcgagacggtggtactggtacgtcgacggatgcgccggagatggcagcttgtataaatgcaatcccggcccatgggcaggggccaaaccgccaccaatcacccctcctctcctatccgggagggacacgggggccagtgaaaacgaagaagccaagccaaagccaacccacagctgcaataataacgcgtagccacagccactgccgatgccgctgctgcgagagggtgacaccggccaatgcaacagcggcagcagcagcagaagaggcaggcaaatcataaggcttgcccccacgcagctgcgtgccagtcaaacggagccagtcaaaactccaccgttctcttcccccacactgtgtttcagccccacacaaacccatccatccagcaccgtacgtgtacttgtccagcaagggtagcggcggtgacagtatatgacattattgtaccatggggagagagataattggctgtgtttagtacacgctgaagtttgaaagtttggttaaaattggtacgatgtgatagaaaagttgtgtgtgtatgaaagatttgatgtgatggaaagttgaaaggttagaaaaaaaaaaacttggttaaaagtttggaaaaaaaactttgaaactaaacagggtagtaatatataggttaggccactgggatgcatcatgggttaaaaaccttgaatgctgcgctggaacgagaattccgtggtagtactgaactttaattttagtcggtagattgtctgtgagagcatggaacatattgtgaattatggatgatagaaaaaactgaattttgtaaccattataggagaaaacaatcaaacgagttaagtattagtagaaagttaataacttggtttagaaaggaataacttatgacaagaaaattttatggacaaattagcatgagatctaacgtcatggaaaatctctgcaatttttcttgcaatctatccaaactgtcgttcgtgtaaaaacataaaattgcttgaaaatccatgttttacatttctatttttcttttaaaattttacatttttcatattaatgtgttttctcattcttgcatttttcttgtgttttatatatatggtcatttctcaaatgtttgaaaatcctcttttatatctgtcctaaatcgtgcgctaccttttactacattttcttaatcctacattaaaaaggtggtcttataattaaggaaattcatgaaaactgaactggttcctattaaattatttttttaaaaaaattactttgataaaaagagctgtagcattcttaccttttgcgtccaactacagtctacagtcagtcccggagacatttaaccgacatccgatatataatgatggttcacgtccagacaaagtcaacagtcaacatggcatgcaaagcaactgttcacgctcctcgatcagacaagataaaactgtgcccgtacggacatggctggtatggcagtagctctgatcaccaagagtactccctcggcacaattaactggagcctgcctgaacgaaacagaactcaagagtaccaaccaaaaccatcacacccttgtcttttcccaaaaagtaagatgcaggtaagcgcaaggattaccacgggcaccatggttattagtggactttctcttccagcatttgacaaagatccaaaggtaagaagaacaagattttatcagcatctgttcaggtataataatattatatgcattaaaagagaactggagtaaacctactcaagagttctataaacatactaggaaccactacaaaaggaatatgggcatttccacaccaaagaaaccagattcgtcatttggctccaagcaccaggagggaaaaagaaaaataagagaagcaattatgaaccctcacagaaaatcactcgataatcttgacttggagccaataaagaaataacatgagttgataaaataggctcttagtcccacaaaagggtgatcatcgagttggccaacccggcttctttgaaagttttatcactctcgtactccaggtttgtggatgccctaggaatgggctgtacgaaatggaaagcctcttatccccgtcctccacttgaggatagcagaatgaccacaggagctgcggcgagatggataaagcatcagcgaacaatgtaggagaagagacaaaactatggaaatttatttcagtgttctaaccttaataggatccgtgtgaaggaaattcctctggatcctcctaccatcaggtaggcgaattgcaactctgcacaaaagctcccgacttcctttgggttcttcagggagaggaggatagttcagcttagcactcaggctaggctcattttctacctcaggttcaatcttttcctcactagtgtcagagcctttactctcctcaagagaagccgctactgccggggctagttcttcgtcttcatcctctgtggctactacgggtacaggggttttacctacaaagaaatggaactgtgaacatgtgcttttggtcaaccttgaaatgcattgcacgtaaccagatcctaacataataataaaaaaaaacacacacacacacacacaatcaatgctgcgaaattaatccatcaaaatatccccttaagtagtggcatccatatgaccataccggtaatattgaaaattacaaattttctttgtgcatgtcatgccatgcatggagagcttacgctaacttttgttatgcctacccctcttgcaaataaatctgggtagttgcttatcacaagtcaaatttgaaataaccttaacttacaatcgacacacaaagaccatcgttgtcagagggtggcaaaaccagttgtgacttttgcctaaagataactgtgattagacatgatttaaattctaattcctaactacacaacaaataaattgttgttgacatatagactactgaaatattttttttccttgcgtctggtctatgttatgcattatcattgttcaagatgagtgttaatggaaagtgatatgtcagcgatgattcatatccaagtttgaaacatggctaagacaagtactgccagaaaccatacatttccaatgattttcctattataaaaaatgtccattgagtctcgtgtccatactatccaattattgtgttatctgggccattaagaatccttaatatctagaagtacctgccaaaaacaagttgaaataaaccactaaaacttattgccagctatcaccaacaggataaaatctggtgacagatgatgtatgaggatagaatgactcgtaaggccaatcctccgactcccataaaggtcagtgattatgccaggcacatccaccagataatcatcgttatatcataattcataacaagagtaaatttcacaaaactacaggtattttgaccaaattatcacaactacagatttaaggagttgtatcacaaaactacatatttagcaccaaatttatcacaaaactacagattttagattaagtatcataaaaatgcatatttaatattgaacttatcacaaaactacaacttttggagtttaaatccctagcaccattgttatggtggagctataaacatcattactttgtgatttaattgattctaaacctatagttttgtgataatttagttactaaatatgtagttttgtgacacttcatcttaaatgtgtagttttgtgataaatttggtgttaaatatgtagttttgtgatacaccgagttaaatctgtagtttggtgataatttggtcatagtatctgtagttttgtgaaatttactctcataacaattacaagcaacctcccaatgaccaactgctcctggaaatcacgcttatgtagtgtaagaacgacctaactgtagttggatgatacaaatgaacaccgctcccccttatccaattttgtaaagcatcaaatgctagtacagctagcctacccccaacttgattgggaacaaaggctgatgctgttatactaagtactagaaaacaaaacacaatgcacctagaggcaccctcacatgacaatcatccctgctactttttcaagaattggacatccactcacaaggtttgaaagttttgattgtatggaagccccatatctttaacagatgaagtttcgattgtcacgaacttagcattaataatgcatctattccacaaaaaagttatttcaccgtgttaaaagataaatccatataatgtgaagaaagattgcaacgaaaaaagataggctcaacatatggttatttatgtactaatgtgcttggttcatataatagttctgcagaaacaaactattcgagcttaaatgtttcaaagggaaaaaaaaacatcactgctagttaacatatctttggacacaagccataccttgtttgccgatagaagtttcctgatcaacttttcttggccgtttttgaggttgagctgcatggtgctcctttggacctttgtccaggtaaggcatcaaatcctgtggacagttcacatgcagacagtaacaaggaataccatgtcaaatcacagttaagattccagtattagaatgtggaagtaagaatgttatcactacagaagttagtaacatgagagatgaaagatagtaggtcgatagggttaccaaattacctccagcaaacggtccgggtgaatcattccattccacccacgcattttttgcccagtgatagggtcaatcagaagaatggcaggaacagagaccaaattgtagtaggtgcataccttcctcccctcactggtgtcatggtaaacctatatttaagatgatagaacatatcagtagacaactagagatgctaaaaatttgatccatcttggggtttgggaaaaaaagtgaacattagaaactctttctttccaatactattcctaatacatcaggaataaaaattggagatacagttatgtggctcaggtatagaaggcgaaacaaaggagtaaggaccaacctgccagaaaataaagttcgatcgaattgtctgagccacagcctcattagcccaagtgtcccgattaagcttcatgaaagaaacactcaagagtaaaaactttgccaatgcaggaaaaagaatgaagggttaacacaaggctgcatgacattaatggtaagatctgtaccatgtgagagctgaactcttcagtcgattgcaaattgatcaagagccacttgtccagaacagaagcctctaactttgcctacatttatgaaattcattgtttttagaaatctgaattaaattggtaggttatagaaaattaaaggataatcaaattagtattatgaagttcatcagctccaggctttcacatgaaaattagtagcagtttactagttctcgtgcactggtcattagacaacaaatgaatttgcaacaactaataaaaacatcaatgtactttcaatgataaatagtgtgaacaaagaacattaagaagcatgtttgaccatgcctcttgttgacaaaagggaggcaatgtttgcttgagtaataaactgaaccttagcagctaataaaccgaactaattatttgacaggtaggattgttagcagctgagataaatgaagagttcgtgggttacatggcgtgctgctccatgataacaattcagtatgtcactaatagaatattgcaattttcccaatgcataccaaatgcccacagacaaagcaggttattgaagtttgcaggcaaaggcagcacatggtcatgttagagataaaaaggtaacaccagacgttaaataagaaaaaaaggatagctgaccttgtcgaagggtccattgaacatcaaagcaaatggtggacgatacaatgccgccagattatcacgagaactagatgcagcattctgctcagaatcccaaacagcagattgccttgactcctcttcaaagttacgaaatgcaactgttgaattaggccgaacgctgaaaagaagtcataaaaccgtttcaaatttagaaaatgatagattttaaattagtagtccacgttccaggaaaatcatgcaaaaagtttggttctattagtgctatacttctctttggttactgtggctcaacttgagtttcatctctagcctattctaattttctttagagtaaaaggctgttgttttagaattttggttttagcaaagcaagacatagaagcctaacaaagcatgtcggcccaaaagaaaagagtacaacaaaatttgggccttatcatctccaaaagaaagagtagaacaaaaattgcatcacttcccacactttaggtcattaggtgtggctcagcgctattccttccagatttaacaaaagtggactataacaaagaaccatagtaataatgtcatatgtattcaagagatgttgcatctaccaaagaaatggctaaacatcagcaaaatcaaccccaattataataaatacttggcacagcgcatttaagtatatatatctaagtatacccccttaatttgcagtgccattggggcagtcccagatatgccatcggtatcatagagaataagggataaaataagagctgtgactgatatgttaatggtcattgtgttgtcctaatgggtagaaggataacaccccgaataaaaacattcctaactttatctttttcaggaggcaacaatctctcctgttttgaaaataattggcagcaaatgaaatgactagatgtttcttctgatcagtaaattctggttgagttcgagctagtgattgtcatcatatctgttggtgacaagtaaagatatctaacttgtagccatgaacgaaatttgttggtgaccaaccaaataccaataatctcattggttgcaaactatatgaaagagatgttagtccacttggcaggggaagagagggcaggaggcttgactgcaaattagtggtactagaaaatggtgctagctattaacatagccaaaggtgcaatttaggccaaaaggtttatatcccatcagcaagccaacaatgattaccaacaacacatgctaattccattggacgagaacaaaattactataggttagtgacatctattcatcaccaaccaaacacacacatgccttttatgaggacttaagcttcgatttgaagccatcaaaaacttaaagctcccctaaacagcatggccttaacattgtcggataagagtttttttagacaatcacatgccccatgtaacctatcccaatttctctttgaaccaaaccaatgattctaggcattactagtaccgattttgtgccaccgatacaccctatttggctatttacatgtatcagtacatcacataaaccacaatcaccacaggggcagcacagatattgcattgaactagaagttgtctcacacaaagtcttaacacttatactgaggaactcaatcccaggaacccaactatcataaagagtttgctaaccaagcactagacttacacgaccatgggggcatcgccgtagagagtctcccgctttgtgggcagcggtgcccgcacatcctcttcctccccaagtccctgcagcattccatcacccagtgcagcagctgggggcggagcgaacctgcccatcacagcacacggtaagcgtacacaaaccaacagaaaactcaaggacccaaaaaccaaagcccaaacccgagaaatctcgcgccgatccacctatgacctacctcatcgcgtcctccacctcagcagctgctgccaccgccgccgccgccgcttccgccgcagcagccggcgatggggccggatgcgccgcaagggcggcctcgccgtcgatgtagaacagctgcaacgcctcctccagatgccagctcgtcatctgggagagacgggatcgcatcaaacccttcgaatcgatcagaagctagactctagaggggggaggaacgagacgacggacctggaggaactgggtggccgtctcgggcgtctggccggcggcgatctcgaggaaggaggtgacgagggactccttctccgcctccgtcgggggagcgccggccatggcggcgaagtcggggatgggaccctctcgcgcgcggcggttagtagggtttggtgggacggcgaggagtgttggtgaggtgggggagaggggaagtggaaacgtgcggggtgagtaagacgagacgagtgcgaatgtgcgatgcgatgcgatggggaagtataggattggagatggtataagtgttggggggagtacggcttggaagggaagaaagggcccatcccgagcccagaaatgctcatgccgtgggcctcgtgattcgatcagttcgtggaccatgccacgtagtatatgggcctaggaagtataaaatgggtcgtttgtccagttggtcagattccagtaaacagtacaactgaggtccctcagcgaattacaaaattgtcaacttacagaaccgaattattcttggtctttaggtgatattgaccctggttttgttcaacaaagcagctgagtcagcacaggacccacgtaggctccgcatgtcatggtgaccaagtcattaccctgtcctcttctcctcgtctgagcaggccggcagatcgaggaggagggggaggagaccagcggggtgaggtaggaaagaagttgagccggagcatggcggtggacatgaatgcaaggtgggcgtcgttagagaaagtggcagaccagccgccgcagccactcttgtccacaggcggcttcacgatggagaggactaggaggatggctgcggaggtgagaagcgggagcagcagaagggagtaggcgacgtcgatgacgacttctatttctctcgtgcccttctcactgctgcaatgtcaagataatagacgtactattagccagatcgacgtagtagtattgtcttgccacgctaacccaaataacgttgttaaaatgtttagatcttatatataaataaattttaaaataaaaaaggttaaaaagataaacaaaaattgattcggtggccggtgcagcgcatgggacacggtggcgctggcttaagcggtttccggcgagagagaagacgaggatttttttttgttttttcgcggcaaatggaccacggacacagtgaaaagcccggcccagttaagtatactagtttcaggcccacgaacgcatcgcacaagcagcagtgcggccatggcggctcctcctcctcctcccatccgaagcaagcagagcgagatctggaaggcggccatggcgcgcctcgcgctcctcgccgtccccgtcgcgctcctcctctccctctccttcctcctcctgcgccccgcctccccgccgctccccttctcgcggcagcaagcggcgtccggccccgaccgccgccgcctcctcagggtctacgttgcggagctcccccgcgcgctcaaccacggcctcctcgacctctactggtcgctccccgccgccgactcccgcatcccggcctcctccgaccccgaccacccgccgccgcggcctccgcgcgcgcactcgccgtacccggatagcccactgattaagcagtacagcgccgagtactggctcctcgcctccctccagccgggctcgtcgtccgcgcccgccgtcagggtggtcgcggactggagggacgcggatgtggtgttcgtccccttcttcgcgacgctgtccgcggagatggagctcgggtggggcgccaagggcgcgttccgcaggaaggaggggaacgaggactaccgccgccagcgggaggtcgtcgaccgcgtcaccgcccacccagcgtggcggcgctccggtggccgtgaccacgtcttcgtcttgacaggtactgtgattcagttggaaattggaaatgtgctttttattttttcctgagtgaacttaagtgatcaaaatggcataatggaacgggctgttgatcatattaaccctccattgctcccaattggtgtgggttatatgttaagcattcgataggttaagttatgcttgttgtccgtctattatatactcaatcccaactctcaactagtatatgattggaaactagttttttctcctccatactcaatcccactttctgactgatatctacagggtttagctactcaactctaaaaactgtgagctgatttaggcttgaaatcattttgtgtgttctgttagttaccggctatacatgtgatttgttgctcggcgcctcagtgtaagacttaccaagttcccttttccaaacagagggagtgtgcccagaacagtgagcacattgacatgtagatttaaccatgataggaacctcacaatgcactcataaatttgaaattagttatgtgcatacttggaataggggggtcaaggtagctggttttggtttcttaggcacgctttacatgttttcttgtgtaagggagtggcatacccttgaaatgccatcattaaagaaaaacaattttgaaccatgtgactttctgtacatttgtcatcaaggggatattggtaatcctcagtgtttcggagcaaaagacacaactgttttgcaagcaatgtaggaatacaagatatactgtttatgttttcgttgtaattgatctgcatagtagcttattattcttttgtatgctcaggttttgttaaatattgaggcattctttgacagaccctgtggcgatgtggcatgtccgtaaagagattgctcctgcaattcttttggtggttgattttggcggatggtacaaacttgattcaaactctgcaagcagcaatgtttctcatatgatacagcatacgcaagtgtcattgctcaaagatgtcattgtaccttacactcatttgctccctacaatgcacttatcagagaataaggaccgccccactcttctgtacttcaagggagccaaacacaggcatcgggttcgtaccatttatcatactaataagcatttaatgtatgcatggcaatatttatcttctttgtagtatctgaatctaagcaattggaaatgaaaatggaataaaagaacatgttagtatgatatgggctatcttaaaattttattttagaacctgttgagtctgaatccacagctctttgatattatttagagtaaagtccatcaccggtccctaaacttgtatcgttgtgtcatcccggtccctaaactcgcaaatcgaccgttcaggttctcaaacttgttcgactgtgtcatcccggtccctaaacttgtagatcactcgtataggtcctccaacttgttcagttgtgtcacctcagtccctaaacttggatttgaatatcatctgggtcaaataggacggtttaaagactttatatttaaaaataattcataactttttcatgtgaactctaatgaagacaaactttatatcaaacttgtagccctcgacgcgatctacaactttgtagttgatatttttttttattttaagtcattttttgtcccagaatgtaattttaattttaaaattacaaaatctataaacatgcaacaatattttgggaccctaaacagttttaattcaaaaaattttcaacttccaaggtggtaggccgggtcaacccctccattttggatttaaaggttggtcttttattagagttcacatgaaaaagttatgaattattttttgatataaagtttttagaccgtcctgtttagagaccggcgtgacacaactgaacaagttggaggacctaaacgagtgatctgcaagtttagggaccgggatgatacagtcgaacaagtttaaggacctgaacggtcgatttgcgagtttagggaccgggatgacacagcggtacaagtttagggactggtgatggactttactctattatttatgtatctacaaggaaactattgccatttgaagcattatgctctcaacagaacttttatttacaaaccagctttgtttatgacttatgagattgttgttctgtactactgtgcatctctatacagctttatcttactataacttctgaaattttctttcagggtggtttggtacgggagaaactatgggacttgatggttaatgagcctgatgttgtcatggaagaaggttatcctaatgccacaggacgtgaacaatcaataaaagggatgcggacatcagagttttgcttgcacccagctggtgacaccccaacttcatgtcgtctctttgatgctgttgctagtctgtgcatacctgtcattgtcagcgatgagattgagctgccctttgaagggatgatagattacacagaattcgccatttttgtctcagtcaataattctatgagaccaaaatggctcacaaactacttaagaaatgtccccaggcagcagaaagatgaattccgaagaaacatggctcacgtccagcctatatttgagtatgatagtatttacccaggtaggatggcctctgctgcacaagatggtgctgtgaaccacatctggaaaaagattcaccagaagttgccgatgattcaagaagcggttacccgagagaagcgaaaacctgatggaacatcgatccctcttcggtgccattgtacatgactcgcgagacatgattgttagtattagcaatcaatcccccatgggaggagttagttagcattccctgccaatttatggattgtttgtagtgcaaatatgagagaaatttcaacagtaggtttatgctcttgttgtcaattgtatttcgtctggagtgattccccgcattgctccatgtgtgaggtttgttggttcactgccatgagaattcatatatgaatctgcccattcggcagacaattttccatattactcagagagaagcttgagacagtacgtagtcccttatatttgttgcttctaaatgatttggctagcgttcacccaaaatgcatgcatgatcatgagcaaaataccttttgattcaacagaaagagatccaatctatgatgtttggcagtaccaaattcaggacatgaaaagcaaaagggagaaattttatagtctcaacaacatgaactgtagccaaataacagataggctgccaacatggtggccaaaggaacggagatattgtcatccacaacatcattgacaggaatacactccactacagtagctgctaatgcaacaagagccagtttaccaagtgccagatcccagcagacagtgaagtaaccaaggcaagagaagtagaacagcatcctgtgatgcaaaagatccatgagttaacaataacaaggagtaacaatgcaaaagaaccagcaatgcattctgaagcaaaaacctacagtgcagatagaaggaagccagaaatgaacattgagatgcttcctatccagctcttgttctcattgaatggcagcttcgcggagccataccttctcccaacaatgtcagcaaagcctgaaaaaataagaaccaagaaggtggatatacttagcagaagcattcatttcatcaagtgaactggggtattacaaaaaaaaactgcagattttcctaaattcccaggagatccaacatcttaccatcaccaccactcatcatcgacaacgaaacaatcccaataggagactggcgccagaagaccaaaacactgaccagcagcacaatgacatagtacagaggacctctcagcaattccctgtaagcaaccaaagatcatgtcaaggaatactattttgatttttgaatgaaggagtatcagaaataaggatcatagcacgaactctggttttccttcacgggtcaccgattttactagagcttcatcagtggaaaggcggagcccgtaggtcagaagccttatgcagttcagcaacgggacaattgccgcgaagaaccgtgcttctgtcgaattactgcgaaaggggcatgattttcttaagatctctagtctgatttggttgtagaaaacatttcgatgctggaagaagcagtggcaagggagacctgaatagtggccaggaagacatgaacaggactccggagagcacatgcacaatttttctgctcaggttctgagattaattatgaaaagaatcagaagttaacaagatataattaagaaaggtataaattttatgcttgaataatctattttcctttgattgatcaataaagaaagacttctcttttatctatcctaactactgtattttttgaacagtagcagtccatctgaaccagtcagatcttcccagcaattgaaaataaattcaagatacagatcacatccactgaattgtatataccatattttactctccggataacagtcaacagagctaaagaattgatattttttgaagaatggcggagatcaaagcttcagctccacctcaaaaaaaaaagaaatacaaaaaaaaaggaaaaacgagatccgacacctgttcgatgagccgccgcgccgtgagcccgtcgaaggcgcgcaccaaggagtacgcgcccgcggtgatgagcagcgtggcggcgcagtcccgcagcgccgcgggcgtcgccgaggccgcgagcgccgccacggccggggcggcgctcgcgg

SEQ ID NO: 11852 - DNA, 2283 bp, Oryza sativa
acgacgtcgacgggccgcgccgccgcggccattcggtagacggactgcagtgaagcgaaatcgctggtaggccaccgcgaatttttgtcggggcgcgcgcgggtttctcgttgagacggggcacttttgtagttttgtggaagcgattcgtcccacctatccacggtactgtgtactactgtatctttttccgaaaataggagggctcgtccaaccctcctagagtgtacgtaatatctttgttggaaataggattctcctgatatttatattttggaaactcatgctagcaggggtgtgtttagttcctgaaaaaaaataaaagttcaaagaaagttgagagtttagaaaaaaagtttgaagtttatatgtgtagaaaagtttttttttgatgtgatatgatgtgatggaaaattgggaataggaaggaaactaaacatggcagttttattccacaccatgaaacagagtaccaatgcaattagttgcgctgaaactatcgttcaaagcacaagcataacatgcactggatgatctctcgcgctttgctgcagaatatatacgttagatattgaagaaacgatgaaatgatttgaactgaaatattatgaaaatgattgaaggatgatggtttagcatgtatatatttagttttataatgaaataattgtaaatataattactatatgtttatatgttataagttttgcgtgtttaatgagtagaatctatatatatatatatatatatatatatatatatatatatatatatatatatatatatatatatatatatagatttattatatgaatgtggggaatgctagaaagtcttataaattgaaacagaggtagtatattttgatgttaagttttaggtgtttaataggtattagttttatagaaagaaggattattgggatgagccaaatacgagatggttctcctgatatttcaggacagggttctccatatggaggaagctgttcctgtcaactcagtcaaaagctacaatcccatttgtcagctgtaacgtttattaataatttagttcccaatttttttctctaaaaatattacatcgaatctttggacacatgcatcgggcgttaaatatagattaaaaaactaattgcacagtttacatggaaatcgtgagacgaatcttttgagcctaattagtccatgattagtcataaatgctacagtaaccaacatgtgctaatgacggattaattagacttaataaattcgtctcgcggtttccaagcgagttatgaaattagttttttcattcgtatccgaaaacccctttcaacgtcgatcaaacgttcgatgtgataccaatttttttttcgtaaactaaacacaccctaaaaaacaaacgatagagctgtaacaacacgtgatgctgtacttgggagaactcatatccaaagatagataataacttcagtaatagtaacagtaactgtttaggactttatacatcttgcgaaaaaaaaagagcgataataataaaggactcggtaacagtaacaaagataaggcttctatactagatcttccctattcaaaactacaaaagagattgaatcaggttgttccggaacacttcgtgccatcgccgccggagtcctgatattgtacgggctgttcttgctctgtcaaggaaaaaacatggcaacgtgtgagcacataacacacacagacataacacgtattagcggccaatgtaacttttacatatgttcttaacaacttaaaaaaaagtcaatgatgaaaaagaaattacttataaaaacgctaaaatcaactctaaaaattaaaagtaaacataaaatttaaatttaaaagacataaaattaaaaccttggagcaagtgcgagccttggcgttgcagacgggatactccttggggcagcaggtggagtgatccttgcagcaggtggcgccctcgacggggcagcatccccacacgatgcagtggttcctgatcccgtagttgcagcagcaggtggtccccgccgggcacttgctgtaccggtcgcattgctgcggcggcgatggcgccggaaacggcggcgacgggttcgggttgggccccttcttgatcgggtaggacgccatcatggcgatgccgcacttgccggtgcgcgcggtgacgttgcgctccatgcggatgtagccgttctttgccccagacgggcccccacgagttgcgcaccgttcagtagccggcgcccggtggcggcgtccgtgccgtaccccaccgccacca

SEQ ID NO: 11853 - DNA, 15028 bp, Oryza sativa
  unsure (1)..(15028): unsure at all n locations
tcgccggtgacgatcttgttgatgccctccacggcggcgaccgccgagaacgcccagcagctaccgcactggccctggttcttgacgggggcgacgacggcgcccttgtccctccagtccacggagtccggcagcgcctcgacgccgtcgtggcggtacgcctccccgacgcggcgccccctgccggcgggcgtggtgccgaggtaggtggcgcggaactcgccgttggtgaggtcggcgaagcggttcatcccgaggcggaacccgccgcgctcgtcggcgcgggcgttgtgggcgtcgacgaacttgaggttgtcccagaacacgcggaaccggcgctcgtgctcgccgatgaacccgttgcgcgagccgccgccgccgccgcgccggtgccgcgccaaccacaggtcgtacgcggcgcgcgcctcggcctccgtccgctccagcccccgcaccccgtgctccgcgttgtacctgatgatcgacatgatgtccggcggcgccgccgccgccgggggagcgaaggcggcgaggatgaggaggaagcaggccatggccagcgccgccgctacggacttgccgccaccgcctgccatggttgtcgtcgacgtcacgtcacgccgcggcgcctcgagatcgtcgaaacgaaatcacgtagaagtatgtgtggatacgaaatcgtgcggtgtttggttggcttgtgctatgttctggagaggcttggcggtcgatgaatttatacaggttggtggcgtacggttcgtgaccgaattttacttggtcgctgacgacgtgtcggtctcgtattggatctgtatcgtgtagagtgtactcgtttctactcctaaatctgacgtgtcacgttcaggttcggtattcgattctaaataggatgacgtgtcacgttcacacacgggccgtagcagattggggattgaggtgttacggcccggcccatttggcccacgaaatatcacctgacgacttctcttctcttctcctcttccttttcccatccgatttcttctccgggcttctggtagagtacgatttgatactatctgcgattccgcctcccctccccctcgccgccgccgccgccgcggggaaatctaggcgagactccactactaccgcacgtgtcgtaatggctcggaacaagaagaaggtagccgtggcggcgcccaaagcccggaagccgaagcgtgatgcagtaataccccgcgcctcagtcagctggagattggatcgtttttggtggaaggggaattgagctttagctaatatattttctcgtttttttttccttttggtgattgatttgttaggaggagaagaagttcgcgaagaaggccgacatgacggagttccgggcgcagctggactcgctggggttgaagattatcgaagttagtgcggatggcaactgcttctttaggtcttcttttcgattccattactcaaattcttgccactttttacaagaagaggctaatcgatgttgtacgatatgttagagtactgttagtttatgaaaggaggaatagtatatgcattatgcagtcttgtgttatatggttactcatcgtagtctgcagggcaatgggcgaccagctcgaaggcaacgaggaagagcacatgaagtaccgtgcaatgattgtgcaatacattaaggtatgcatcagatgagatgaccaaaacaaacatcttgtaacactgtgacttaataactgtagttagggtgccattgaatcaataaggtattagaaatactgcaagctttggctatgaccaagaaacatcttgtaacactgtgacttaagaactgtaattagggtgccattgaatcaataaggtattgcacatgctgcaaactttggctgtgtacatctgatctgggcgtagagtacaggctgccaggctgggttgttcttttatctaaaagacatgctgcaagcaagcattggcctatttacacttcataatctttcttgtatgcatcttacaggagcaccgtgtggattttgagccattcattgaggacgaggaaccgtttgagaaatattgtgactctatgcttgaggatgggacttgggctggtcatatggagttgcaagcagcttctattctcaagagaaaaaacatatgcatccacatggtaattttcaatacaagctttgcagtatgatttcttcaacctatgaataacacgctaggcagttgagccttgcctagtctgtattttgaaacacatgggtgatatagatcaatgtgctgcttatatatcccctgatggttctctgttatttttcgtactcattttcatattatagcctttcttctatagaagagaacgtactgtaacatttgattgatgcctgtaccattactgaatgatttgcagcttaactcaccacgatggtacataagaaacttttctgatcgtgaagctaccagtatgattcatttgtaagttaatgtgtgttctgctgttttaaactaatatgctaatactggcagtaaaaggacatacattctcatgttcctttgttttgattccaatatagatcgtatcatcagggtgagcactacaatagtgtcagactgagggaagatccatgtcaaggtcctgcaatgccagttattatcaaggtttctcactgtccaaattgtaaactgttggttgttttgtgtccctggaaggacagtgagatcctgttgtagctcaacttgctctgttactaatcttaattttatccgttatgaaattacaggcagatgccaatgtagctagcacaagcaataatgctcaaacaaaagcaaaggacctgaagaaatcttcagacagatcaaagtatgatcatatatcggttaaattggtgatggctggaactggatgttctaatatcgctgcagttgaacaggtatgaattatacaacaaatcgactttcttgtattgcaactgcgagcctaggctgaccgtagcagccaatcagtcattatatattaatggtcaatgccacatcacataggttttgaaagacatggatggtgacattgatgctgctatagagtacatgttagctgagcaactaatactgggttctgatgatgcggatggagatccttatctggactatgcatgtgatggtaaacatttgattattctgaagtctaaagtggctgtccctatgaatgaatctcatccttatctttcttgaggacttcagcttatgacaattaatgaaatttatggtgaaatttggagtacttctgggattccatagattgagttttcattgtttaatcctattcatattcttgccaaacatgagctgcctcacctgagcaagcgtttcatgcacacccctcaattcagtagcataaatctagtaggtaaaacctatactgggtgttgtgctcatggcattttgggtttatgcctcactaatatgatatttaccatttactggttatttttaagatcatcaaaatatgataacagtaccaagaagcatgaacggtgttatagaaagctcaagtaagactacggccttgttggagagcttctagctactgcagcttctcccagaattttcagctctctcaaacaatccagattcttagctatagaatccagaaaatgaactagatgccggttaccaactagctgtttctcagaattttaagctcccaccaaacagcccataccagttgctgtgctgggtgttttccatgttcagttcctctgcaattgccaaaggtcaatatcataccctgtaggaggtatatctgtactaagagttagtgtgctatctaaccaccctgtaggaggtaacatttttgtttggctggttattgttggagaccactattttagaagcacaagtagttcattttgtaaactgagggcattaactgtttcaattaatatccaatttctcatacctgttcaagtaatatttgttttacattggccatgcactgaactcatttcctttattgtgtatattacctggatcagcagagtatgtacagaccatagaggatgagcttagcatgaagcaggatgagagtcaactggatgaacacaagaaagaagaaaaggactgttctagcaaaggcgaaacagctcagaaacacaacagttcacattctaaaaaggtaactatcatgtggacgactcttaatagtttccaaacattgaattgccttgttaaaatactatgttggaaggaataaataggaattatccctttattcttttgcacagggaaagtcaaaaaccaaggaatgctcttgtggatctgctaggaagcacaagccttcttgtaatttagccacaactgtagcatcgagagaacctccaaaaacaactgcaccatcgagagaacctccaaagtatggctttataatggttttgctaaaaatatggcgccacatttttgacttgatttcagtcatttttttcccattcggattgctaccattcttttatactcctatgtaagtatgtttcgctctactatctcctctttcaagtaggtaattaattgttttcatcctaattctcttatatagtgtgtgctgcaaaaaatatggtgtaagtattgagatttggttttaatttttttttgttttttggtggaaaatgtggtgtcttaaatatagctaatcccctttataatgtttctgtccttttgtttgtcttttaccatattctattctacaactgaacttatgtcctgctgttcgcattgtaagcattctttcaaatggaatttttggggggtgaaatcaatatttccagcgtatttgcatagtgcattgctgctgttgtatctggcctatgaaaccttaacagtattgctgcaaaatatgcacttatcccatatgccttaaagtcaccgacctgattactatttcctttttcactagggaggttagttgcattgcatgtttaacacaatgctggaagtgttatgtactaatactatctgcttaatgtgctttactatcaggaccaaaggtggccaagggaaaggccagaaggggaagaagcaaaagaagaaagaacaagatgaaacaccagccatccgggatcacgattctaaagttgcaccagatctaggagctctttgcatatgaacatggtcgacgagggtgatgttctcctcagtgtgtagccgccaggaatgtgcggggcatcagttttgaagagagatgtctgcggtctaccttgcttggacgccatgatctagatggtgatttttctcttgcccagttgacggcttcacgtcactgccttctgctgactgactgttgttaagcctgtccaagtttcaggatgggatcatgggactgacggtgaggtggtgatctcagtgggcacagaaacatgaatgagctgttgatacatagcttcttttcttcatacatactttacctgtggatcaatgccatgtaaaacaatgatcagtcgtgcaaagcatattaattttgtgagaattatatcataatagagtattccctgtcctaacaaaacaaaaatacgctctattgtttgagatggagggatagtataatgggttcatcctggagtatatatagccagtcagtcacaattgccttcatgttctcgtgaaagtatctgttttaatataatactgttttctcgtgaagtatcttatctggtaagcagcttatctacttcaccagctacaagtccatacccccatgtgattacggaaaaagaaaatccataagaccaagctacagggttgttgcttagcaatcggtgaagctctcctgggtcagtcaggaagggaaagcatgttgcgatcagaaaaatggcaaaacgtggctcgcactaactcagagtcaaatgctttccttttgggactttgtgagagctccctttgggtcactgaaaaagcaatgtgcgagttgcgagataagaaagccattcgatgatgactcggataatcaaagtttaattgacatgtcattagtcgtgctggtgatagatattaaccccgtcagttgggtttggggttgtgcgttgcgtagggcaacaagctaatccttccaattaatcatagttgcactattcaaattattattgcgtgcatgaataattggtgcacgaggacggagcctactctaggatattgtcgataccatctgaattctcgtgggaaaaaaataataggagacgataagaggaatcgactggaatctgtgggagatgggctccggtcggcgcagtgtcctacagctattggatcacccatttttggctcttggctagctagtagacaccggccactagcaatgctcacaggcaaagatagattttttttaattgacatttagtaattctctttcaaaagaaaaagtagacaaatagacaatctgtagctgcctggacatatcttcggctcttcgatgagcaaaacgatgctactgtgcgttcattgggtcagcagggcacaccaggacaccggcgagactggaaggcgtgagatgtggccatcaaccaacaaggtggggagatagtacgcaacagacgcgtgttgcgcgagccgcgctgacgctgcacatacagcgcggacatgccacaggccacagcagcaagcggagcggagaagtggccgctcaagccaagcaactgcaggatcggaggcgaaatcgcggaagcaaacctcccccgagtgggcaaaagaaattcacgcggagttggccacactgccgactgcccgcgtctcgggcaaaatttgccgacctcgccgcccgccgcccggtaaacctcgcggcagattgcacgttggatttccctggtatccatcggtgaaaagcggcaactactacagtagcgcttcgtacaccagtgccgatgattctagtacggcactatcccgtcagtgtgtgcggccgattaacacgtgatctactcactggtccccggtggtgcacataaacaagcatggagtaatcaaccactgatctgcagcacgttgcgcatttcgggctgcgaagggaagggacggaccccagccacgttcccgtcatgttcagacgttgtgatgctcatgttcgcgcatggggctccggttcccaaggagatcggataggatttcagacacccggtcaccggccaccgctaacaccggccggcgagcggccgcgaacatgcatggcgtctcgtctgtcgtctcccgatcgaccgtgttcgtgtacgctaccgtggtgaccaaccagccgctctctgtgcagtgcatgggcgagttgtgtctcctcccaactctttttccttatcgggtaagcaaacggccgtgattgggggaccaactgccccggtgtcgtggtacgtatcaagtacacctccgtcttaaaatatactaattattttgtagcagagtagcaagtcaaaaaatttaaccaccgcaaaaaaagtcaaaaaatttaaactttaattattaatagtaaaaaaatttaaaaaagatcaatcatgtaaaattgatggtattagatttatcattaaacaaactattataatatgtaatttttttaccttaaaatactagttttacaatactagttttacagatattggtagtcaaactaatattttatattttagagaccttattatagtttaaaatcattatattttgggaggtagcgagtaccgcggtaggacgcgccaccacggagcgaaaggaacacgagattcgtccgaccgccgcctcgcgctcgccggcagttggccatcgttgacgcctcgctcgggcgcccggaaatggtgtctcgccacgtgtggatattatgggtaccccatacccatacggcatggttatccgactagtcataggggataacttatatctatggaatatgtaatagatcatgactcgggtattacgtttccttatatattacggaacagcctaaagtcctggtttgataagattgtaaagtagaccgataccgtgttggttaaggtttctatcttgtaatcctgccccccatcataaggtgggcaggaagccctctagggggcatgagacaacctgatcgtcagattaatacacactcggcggattcaaatccccaaacaggagtagggtattacctctcattgagagggcctgaacctgtctaaatcctttgtctccgcatccatccacttttaggtctcgtgcgctaccccttttattattgccgaattcatgtttcgacagttggcgcgccaggtaggggctgcgtcgagttttccgtcgagaagtgcgatggaactttgtgctggcatcatcggtgctactcttgtctttggccgtgatcctctcaacaaaagggcagggtcttcgtcgccaaaaattctatctggatctggtcaatcaaccaggagattaatcaccgatcgaatcgatctacaaccagcttgttaccgtcaattttacctccgtcagtgagatcaaatccgtcgctacaatgctgccatatctgttggtccgtcggtttcgtcaccagggcatgatttgaagcaatcagcaagcagccgccgccaaaatcatgcgaagatcaccgttggttgagcctgtacatcaccaagtcaatactactcggatacgtacggcaagacacaaagtccaggatacaaattaaatatacctggtcaaatctgtggtcaaggaaattaatccatacacaaatcagctattacatgcacaaagtggtctccaaactaatccgtgcatgtgctaccgacgattacatgtctacacggctgcatgacacggctgcatgctacggttcatccattgacaggcctcgaatcaaagttggatcacaaaccaggtttatcgttctaaattttcttatataaattagaattaattcacagatcactaattattatttgatctattattttatacatgtaccgccggccgccttcgtcgctgccgattggtttcatcgcctccacggttggtgtgcgccgctgccgttgcnnnnnnnnnnnnnnnnnnnnnnnccggcctgcctccgtcgccgccgactggtgtcctcgcctatacggtcggttggtcacaccaccgttgatgggcatcgtcatctacaccgccggcctgcctccgtcgccgccgactggtgtccccgcctatacggtcggtctattatgccgccgctgttgggcgtctacgacttcaccgccggcctgcctccgtcgccgccgattggtgcctccgcctacacggctggcctattatgccgacgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctgacctattatgccgccgttgttggacgtctacgtcctcaccgttggctcaccttcgttgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaaggatccagatccagatatgcataaaagggattcatggctttaagcttatctcttacgctccaggaatggatcagtcagaacgtcaccaccggctcgcctcgaccgccgccgactggtgtttccgcctgcacggctggcctattatgctgccgttgttgggcgtctacgtcttcaccgaccggccgcctcgtccactgccgactggtgtttccgcctgcacggctggcctttatgccgccgttgttgggcgtctacgtcttcaccgaccggccgcctcgaccgccgccgactggtgtttccgcctgcacggctggcctttatgctgccgttgttgggcgtctacgtcttcaccgaccggccgcctcgtccgctgccgactggtgtttccgcctgcacggctggcctttatgctgccgttgttgggcgtctacgtcttcaccgaccggccgcctcgtccgctgccgactggtgtttccgcctgcacggctggcctttatgccgccgttgttgggcgtctacgtcttcaccgaccggcttgccttcgccgctgccgactggtgtttccgcctgcacggctggcctttatgccgccgttgttgggcgtctacgtcttcaccgaccggccgcctcgtccgccgccgactggtgcttccgcctgcacggctgacttattatgccgccgttgttgggtgtctacgtcttcaccgaccggcttgccttcgccgccgccgactggtgtttccgcctgcacggctggcctttatgccgccgttgttgggcgtctacgtcttcaccgaccggcttgccttcgccgctgccgactggtgtttccgcctgcacggctggcctttatgccgccgttgttgggcgtctacgtcttcaccgaccggccacctcgaccgccgctgactggtgtttccgcctgcacggctggcctattatgctgccgttgttgggcgtctacgtcttcaccgaccggccgccgcatccgccgctgactggtgtcaccgcttgcacggctggcctgttataacgccaactgatgctatcttcttcacggctggctacatcgctgtcgctactaataggcatcagtatcttcaacacaagctgcctacgtttgccatggctaccgactgttttcttcacttccatggctgcatgattctgccagtgttgattggccttaccatcttcatcgccggtcgtctcgtctgctgctgactagtaccctcgtttctacatctggtttatacagctatcactactgatgaacatcatcgtcttccgtcgccgactggttatgttgtcgccgactagtgcttttattttcacaactgcgcgtcttcactaccagtttgcttctgttgccgacgactcgtgttcacttcatcacggcaatgcaactttgtcatcatggtagagcaacttcatctttattatcttcggcactggcaaactctattgctgctacttcgcaagttttgctacttcaccaaccacgacgtctttatgagcctcgacatctcggcatgcgatgccatgttattttactacaacaagaggctctccaacattcatgatttctacttggacatcttcaacacatatcttcaatcaagcaataactattcgacgacaagaggctacagttctcgactctatgttcagttgtttcccaactaatcaaagagtcggggactacacaactacaaggctcaaaatttgacaaattttatgtcaagctgaagaaatcaattaatcagccaacgagtcaactccaggagtcattatcttcatctttgcttcggagcagacattctacttcaacaacttcaaatatttcggtttagacgagttgggcaacaacatcaactctcctccaagtaaagcatctacaacagctataacattaatttgatggattattatcactgacatcatcaccagcacctctgcttcatcgaccctgacatctccgctgttgctaatggatgattatgttttcgccgacttattatttcaccttcacggttgacctactatgcaaatgctgatgagcgtctttgtcattatcattggttgctacactgctattggctggatcaccgacatcgtcatcttcatcatgtcggttgcgtttgtcgtcgtcaactattttcttcatcttcatgattggtggattttgtcatcacctttgatctacctcgtctgtcaccgactgattattttgctgccatggctacacaactttatcgctgggctccttcatcttcattgttagttgatctgtctgccgccgactggtttcttcgcctccatggctatgcgacttcattacttttgattggtatcactatcttcgctaccaccaatatttttgccacctctggtgggcaatattctctctatattggttgtcttgtctctatgccaactgcgtcagctaccatcaatgaacaattgtgactacgtgctcaggggcttactagcttaaatacaagtattatatcttcaatttggacttgctccggatacatgcaacatgaattcatgatcatgggtctattttatatgctcaaagactggactatttattattccccgtaagggttatcaattgaatacttgcgccagtcgggattcaattgttacatctattttagagtatcccataagggataaccactcagatcagaagctattcatatgagctacgcttggtctatattacccggaagatttattactcgggagcatgttatatgcgtcatcctttaaagggcgtcgaaggcatatgttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaatagtaaagctttatatagctgtcccgctgacttttttatatataagtcaaggtgctgtttgggtttttaagcatttgattggatacaatatcattgcttttcgccacgtaagtgtgcatttttattgaccaatattatggcttaggctgattatatgttgtggccattttctaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttggaaatttctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctgcacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgactagtcataggggataacttatatctatggaatatgtaatagatcatgactcgggtattacgtttccttatatattacggaacagcctaaagtcctggtttgataagattgtaaagtagaccgataccgtgttggttaaggtttctatcttgtaatcctgccccccatcctatataaggtgggcaggaagccctctagggggcatgagacaacctgatcgtcagattaatacacactcggcggattcaaatccccaaacaggagtagggtattacctctcattgagagggcctgaacctgtctaaatcctttgtctccgcatccatccacttttaggtctcgtgcgctacccccttttattattgccgaattcatgtttcgacaccacgtacacggcggcgatggccgcgtgtgcgtcaccggccagtctacgatgggtagctgcagtacagcgaccgcagccatccatcagtgacgggatcactttaacggcatgatgcaaatgaagatagtattgccctattattagtgacaattgacaatattatggcatgcgattagcttccggcgcattacagcgcgcgagtattatttagtggttttctaggaggtgtaaagcgtttcaaagcaaagattaccctctcagcaagtagtcagagtcttatccgatgaagtacatgttaaattaggatactatatactactaagtgatgagaaagagagagaaagtgaaaattggaaccatgccattatataaaatttaagatatgccattttgacccacatgtcattgactcatgtgagttctttatgtcattgagataccgatgacatatcttaaactttgtaaaattataatggcatggttcttgtcgatgacatgggaccgggagtatcgtgactagaggcttgaggcagacacaatcgcccacgtggcctggcacccacgggggggggggggggggggtcgggcccgagggtggtgtgttcgccctcctctttgtctccccgagggggtcggaccgctctcgccttggccccgagggctggggcgccccgaccccttgtggattttgcgccgcgtgtatgggttaggtgagcacagcggcgctcacctaaccgcatttattgcggtttggacgaacgcgtcacgccgcgtgtaatgcggtgcagcgcgctcgtttatccggtctgtgaccagtcacagaccggtcagatcgtgggttaggtggcgacaggcggtctgacgcacgcctcgccccgtccagtcaggacgagagcctccaagcactcgtccctagccggagccggcgtgttacctcctggagatgacacgttggttccggtcagatatataccaggcttcatcctaaccattacaggcaagatgttgta

SEQ ID NO: 11854 - DNA, 4496 bp, Oryza sativa
gaaccttccacagattgggagcttagaacctcacccagggcccccggccgaactggcaaagggggcctgcgcggtctcccggtgaggagccccacgctccgtcatctggcgcgccaggtagggggctctgtgagtgatcttctgagctctcgcactctttcgtgttcgccaagcttttcctgttcagcccaatggccgagcaagcaaaggcgcacgacctctccccgagtatgagcggtgacgacggggagctaaacccacgccgtcgagctcgtactccaccgccccctccacgccaaagtcctaggcgggagaaggcgctcgagagggccgaaggatccgcgacttcgacatccacaggaggtggagaagggcggcgagatggggagcgtcgcctcctcgtctacggcgacggcagcacgccccagggcgcgctccaagctgcgggcgcgctcctacgtcacccgcccgtcgcccatgacccggagtctccagcccaacgttggctggacgatgtggccaaattggtcatgactgcacggcagcgcctggatgctggtgggcggtcctccgccaccaaggcctctggtgctgctaccaccggctccgcgtcgtcaagacggagggcgcggcgagcggcagccgctgttcgccattcggccgccactccttcgtcaacgcctctgacccgggaagatctgcgtgggggaccggatgcccgcatcagtatcgagcgccggcgtaatggccgacgtgctccccacgcaacggagggcgcctcctcgtccggagtgtcacctcaccacagacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaggcgcggggttggctaatgaacttgccacccgcgtctgtccactcttgggaggatttgtgccaacagttcaccatgaactttcaaggcacatatccgcgcccaggtgaggaagcggacttgcacgcagtacagcgaagggatgatgagtcacttcactcgtacattcagcggttctgtcaagtccgcaacaccataccatgcatccctgcacacacggtgatttacgcgttcagggggggtgtgcggcacaatcgcatgctcgaaaagatcgcctccaaagagccccagactaccgcggagctttttcagctcgcggaccgagtggctcgtaaggaggaggcatggacctggaacccctccggttccggtgtggcagcttcggccgcccccggatccgccgctcagacagggcggcgtgacaggaggaggaagaagaggtcagcccacaccgacgacgagggtcatgtcctcgctgtcgaggacgcttcgcgggccactcgaaaggggaggcctgcgggcgacaaaaagaaggaggccggcgctcctagtagggagcgcccaaccgacaagtggtgcatcgtccacaacacttcccttcacgacctcgcggactgccgtgcagtcaaaagtttggctgagcggacgaggaagtgggaggaggagaggaggcaggagcgccgagagggcaagtccccggcggttccttccagcaatcggcgaagtgaggccaagcagaaggcccccgccgaggacatcgatgacggcgatgatgacctaggtttccaagagcctggggccaccattgccactgtcgatgggggagagtgtgctcacgtttctcgccggagcctcaaggccatgaagcgagagcttctggccgcggcccctactcatgaggcgacgcgccgggcgcggtggtcggaggttgccctcaccttcgaccagaccgaccacccaccgtgcgttgcccggggaggacagatcgcaatggtggtttcccccactgtttgcaacgtgaagctggggcgtgtcctcattgatggaggagcagccctcaacatcctttcccccgcagcctttgacgccatcaaggccccggggatggtgctccggccgtcccagccgattatcggtgtgacgccggggcacacttggccgctaggtcatatcgacctcccggtcaccttcggtggacccgccaacttccgcacggagcaggtgaactttgatgtggcggacctcagtctgccctacaacgcggtcttggggaggcccgcgttggtaaagttcatggcggcggtccactacgcctacctccagatgaagatgccgggccccgatggccccatctctgtccatggcgacctcaaagtcgcgcttgcttgtatggagcagcgcgcggaccgcctcgccgtcgcgtccaagcccgagggtggcgacgagaggcttggcacatccgccccccgccgccccgaggcagcggatagtcacatgcgacgaggtcccggtcaaggagattgccctgggcgacggcccgtccaagaccacacggatcggtggtcttctggacggcaaataggaagacgcgctcgtctctttcctgcgggcaaacgctgacgtcttcgcatggaggccggcggatatgcccggggtccccagggaggtgattgagcaccgtctcgccgtgcggccgggcgtaaggccggtccggcagaaagtgcggcgccaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccacagcggggtgcgaccttttgtgttttctagatgcatactctggttaccaacagattcgcatggctagggaggatgaggaaaaaactgcgttcattacccccataggaacttattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagaccttactctcagatctagcggaaacttttgagagtctccgctccgcccgcataaaactgaaccccgataagtgcgtgttcggtgtacctgcgggcaagcttctcgggtttttagtctctgcccgaggcatcgaggccaatcccgagaagatacgagctatagagcgcatgcgccccccagcaagcttagggatgtgcaatgcgtcaccggttgcatggccgccctaagtcggtttatatcaaggctgggagagaaggcgctacccttatttaagctcctcaaacgctccggaccgtttacctggacggaggaagctgaacatgccctcgcccagttgaaggcgtatctcagctctcccccggttctggtcgccccggagccagatgaacccttgctactttacttagcggcgaccccgcaagtggttagtgcagcgttggttgtggagcgcgatgaggataatcctcattcgcgcatccccaccctgtgctggcttggcccgggagagagcagggaggagaggcccccgagccgaacggcggcccaaggcccccgacgaccggagttggccctctgcccgcttgtcagatggtgccaggtgcccccgaaccccaggatggcctgagggccactgcgggaaggccgcacctatcaccctctgaccccgaggctaatcctgtgcccgctcgactcgggagagagcagggagaagagacccccgagccgaacggtggcctaaggcccctgacgaccggagttggccctttgcccgcttgtccgacgacgccaggagcctccgacccccaggacggccccggggccactgtgggaaggccgcccctgtcgtcctctgaccccgaggtcgtcggcacagaagacgagcgcgcctcgcgaggccgcttggacgaagagcgccccagggatgtggcccctagcgaaggggatcggccccaccgaaaggtgcagcggcctgtctactttgttagtgaggccctccgggacgccaagacccgataccctcaggcccagaagatgctttacgctattctgatggcctcgaggaaactgcgccattatttccaggcgcatcgggtcatggtggttacgtcttaccccctcggccaaatcttgcataatcgagagggtactagacgggtggtgaaatgggccatcgaactttctgagttcgatttgcactttgaaccacgccacgctatcaagaaccaggccctcgccgattttggggcagagtgga

SEQ ID NO: 11855 - DNA, 12423 bp, Oryza sativa
cggagacgtcctcagatatttggttcgccttgactttcgggcgaccaataatatggcagagtacgaaggactccttgcgggactcagggtggcagctggactggggatctgccgcctcctggtgttaggcgactcccagctggtcgttaaccaggtctgtaaggagtaccggtgctctgacccgcagatggacgcttacgtgcgccaagtacggcgtatggagcaccattttgacgggatagagcttcggcacgtgcccagacgggataacacggttgccgacgaactctcacgactcgcttcctcgcgagcccagaccccaccgggcgcttttgaagaaaggcttgcctagccgttggcgcgacccgaccccttaggggagacggacgcgcctgacaggcccccgatgcccgtcggagtccaggcctcgggacccgaggggagcgctcctagctcccttagattgattgcttggatcgctgagatccaagcatacctcacagataagactctacccgaggaccgcgaagggagtgaacgcgtccggcgcatttccaaacgctatgtgctggtagaagggaccctctatcggcgcgcggctaacggaatcctcctgaagtgcattcctcgggaacaaggcgtcgagcttctcgccgatatccatgaaggcgaatgcggagcccactccgcctcgcgtaccttggttggcaaagcttttcgacaaggtttctattggccgacagctctcaatgatgcggtcgacctagtccggcgatgcagagcgtgtcaattccacgccaagcaaatccatcagccggcccaggccctgcagatcataccgctttcatggccatttgctgtctgggggctcgatatcttgggaccgtttaggcgggccccgggcgggtttgagtatctgtatgtcgcgatcgacaagttcactaagtggcccgaggcttatccggttgtcaagatcgataagcactccgcacttaaattcattaagggcatcacagctcggtttggagtgcctaaccgtattattacggataacggcacccaattcactagtgaacttttcggcgattactgcgaagatatgggcatcaagctctgcttcgcctcacctgcccaccccagaagcaacggccaagtggagcgagccaatgcggaaatcctcagaggccttaaaaccaagaccttcaacatcctcaagaagcacggcgattcgtggatcgaggagttgccagcggtgctctgggcgagccgaaccacgccaagccgagcaaccggggaaacgcctttcttcctcgtctacggcgcggaagcggttctcccatccgagctcaccctgaggtcccctcgggccaccatgtactgcgaagctgatcaagatcagcttcgtagagatgacctcgactacctagaggagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccgatgtgggagggtccgtatcgagtgattggtgtcccccggccgggctccgttcggctggccacgagcgacggcgcagaactgcctaacccgtggaacatagaacaccttcgtcgcttctacccctaagggggatcgggtatcaggatttaggcttgggccaaccccgcacccccctcgggcgtgcagggttggccgggggctgccacatatgcatattcttatttctcttatatctgtacctcaataaaagtattttcgatttcctaaaggctgtatctgtgctgttgtttccttttgaagaatcttgacttgaaataggtcactcgtgttcaatcctgccctcgggggctcgggtcggctaaaatcgccaaacggggcccagaaccgagccgtgccccggggcgtggtgaactccgggggagaatcggcaaaaacccacaatcgggtcacccataaccctcggtcaccacgctcccggcctggccagtctcgacatgtggatctctccaggcactagccccgacccgagccatttgaggactaggacctgggcacgagcccttgttcaagccaagacacaagagaaccgcggcacagacatccttgtctcatacacacaacaaatagaattaacacaaaaaatttcctctttatttgattgcagattaaattagtctatacaagcagggggcccgaaggccttaaaaaaaaaagaagatactatttaaagattggcgggggcctgggggctcactccgacgcacccggatcgccggcctcgtcgccactattgcccactccgccgtatcatcctccccgtcggagttgagggcgaacgcgagccgaggggccgaaccctcgaagctgtggacgatatggtcggcggcgtcccggacttgcgcgcgtgcgccgtcctcggttccgggagggaactcgtccagcgccgtccatggggagaagtcgggatccctggcttggtaactcgccagtacgagctccaccgctcctcgggcgaggtccctcgaggatgacttaatcgtcctctcgagctcctcggggagccgttggagagtcccggctatctccgagaggcgctgggcgaggcccccttgggtggcggcgtacttcgcagtctgcccgccccagaggcccacctgccggccggcgcggtctagacgggagacggcatcccgaagcatgccgggccctacctcgcctgccaagcggagggcctcgacctccccggcggacgagtctagcgcgccctgcagatcggcgatggtgtgttcggcagttgcgaggcgagcggttaagtcgctttcgcccgcggccgccccgccgatccgtgccctcgcgtccagctccttctcccgcgcctcgagctcagcggcccgctggttcagcgcggtcctctcggcgcgggcatcttccagattacggcgcgcctgttcctcttgcgaagcctcgcggagggacaggctgtccgccagccgttgcgccgcggcctcggcctcctcgagagctcgctcccgctcggtgagcgcgtcctcgcggaggcggagtgcggactcttcttcggcacaggcggcttcgtgcaccgctagtgtgacctcccgaatagcaacggcggcctcgcgatccgccaggtccctctccacggcgcaggcacgctcttccagcgccatggcacgggcctcaagggcttcgtcgcgccgccggatgccactccggtctccgccgcccgccgttctcgggcagcggcagcgtcaaggaccccctgggcggcatcgagttttttctctagctccgcctcccagctcccgtattgaaggcggagggagtcctgcgcctcgttcatcacagtggtggcgatgagggcagccccccgctcctcctccacctccttggcgatctcctccagcaccttccgacgggcttcgagctctgagacgtgccgacggtgtgccttgcgacccacttccaccatggcctccaccgagcgtcgcccctcttcgacacgcacccatgcggcgtcgagctccgcccgctctgcttgcagggcctccacttgggcacttaacccgtccaacaccgtcgtgtttgcgacggccaaggcccgcagaaggggttctgcgctcagtggagcagcagaaggcgtggggaagagccgtctcggtgaggatgccgcgcggctcggcccgccaatggacgtgccggactcagggatatcccccggacctagcttatcctgggcgtcgcccgaggaattgggcccaagcgatgcgcccgcggcctcgtcgcaagctgcctcggaagtcgtcgccgcctcggcctggtgaagtctgacctcttcccgagcggcttcttcagctaggcgagcttggacggccacctgaacagcttcctcggcttctcgaaggcgatccgcggcctcttgccggtcagtttcacgggtcgcctcagaggatgtcgtcgcttcggcctggcggagtccggcctcctcccgaacggcttcctcggtctggcgagccagggcggcctcccgagcggcctcctcggcttcccgaaggcggtctgcggcttctcgccggtcagattcccgcctccgggcctctgtggacgccgggtcctcggactcagactggccggacttggaatggcgggagggacgcgacgggatctcgctgaaacagaagaaagaccagaagacaaaacaagatggatgagtgaaaactcgcgttaaaggaatgaatacggccatgatgggcgtgggacgaacctgcgagggggtcggttaaacgaccaccttggaggggaaataaggtttccccgggatggttctgtccccctcatcttgcggggccgtttcttcttccgctccccctcgggctgcgacgtcggcgtggccccctccgggcgcctgctgctggcacgcgccgccccgccccctcggggaggagatgagggaggggttccttcctgcttcctcttcccccgggcgtcggcagggtggccgctccccgggcccccgtcgcgaggcccagaagcacgaccccctcccggggtagatcgttcccccctgcggctcccgaccgcgccatcgtggcctcgaggagcccgctcctccgatgccccgaccgcctgcatgatggtcaagatggaggcacggtctggatcactgcagagggggaggactccttgaggaacgagggatgcctccacggagctgagattcagcacccgttggaccactatcttgaagtcctcaggagcccagtcccatcggaccccctggtgggtcctcatacagtcctcggacccggtgtactcccaggcgccccgggcgcgccgctggagtggcgcgatccggcgacgaagatagtcgccgaacaccatggcccctgtgagcccctgagatcgcaggcccgccaggcggtcgaggacggcgtcgtagccatctcccagatctaccggcgcccgccagttggaggcctgcgctggaggctggcttgggagtcggaggcgcgattcgtcggcgaggggggtgtagaaccagtcgctcttccagtcatcccacttcttgcggaggacgcagggaatgtagcggttcagcaccggcccccgcggctggaagtagcaaccaccaaccaccgacggcggcgaaaccggctgtacggtgaagaaccaccggaacagccgaagggatgggcgcaccccgatgaacatctcgcacaagtgcgcgaagatggccaatgtcattaccgcgttgggggtgaggtgcgccatctggagatcgtaaaactccagaacatccacgaagaaagaagaaaatggcggaaccagccctgccatagcaaaagggaggaagaagacggaccgccccgggtagcgtggcgccgggcatccttcgcccagcgagactatctcccggccggtcgcagattccggcatgaagcggcgcagcagcccggcctgtctctcgctcacgatgcgggaaggcggcagcacgctaccgtcaagcggagcggagccccgtgccatgacgccggaagaagagatgtttgagagcgagcgcgtgtggcggaggtagggcacaggaaacaaggagttagggcgcaagcggcgaagacaaggggaataatggcgaaagaaaggaagcaaatctcttcctcggcaactttatacccttgccaacgctgtgcccggctcctcgtttctcgcgcccactatcttgccccctcgtttctcgcgcccactcttccactaatcccattcgcccgtttacggtgcatgaggtggatatgcggctgtggcagtcgagatggaacatctcgtgcgcgcgttaattacgctcgccgaccgaagcgccatcaccatatctccaggcaaaacgaaccggcacgtcccgattcacacgttactcgagtaatgtggcagtcttgaagagaccgttcattattgacagccgagtaaccgttgccgatgtgcgtgatttgcgactgatgggtttctgcccaactgtggagaccggtcccacctgtcaccaggccttaggaagtggcgtcacgcccgaccgcttccctcgaggagggtaatcgccccggcataacgccgggggctactgtcgatgacatgggaccgggagtatcgtgactagaggcttgaggcagacacaatcgcccacgtggcctggcacccaccgggggggggggggtcgggcccgagggtggtgtgttcgccctcctctttgtctccccgagggggtcggaccgctcccgccttggccccgagggctggggcgccccgaccccttgtggattttgcgccgcgtgtatgggttaggtgagcacagcggcgctcacctaaccgcatttattgcggtttggacgaacgcgtcacgccgcgtgtaatacggtgcagcgcgctcgtttatccggtctgtgaccagtcacagaccggtcagatcgtgggttaggtggcgacaggcggtctgacgcacgcctcgccccgtccagtcaggacgagagcctccaagcactcgtccctagccggagccggcgtgttacctcctggagatgacacgttggttccggtcagatatataccaggcttcatcctaaccattacaggcaagatgttgtatgaagaagggcgaacatgcagattgttaaactgacacgtgatggacaagaatgaccgattggtgaccggtctgacaatggtcatgtcgtcagcagacagccatctcccacgtcgcgcctgcttccggtgaaagtggaggtaggtatgggccgtcccgtcagaaggtgattcggatggcagcgatacaaatctccgtccattaatgaagagaagtcaagttgaaagaaagggagggagagatggtgcatgtgggatccccttgggatataaaaggaggaccttgcccacttagaaaggagaggagaaagcaatcccagaagaatcgggggctgactggcactttgtagcttcttcatacgcgaatccaccaaaacacaggagtagggtattacgcttctcagcggcccgaacctgtatacatcgcccgtgtcttgtgtgtttccgctcttgcgaaccttccacagattgggagcttagaacctcacccagggcccccggccgaactggcaaaggggggcctgcgcggtctcccggtgaggagccccacgctccgtcagttctaaattacccgatgagaaagggaggggggggggaaaatctgccttgtttatttacgatccaacggatttggtcgacaccgatgaggtgtcttaccagttaccacgagctagattatagtactaattacttgaggattcggttcctaattttttacccgatcgacttcgccatggaaaattttttattcgggggagaatatccaccctgtttcgctcctaattaagataggaattgttacgattagcaacctaattcagatcagaattgttagttagcggcgttggatccctcactcatcccatcccaattcccaaacccaaactcctcttccagtcgccgacccaaacacgcatccgccgcctataaatcccacccgcatcgagcctatcaagcccaaaaaaccacaaacccaacgaagaaggaaaaaaaaaggaggaaaagaaaagaggaggaaagcgaagaggttggagagagacgctcgtctccacgtcgccgccatggccgcccgcgccgccgccgccgcgttcctgctgctgctcatcgtcggcgcggccaccgcggcgccggacatgtcgatcatctcctacaacgcggagcacggggcgcgggggctggaggaggggcccacggaggccgaggcgcgcgccgcgtacgacctctggctcgccgagaacggcggcggctcgcccaacgcgctcggcggcgagcacgagcgccggttcctcgtgttctgggacaacctcaagttcgtcgacgcccacaacgcccgcgccgacgagcgcggcgggttccgcctcgggatgaaccgcttcgccgatctcaccaacgaggagttccgcgcgaccttcctcggcgccaaggtcgccgagaggagccgcgccgccggggagaggtaccgccacgacggggtggaggagctgccggagtccgtcgactggagggagaagggcgccgtcgcccccgtcaagaaccagggccaatgcggtaaggaatttcttctctttcctcatctcatctcccttgtgcgattatttaccattgaaagcttagatgcgattatctatttgtcacgctaatctcggatctaagtagggcaatttcacaacagttaattcaggttcacagctagtaatcttttgcccctacttgcaaaacagtgcagatttccttctgatatatacataatataatagtagattatgattatatagtcacacaccgtctagtctctagaaaagatgggtcatttttctagctaaagctgactttcccccctgaatgagcatatctgatttaatgacagagttattgttcttttaatacgatgataatttactggaccgaataattgtttggaattctatggtaaggatttattacgtagtggatgcaggatgtattcttggaaaatcctctcattgggttaactgtgtaaggtatttgttctcttcgttctttgcttctggagttggcaacggctgtgacttgtgaatcgtgcagtgacagcggtgtggacttgaacagattcaaagcccgccgttggttggggctgacttgctcagtgtggtttccttgtttccaggattgtagtttagcttagcttgttttttcctgattttaggactgccgtttctgtggttgtgctgcttttgtctttatatttttaaaggtctttttcggtgcatctatcagtcaaatactttggacaaggtgaccctgtaaccaactactaagacattaaaccgatttgatgatgttgctttgcattgcaactattttgggcctttaagacttttaagggatatcacaccttatcaacctttcgtgttcagtcgagcaaactttttatcctgtgctgggagctgtttgctgatattagcctacaggtgtcttcaaactgcttttgtgggtaaaaacaggggtgaaacaaatgtctgcaaatatcttactatccatcttgatcttgataatattgatacaattaaacagtttagggttcttgcctcatattacaattggttgcttgcggtatgattgcagttgttgctctcttggatgacactagttattttgatggttactgacatctttggtcttgaatggtgggatgcaggaagctgctgggccttctccgcagtaagcacagtagaaagcatcaaccaacttgttactggtgagatgatcacattgtcggaacaagaacttgtagaatgctcaaccaatggacagaacagtggctgcaacggtgggctcatggatgatgcctttgacttcatcattaagaatggaggcattgatactgaagatgactatccttacaaagctgtagatggcaagtgtgacatcaacagggtattaacttattttctgatgaataacttcatacattcatctttcagttcccacattatgcaaatcgctaatgtttcaacgggtgcattgttttaggaaaatgctaaggttgtgagcatcgatggctttgaggatgtacctcaaaatgatgagaaatcacttcagaaggcggttgctcaccaaccagtcagtgttgctattgaggctggtggccgcgagttccagctctatcattcggtaaatgaacttgcagatatcaccccatgcatataggaggttttggtcgtaacaactattgatttttacattacagggcgtcttcagcggtaggtgtggcacaagccttgaccatggtgtggttgccgtcggttatggcactgacaatggcaaagactactggattgtccgcaactcttggggcccgaagtggggtgagtctggatacgttcgcatggagcgcaatatcaatgtgaccacggggaagtgtggcattgccatgatggcatcataccctaccaagagcggagcaaacccacccaagccatctccgactcctccaactcctccaacaccacctcccccatccgcccctgaccatgtctgcgatgataacttctcttgcccagcgggcagcacctgctgctgcgcattcggcttcaggaatctctgcttggtttggggctgttgcccagttgaaggtgcaacctgctgcaaggatcatgccagctgctgcccgcctgactaccctgtctgcaacacccgggctggaacctgctcagcggtaatctcctcgctttcttgttcgttcttactgcaactttatactgcctacattctattccaaagattgttttcatcatagtattctgctccgacaagctatacggttttgaaaaggcacgaggctttcatgatctgaactcagcaaatatttgtcatcatgctttttctgaaaaaactagacattaaggttgctttggctccaaagatagttcagataactgtaatgcactaactgacctttcttctgttggaattgtgcaagatatttgaacgtacgaactgaccttccttttgttggaattgtgcagagcaagaacagcccattgagcgtgaaggctttgaagcgcacgctcgctaagctgaacaccgcatgagctcatcgataacatgtaatcggcgaggagaggggatgaggcagcgtggagcctttctgaaatttctgcttccgtgcctccatatatcgttgtcgcattttgaggggacagcttatttactctactgcctgccttttatcttacagtgatctgtgtacatagctcgatccaatttgtactcttatttatcttctccaatttgtactctatataatttatcatctcaagaatacattaacgaagatcctgttttaccgttccaaattctcattattcacttctgtcgaaatatagctacaactagtacatctgatcagtgaatttcagaacactgattacttgtaaggatacaatggaaggatgcaagaatgttcgtgtttgcatccttccctcttattgcgatgtgatatcagattgttgtcagcaatgcgtcaggctgagatttgcggcacaaattggtaggccgttttccgtttattgaccaacagttacaaagtttggaatcatgcgatctgaacgacaaaacgctgacaaagttggtgatcgctgatcagttcagttgccaccacctccgccgccgccgccttcttcagctgccacagccgaaggcaacgccgccgccggcggcctgaagcccggcaggtcgcaggggatgtgcggcacgaaggggcagtgctgcggcgggtcggcgtagaagcgggcgcactcgagcgccggccgctggtgggggaagttggggatgcagttgaggcgcacgtcgagcaccttgctccggacgagctcgaggcaatggcggcggccgacggagtggaagtagttgtcggagagggagaggttctgcagcttcccggtcttggccagcgcgcagagcacgtcggggatgtggccgtacagctggttcccggcgaggttgagctcctcgacgagccccaggcagccgagggagagcgggatgggtccggtgatgtcgttgccgccggcgtcgaacacggtgagcccctccaccaatccgatctcgtaggggaggcatcccgagaggtggttgttgaggaagagcacctcggagaggttcgccgacgtgttgtagatggagcgcgggatcgggccggtgaactggttgttggccaccaccaggtactccgccgtggtgctcccgaagttgtccgggatgttgccgtagaagccgttgttgttgaggaagagcgcgacgacggtgaggtcgaacaccggcggcggcaccgtgccgacgaagcggttgaagcggaggtcgaggaagaggaggcggccgagcgggacgacggtggccggggaacgcgccggagaagttgttgttggagaggtcgagctcgtagaagtacgggaggccggtgaggtcggggacctcgccggagaagttgttggagttggcgtggaagagcgctaggtccgggaacgcgtcgacgaagccggagaggctgggcgcgccgaggccgtaaccgttgaagtcgatggacgcgatggtgagcgtggtgttgtccttcggcgtcgttgcacccggcggcgccggcgggtgctcgcagtaaagcccttgtacatgtcccggccgaagtagctgtcgcaaaggttggggccgacccacgacgccgtcac

SEQ ID NO: 11856 - DNA, 11087 bp, Oryza sativa
  unsure (1)..(11087): unsure at all n locations
cgccggcccgcagccacacgtatccagcgacggcgccgataccttcccttgtccaccgcgatcgggcctccacgacggcgcattgcgcgacaccatggcgaagtgagtatggctggggtcacacaccacgccgtgcaggtgcagcgcggcgagcaggagcgcgagcgcgagcgcaagcaggcgcgcattatggcctgaagccgccgccatggacgcacgttagatggtggtgagacgtgggggggaagacgagttttaaggaggaggaggaggagatgggtccatggctccatgaactccattgacatggaatggatcagcacaagtggagcgtgctttatgggaaaaactatattcattttttaaggggatatcatctcgtttttacatgtcactcccaaaataagtgcagttttaacaccgttcatgctcaacgtttgaccgttcgtcttatttgaaaaacaattatgactagtatttttattgttattagatgataatacatgaatagtactttatgcgtgactaatatttttattttttttataattttttcaaataagacggacagtcaaaacgctggacacggatatctatggttgcacttattttgggacggaggtggtaaaaaatttagtgtagcagattatggctcggtttagttccaaactttgaatcccaaaaacgtcacatcgaacttttctacacacacaaactttcaacttttccgttacatcatttcaatttcaatcaaactttcaactttagcgtggaactaaacacaccctatatgtgatatgtcacttcaaacatgcatattcaaattcaacttatacaagtaaaaacaaaaatagcaaatttaactgtgaaaagaacacgtaatttacggttaaatttgtttgttatttttgtttcaaattacatatgtcgaattttaacttgcatgtttgcgaaaagatatatcatatattgatcacaatatatatcttgataattttttttaaaaaaattttgataactttttaaacgatacgcacaaaacgagaggatgtcccgacaaaaatccacttccgctttatgggtgaaaagaggtgggaataggagagaagttgttttgccggggaagagaggaggcaatggcagccagcaaagagagaggcggtagtggggttggcggttaattagtcgtcatcgacggtaggagtgaagaagaagaagaaatgaagcagcgctcgtgcgtgcaggcagcggcggcgtgcagctcgcgaccactggccgagccgagcggggcgtgcacttgattccagggcgaagtggctacgtgcctagctcgcgaagtgaatacacacataatagtatggcagtgtgcggtcaaggcgttttgtgattttgagttgagttgttgatgatgggtcagtgcggggaaggcaatagcgtcggctttcctcggcaggagggcagaggctgcctcacgaccgggctcagtgctctgtagtctgtacataccggtagtatatgattggggcactggggcatgacaaaaggcacaatgtgtgtatgtagcaagtggaacatcatcatcttctgggccaggagcaaagatatgttcatatagcatattagcgtttgctaaacatgaagtcagcatgacatgactcggccggaagcaatatttgccgtctgattcataatagcaaaccagaaaaaaaaaggtgtcttctctttgccagaataatgcttactatattccatatcacaaataagtgtgcagatatgtgtactgtggagtatagaaaaagaatgttggaagatggagaacttatctgcttgacccagtgagtagtgaccctacaatttggatacccacccaagtttttatgttagtgtcccaaaaaggctctgcactggtagtcttgtaccataatgctcacacatattgaattgccaataggcgtcccctttcggatatgcctaagccaatttgtccactggtgcccgtaatggccttagcccctctaaagagaggtgttgcatactggagcctgagcagacaacttaagtttgaaaatatgttatcaaggctggctcatgcataatttgtttctacaatgaactgcacagaatttccaaatatgcatgtggttgctctgacttgtcttgttaatttttcttaatttctagcatagcgattttacaccaacacaaaatacttacatgatacataagttttgcagcaaattaatacaccagaatagtaaaaactgaacacaacggttcataagtagtagagaaaaatggctggccctagacgattaccaaagattcaggtatgcatgtgtgcagtttggcatcgaatgagctcactaaagtttattagggaactatttaacaatgagaatcaagaacactaaaaaaacggtttagtgcaccagcaaccaacatatttgtatatgccggctacagaaaatgatttcaggggaaaagtatatatcattatccacaagatatgtgcccatgataaacctcagcatgtgtcatgttacttgaaaaaatatacaaagcattccatttctcaaattgaacagagtgcatgtaaactacatcagcagtcaaacatgacatcttcgatatccaagaatatttccagtggtggttcacaggtatggagagtaactgacgaggttcatgaccaaccacatatgacaaaagaggttcctgataagacaaaagatgatcattatagagaagtatcatttctcaggaacaacagaagatggtctcagaacatttgtaaatttcatgtgtggtaacagttcaactccagaaaaacaaacttctgaaagtgattacttggttgtatttagagtgccttgaatgccattcctgggctggtggtttctctttttattaacaaagggaggacatcactgcctcgcctttctaagaaagaccatttttgccttagaaaaatacaacagaaatacagaatacggtgagaagtaactctatccatttgttcaacgagaatttatctcatctttgctgcccttagcccttaggtttttgtgggacttttcgagtaacaaagatccactggcattgccgttatagcatcttaaaggttttttgaactattgcaacattatgtaaacttgagattgcaagagttaaacaaaaatgttgtccatgctatcatgttaacgaaatgtgtagcatactaaatatgtgaaacacaaaagctattagtggtttgttggatttagagtataccatgaactagtaaaaaagattcaaaccgtcttagaagctcacccaatgtagcaaaaacaccggttactcagtcttcttttgcttggttgattctccagtcttgctaatgatggtatctaagtgccttgatagtacactgtgcgccataccaatcttttcatcgacttggtcctggtacttctcatacaatggtggaactaacagagaaaacattacacctagagaaaagccagaatgatacaattattacatatgagctatcataaaagaacgattgatccatacatgaataggtccaggaagttaaagagaaacaaattcagtagtactcaccaatgtaaatgagcgtaaggaagttgaagagcattccaatgtatgaaaccacccataaaatcaatataacctatatgaccaaacaaaataaggggcataagaagaaagcatacaaaggcaggtacagccatatagacgtacagttgtgtgtgtactagtgggcatggatgtgtgtgtataagagagagacctttataaaaacactcctatctctcttgatggcaatatcatggccaacagccaacaccttgttgatccatacaagagcccgatctgcagctttctcaacaaccacatctgagacctctagtttagggagtggtggaagaggcctgcaaaaatcacaactttgtgtcaaacttggatagatgatatgggcaatggaagtacaatgccagtcacagagaacaacataaaacaaccaaagtgccaaaaacagctctttctttttcggtttagcgatacaatcgcagagacactgcataaatgcatatcaattctaggcaacaatcaagtcagatggggaacacaaactcataaatgagccgataaggaatggcaagcgcggtgattgaccatgtaatgtaaatctaggaaaaaaaccttgtggattgcttgcagaagagaccatatagcacagttacaagctctagagaaaatgacacatgctagcagaattaacttatcgaactgctatcgcggcttagctttaaagtaaagcagcctctttactttgtagataagggatcggatagatgcattattggtaatgtaataaaaacgaaatatgcaggtttcaggaaaagggataattaggaaaccccgacatatgcagagttcaaacctttgaacaatctctaatcttaggagatcatcggatcacttccaattacaaactgctctggcctgaagtttagtttcttactgcaacccgtaattcaaaaatgctaagcaagttagtgtatgaaacagtttggcagtgagcttcttgaagccaaaaagatgcaacaaccaaacggttggggaaaagaaagtccacattattcagcaaaacctcatacacattacagtgaacaccgcagttacaactacagcgaatcagggccgcagggcgcggcgcgactctacatgagatcagaaacacgcggtgctgtagagccagggcaaaaacccacctgttgagcagcgaggcggacttggcccagaagaagaggatggcgacgaggaggagcagggcgttggccatgactgacgggaagctgtaccccgcgcgctcgaagaggaaccacaccgccgtggcgcccgccacggccgccgcggacacgttcctccgccgccacagcaccaagtcggcgactgcgagacgagagaacacgagtgaggagaaaaccgaacccaaattctcgacccggatcggagagcgccgggaatgcgcgtgcgtacctgcgccgccgccgaggagggcgtggagggatcggcgggaggtggtggccatcgggatcgccgcggggagggttagggtttggggccgcggccgaagcgaggagaggaagtggggtaggtgagtggagctcacgaggcggaggcgacgaggacgagatgggatctctctctgtgtcctttgctggatcaggaaatggattcggtttcggagacggcgcgagcgaatgaattccgtcgaattattttgaaatattatggtgagttattgcaattttgcgggcaagtgatgcccgatggtgttggaataactccttccatttctatacttttaagatttaaattttacaccataatattcttatttttcactgatttttgtgattcccatcatttcaataattttaaagctaatcaaatgcttggaaagagagaataagtaaatttcatttaaccacccgtattatgatctacctcttaatcacaaataataataacctataactagatgggatacattatagtactacgaatttgaacatagagcatataatacccaacgaatttctgtcgagatttatagtactatgatgtgtcctatctagtactaaattttagaacaaattgagtaaattaaaaaaacatacgattttttagcacataaacatatgtattatggtcatttcaaaaaacacaatatttatcattctaactttgaattaccataattttaagttatacaatcgcatctcgaatttatgagttatttatccatcatataaatgttacatccatggccttttaaaaatttgatatatgagtatgtcaaattggttacaatgtggttttgtggaactttatatccatagtacctatgggtcatgtgctatgtgtcaaaatccttgtagttttgtgtaattttgatcataacgagtgtatttttacaaaatttcccaaaagaaatacaagtaattcgaaattcaaatgctaacaactgaagtgaaaaaaataaattatttattgtaacaatccttatattttaaaattgatggagtaattatgtgcttggaccttctagtacattcagtaaatatatactgtttagaatgatttttttctcttaaatatatcatggccataaatacgtttggtcatgcaagctactagtttcatgccgttcaatttggaggactggcactttcatgctgctttgtttagatacgatgtcatttcgaagaaaacaagtatccaaaccaacagattagtggatgctagcatttgacgacgacatgtttaaatcaagccgaattatgggtccaaacatggacatattcttcctatttgttgaaaacaacagcgtggaacatgagtacccgttccaacgccaaccgagtaatcggtccgatgctaccttggctgtgtttagttcagcgcaaagtttggattttggctgaaattgaagatgatgtgactgaaaagttacgtgtgtataacaggtggaggtggatgtgatggaaaatgattgaagtttggatccaaacacagcccataccaactcacatagttcgtggaagggagacaataattgtgatcctctaaaatatcacagtaaatttctatttttataataaacacacaaacgaacctgaacagtaaccgtttcatattaaatgaatatacggtccttacctgagacctgttttttcagcaaaactatatagtcatggcatgtatctatatatagaagaccaagatgcacttatagaatggaatgtgtgatttcaattttgagaccccgtgttcaatatctaacgcgcttacaattttttttaaaaatgtgtttggaatccaaatatcgtcttttatctatagaagaacattttgttcagtacaccatattgagtctggtggatatcctagaaaattccaactccaactgacggtacgccagtacaccgccattggcagctagcctgaagtgatccaatttttaatttttaaatttttctgatctttttaactcttatctcatcatactttaagtgaacaaacacttatccaaaattatatcagaaatgctattacattttaaaatggagaaggtatggcacgaaaagcaccaaatccaatagctagaagccgcattcagttcaagatttgaagcaatatattcaaaactcaaaaatagcctgaactcctcaagattagctcacacgatgatgacatgactcaactgaagaatcctggccttgtaccaaaaacaagtccaggttcagagaaccgcccccttccgcggaaacggcagctgttacaaatcccacccgagcagcagccacttccaacacacacgctcacccgattccccgcttcgccgccggcgctcgcatcggtcaagtcaactcgacgcccacacacgcaccggccatggccgcggcggcggcggagcagcagcagcagggcttccgcccgctcgacgaggcgtccctggtggcctacatcaaggccacgcccgccctcgccgcgcgcctcggcggccgcctcgacgccctcaccatcaaggaggtcggcgacggcaacctcaacttcgtctacatcgtcctctccgacgccggctccctcgtcatcaagcaggtccctatctcctccacgcgccgccaccgtcgccgctgccacacatgtagtacgcatcttctgtctccgttctttcgctgacgacgctgcaatccaggcgctgccgtacatccgcttagtgggggattcatggccgatgtcgagggagcgcgcctatttcgaggcctccgcgctgcagaagcaccgcgccctctgcccggaccatgtccccgaggtctaccacttcgaccgtgccatgtcgctcatcgggatgcgctacatcgagccgccgcacatcatcctccgcaagggcctcgtcgccggcgtcgagtacccgctgctcgccgagcacatggcggattacatggccaagacgctcttcttcacttcacttctctacaactccaccactgatcacaagaaaggaggttggttgatttattacaggtttggtttgcctgtgaaaattgagaagggagaaaaatgagaaccgaattgatggcatgttgtgttatgtgaattgcagttgctcagtattgcgataatgtggagatgagcaggctcacagaacaagttgtattctcagatccatacagggtcgccaaatacaatcgctgcacatcacccttccttgataatgatgctgcagcggttcgagaggatgctgagcttaagttggagattgctgaattaaaatcaatgtaactagctctcctgattaaaccagcgtttctctttccttttcattggagatgatggacatgatttgcatatgcaggtttattgagagagcacaagcttttcttcatggagatctccacactagttccatcatggtgacaccagattctactcaagtgattgatccagaatttgctttctatggcccaatgggttacgatattggggccttcctggggaacttgattttggcatatttttcacaagatggacatgctgatcaagcaaatgatcgtaaggtgtgtatggatttattggctaataatagtaaatgaaagtgcgtaatcttacctgggtggttaagttgttttgcgtttgctaagataatggcaaccacatgtcttcctgtgtactaatttcgataggatagaagtttggaacatgatacttgtatcctatagaataactagcaattgatattgttgatatatgccgtatgtaacagagggaggagggtgctcagcagacgatgaatgtccctgagtattactccctccgtttcatattataagttgtttgatttttttcttagtcaattttttttaagtttaaccaaatctgtagaaaaatagaataacattttcaatacaaaacaaacatattatcaaaatatattctatgttaaatttaattaaactaatttgctgttgtaaatgttgctaatttttttctataaatctggtcaaacctaaagaactttgactaagaaaaaagtcaaacgacttataatatgaaatggagggagtacttaatgggaactgcagaaatgacaagttatgatatggcaaagtgcaattgcaacatctagattctagaaggtattttcatgatgtttcgccaggcataaaataagttctatgtctgtacatattttgcaggcttacaagaaatggatcttgaagacaattgaagattcatggaattttttccacaagaagtttgtcgaattatggaataaacacaaagatgggaatggggaagcatacctgccccctatatacaacagctcagagcttttgagccttgtacagaagaagtacatgacaagcctatttcatgacagtcttggatttggttcagcaaaaatgatcaggtaattaaacagtacaattatgtagagtctgtactactaagtcaatttgctgaatcttatttacgtctagactatgaagatatactagacctgccctttttaaatgtaagaagctcaaaggcacagtaagttagtccaaagtagaggtttccgatgccaattttgatgcagcacttctttttcataaatgtatatcagtatgtgctatcctaaaagagatgttccagaagaccacctttgacgattataagtatgactgaaaaccgtcataaatggttaaattggaggctattcaggatattatgttgtgagaagctaagtgtaaagaacttaaaatcacatttaaacgccattttcaaattttttatctgtattccgatgccttgtgcatgatcctcacgcgacttctgtttactaaattggaccatacatatgtaggagaattgttggaattgctcatgttgaggattttgagtcgattgaggatgccagcaagagagcttcgtgtgagcgacgtgcccttaattgtgcaaaggcaatcctgaagggaagacgccagtttgaaagcatcgggcaagtgattgtgcatgtacaatcgtttgatcgggactgataatgccaaccatctacacgacctttctgattgaggagacaaaagttttcatctgtttaccataagcgattatctgtgcctattacaaagcagaattggccagttatttgtgcttttagtactttggatcatgaaaagtgtgtgcactctgcaagatcgatgttttttttcaccacttggctaagccttccaccagcttccgggcttcttagtttatgagctgaataatggaagttcagcacaaacgtttgtccatggatatggacgagtgtgttattacaaataaagttgatagttttcggcaaatagattgttgttgttttatttcaaagagatgtagtcccccttttgttccttttcatcacttaggctgcgttcaagcgcaggagaaagagagaaagatagttttgttttccgcgtgcatgcttcccgaactactaaacgatgtgtttttttgcaaaaaatttctatatgaaagttgctttaaataatcatattaatccatttttgaagtttaaaataattaatactcaattaatcatgtgttaatggctcacctcgttttacgtatctcttcaatcccctccttctcaaacacacccttagacctgattacttacagcttgtacaagttatggttggaggttcagtaatttcagctgtaccttttcactcttcttttccatcttaacataaaccaggcaggaccgcaggagttgttttgttggcacaatttgcgagttggatggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11857 - DNA, 5787 bp, Oryza sativa
acattgtgaaacgaagcatgtaatatatataggtagttagtagtattagaaggagagagaaagcagagataaataatatattttattctatataggcaactcatatgtttatgggtgacttttgctatttgcttgatatggactagttctacaatgttgttaggtggctgaatgaaatattgtattctttatggactagttctactatacattatgcatgctcaagtgtggacgctctgcaagattgatgtttttttttcaccacttggctaagtttgtaagaatcagtcggttgaatggcaaaagcttccccaaacaatttaactttttatctagattcaaaagaatcttaataaaagctaaaaaactggttttccctgcttttttatgctctcacaactagatttccatttctcagaatttaatctacaaagtaggttttccttagcttcctcgtagattttttttcgagtaaagtgtacgagcggtacttaaacttgtagcggtatgtcatctagatcccccaaactctcaaaatgcatatccaggccctagaacttatcaaagtgtatcatctaggtcccaaatcgacacatcccctcttggatcctacgtggcgctgatgtgacctgccacatggacgtgacatgtccttttttttcttcttttctttttcttttctgttttcttcttattcttgtttttttcccctctcttttgctcgggtcacagacaaaggagaagaaaggaaaatgcaagagaagaaaaaaaagaaagaaataaaatttttaaatgggtcctatttgtcagtcaaaattatgccacatcatgttcgtgtgacatgccacatccgcaccacgtaggatcctgaaggatttgtggtgatctgggacctagatgacacactatgacaagttctgtgacttggatatgcattttgagagtttaatgacctagatgacacaccgctataagtttaaggaccgcccgtgtactttacacatttttttctggattctatagctataaaatctcataatatgattatttagggaattggagattttggaagaaactgtacatgctagaagttctccaaaagacctatctatactttgaacattctagttcatccggtgaatataatagagtttgtcaactttctcactatggttcgcttggtcatgagaatactataatgatttttgtcttgtgagctagtttcatgccgtttaatatggaggactggcactttcatgctgcttttatttggatatgatgtcattttgaagatacatgatgctagcattgacggcgacatcaagccgaagtatggggccaaacacagtcgatatattctccctgtttgttgaaaagaacagcgtggaacatgcgtaccaactgattaatcgttcggatgctaccttatcaactcgcagagttcattgaagggacacaataattgtgaattgtaatcctctaaaatatcacaataaatttctttttctaataaacacacaaacgaacatagtaaccgtttcattctatcaaatgaatatatggtccttatcttagagctgtttttttcagaaaaattatgtaggcatggcatgtttctatatatctatatgagaacatttcgattatggttgatttgctagaaaattccaacttcaaccgaaggcacaccaccattggtagcctgaagcatgagtgaaagattcattagtttttttttattttttcgagaaaacaattttatttatttcatccgtcctaaaatactgctataagtgaacaaacacttattcagatttattagcaacatatattcatgcattataacagatcgaacatacaattgagacgagtaagaaagggctaggaaggtaattgaggataaagtaccgtatcatacggaggttgtgtacatgatttgagaaggagcggacaaatagactgcacgagcggtgggagaaggagatgaacggaggatgactcaactttaatactttctccgtttcatattataaaattttctagcattacccatatttatatggatgttatgtctagattcattaacaatggtcaattgtagaaaatttttacaatatgaaacagatggagtggtaatatagagataacataaatgatggtatattttggaacagagaggaaaattcaccaaatccaatgaccagaagccacattcagttcaaaattagcagtatactaggatgtgtttagtttgtgtgccaatttttttaaggatacagacacatatttgaagtattaaacgtagactaataacaaaacaaattacagattccgcctgtaaactgcgagacaaatttattaagcctaattaatccgttattagcaaatatttactgtagcatcccattgtcaaatcatggtgtaattaggctcaaaagattcgtctcgcgatttacatacaaactgtgcaattgttttttttcatcatatttaatcctctatatatgtgtctaaatatttgatgtgatgaaaaagttaaaaaaaatttaaaaaattttgaatctaaacacggcctggattgaaaactcaaagatagcatgaactcctcaagattagctcacactgatgacacgactcaactgaagaatccgccttgtaccaataacaagtccaggttcagagaaccgcccccttccgcgaaagcagcagctgttacaaaacccacacacctccgcgcagcgcagcctcccacacacgcgcactcgattccccactcctctcgcgggtcgcggccacttcgccgccggcgctcgcatcggtcaactcgacgccacggccacacacgcaccggccatggccgcggcggcggagcagcagcagcagcagcagcagcagggcttccgcccgctcgacgaggcgtccctggtggcctacatcaaggccacgcccgccctcgccgcgcgcctcggcggcagcctcgacgccctcaccatcaaggaggtcggcgacggcaacctcaacttcgtctacatcgtcctctccgacgccggctccgtcgtcatcaagcaggtccctatctcctccacgcgccgccgccgccacacatgtacgcatcttctctctccgttcctccgctgacgacgctgcaatccaggcgctgccgtacatccgctgcgtgggggattcgtggccgatgacgagggagcgcgcctacttcgaggcctccgcgctgcagaagcaccgcggcctctgcccggaccatgtccccgaggtctaccacttcgaccgggccatgtcgctgatcgggatgcgctacatcgagccgccgcacatcatcctccgcaagggcctcatcgctggcgtcgagtacccgctgctcgccgagcacatggcggattacatggccaagacgctcttcttcacctcccttctctacaactccaccactgatcacaagaaaggaggttggttgatttattatacaggtttggtttgcctgtgaaaagggagaaaaatgagaaccaaattgatagaatgttgtgttctgtgactatgaaaagggagaaaaatgataaccaaattgatggaatgtttgtgttctgtgaactgcagttgctcagtactgcgataatgtggagatgtgtaggctcacagagcaagtcgtgttctcagacccatacatgctcgccaaatacaatcgttgcacatcacccttcctagataatgatgctgcagcggttcgagaggatgctgagcttaaattggagattgctgaattgaaatcaatgtaactatctttccagattaaaccagcgcttttcttttcttttcatattggagatgatggacatgatttgcatatgcaggtttattgagagagcacaggctcttcttcatggagatctccacactggttccatcatggtgacaccagattctactcaagtgattgatccagaatttgctttctatggcccaatgggttacgacattggggccttcctggggaacttgattttggcatatttttcacaagatggacacgctgatcaagcaaatgatcgtaaggtatgtatggatttattggctaataatagtaaatgaaagtgtgtacttttacctggtccacaaatgtcctcttttttttttatgtgacaaaaagatagtttttctttttgggtggttaagttgttttgcgtttgctaagataatggcaaccacatgtcttcctgtgtacttgtatcctatagaataattagcaattgatattgttgagatatgccgtatgtaacagagggaggagggtgctcggcagacaataagttgaataacttgccttactcatcacttgaatgtccctgagtaatgggaactgcagaaatgacaagttatatggcaaagtgcaatggcagcatctagattttagaaggtattttcatgatgtatcacggggcataaaataagttatatgactgtacatatttttcaggcttacaagaaatggatcttgaagacaattgaagattcatggaatttgttccacaagaagtttgtcgaattatggaataaacacaaagatgggaatggggaagcatacctgccccctatatacaacagctcagagcttttgtgccttgcacagaagaagtacatgacaagcctatttcatgacagtcttggatttggttcagcaaaaatgatcaggtaaataaatgttgaatagtataggaagaggagattactgcgaatattggacacattctattgagccttaggagcccgcatatataggaaataaatagggtagagataaggaagtattatatttaacatggtattagagcctcaggggccagtatatagatacatgagataaggaaggattacagatatggaaaaaatccacataaatcaatcatatcctaatatgactctaactaccatatactctaatattaaacagtacaattatatagtctatactactaagttaatttgttgaatcttatttacgtctagactatgaagatatactagacctgccctttttaactgtaaggaactcaaaggcacgctaatttaggccaaaagtagaggtttccgatgtcaattttgatgcagcacttctttttcataaatgtatgtcagtatgtggtgtcctaaaagagatgttccagaagaccacctttgacaagcataaagtatgactgaaaaccgtcataaatggttgaattgaggcaattcaggatattatgttgtgagaagctaagtgtaaagaacttaaaatcacatttaaacgccattttcaaattttttatctgtgttccgatgccttgtgcatgatcctcacgcgacttctgtttactaaattggaccatacatatgtaggagaattgttggaattgctcatgttgaggattttgagtcgattgaggatgccagcaagagagcttcgtgtgagcgacgtgcccttaattgtgcaaaggcaatcctgaagggaagacgccagtttgaaagcatcgagcaagtgattgtgcatgtacaatcgtttgatcgggactgataaggctaaccatctacacaacctttctgattgaggagacaaaagttttcatctgtttaccatcagcgattatctgtgcctattataaagcagaattggccggttatatgtgggctgggcaacaacaatgtatatagccaaagtagtccatacagatggacccacatatgtgggatttacctattgtaaccttcatactccctccgtttcacaatgtaagtcat

SEQ ID NO: 11858 - DNA, 938 bp, Oryza sativa
tccgtcgccgccgagtggtgcctccgcctacacggatggcctattatgccgtcgctgttgggcgtctacgacttcaccgccggcctgcctccgtcgccgccgagtggtgcctccgcctacacggctggcctattatgccgccgctgttgggcgtctacgacttcaccgccggcccgcctccgtcgccgccgagtggtgcctccgcctacacggctggcctattatgccgccgctgttgggcgtctacgacttcaccgccggcctgcctccgtcgccgccgagtggtgcctccgcctacacggctggtctattatgccgccgctgttgggcgtctacgacttcaccaccggcctgcctccgtcgccgccgactggtgtcctcgcctatacggttggttggtcataccaccgttcatgggcgtccacgtcttcgccgaccggctggccttcgccgccgccgactggtgtttctgcctacacggctagcctattatgccgccgctgttgggcgtctacgacttcaccgccggcctgcctccgtcgccgccgactggtgtccccgcctatacggtcggttggtcacaccaccgttgatgggcatcgtcatcttcaccgccggcctgcctccgtcgccgccgattggtgcctccgcctacacggcatgcctattatgccgccgctgttgggcgtctacgacttcaccgccggcctgcctccgtcgccgccgattggtgcctccgcctacacggctggcctattatgccgacgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattat

SEQ ID NO: 11859 - DNA, 636 bp, Oryza sativa
ttgctcctaggtgagcggttattttgcatcacctataaatgaaatgatttgaaggatttcatttttgccttgtccatttaaattccgcaatttaaattccgcttgcaatttgaactttgcgatgatgagtttgctctctctttctcacctcacttctagtttcgggaattccttttctcttcctcctctagtttcgggaattccttttctcttctttttctctcttcttttctagatccggcttctctaatagccgcgattctagtaaggattttgagaaatccggcttgatgagtattttcgggggcaagatttgaattgctatattcaccccccccccccccccctctatagctgttcttggtctttcaccaatacagtgcaacccgtcgcagatacaagctgtggaggctattttgcattgtcaggttcagcattttccaattacctacctaggcctccctctttcaaccagaaagccgactaaggcggagattcaaccgattcttgatagattggctaaaaaggttgctggctggaaacctaaactcctctccattgatggacgcctctgtctcgtgaactctgttcttcaggctttgccggtgcacttcatgacaggtcttcaattgccta

SEQ ID NO: 11860 - DNA, 628 bp, Oryza sativa
ggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggctggccggcggtgaagatgacgatgcccatcaacggtggtgtgaccaaccgaccgtataggcggggacaccagtcggcggcgacggaggcaggccggcggtgaagatgacgatgcccatcaacggtggtgtgaccaaccgaccgtataggcggggacaccactcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcgaggacaccagtcggcggcgacggaggcaggccggcggtgaaaacgatatcgccatcagcaacggcagcggcgcacaccaaccgtggaggcgatgaaaccaatcggcagcgacgaaggcggccggcggtacatgtataaaataatagatcaaataata

SEQ ID NO: 11861 - DNA, 691 bp, Oryza sativa
attgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaaggcgtggcaagccaacgttaagctgttgagtcgttttaagtgtaattcgggcagaattggtaaagagagtcgtgtaaaatatcgagttcccacattttattgtctgattattgatttt

SEQ ID NO: 11862 - DNA, 39069 bp, Oryza sativa
  unsure (1)..(39069): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagtgcaaccattcctacaattgtcgattccatctttgggggtcagctgtctagtacagtgtccagcacagaatgcacacacagttctgttaaacatgaccaattccttgatctgtcactaccagttccatccaggaggcctccagccaagagtgtgtcatcaccaccagcaaagaggaacaaacaatccctaagagataggaataaaaatcggagatatgggaagatttcgacccgagtgactcctacaatagaggtgagcaacaaagaaaagattcaaacagttgctgaaggcaataattccctgattcctggttcagagtcaggacaggttgtcagtgagaaagagcctgagccttctgaatgcagtgagtcatgtgcttctgtgcctaatctagaacaaacaggtacttcaaatgtggaggatggcacttgctggttggattacattgatgatgcagatgaagcaaaatcagagattcttgattctgcagattctattgaagcgggacagatctgggaagacaagggtgttacttatggtccatttcttccacaggatgatgccttatcgaaagagcaggtcttgggttctgaacactctggtgaaaaccctattgatgatgcaacatcttcacagcctgttatcttgcttccttacaaagaatttggttccactgccaatgaaatggatggaaccacagaaaattcacagaaaccagaagatgcagttgctcctccagctgtttctcccttgccagaagataatgcacaacctgcatctgttggcgatggggatcaagatgactatgttggtcttggtgatatgttcaatgagcctgaagttacttctgaagtcaagaaagaaataggtacagttgaagatattgatgtgatggcctggagtagcaacagtgctgaagacgaggtggatgatagtaatgctcccgtatcagttgagggctgcttggctttgtttactgaaccggagttgctctctgaaccatggcactgtgagctctgctctgactctattgcatgcccaaacaccaatgatggcaaagatgatgagatggcgactagtgtcaatgaaagaaaggatggtgaggagatgatggcaggtggtgatgaaacacaagacggtgataagttgatcgctaactgcaccgaaaaggagggcattgatcagattatggcaactgacggttgctcagataatttaaatagtgatatgaacagtaaagaaggtggttgtgcaaattcttctttggttggtgctgacaactcagttgatgctaactttccagaaaatgggaaagttgctttactgaaaacaggttcgtcacttgttgacacaactgaacaggcagacagcaaagcatatcgtcgagagattagggatttgaacaactcagcagtggaatatacatcttcgagtaagcaacctcatgattctgcccagcataaggatgaacataatgtggatgtagcctctgaagaaacaactgcaccagagtgttcttgtgacaacgaatctgcctcttgcagcacaaccaataagaatgaagctgaatgtggtgttggtgctgaagaaattgttactagtagccttccatctgagacgcaaagaatcttaccaggtgaaaaagacaatgaagatgttgtcacgcggaatcatggcagaaggaagcgaatgaagatggttggcaaggcacatcaagggcaagataaccaaaatgaacagaaagagaatggaaaaaaggttttcagatctgcaatgagaaggatccttattagcaaggcgccacctgtattgacaattaatttgaacagattcagtcaggactcgcatggtcggttcaagaaattgaaagggcatgtgcactttaaggagacacttgatgtgcggccattcatggacccaaggtattgaactttttttttcagttagaagtactgatgttttttatcaacctgtcagctttctgattagctgtgaccatctgccattagtctattcgcatttgctactaagaggtcccactgtccatgcatagccattgacatttaaatatttacactacaaattacctcacaagtggttttcaactatgtagctgatattactcctgcaaggaaattgtcgtagacacatagttaggatagatagcgaatgtttagcttccaggtaattttggttcctcatccctagcgattggccaatgttgtttgagaagataaattgctgcactatttgtcatgctttttaagaagaaatgtagatcagatttttgttacattgagagtgcattgcattatcgtattcaactccaccatgtccttatcgtcgtataaacagtaatatacctgaaaacatttcatagtcaatgtgaatttggaggtctgggttaatttagcagtgcaacacgatttagactacaaggtagtaagcagatcaatatgtctcttttgtttacctggaaatgtgtttgtatttacggatgctatgtctatgattaataaatgggttgcttctttgaactttctaattcctaaataatcagttatatctattgaaagagaacaacatcatgtggatacaaattggttagcttttagaagctgcagcaaattgttattcaccatttatatgctgattgaaacactttgacttgagcaatggttctgaaatttcccatcggcttcataattttgggatcatgtctagatgttgaccatgtagtacaatagtatacacaacccagtgcatgtacattcttgcccatgatttttcagaaaggatggccagtccaaaagattgtaaaagaacagtcctaaaccagctagtgcctagtgatatgggcatatggtagtgattagcagaaaacaagacctggtttcctcttgccctctctcttctgctggttacacacgaaattaggtagatgaaagttcaatccaatctttcagctgttctttaatttcaagagttggtgttaaaagtcatcccatagatgtcccaaagaaaaggcatttacttttaatagcttgtaccatctacacatgatgacttctcaagtgtatataacagtatgccttcccatctgtacaagaataggggaaaaatgtcttccagcttccaatcttgaattgaactaagaaacgttgtagatgtgcatgtatcacatctgatttgcacgcgagatatcagtattttcggtttcaatgttattaacttgatattgagcccttttgttgttgcatatttcaactgaatggtcttaaacttggtgtcttcaatttgtaatttatgaatactgcagccttagagttgatctgctcatcacctattctctgtaatctgcaggtctaaggagaatgacaatacaacttatcgtctcgttggcgttgttgagcacttgggaaccatggcagctgggcattatgttgcatatgtgagaactggcaagattgggggtcggcagcagaggagcaccggctccaagtcatggttttatgcaagtgatgcacaagtcagagaagcctctctggaggaagttcttaactgcgaggcttacatactgttttacgaaagggtgggagactaagaaaattatgtctgccatccagcaacatcaatcagtctctatcagggcatgttcaaatggcaagcaatagataagaaacgtcattttttggaaaatcagaggctcagttagtcttcatactaattactatccatcaagtccattttgtttctttgattgagtccagttggccttgttaccatttgtctactcagtcaaagagatttttcacaagtggacttgagcagttaatctgttcatactgcctacagcctttttgtcttttgaagcatattttggaggtgtgcaaatgttcagaattggcgagctgctcatacatatcttggcaagggctctgtggagaagcccatagatattgttttacaaccaaacaaacaatgttcaccttagtactacatattttttgattattatgtctccagtctccacccctaaattttgagtgatgggggtgtatactgtaacgtgccttaggtccatttaaaagtggtaattacatacttttacctctgtcatctgggatggaaaaaaatgctccttttattgagaatttttctgtttcatcagaatgtagtgttcgtgctgttgtttgccctggagcttgtgttgaaatgcagtgttttttttcttttttgccctttctgatactgatatctgaatatctgatggtcacacaagccagcaaaaaaccaagatgataattgttaacacatccagttctaactttacttttgcactcaaacctttttctttaagaaacaatttggttacaatctggatccatcctaatgctagtgtgctagtgccgatgctacgttggaaaccaactatggtgagcagactactcaacaacgccgcgtacagcttgtttggatgcaactggaccaagcaaagctcaccgcagatagcgtgcggattgatggcgattcactacgtactggcacacaaaacctgcaggtttctggtttagcacatctcttgttgccagcacaaaaacgtaagaatagtctcggacaaaaaagatgggggggggggggggggggtaggatcgtaagatctaagtagcgaaggtgacacgtttagccttcctgtattagcttaagctttagatcgaactgattgattcgtataactcaatataggttttttggatgaactgatcaacacatacaactcaatatacgcaatagtctctaaatccatttgtttctcttattcatatgcttatccgaatagcttattagctaataaaaattatttgtgagcgaagcttttcattagcgactaaaaatataaactacgataataaaaagattaaaaataaaattcaaaattaagtttaaaatttaagctttgtcttataagcataatagcgtgcggatcttaaaaataaaacaatgaagccttcagtaccgttccaatttttcccaaacatccaaagggacttcacacagtatggtcttcttgggacttcttgtgcttccagagaataacgctttgatttgtccgtttgacaaaagcacccagccgcccggcgcccaattcctgcatttctacctccttcggtgacccgcgccaacaaccaacgccaaccatccatccatccatccatccatcacaatccggtcactgaaaaatccaccagaaaaaacggcttcggaaacctgcccgccgcttcgtcggaccgcggctcgtagccgactagtccgtccgttgttccgtcacggtcacgccccgcgaaatcacccgccggtcgctgcaaaaacggggcgaaatcgcctagatcgtcttgctcgcgtggccgcggctaaactaactcgagtttttcaccttttgagttttttttttaagaattacacaatacaacacatacactcacccctataaatacacgcacgcaaaccctatccttatgagcatcattgaagactaggccggcaacactcacctctataaatgcacacacgtaaatcctatccctatgagcatcatcgaatactaggccggcaaatccattctggagattgacgaagttactacaggcgccttcctgttgatgggtacgttgcctaccactgaaagcacaaaaccgttaaatcctgaaaaattcgctccttactctaaattattttctaaattctatgactacaatttattgtaatctaaaaaaattaaattgtttggtagagtttctgattttaggaggagcttgttgctccgtcaccggacacggtcagagtccgcgaaatcacgcttcggacgctgcaaaaacggggcgaaatcgtcgtaaccccaccccgaccggcgcccgtgccgctcgcccgcgcgcaccgcgcccgtgggtcgccatgtggtggtcgcgcagcgcggccctcgcgagagccgcatcatcggccatccgccacgtccacactaacggacacacacacgcaaaaaaaaaaaaaaaaagaagaagaagaagagtaaaaccggcgagaccatctgcaagagaggataacacaacacaacacgctgacgctgctgatgcgagtgagataacgagatgcttatgtatttttaggctcttctcgtgaagctgtgtccaaataggcgtaggcttctgcttctccttctccttctccaggtgagtgaggagagaatggaggcgcgggcgatgccgccgccgacgcggacgcggcgaggcgtcacgctcgccgagcagatggccgcgtcgtccaacctccgcgacctcctcaagctccgcgacaacgacgacgacgacgacgacggcggcgggcaaggtggtcgccgccagccgcggccgctgcccgacgcggtggtggtggcggcggggcggcgacgcacgctgctcgacgtcatccgcggcgtcgacgacgacgatggccacgaccacccgcccaccggcgtccttgagggacaccgccccgcgacgtcgacgaggacggcggcggcggggggagcgcggggcgggagggtgtcgctgatggcgctgctggagcaggcggagcggcagtggacgacggccgccgccggggacgccagccggaggcgcgtagcggacgaccacgcggcggcggcggaggcgggcacgaacaagggcttcgccggcgccgccgccggcgtgggagggcggtgctgcgtgtgcatggcgcgcggcaaggccgcggcgttcatcccctgcggccacaccttctgccgcgcctgcgcccgcgagctccgagtcggccgcggccgctgcccgctctgcaacgccgccatccacgacgtcctcaacctcttctgatgtcaccatctccgccgccggcgacgacgccgccaccattaattccgtcgacccaatacaccattgctgtaatgtacttgtagataaaaaaaaggttctactacttcttggcttcttggcaactgcaaatcatatcaaagaattctcagagcatcacctgttcatcaatcacccacccgtgctacacaaccaatcgcgcgattcttggatcgatcgaataaccctctgttcctccatggcagcaacgatccgcagatcccggcacaagtgctttgctgctgattagtaattacgtttgcagccacgcgagtgattgaagattaagttggcgcatgtaattagcacataattaattaaattttaattattataaacttgataaatgagtgtatttgatttttttaaagcaacttctatatagaaagtttttacacggaatatattatttagtagtttaaaaaaaatgctaatgaaaatcgagatataatctacccactctgttttataatgtaagttattttagatttattaatatttatataaatacggacaatattagaatgatttatattatgaaagcaaatcttaatgagaaaataacaggttgctcggtttcagtgcatcgcagtcaccgttgaactccacccgtttgctcggtttcagatcaacgcattagttaaaataaatcaattgttttttcagacgatgcgatcatgtgatgtcatggctggaggagagaagattagatagggatgagttgaaccgtgagcccatctgaccaacggtactccaaacctgacaccttcgttctgatgatgttgacttccctgaagaaatgatcaaattaatttatttcagactaagatcacaccaattgacggcctctgcatgatccggagttccggacagtccacttaaacggctaaaccctgaactgacaaaaatttactgtactataaaatggtttcagaggagatactaaaaatgtggcacctttaggatcgtaaaatcactcttgaactgaaaacgtagaggatacgtacatcattgcttattgcatatgaatatgatatcttgtatacttgtgttgaggctatcaaggccagcactacagtgccaatcactttaatcacacttgtactaccatatttgttagttaagtactagattgagccaatggggcactaacacacactaacatatgcaaccatgcaagcaatgggcactgaaagtgtactttgtaacattggatatattatatcatgttgggtaagctaacttttaccatcaatccatcatgcagaagcacgggttcagagtttcagagcaaaaaacaccccaatcttaaatctaaatctatccctctctagcctgtgattgcgtgcattcgtcgccgttagcctgtctttgcgagcggcgacaccgggaatgatggcgacgccctgcatctgcatgcaaatatgcaatgcaaagcgctagggaccgggaaatggttagctgaattcgctgaaatggcaggagagaagaactggacctttttggagatttgcaagggttcagacaaagcgcattagctggggtggaattgccgtttagcgagcaggaatcgtgtagggctcatgcagtggctgatgacttgtgacagcctacaggaatggggtacccaccactgtactggtacttcgcctgtaatggatcgagagaataattgtacactcagatcttgttgcttaatactttaattccttctggaattacagtcccatcgatcatcgttttgtctccaactaattgtaacccgtgagaccataaaaaactaatatgtaggtaaactttttatatatgtgttcttagctatttaaaaattaatgctgaaaaataaactacgatgagaaaaattatcaaaaacaactctaaaattaaattctaacattaaaatttgcatgcgagcgatggccaataagcatattttacaaactttacaaaaaaatatcttgtgatagattttagcgcaaatcagtctctgtaaaacatggcatgggtagctagctctggtcgccaataattgatctcctcatgaggggacacaatgacctaagcttaattaggagtttaggacagtgattcagtgaacaccgttggttgatgctgtcctagatcgcggtggttgagctgccccgtccgtctgcatggacgcagtcacactatcacaaattcacacaccatctggcattctctgcttcgatggagatagcttgcgaggaagaggaagatgaacagtggcgtcgcacagtttctgatcccaatttttatccattgccacctcagcatggctccccacaataggactatatataaatctttgcctgcctgtcgatctctgtatcttgaattcttgatgtgttcatcggacatgcattgattgattgattgcatgggactccaatccatccactgtttggattggatcgaccgtttttttttttgtggttggcactgggaggaatgtttgtcagaggccggccggatgattagttaaccaaacgtacgatgagaaagaaaattaacaatgcagctagctttagctcatggttgcgaacttgggatggcgaactgtgcatggtccagacaccatacacaaatttcagaggagacgatatacgtcgtgatcatgtactccctccgttacatattgtaaggcattttagtattatcttaaatcaatttttagtgctgattaaatttatagataaatatatgcaacgcttataataacgggcgtattgtttatccgtcgagagcttaacacaaaaaactttactggttgcccatatttcctaataaaccaaacgacttattagggaataaaaattaatttataggtaaaatcattatatatttattcgtaactacttaaaagacaatgataaaaagaaataacgttgaaaatatcttaaaattaacttcacattcaaattcaaaaattcaaattatgcctttttgttttgacttattaggccaatcaatggggctccaagatccatttaggttggaggagatgggagactacggagacaaagagaaagtagccaagtaggatcagaaaagaagcctttcgccttcccatcaacgagtattcctcagttgaggtccttgagccctgaggacgccagcttaggggcctcatgcctcctccgtccagtgtcctgctcgataacgtgcttgtccatgcgattccatgtaacatgcgctgtagccatcagctatgctatgcaacagttgcaggctctacaggttagcacctaacagggatctcctcttagatgctagcacagtttgttatgtttcaagatcaatgtaaatatttttttagaaacacgttacaatcacataagctcacaacgcgtgccctacccctataaacattttcggaagattaggtcaatatatatcttgagattaatgaagtcaccacggccgtatctaactatagtacttaatccgggtgggttggttccaccacaaggaacctaactagttgagctacactcacttcgcaagatcaatgtaaatattaccacgttaaatctagaaatcttctattatatactaaaagtccattaaacttcctacaaacgctctcaagttgccacatggcgctctaataaattagagaaaaccctagaaaatctgagaaaaaaagcaaaacatccgtacattgattttcattaaaattggtgggtccaatattataaaccgttatattagatttgtcttaaagctaaccgcaactacaactatggtcccaccagcctctcacctccccataggtacgtacatgatgtacgtatgtatcgcaacaaaaaaaaacacgccgctctccttccttttgtatctttttttcccttgtatatagtttctttggaatataaatgcatacatatatatgtcgtatttttggattggtactttgtaaagaggagaagggttaatgcaaaatataagtacactgtaaccatgtaaggtaattattatgtctatattcgcggacaactagctactaagctcataactaaaatatcacaccagcgttaaatctaggtctttacagacatatataaattttatcatcatatcgctctttccaaatatacatacctaaattagaaatgcaatattttaaaataaagtttacacccattatatatatagccatttattatctatctattatatactaaaagtccattaaatttctagcaaacattctcaagctgccacgtgggactcctataatcattcctaagacgccacatgacactctaataaattaaagaaaatcatataaattttgggccacatgggacttctataatcgctcctaaaccatatcacgtgaccctctaataaattagagaaaatcatataaattttgagaaaaaaacatatgtaacgtttattttaacttaaattggtaggtccaatattataaactcttagattaaattaatcttacaacaacctagacattagaaattagaagtacatatggtcacacctgtacgtacgttacgtgcatatactctctcccacccactagcccacattgcaagtacatatatacatagtacgtatatgtttcttccttcctctaatcatccctccctcctacttatataatcctattctatagctaataaaatttgaagggtagaatccaatacgcttccggtccgtcacagtatatcaattcattcattttcacttaaatgggtggttccaatattttataccattagattagatctattattaaaaaaaagtaacaccttcctcatatatccatatacatgaggacaaatatattattgtggacctgggcaaaaaaatacttcttacgtacgtatgattgaagaaagaaataaagtaattattacttactactgttcgccacaagaaaaataaaccataagcacatatatacttataataaatcatgataaaggaaaaaacatatgtacgtactacgtgtacagttaggaaaaaaggtcgacgtgttctaaaataatatttctacaatttaaagataaacaacttacacagctgaacttgatctatatataattcaaatataatatatccaatcaatgttctttaaatgttctatattttaaattattttaaaattacatatctactttattatttatatttatgtaattaaataaactactaatatctatggtcctaaatacatcgcaatacatggagccgactgttataataatttttaaataattttacatcatattttagtttagggtgtcagataccactagaggaatatataacactaatttaaatctgcatatgtgaaaataaaaataaaaataacataatttagttgtttttaagtagatatgatttaattttaatttgacaaaaaattggaattttttaagactatttgattggtatttgagaagtgagagaataaatacaacataggtgtgaaaataattatcaaaaatatttccagcctatgatcttgctatatataatacaactccttaatccatcttgatatttatggtcattatgtatgttttttctttgctatatagttttgataacaaataaataatcaagtaacatgtgcgtaacaaacttgacgttacactatagatatttgtcaaaatataaacaataatatagtgcttaggagattatcttggtagtattctttaaaaaaatgactttgtcccggttacatataaattcctcttttgttttgggataaaatttgactcatcgaaattatgtgacgaagggagtataagcaatataagtctatctttaattagataaagtagtctattagctacgttttaacgaaaaataatttcattaatatataataaatccataaagtcatctatagcacacaataaaaaatgttagtaaaattttggaaactgaaatgctaaattctaaaaacgaatcacatatagtacaaatatatatgaaccaactccatcattgtgacacaattttttcttggttgtacagtttcaaataattttagtatagagtttatacgttgcaaggataatcagaagaaaaacataaccaatgtccaaacctattattaaccaaaatatgtttaaaatggactcaaaaaaatatttcaacaatatcatcctaacatttgtaataaaaactaaagcaacattaaataaggtgtctgcgcgtatgcgcgggctactttcctagttttctataaaacctatatataaaaatgtaatccatgtctttgagcaacggtgctgaaaaaaatgtgaaaatgtggtgacaccggtataagataatagcagcgcattgccatagtgagttttgttcggtctctaaaaaattcagctttgaacgtttgagatagctgaaattgatggattaatagatagtctgacttttctgataactatttaagggtatccacgaattaattctctctttcaaagttgttgcataaaaacatttcaaggaaaaaattatatagtttttttacacaaaacgtatgatttagtagattggaaagcatacagatgaaaaatccaaaattcataatcagaaaaagaagtacgtgaaaaaacaaactagcaatgggccaccaaggcccatctcaacattgccaatttctatatgggccgcaagtaaaaccaccgggatatacgaccgccgccgccgccgccgtgctctcgctcgcagggcgcatcggcgagccgccatggcggagcggaaggaaggggaagggaaggtggtggtggtggaggaggaggaggaggagcggcggctgcggggggcgctgcggagcctgcagcaggaggccggggtgctggagcggctggtgtacaagcaccggaaccagcaccgcggcgccgcctacttccagtacctcctcaaggtgaggcgcgacgtgaggctgctcctcgccgccggcctcggggacgtcctcaccgccgtcttccccgtcctcgcctcccgcaagccggccaacaccatcctcgccgtcaacaggtcaagcttcattcctatgcccccccttggaacttgaatcaacgctgataaaattttgtcgtagcgaggcgtagaattagacgaagccgctctaggattatggcttgattgtgttttttttctttaggcagagtaagaagaagcctggtgcaaaccattgtcaccatgagaggcttttgggtgtcgcacgcttgttatcagaggtgagtgttatactgttattcttttttaccccattgggattcaacacttagcttaagtgtttagagaagttggaagttggaaacactaatggtagtttggacttaataatgtgatgtcaactgacatttttttttcttttctgctactatccagctaattatgacatagatgcaaattattgtgattatctgtaacttatttaggatggcactcttcaccggcccaatgaaaattattgtgattgtccttgcatatttcaaagtcctaaaggaaattttaggtcatatgcaaatccatttatttcctctatggtatatgcggaaaattaagtgacaagctttgtatgctatattcaccattcttgatatgcttctggacagctctagctgatgatagctttacccaaagagaaacttatattttctctgttatgtgcagatggctgaacctgttatgatgggagcagtgtatcctttgcctttttttttgtttctttgttccttgtattctcttgtgcatagaaatattttttttgactggatgcataatatattaaactgtacacttacaactggtttgtcttgtgcaacgcgtgcctcatatttgtactagtatctttgcccattcttttactttcatatagttcaaatagatatgttcatttccctgttttggtaacaatcgatagttccttaacctgcggtatagtcagatctcgtttttacttgcaagatcattttttgttgatctttgcacagcgattcttgctttgctagcaagagtgagggctctggttcaacaggtgagagcagctgcagaattacctacagccaagactgtgttgctatagttatagtaggaaatatatatagtggaagcatatgttggctagtaaggttctttccctcttttcactgaccctatattgtgtgcagatgctacttgatgttgtctcagtttacaacaaggcttctgatcttattgataggaagcaatctgttaagattagtattggtggagcgcaggtgagtttgcttccagagtagcactctgcatgcataactgtcaaatgtcaagcatgatgaaactatactacgtcaaatcatgtttggattggcagaaaactatatttattcaccacataaatcattcatgtcacctttttttttaaaaaaaaaaatccctacaggctttcagagagtactatccctcaagcaatgatgcccgtacttttctggaatgtgtttgggtgaaagataaatttgttttgcatgaaaatacaaaaggtaactgtgagaaaacccaagctgaggatcaaaagtcatgtgcttccgaatcagcagtcctgtatgaaactcttggacaagtttctgaaggttgggatgcaatattttctgttcttcatgatatatttattaatactttggtttcttggtcgcattcttggaatatttacaaatgtccatggcatgttgttttgcatggtatcatgatgtatattagtatggcatttaacttctgattgttgtatcgttaccaccagataatttgattgtgataggtgatatggtgctggctagtatgttttgcaaatttcttcaattgcaatgattacttcatggaataaaatgaaaatgttttcattaccaatagttatgtactccctccatccacaaaagttacacatattacttttgacaccaagaccaaggggaaattaaatcaccttggatgttacaaaatcaagtagtgttgcaaacatgcaacaaatgagtatttagatgactccttaagttctaataaaacatttaatttatctcttcatttaagtcttgaatacataaagactacaaataggaacaacttatttggaaaaactcaaatgtgaaataggtgtaacttttgtggatggagggagtatttaatatgagagggcactacttttatttatggtttgatagcgtcaaactttaaaaggaagtttcagataattctagtgcttctgacatttttttcagatatggaaaatgctgaaggattgaactctcccatgaagctaccagatgccaccttagcaaaccagccagagaaaacccattgccatcgtgatgaagattctcaaagtaggaggcaattggtgaatgacaacaattctaattctctttcagatgcagttgctactcatgtgcattcaactccatgccctgatgtcaagcctgagacaaagaagagagttgcattcattgcagttggaaatccgaaagccactgctagttcgattggaacaactttaactaagaagcagagactagatgtgattccacgcgccactgcagaacctgaagatctatatgtcaagcctgagacaaagaagagagttgcattcatcgcagtaggaaatccgaaagccactgctagttcgagtggaacaactttaactaagaagcagagactagaggtgattccacgcgccactgcagaacctgaagatctatatggcaaattttctgaggatacagacaagtccatattttagattgttttgcactgcagctgaccagtgatcactgaaatacttctcagctttctaacatgaaaagaacaatcaatacaaaagagggctcggtgtagctcaagatatggttaaattttgaagcaacttttgctgtagcatctaggaggttgcttggtttatctcgctaaatcattagtatagccttcattgtattctgggatgcaatattattttgtcatccatttttcaggtgtaattttgcacaaagatgaattttagttcgtcccatctgatgttcaatgtaatatgcattcattctttgatttgacgctgactgcattacgtttgtggagtggccttaagaactcgaaaattcaggagtctggaacgaagtgtatcttgaacttgggttctaaagcatcagattatgcattactgtcgaaaaatcatatgcagacaaaacatggtaataattcctctgaaaaatcctccgtaagtgttaatgctgatctgaagttatacaagaacaccagaattgcatctaataccaagtgatgtacgtcacaagatcagaagcagaaaaaactaacagtaacagattctcctgctgctatctcatcagggcaaactagggagagcagctttgttggaggagaggaagctgacccgtccgttgtcaacatggcaaaatttcagaggaatgccctcaaacttgttttcaacggtttctagttcttcccttgatggtggtttgttgctgcaccaaattgaaaagcaatacatcaaaggtaggaacaacaatcgaagtacacgcaaataacccaaaagtcatgaaccatacgtcgttctcaattttattgcatgtaatgtgacctcttgcgcatttctttacctaccttatgacttgtatggtattttcgttacttctcagtattctttaggggaagttggtgaacaaaaagagtaagtcaaaatagatggagtcaatgataaaatataaaagaaatcatatgattgggtatgcaatttgatgagatggcaaccaactggaacttcggtgctaagcttgaatcgcattcatataattaacatagaagccactttgagtggatataccaggatgacaaacagatctatgactacgtagtacatgaatagcacgtcatagatacatcacgcatgacaaaatacaaaagcttcataccatatatgttactaaatttatatcaagaaaccacaaaaaatgatcatttatgaattgacaatggacggtcaatgcagtaattcaaatatagcactagtgaagatgaactttgtgatcaaaataaaacacaaaccatgatgagatgaaactagagcacgtttctaggtctggatggatgacattcaagtgaccggaaaaggcaacagtaccttaataggcataggacgaaactagggtctcctggggatgtcttcttaaatttgctattcggtagatacacttcaaaggatggatgcatatcatctatgcacatttccttgagcaatttagttatgtcattggaggcaccaccgactctatttaagctctgaatctgatcagtttcaaccacacttgtggaggcatcagtgacgctgtaagtatggctacgcttaactgtccagggaacgccatatcgtccaataatatagccgagcaacttcaagtgcttgtaagcttggaaggcatcccaggagcacccatatttccctccagcaatctttccgtagatttcctccattccaattgtttcaccctcgtaatcaagaagaaccaatgcccctctttctgccaagaacctgcacggtttggtcagctgacaagcctcaaattgagaacgaagcgaaaatccaaggcgtgagaatcatctataatctaaaagcagtgcagcagcgctagtgtagcattgtaaacagagtgcaaactttgggaatgtgaccgaagcaagtgcaatcaagtgtacaaggaatccgagtagcgcaggcatttcatcgaacaggtggcgtacccaatctcctcgacattgtagtacagcttgccgtcccggttgacaccggtggtcagccagagcttgcccttgctgtccacaacctccgccgcaccagcctcctccagccacaccgcgcgcgacgccaccttcctgctcccccgctacacaacccgatgagctaacacgaagcaaaggaaaaaaaaaaaaagacagcacctgaactggactctcgacgaagacgacgacggggcggcgtccaagaacggattgagatggtgctcctcgccatcatcctccgcggcaacggcgacggcggcgatcgccggagctcgcccgctcctccgccgccggtggtcgacggcgcgcgtgggcttcggcatggccacttccgtaatttttcccaccaaatttacccttttacctttttaccccccaaccactgccactaaaccaacgggcccacgcgccgggccggcccaccagccggcttctcagccacatgggccacggcaggtggggcccacccgcaagaggtcgaagcccactccgcctcgtcctctaccccctcctcgtctcccttttaaacaggaggagaagaatgggaaacgacctctcctcttcttctctcttcactcgtgttgaaattgaaataaatcgcggtcaagataaaaaaaaaagaaaaaaaaagaagaaaaaaatcgcggtctcctcctcatcgagccgcgcggctggatcgaggattcgagcaggtgcggaatctccaatccctcccgcttctgttcgtttcgatttcgcgtgggtgggattggctcgggtttgggaggcgttagcgatttcgcgtgcggatcgacggggagtttaggtttgatggttccgattcgtgggggggggggggggggtgttaggtttggatttgatcggggaattttggtttgggtggattgattcggtggagatctcttcttcttcttgggggaggttaggatttgggagcccgtgaactacgtgttctagtttacttcttcagtttctggattgttcgtgtggattaaccggggttgatggctacttgtacgattggtggtagggggttggtgggttggtaggttttttggtgataaggctattggatttggcaagtcgagaggttaatttcccaattctgttaaactgttcgcgattttcatttcctagtaagtgtgtatgttgtttcaagattcgtaaatttgtgttctgaattttagaagtatgaaatcctaataaattcaacagttagtttgaattgaaagacgcgaatattagggaaggacctaatatcaaataattagatatttagatggggcgaggcttcgaacacaggtcatttagcccaccaccttgtggagctagccggaagacccctaggtgtttctcaacagttagtttgaattgaatcatataagttcgtaaccccttgaatttcaggttgatttcagagttgagtgccactgattcagctccaaagttagcatgagtactgtcagcggcactcggcgtgccccaaggaggcaatcacaagatggtcctggtgataaagtcgttgtgaacctggacgcgatctcctccccagtggttggaagccgtcgcgcggtgccgacctccactggtgcgcgcgcctcccccattgatgtggaagctctggatgatgaagtgcagacattgtccgcttcgcaagtgcctcctccggtatgtcactttttgttatcttgaactgaaagtattagttcagtcttgattatattctgtactattatctgtagttattgttatatgattgggttcataatgatgtttaagtcttttaccagggtttatgtactactccctatgtttctcaggcacactagatgttcctgttaagaacgaactggtgactttgtctccatgaaaaaaatgatgcatcccttgcccacatttgttgaactgtcttgcattttgcagagaaggaaccggagaactaggaggcagcctgtggcagtagttgatctggaagtagatgctagccgggaaggttagttcatttatacaaagattgcattaatctgtcctaattcataaattagtaatcacgggaaacatgggaatatgctatctattcctatgtttgccattcatcaatctgtcctaagtcataacttaataatctgtcctatgtcacaacaataatcatgtattaagtcaagtgtgttttgtgatgataatacacagggaacaaacgtcaaagggttgcacctgttatacactgcctctctccagaaaggggagaagggtccagcttgaaggtatcctataatactatacaattgatccccacttagtttattttcatactccctccgggctggttttatttgtcgttggagctaagttagctgtggatgagaaaatttgttgttcgagtgtttttctcacgtatgggacgagattgcccttgtgcattgatgttgttattcttcccagatcaactcctccttaactccttgaatgcttcgttcccatatcacttaatgatggcatgcatgcatgcagcaaatgtggtataaatacatgcgtaatgtgtggcaaattagcgcggcaaaaagcgtgcgtaagcaaaaacgagattttctagcggcaaaacgcgcgcataagcacaaagtataattggttggtttaattttcgtatgaccttgcacgctggctgcaccgaagctgcatgcatggtgccatgcataatcgccaagacaaaaaaaatgcgcatatccgagaatcgaactcaggtccccacgcaccaagacagatgcactaagccaactgagagtaattagttgcttgtttggatgatacacccagccgtatttaataaggacaaaacaggaaataggaactttacttagtgacttcttggtttttgagattgtgtccgaaacgacaaataaaaccagcccagagggagtaatttccaagtcttcaacttttcagctttaagggcctggttggttattgattacttgtcgtcgctctttattttcttctatgtaaaaagtagctggtactgctgtgcgctcaatattgactcttttggcctccctatagagtttacaagttggcctttcagtggagtgagttatttgttttaagttgaaacttgtaggcatttttcttggtccattatgtcatagaatactcatgcttgtagtattatgtatttatgatgatctggtagagagctattaaaattgttcttgacagccactggtagttaagattcttgcttgtcacaaacaattaggattttgctaaatttcaagcattgtcttatgcattctagtgtaaaagtatctattacatgcatttgatacttgtggctgatggcttattgcgttatgcatttagcttaacactgattgcatttcctgttttggaacaatgctgtgaagactagcaatgagcctcctaaggcaaaggaaccggtttttaactgtccggtgtgttggaacaagttggaggagccctccacaacaatttgcggccatatcttctgcacgacatgcatcaagcaagccatccagattcagaagaaatgccctacttgcagaaagagtctgagggcgaacaatttccaccgtatttaccttccaaactctgatagttaaggtgagtcgtttacctatcaattgccttctcttgtatacctggcactctagtgaacttctgatttcatcaaatcgattgccttctcttgtatacctggcactctagtgaacttctgatttcatcaaatgcaggctcattggatgtaccaaaggaacttctggcagcagcagcagcatcctccaatctaatatattcagaggaacaggagttctcccataacgtgtaccattttgctgtggaattgtgtcacggcaaaatgaccacctagacccgcatgttcatccaaggctactgttgtttgtatgtagatgcatcaccaggagctcatcagctgcaggtgacaactctggtttaggctaccgaatggcctctctgcctccaaaggatacacaacaaaactaactatagtccccattggttagatttatctagtttgtgtactgttgtatttaccatgcgtttggccatgtaccttaccttctctccatagttgttgacgtagccttgaatcagcttgaaatcgtgatgatgttaacgcattacatgtttactcttgcttgtactcgtttgctgttctgtcttctgtgtcttcaagtttgccttctgtggcagagttgcagccaccaagtcggcacaagtgcagctacatttgtgttagaagtgatgttttttttttcagatgaaatggcccgtgatgaacgaactcggaataacaggagggttgaaggatgcaatcatgcaggtcgaacgaatttgacaggcacttcaacgagcaaacgagcagagacaccgcaagaatttttcaggatttcatttgctatagaaactaaatagtaccaaagccatgtttttttttacacatcaaaaacacatacagatacagaccattcccaacccgttgggatcttcattgtaaatgatttgcctcgcaagctgctgcaacaggaacagctgtatatagttcggaattctgaattaaatcgttcgttaggggcaattctgaattctgatactatatatatatatggctttgaaatataaagttctccaaggaaggtgacacatatttcctgttgtacgagcataaggtgatttgacgctcagactgataacaactgaactagggctcagtctgctttaggcctttgaaggcagtttgttcatcacaggggctattttgtcctctgggagccctctttgaggatcaatcttgtaggtgtcatagaagtccaaaatttccatcgagatattcttgacctgagaattgatgaaaatacaatcaatcattaatggatgaaaatagcaagagaatcaaacgatgggagccagggcaagatcaagtgatcaacaggcacacttacaatgttcatgtcaacacggagctcttcaaaccacagagttatgtccttgtctttaagaacgcttgcaatgtagatgcaggctaatgctatcatatatggtgggtgtatgagaataagatccatcttgtaagtatcattgacaattcccctgcaagtaacagcagatgataagcataggaaaaggtatagttgaaaattttgcgtgcattatgttcactaatcataataaagacaattcaattcatttgtttatttctcatgtgattccagataaaagctactagatcttattgtactctatcacactgaaatgattaaaagtggtaagagtccttcaaaggatattcaatatgacaataataaatggaaatactctcttcaaatctaaaaataaatgtcaacaaattatccatgtggtaattaaaaagggttagacttggaccaccaaatgccagaaagcatctaaaacagcttttctgcataaaacaaaactcaaaacagacttcacagatacaaaaatgcaaattgttataagaagagtaccaggcaaattgtgtcagatctgttatgccagcatcctgcaataacctaaaatcaaagcatctgttaataccattgcagctctgatgttcatttaaagtatatataagggcttcggtaattccggtgaaagataatgttgtttcatcgcatgatagtggaaaaagaatcttactgtaaaagaggacgatatgggtggtaaacaactaaataatagtcaagtgcctccaggagcttcatttccatttcaaggatatccttgatttcaaaccggtacttctcatcagaagctacattttgcggggggagagcacatgtttagttttaggttagtgcagttcttcccgataaatatgtgtccatttatgattatgagccttaccacacatcttttttatgtaaaagacaagaagtcttgcttgcactgtgctctcttccacctttgatgccaaatacaaacaggttggtgctaccagacgaggatcatattcagtcatgctctttctgtaaacatatccagcatcagaacaaaattctaatagcttgatgttccactgcaacaaagaattaaatgttctggaatgaaatattagaaagcactgtgcactgtgccactgtgtactctagttcttatcgaagaaagtagagaatcacatcaacatagtagagaatcacatcaacattttgcaagccccccacataccataattcttagggcattaattagctagagaaaggaaaatgatagccttattaggaagttagaaagtatattgtttatagattataaggtagtcaccttaatgggaaagtaaggccatctacagtgtgaattcgcaccaaacaagctataaagcagtctcgcagcttagcattgttagctctagtgtgttactcatctcctaattaacatttggaacccataatcaagtcactctcctctccacctctctcttgtatatcagggaatatatttattgtgcaccaaattgagaagttctattttacttacatgagagatggctttactttcccattaaggtggcaaccctataatcttaaaaatacgctttctaatttcctaataaggttatcattttcccttctctagctagttaaattgacagtcaaattcatatggatatcttaggcactctttctcctcgatgaatagaaggcaactgcctttcccatgtatccttaaagagaatcataccttgtgtatacacgcctgaaataagtaacagcagtagctatcaccctgaaaatacaaatgacataagatcagtatcttcaaaaacttgaggtcggtatctcaaggtaataatggataagtctggtggaaaatggacaaaattagtagatatagagtaaacattatgagttacagttaaccttgtgagaacgttgaaatgcccttatggttgacagatactacagtaaagggaaaaatataaaagtataactaacatgttcgtttttctcttaaagaaattatatctcagtctttaaggccaagcagacagcagaaatgttacagcaaaaatgaatcttgacgagggaaacattaaaacaaaaccaaagtatttatgtctctaaagtaatgagccagcaatttatacactataacatatatttccacaggcttgaaagtaatccttcagaaaagtaactgccaaatttgttgcaagtagaaaggaagcagaatccccttcttaaaataattaccctaaaaaagtcacccttggtaacatttttagaaatagtctacagcgcatagagtgtacaaggaaagcctgctaactaagtcccaatgcaaaatgacaactttggttgttcgataagggcatcctataacaaatggtacaggccagaaagtggagagaaggtttaacctttgtctaactttcacctgttgtgccaatcgccagatatctgaaatcatcaaatgatttgccttaatttgtaggactaacacaaaagtacaaaacatgaacatcgagcaatcttaagtgagacgctacagcttctataaatggaacgaaatactatgcgctcctatccattttcatacctacggtagttatgctacacctttgtcgatttatggaaacaatgctagcatagcttgcagtgaccccactataaccgaataagaatacaaatctgtatgttcgagaattttccatacgaagatgcataacattgcgcaagggcatgactacacatcctatgacaacttgattcattgcaattacagcaaaaatctgtgcatattaatggctaaaagttccctttcttaaccaccgaatgaccaaacaacacatgccgtgagctgaaaatgctttgcatacaacaattatacactacaagcatactacacaaatttctaattgccttgtaactatagccaattcctttgatcaacacaacccaattaaaacgtactagtatgcatgtgacacaaagttgtatatactgactaccgaattcatctagaacgagcccactaacgctcgcatactagttcctaaaatcattctcaaatccgtttatgctaagtagcagtatctccccaattccagaaaccaggcaatcacaccgagcccggagctgagaacaaattcgcgtcaacgaaagcatcacaggaaagctaaagggaggagaagctcacggaaggacatgtggatcttgacgaggcggaactcctccagcgtgatgccccggtcgctgtccgcctgggggaccttgtccacgtcctcctggtccagcagctgcttgctgccctcgctcgccgcgggatcacacacgaacgaacaccccccaaatcagcagcagctcagctcacggattcgcagcccaagaaaccgaatcgagagggggggaaacgtgggggaggttggacgcttaccagtgcgacgacgtccagaagttggcggccatcgtgggcagggcggaggcgactccggcgagcctctccggccgaatcggcggcgctcaccgggaagagctcggagttcgccggaggggaggggggaaggggaggggacccaccggcgtcggggatggattaggaggtggttttatcaggctcgagttttgggccgtttgggctttgggctcttcgaggcttactcggcccagaccaaatgatgggccgattcactatttcgctagtattttgcctcctaaagttcaaaattacaggagcctctctggggaatgttaagattgtaagaaataattggttggtaaccagtttttgataatgaaaaaaaaataggtttttcaacttctaattttcagttcatttttttagtctacaactatagattcttagaatctggacgaaaagctctgggagaagcgggaggtgatagaaactcttcaaatagggccttgaactgtttggtgtttggtatgttacccaaatcaatcatgataaatcaaattatgtaattcctctattttgttgttgcgtcagcaaaaatgtaattctgaattgtgacaaaaaaggaacttgtatggtagaggtatgtgaatgcggatgtgatagtatttttggtttgatgccttccaagatgtggtacctcgtattacatttttggtatagtggggtacttaggtttgtttggattgctaccttccagaaatttgctatggttggtttgggcaaacataccaaacactttgttttcacaagcaaattggagctcttttttaaggagggaaatataattaaaaaccaaccatgaattatattagctttttttctaaaaggtgaaaaagtataacaaccatgaattcaaaagtgctacatcatcaacattgatttaaataaacaaagggtaggagtaacctttcatacctgtcttgtaacatgaggattgctgtggataaaatgcctatttaccccccaaaagtgctcattcccttatttatccctcgttctctcaataacactcgagcccatattccacatgtcaaaactaagacatctatacattctatatagttataacccactaagtttaaaactcaacatacaaatatactagctcatcattcactaacaataattacatataaaaactcatacaagtattcaacattatttacaattcattgaattctacaaatcaacatgcaaagcatatgtgattatcacaccttacatcatttccataatattttaacatatctattcatcattatattacttaatatatatttatccggataacatttattgattgctcccagcgaaaaacatttagtccttatttggttaatccttacgagggaggaattggaggggatttattgtggtgtggaattattccccctcaatcccctctaaaccgaacatggccttaatcattgccaaccggggctccccttttcccattaaattggaagtcatcgggaaatacatttcaccgagggccctggcaaatgacactgtagctagctctggtaggccttctttggctggtatgacaagtgccctcacatgtaggtcgttgtgcagtgtcatatattgtacagtactacatatgagtacttgacaggaggaaaaaaaaaagaaatctctttaaggtggtcgctcagtcgtctactcaccatgtaagaacaaacagttgctgctcccaaacattcacatgctgtcctctcccaagtctgaacatgcatattcagaccaaaaaaaaacatcagtataactaacagtccaatatgtactcgtgctatgtcatttgctctctcctgtatcgtaggatcagccgcagctaaaatctataattttaaaacttaattttagagttgattttaaatttttttcgtaatttatttattaacactagttttgaagtaactataaacacatcttacaagttatattttttaaattgctaataattaactgtggacgaaacgcgatggaatcatactgttcatcttcgaagaacagatgtcggtttgcacgtccttcttggcgcaattcaatacgattcaggcttgatgtcgacgacgacctgtcatggaatgataccagaattaatggatggggaacacccagcatgttgacgtctcagcaaccaatccaagtgaattatgatctaactagctactgaaaattcctttatccagtgctaaccaatcagctctaacgatgaaactgtcagggaaaaggttggagtgaatatccatgaaaacgaccgggttttctgaagaacattcagggagacgaaatgcttggatggatacatacatacatacatacatacatacatatatatgtatgtgtgtgtatatatatatatatatatatatatatatatacatatatatatatatatatatatatatatatatatatatacatatatatatatatatatatatacatatatatatatatatatatatatatatatatatatatgatggatggttagtttctgcattgggtctcattcatgagatgggctgtctagcttatccttcagtttcagattcttgctaagttctagttccttctgtttggctgaaaatttgtagagtgctgtttatctatctcccactgtctgaaactctgaattacagttcactagtatgagtatgtttgtttcagtctttcagaatcatgtaaattatactgttttcagtaattattgcccatatgtctagcactcaactccagtgattcctcaacttttgcatctctggctggattgctgtccattgaaaacacccattgaaaacacttgttttcagaatgttccaaagtttctttaaccaaatactgccatgtgtgtatacctgtttcagaatattccaaagttttttgactaaatattgccaagtgtggcatactcatttcagaatcttccaaagtttttttgaactaaaatattgccaactttgcatctctctatggattagatttcactaaagatattttcatcatgcagccacccatatgatccttgtacttacgcaggccgtagggtcccttggcttcaaaaaagtcaaggaatccaacctcaaatcagataaactttagtgcagcgattggaacagatgccacattggatctgattggacttgtctggataggattatcaatttatcatggccaaaacatccgtcatgtcatgtgcatacgcctgttcgtccattgccagctaaatattcagaacctaacactgaactttttccacactgatcagaaattaagaatgccaaacacaactagctcctgatcaatcaagcgacattacaatctgcaactgcaagtgagtagatgcatgtgtactgtagtataatcgcattcaaaacgaggagtactacattgcaatgaagaatttgtttcgccaagattgatcaacctgacatggcagctccttcgcaattgcagcattgcctgcccttctcctgaaagtgccataagtcttcctgtacctgaagaacataaattcttgcaacaccgaacagatcaccaataaatcatggtacttttgaaggacatatgttcgtcagatctatgcatattcagacacaatacttatcagggcaaatacttatcgttggaatcagctagcaattaactccatgaagtttcagctatacatatacatattcgatgcaagaattaatcaatacggttatacggagatcgacagacataattgcatctagcttgacgccttaatctgtctgacctacactcgtgtctctcgtagtactactactaaatatcaggattatatatgtcaatggcatcatttccattctctgcattcaatccaagaacctttcaggctttcagtgacaaccaaacggtccccctttgcaagcctgcaactgccatggattggagagcatgcttcgtcataaagtggcatgctctccatcgaaaatgacatgcgtgtgcttgatgcttcgatcgatcttgatttggtggtctcatgacaaattacgaattggggttgcacaaacatgtcgacattttctttcaggattttgccggtgccaacatgatcaatggacttattaatagcagcagcattagcagcatgttcaaccacatgtatcatgtacaagtacaactgcaactcacttaatctggaacatgcgtaattaaagaagggacatggattacagactcgtgtgtatagctgaaatagtgaaattaaactgtactctaccctgttaatcatttacgtttcagttttttgctacctaatactcgtcaaaaatatttgacgagatttcgttaaaaatttaaagttccgaccatcaataatttctttaaatttgctgcctgttactatagaaaatatttagggcgagattcagttaaaattttagaattccaaccatgaataatttatcaaatgcttagtttttttaagaaataataaacatggatttgtctcaaaagtagtatcataaccatgatatcgtaaacttattggatatcataaacttattctaataaaaagttggtttttagaatttaaaagtttgatagaattttatcctaaacattaaatatttataaccgcgcgtgggactaccaaattacgtgaaacatagtactaggtcagttcaacccaaacaaataacatggaatgtaaaaaaaaacacaaatattagataataaatagaagtgtgagccttcgaatctaggccggctagtctaccaccctatggagttagccgaaaaacgctgggcgtttctcaacagtgaaatatataacaatcaaattaaagaatcatgcatcatatccaattatatggtcgagcttaaccaaatgattagaggggagaagggagcacagacgttgctctcagctcgctctgtcactacccagtgagccactctgtcatgcacgttgcctcgattgctcagtaacgcactccctccgtcccacgatataagggattttgagtttttgataacaacgtttgactactcatcttaatcaattttttttaaaatataaaaaacaaaaagttgtgcttaagatactgtagataataaagtaagtcacaaataaaataaataatagttttaaatttttttgaataagacaagtggtcaaccgttgcaagtaaaaactcaaaatcccttatattatgggacggagggagtagttactagagtaatacccatgcttttctaaagataaaacaaaatatattatgatattatctaaaataattcttttataaatatattatctgtcttttttctaaggggaatattcatcttaacttagttttatatgtgtttatcatttagatttggatagtttgtaaaatttatatgtgtttatcacttagatttggatagtttgtaaaatttataatagaaagatgaagtggtagattactatcaagtaccgacatataattaagctggattgaccaagcatgcaatgatataagttactaagaacatccatgtgaaataaatatatattccttccgttttttaatagataacattatttactttcaaacacatatttaaccattcattttattaaaataatattatgcatatgtataagatataaatcatacttaaaatatttgaagtgataaaacaactcacaacaaaataaattataattatgtatttttttaataatacgaacgatcaaatgtgcgataaaaagttaactacgttatctataaaaaaaatgaggtctatggcattgctctcactctcagctagccaccgacacatccagaaacgcgtgcagacgccggccatggctgatggcttaggtacaggtacatgccctaacattgtctgcatttgcatgtactcctatatgaatgcgagaacgacgacgaccgtacgacagtaccggcttttgtatcttacgatgggagctgggcactgtgctgctgtctaacgctgataataataatactagtaatcaattaagtcatacccttgctgctggacctgtctgtcatgtggaagatacgactgcacccccccatggtctgctactcatatgctagctgactgatcagtgatccagttgtagtttttcgtttcctttcagctatctttatgataataagctgtaggtgtagggaccaaagaggatttttttttatttatttttgaacttttctatttttaatcttaaaaataaacactttcaaaacttatttacttataagatctgaatcttttggttatgtcatgattggcatggcaaaataacattgtcacgccgatctggctggcgtggcagcgttatttggccacaccatcctcactggcatggcgggataaaactgttatgctcgctgtgtgtgacgtgtcagtattgtttcgaaaataagttttgaaagattggcatggccaaaggttcaaattctgaaaacaagttttgaaatggtctacttttaaaataaaatataaaaaaataaaaaaataaaaaaatcaccaatgcgtggttctttaaccttttgagatcaatcttgcaaactcgtgcttgttttgcaccctatattcatcggatttttctcgcctattagagcaagtttaatagtactctttccgggttgataatacttgtcgttttggataagggtgaggtcaaactttagaatctttgattatcaatcatttttaaaatatttctctttcaaatatggtgactatatgtatagattggtcttaaaaaatactttaataagatcatatatttgtttaacacttttatatatattatagtagaaaataatggttaaagttgttttttggagaccgtgcctttgtccaaaacgacaagtattatcaacccggagggagtataaccaactactagctctaattcatctatagtcaatctaatagttcattcatacaatagttacctatagacatatactaatccattaatatatggtctcacctctcatacacatacaacgtattggagtccgtgccgcagctagctataaatctgtagtctgctttccttctctctcttcttttctcttctctacatgtgtttgtagctgacttatagcctgccattgtactcgctcttactcgctccacgcttgtaagattatacgatttctcaaaaagctttcatctaatgcattggttaaaccattatttcagatgttaacgaacttgccgtacacattttgcttggactttttttctttaatttcgggttgagatggctcagttgttttcagttttcagttggcagatcattaagtcgattcggatcggagtttccgacaggtacattggttaattaattaagacacaactgagaatacaaagataatgcacccggtttttttcaagctacactatcgaattatttccgcgggttttttttatttactatacgtcttgaaaaatatgtttcctcaaaaggatttctcaactttttttaaaaaaaaaccattcctccaaattgtcgacgggggatacccatagactggatatagagggtattggggtacgctagtacgaggatctacgtagtacaacatcaagcaaacaagagacagagattatactggttcagaccccttagtaggtaatagccctaattcagttgatatgggattatacgatgggaatcacagattacaaagggaatagtggaacttgataccaacgagattgtagtcgagttggttcgactagatcacccggtgacttggctcatgtaggctccggcttcgtaggctgtggtggatgtgttggcggtaagattccatgccttaggtcctcccaggggtcccttttataccgcaggtcaattggtctccaagtagaacttggagatgtcggaccccatacgatacagtaacgatccagttctgtccgagtagtactccttccatctgtggactccgtgatgaatttccttaacgtgtacatggaacatccgtatacgtgcaggtataccatatcagtacacgacgtatatccaagggtagagggtataccttatccgtaactctgacacaaatctttgttaaatttattttatgaagtttataaaatatttaattcatcacgataatcaagtagataaataatctaaggtaataatgcgcaataacctgttttcagacagcctcgctggtgacggttgagcgctagcaaacagctcgcgcatgctgcccatgcagagagtcaatggatcaatccatgtatgcgctcgccggcggccgctgctcctcactgtgcgccataaattccaccttcggattggatctgaatatctatcatctatttttagttcgatccgtttaatttaatttgcccccaattttcactggttgatctgacctctccatcgactgattgatcgatcgatcgagccctactagctgtacatgaacaatgaacaattacatcgtgatctcttaattgaatgcatcttaattctgcatgaattcatgcatgctcttctcgatcgatcgtgttcttgaagcgatcgaggacggacgacactgtgtacttggacgtgaccgatatgcatgagagctttgtaatggtagcgttccaacgctaattaaatacaagcaaattaatcaaggtcatgtcctaatttatgcatgactaaattatgtatgagacagtattgcagcttgcaggtatgccatgatgatgttaacagtcctgcttctggtatccttgacaatgaacgatcgatcgatcgatcgatcaaattaaaggacattagctacgcacagtactgatcaccagcaaaacacatggtcagttgttaatctaatcaacctcctttaatttactccgatcgatcgatccaggtgctaaatagctgttcattaaattcgcagaggcatcagatcaccgttacattcatccattaatccagaatttcaggtactatttcactgcctgcgactgcagtatttgcttctgtgctagtaagagtacttcttttctgaagaatctgttactgctgctgtgctcatacccaactcgatcaatcacccatgggtttagtatcctctatcttcgaagctactacataattttatcactggtatatgggtccgatagaccctaggactcacatgtgagacatagttacaatcggtgttgggcctatatatggccgccgctttctcttccttcctcagggcaagcggcgtcccgcatgctcaccacacctcgaggctgattcattgctagggatgcggttatgcttgcggcatcttaacatgggcaaaggtcattacccacaagaagtggcggctcatcgtccttatagatagagttggtcctcttagtgcggcatggcctcacatgatcttttggctaaaacaactacggtggcgtcaccatgacggtgacaacaacgactgggttagaggtgaactcgagttaggatggactagttatgtccgcacgatccgaagactgccacaatcagaacggtatctttagtggcgattgatgagtgtaaccggtaacgtcagaaatgacggtcggtgcgtcgtcattggcgagctggcttcgatagccatggtagtggcaagatccgacaagtgactgttttacacttcaattactcttcagtgatatttttcgctttggcttgacatcaatcatcggcgctgatgtgcacaaaaattgatttgaataatgatcggacgctgattttgagattctatattccgttttgtaatttgatttatatcgacggtgttatctatttctttagactaatgttctagctagttttcttattagctatcaagttatgatttgtaatccgcggatgcccgatctataaattctataataattaagtttagcttctttaaatgcttcggtccaacgaaaaatatctcgaggtaccgatatctcacggtaccaaatcgttttcgatcgttagatctaacaatatctatcctgtctagttagattcaatgattgaaaatgatttgacaccatgaggtaccgatatctcgagatactttttgcagtactggagtatatctcttattaaacaaactaattgtctcaaaatcctcacgaggaagaggaatccgacgttatggcccgtgagaaagatggcatcaatgcgcaccccccgcatcgcctcatgggctcccctcccctctcgctacacccccggaagcaccgacccatcgacccccagcacgtcacatgcgctttgacaacgatctgagatcgatcgatgtgccgccgcccgccggcggccgcaaccgcttgccggcgacaaaaaaaaccggcgatccccttttgaccttgccagtctccacatgtgcaggcaagtccgtgtgtgtgtataaactagttcagcacggaacgaactcacagcacagcacaatgtgtcattctgcctgctttttttagaatgatattttttatccggtctctacatccaaccatatatatatatatacaactcttttaaattgaaaacttaatctctcaaacaacctaatctaaaaattcactcatatgaagatttgaactcagaatcataagatgctacttagtcagtgcaaaattactatattttgatcaaagttaaaacgtctttgtaatctggaacggagggagtagaatatatgtgtcattctgcctgcctagcttgctagctccactgccgtgcggtgcatgcgaggtcggaccactcccactaccgcgtttcgcccaagttgcgacgagccgaacgaccaaacacaaacgctggatgctgcgattctaccgaattttcgcctgctttctcccgtgcgatctcacccgaattcctctctctctcgtctcgtccccgtttttttttacccgtctccacgaaccaaaaagaattcgaaaccaaaaaaaaaaaaaaaccgcagcgcgcgtcctctctctttataaccttcaagtgttcgtccactccctcctcagctagcagcagctctagcttattactaccaccaccactgtactaccccgcacgacacggcgcgacacggcgcgacgcgacgcgaggaggtgagcgcggatgccggcggacgcggcggcgaaggggatgaagctggagaggtacgcgagcggcgcgggcgcgatgctgctgctgcggcgggcggcgagcgggaaggtcgtgtcggcgtcgtcgcacctgctgttccgcgccaccgtgctcgccacgatggcgctcgtgttcctcttcacgttccactacccgtcgctgctgtcgcgctccttcacgctctcctccggcgccggcgccggcgaggggggagccgcggcgcacgcctcgcaccggagcttgctcatgtcgtcgtcgtcggcgtcggcgtcggcggcgtcggtgtacgggggcgcggcgtgggagaaggaggtgaggcggagcgcgaagccgaggaaggacggggggatagccgtgctggtgaccggc

SEQ ID NO: 11863 - DNA, 17945 bp, Oryza sativa
gacatcaacgacgcgctcctgctcgagaagctgttcgacctggtgccgttcacccacgtgctgcacctcgccgcgcaggccggcgtgcgctacgccatggaggcgccgcagacgtacgtggcgtccaacgtggccgggctcgtgaccgtcctcgaggtcgccgccaagcacgccgacccgcagccggcgatcgtctgggcgtcgtcgtcgtcggtgtacggcctcaacaccgacgcacccttctccgaggagcaccgcaccgaccggccggcgtcgctgtacgcggcgaccaagaaggccggcgaggccatcgcgcacacgtacaaccacatctacggcctctccatcaccggcctccgcttcttcaccgtgtacgggccatggggccgccccgacatggcctacttcttcttcgccaagagcatcgtctccggcgagcccatcacgctgttccgcgccgccgacggcgccgacgcgcgccgcgatttcacctacatcgacgacgtcgtcaagggctgcctcggcgcgctcgacacctccggcaagagcaccggctcctccaagtccggcaagaagtccggcccggcgccgctccgcgtctacaacctcggcaacacctcgccggtgccggtcacccgcatggtcgccatcctcgagaagctcctcggcaagaaggccaacaagcgcatcgtcgccatgcccagcaatggcgacgtgcccttcacccacgccaacgtcacccacgccgcccacgacttcggctaccgccccaccacctccctcgacgccggcctccgccacttcgtcgactggttcgccgactactacaagctcaagctcgacgtccccaagatcgccgccaaggtcgccggcgccggcaagccctcctcctcgtcggcctccaagaagaagaagaaggccgcggcgatgtcggcgtcatcatgatcgagcagcacaacaccatgagacaccatgcaagtgtgtattccatagctagttcttggaggctcttgtctgtataacattgtaagtgcttattgtttaagcccctattaatttcttttcttcttcttcttgaggtgtttaatttttagtgattagaaacaagggaataatggtggagaaataacactgttgttggtagataaatatgagaggggtatagagatgatgataaagatcaaaaacacttggaagccaggacagaaagaaagatgaagtcactggcttccttcgaatcaaaatgtctcttttttttcttgttcttttcttttacagtgtcatcacttgttctgttcttgttccacctgatgatgtaagccatatcaacatgctgttgctgatggaatccaatccaatccaatccacatcatgaagctaagctcagctgcaagcaagaaagaacttcacttctacacttctacttttatttctgaaatctgaatcatcacaatcttttaatagataaaaccatatctttctgtctacagaaacttgtgcagattcaggccctgactctgcatttcagtgaggctcatcaaccactgacatttactacttctgcagagtgtgtatgtatgtttgtgtgatcaatcactgaatcacatggctcttgattcgtccagcaatgaggcagcaggtagtggctggttggtgaggggatcatcagcatggtccagtctctaatttgctgctcatttttagcatctttgatgggcagcatgagcacatattcagtacaggccgctgctgctgcttgccgtttcagagttcggccactgtttgcgagattttgtgcttggagacttcgacgcaagtgtactacaaggaagaaaagagagtatttttcctgccgatttgtgcggtgtttttagcgtaaattcagtagaatgtcggcacgatgtcacgaggctacagttttcagaattttcggtgcgttttcaggcacagggttcagcaaatggatattaatcaagagtgccaggctatcttcacttcactcgttcgtagtgagtgagtgatgactgaatgaatgacaattgacaaccgactttttttgtttatggtgagtaacaatcatcttgttgtgatagttgatagagacactgcatattgtctgcaactgtgctttttttttgcagttttttcccagtaattagagatatagttttactctctcctttgttctgccgcagattataacctgaaaggaattttataatttaaattcatactcaattttaggggttttcttcatgattcatcactttggttgctctataagaatccctttatggtacaccgtactacattatactattagaaaatctacctaagattatttttaaaaatcaaattctttttggattataatctgcagctgaactaaacggggtcttttgaactttggattccttttataagccctatttattcgcactggcaatctgtccatgaatggccccctttctgaaccatccatcatgcattcatgctgctaagccttagtcctaggacgattcttgtccatttcctgcctttacaccacagctgcttctttgcatggggccatcagattccagtgatgttgttccattattctactactagatttgtgctacatgatccaaaaaaagagcagagaaaacatcattgtactctgtgaaaaattgtgtatatgctgcagattccagtgatgttgcatattctactatacttgacttttgctacagaatccaaaaatgagcagagaacacatcattgtactctgcgaaaaattgtacattctgcaggcaaaaatatggccttcttgtcagcatttgcctttgtttcttctccctgattcaattggttgaacatgcagctcacagcaagaaagccaatgtgtgttcttttctaaggaaagcaagaaatacttcctctatatgagtttcttagaaaattattttaaatccatttttccgtttgtaccctcgaataatcgtcacaaaatcatttagctatttattagtgtggtgcttctgggattttgctcgcctaaccagatatctcatatgccattttctaacgctgcatcggacaatattttctgactatagttttcagtacacatcattgaaccaaaactatatggtccagtttaaatcttgggaaataaatatgtcggcatctagattgttccaagctccaaacattgcattgaacacggatagtatataggaccagagagaatccatctcataaattatgcagaaagcaacaaataatataaattaagaattagagataggcctgtacttaacaagtctgaattgatgatgaacgaggtctgtctatacaacagtctggtgatcatgttctggagcagcatgaacagaatcatttgtgagcaggaaagcaccttggatctgaggcttgtgacttgtgagatcttggaagtgttgcattgcattgtgcaatgaataataggtcaaagttttcagctagtatttcaggtcatctgtttttttttttttttttggctagagacaattgaactctgccattttacagctaaaaaataagttatagtaccaaactaattgttcagaaatctctgcactagtgcacttggtctgctatctgaagccagtgctatagtgttagtattatattagtactgcaagttggaagtctggtcccagtggctcaggtaagcttcacagtggagcaatctttgacttgcattggaatggcattagaccagaaaaaaattggacctaatccagattattggtctcccagtgcttcttcaccacttgcaaaaagtatgttactttaattaattccatcatgctgatgatctaagttgatgagcctccatttcaactcttgctgactattggtttagttgtagtaacatgcatgttcccatcattccagcttgcttcgtttactagttgatttctttgtgttcagtctttgtgcgagtctgttcaggaactggagtatctgcaaatctagcagcatgaattttcagctggattgtgatatgtgtgtgtggccatccgcctgacccactataatgaaaaattcagttatttttcagcaaatacagaaaagaaagaaaaaaaaggtccacggcgtcggtcatggccgtggtctgcatccacagtttcagagatgatagaaggcaacaaatctatttggaaatgacactctgacagtaacaaacagcgcctgcgggaagagaaaaacgccgcgggagtttttacggacaaataaagctttgatgaagtcttaaccgttgtgaattatttatggcctcgttatattccagttataccagatactccctctaacttaaacattttagaattttataaaaaaatataacaacatttatatcattaaattagtttcattacgcctagcattaaacatatattccgatagtttcttccaaaaaagtattgccaatttttctataactttgattaaaaaaaaagttgcagagaaaattgcgtcgtcgccgccacaacacctgggctccatctctctagtgggccgggctgagagcaccaggcttcaaccgggggaacaagttcacttagactcctttaagtagtggtcgaatctgattcatatctctgaaccacaataccggatatctcaaccccttaattatcaaaaccgatgcaatttgactccctcggtggttttggagggcggtttcgctgatgtggcggtgttgacttggtcttcatcctacgtggcgtttatgtggcactacaattaaaaaaatatatatggcggtgttgacttggttttggtcttatggcatagagagaagctagagagggaggaggaggaaggaaaggagagaggatgacctgtggccccctatgttagtaggtcccataatttttttttatcactaacaaatggatcccacatatatattttcttaagtctaatgccacataagcgtcacatcaccgtcacgtggaacgaagatcaggtcaacaccgtcacataggtgccaagtcagcgaaacctccctttaagaccgttgagggagtcaaattgtaccggttttaatagttgggagtcaaattgtaattcaggggtacgaattagattggaccactattaagggaacaccgtcacataggtgccaagtcagtaaaacctccctttaagaccgttgagggagtcaagttgtaccggttttaatagttgggagtcaaattgtaattcaggggtacgaattagattggaccactattaagggagtcaaagtgaacttattcctcgaccgggagaccccagcccagcccatattagccaccgggggccggggcctggaagccttagccctcgctcgccgggcgtctccgtcacgaacaagcgccgccgccgccgccgccgctcgccggtgctacggaagacgcggccgcttcttattcggaggcggcgaggagagggagaggggcttcatctgctgctgcttcggctaggagcctaggacgccatggcttcctctccgacgacaggtacgacgaactcgacgagctcccctcttcttgacttctttgcgcagcatgtctacctcagattgaaccaaaattcacaaaaactccagaaaaaaaaaatcgctagctttcggctcaactagtgagaacgaagcttacggcacaaatccattagcttccagctgcagattgtgaacttttcaaatcgcttagattgaagactatcaactcatatctttgtccttccaagaccgagtttaaagcttccagatggattaatttaacttctacattgcaattttcatgccatgcttgcattccattattattagtttatttttggggttcttatgatagtgtgatgtatttttagatggattaactgagtcagtggccaaaaggaagggctctccttgccaacaagatgatgattgccaagatgacaaacgaataagatcaggtgcagaccttctagaggtataaattactatagtgcaaagcctacatgcatgtgaattagttgtggctcgaataggaatttgtaggtaggagtaatgtggtgggcatgggaatgtgaatgttagtgtgaacccttcatttggcccgtgatatttaaagagaaaaattcattgctaaattcactctctacaagatataaagataggtatgcttatataattttaattcttttgaagataattttagatataattttaatgttaggtgtagggttgaatgcatcacattttcagtcgtgtttatatgattctgttactaatattctctgatcctagttgacgaactgcatctttggttataagttgtaggatttaatcacatctgattcaatattgcctataaagataaggacgattcagataaatatctgtatgaatttactcgtcattgataactatactcaactttgctttgacaatctccaaatcttttaaagagaagtactgaagaaaatccccagatattgttatgcacggttattcattcatctggtctactcattctatgttcttgctgcaaaacatccagatgcactatacgtatgctgtacagagtatacatgtttatttccggttctttgctattctgtcatccttagcttataatatcatattgcacagtataacaacatgattttcccgaacgcatggaaatagcatttgttgattgaacatacctatttcaatttttgctgatccttactaatcactgtctggaaaaagatttatgcaatattcatataaagatcccatgtctcagtccaccaattttttcgagggaaattctcattccacctaccacagctacataccagtgtattttcttcttctgtatgtgatgcagcacatctttgcattgctttcgtacttccagtactactgttctcacattgctttgcatgcaggacattttttggtacattcattccttaatgccacttcgagatgctgctcgtgctgcttgtgtgtctcattcatttttacgatcttggagatgctatccctaccttatgttcagtgaggagctactccgattgcaggagagtgcatttagtgatgatgagagaacgagaaatctcatcagcaaagttaaccacattttacaaaatcactcaggcattggcgtgaagaaactagagcttgttttcttggatagtactgatgtggacttaagttatattgacagttggcttcacaaggctgtcacacgagggattgaagaactcaccctgatactgcctataaacagcaatgcagaatacagcttcccatgttcgcttttatctgatggtaatggtaactcgattcagtatcttcatctctctcgctgtgccatccgccccactgctgatcttggttgcctgagaacattgacaacgttgcatctatattccgtgcgaatcactgggtttgagctagagtaccttctttccaattcacccgcattggagtggttgataatgatggattgtaaagagatagttcagttgaagataccaagttgctgaagcggctccatactctttttgtgagtagatgtcaaatgctgaaagtggtagagagctatgctccaaatatcgccacctttcacttccggggtcatgttcatgcagtgcgaatgttgggtttactgcaagtaaaagaccttgagatgtcatgttcagatcactctagcattctctgctatgctctcaccaatcttttgtctattgtcccaaatgttgaaaaacttagaatatcatcacaaacacaggtaaactctgaagcattacataattatagagtagcaattgtacataaaattgtagacatctattaaaaaattacataaaactgtagacatccattaaaataaaataatacgagacatctttatgcagattgtcagtacacaaactgtaccagggaaatatcttcgcctcaagcacttgcatatatctcttaacaggtccccaaactttgattatctttctcttgtttcttttctcgatgcctctccttcactcgagactttcatcttgcatgtaagtaactagtttcatcttgtaaagacaagtagtatatatcatccataaatataaccatcttttgaagtgttctctctgttttacaattaattttgatcctatatgtgcagatatgggacatatacataccactgggtcatatggggcatccttggactcttggagactctgaacagctgaggcagatgccaggacaccgccatgacagtctcaagaaattcgaggtcgtcggttcctgctacgcgaagggcttggtcgagctaacatgtcatatccttgagacgacatcgtcgctcgatcgtattaaactcgacacctgtggttatgttgggctttgtgcttccggcagtggcagatgttacccacattatacagaacaaatcatggaggcctgtaattcagtcttggctatcaggacatacatcatggggaaagttccacctacagtgaagtttgaacttgttgagccttgcagccgttgccctgtacagtagatgctaagttattaccggttaccatgcccatatgttttttttaaccatttttttaaaaccctacggattgccgacataacttgttgagaaaggatcattgcatcctagtcaatatctttaatatatttattcacccataaattactccagcacttgttgagcaattgttgtacaggttacatatttgttgtacagatctctagtcttaaaataagacatcactgaaaaactttacctctgagcaatggactgagcaactgttggacagctactttccaattcactcgtgttgaagtacaaaataagcagcagccttctcaatccaaaaggatataacaataacatggagttctgccgcctcagaagatgataagatagaaagcacctttctgtaaattaaataaattgtacactcaaatggaattaacttggtacagaaagaacggtggaactattcaaatactggttaatatcacaatattaatcgttttagaagaattaaatgaatatagagataacacatgtcactacagaaaaaaggcatcgttatcaaaaatagtggaacaataaagccaccatgtaagtctgaacatcagaacaggacagaatcatggaactaaaatgtccctaaagttgccgtagaacaattctagaatgttatcgtggcaaaatacagtgactatacggatcggggcagaaatttgcatcatattggggagaacatcagtataccagagaactggaaacatccagtctgtcctaatataactattagctggacattttattttattgtagcacaaaaagaactctgtactgaaacttacaatcaaacatgaagttatggtggtcacttgatgttaaattgttgatatgataatagtttttttttccttccatttcgtgagtgaaatacaagcagaaacatctaatgcaatgcaatctctgtataataacttcaaaagcttccacttacctggttttcagcaagcagatactacctccgtcctatataatataggaatataatataggaaggaggtagtatgattaaccattcatgttttgagctgggccacgatctgaagtatctgagagaagcttaaaattttcaaatttccaaactactgggaactaattcacagataatgaattaaacaagatattttcagggatcttcatgatcacaaggctgaaattagcgacttaaaaactgagtgcactgcaaataaatgacaactgatcaataaaggaagaacaatctgtacggaaccaacctgcaatcacactttcagaggtggaaactttagtgcgattttcaaatatatccagttagaactgagtagattggaaaatatccaatgtcaagttgtcgactaatattttatcagcctgtaatgaacaaaaaatcacatataaatatgttacctcatttagggaaagaacacactaccccccaaaagtcagatgcagcaactcgcaacttcttatattagacaagtacaacactaatagctagtggttttaagcatatagtacagtatattgaacaattgataactggaaaaaaaatgcatatcaactcttacacttggttccatgatgctatagagtcttcaacagagacatcagtgtgaagtgtaaacaacttgtcacctcttcagagtggaacacaatacatgatatgctacatagtaatgaaactaacattctgcataactcaaacatcacatccaacagaaagtgaactggtatagaagcatcaaattcaaacctgatgcaaataaaactcattcaatacactcaattattcttcaaaatgggtttcttataccatcactgttacagggaataaccaaactgttcttttccacaaaatactatgatactgtagaagctgcaagctaacataactttaacttgtgcatgaaaataaggaaatctcagtgaactcctcctaactattcattttgcaatttcattgtgacagttaagctcagcaccgcgcttcgaggtctagtttgctcatgaagattgctactggctcaccaggagaaggcggggtcttgtccagcatagaagcatgcacgccagctttagcacgagcagcctcatcagaagcagacaggacctctgcatgttcaaggcctacctgcctcttgatcagctccaagttctcctcgagaacactcatttcaccaaaaggaagcttcaaattcaaagcgtggggcccaacactcctcgcctcatcttttttcgacttgatgaaaggcatgcagagcttctggacttgtttgaagttagtttcctgtccgatggagcagttcttcaatgcttcattaatctcctcatcaggagcaaacaaacgtgcttggctatcaaatttagactggagaaccctcaaacattgctctttccatccataatagttctcattgacgtagaccagaccaacagtcagcttgttttgctcagatggaggaggtgcagttcccttcttgggtttcttggaaccagattcttgcttctggagcagcttcctgaatttaactatggagtcctgtaaatatttgttagcaattcttagtgtgggatctggggttccagcaattggccagcctgcctttattgcaaatccttccttcctcaggatgtttcgccacacatgctcagcatagtgtggacaaatgggggtaatgagcctagtctgcacctccatgaaccgccataataattcacgattcatgcctgctgctccacaagagagtctgtactcatctctagccaactgtaggtcatagaaccccaacttaagggcatctctgaacatgaaggcattgtagctcttctcagtttctatcaccgcaatgtttatctcgttggcaaacacatggtcagcataggtagagggaggcccagctctcagagaagattcagcggctataacctcttccatccatgcaatttcttttgtaagcctcaaaatagcagcatttgctgtttcaaagacaaagtttgcatcatccataccatcaccggcatcagcaagggcaaatctagtggcatcagaagagaattcttcaatggcctgtcgaagagttcggaaattccctgtggacttggacatcttctcagaattaagcataagatgtccattgcagcggaaaccacgaggccaatgatgctctggaagaagtgctgtatgattgtaaatgctgaaagtcagatggttttggataagatccttaccagagacacgaatatcaaatggataccagtactcaaattccagcttcattttgctcaagagggcaggagggatgtcactattgggtgctggaccatcacagaacacataatcccagacttcatctgtcatttgttctggtctgatagaagatatttccttgccatacatgttgccattttgcaaaaggtgagcgattgtgtaatatgccatgtagagggtggaatcagaaagagattctacaaggaactgctcatcccatggaatgcgagtacctaggccaaaagaacgagagcaggcccactggttcagccagcctaacgtgtgttcaaaaccattacgagtttcagctgagaatgtattcatcttctccaagcattgaactgccttctgcttccattcagtctcaccataagtaatgtaccattgatctgtgagagcaacaacacactcatcaccagatctcgacataactttcttctcaggctcgctatacaacactgctgtgccttcttccaaaagcttgttctttatcagtggcttcgcttcttgaacttttctgccattgaactcccctacaatcattgtcccatcagtaaaacctttcagatatgtcatcctttttgcttcagcaagcttctccttgtcattctgactcttaatcttaagatcgaggcacaccttctcagcagacttgtctccaaattcaggaatgttgattattggtacaaccttaaagggaagaacccattcatctttgacaccatacttctgtctcaaagctggctttgcgactaaatcctgtagtgccatgaaatcatctggagaatcacttgggacactagtcacaatgccagtacctttatctgttaagatagtaagcatgggaagtgcatatatgatctcattgaaggcaagaggggatttcagtggtaaaccaatcagatcacaaccagataactccattaagcaagttggtttttctgggacccttgatagattctgatatgcaagattaagagcagcccttgatgtaacaatgaagacatcagtgtcattgatctcaaaggccccatattttccatcaggcaatacccaacagtttgtctgcccatacattgtctcaggtctcaatgtggctgctgccaaataaacatttcttccttccatggtcttcaacttgggaggaaaaggtggaacaacttccattttaattaacacatattcttgtggctgtacaccttcaccagatgctcgatcatggtcagcacaaggttgaccatccaatggagagtagattgtgtacctcatatctttgacaaccttgcccattttcttcagctttctcatttgccaccggacaaatgcatcatagaaggggttcatgtcagtagttatgaatgacctcctccaatcacagcccagaccaaaggccttgaggtcctccttcgccaatggagggaagtaagttaaccagtggtaaggatcctgaaatttggcgatttcttcatctgataagccaaagcctctcatgatctcccactgaaacttctgcatgccaaccttcgaagcagccttagatttcttgctcttaaatttatctgggacaacagaagccgcattgtcagcctggctactatcagcaacttctgcacttgaatcatcctctacttcaggaaacgctggaggatatccatattgttgcgcctccctagagagtttatctgctgaggccttgatgggcattcccgtacagtggaaagcaaatggcaaaagaacatttgaaccacgaagcctctgatatgcagcaccaaactcaagtttagacaaggagaacgcatggcccaaatgtagcaagccattcatgtaaggatatggaaagttgccaaagaacttttccccagggcccggaggtttattcccaggttcagcctcaaaaaccttgctctcctcccaccatttttgagcatctgactggatcttgagtaaaatatctctccgagcaaaacttctgcctccatcaggatttgatgacattttcctaatcaatcaacaaaaaacaagtggttaaggctttttgtttaataaaattgaactcagtccagtacttaaacaatgtttctacacaaacaagaataactaaccaactcatcaagcacacataaaaaaataagtttttaatgaaccattgttatgcaataagatttgattgaagtcttgtgctaaacatacctacaactcatgacagggcaagtcattgatatgaagctattatgtgatctaggataacaggatcataaatttataaccaaacaaacatcttcaagaagcgaaggggggggagaaagatcagaaagaattagttaatttacacacttaatagcttgaagagaagaaaattcacactaactcaagtgttccataaacctaaagactaggtggatcatgcatcctatggatactacagcatatccacaattccacataataccaaggcagacaaatgatggaaagaagaaatccacctccaggaaataaagtgtgaaaaatacacttcctaccaacggctcaccataacaaaaggaaaattttaggggggttttttccctagaaatgctcatgtaaaactacacgaggaagtagatccccaacaatataacgcaacccagtgacataagcagagaatcaacatacactaaacttccactcttgatcagctacgacgattaactaaaaatcttatcggaaaaacgacgaaccacattgagtaatgagcactctgcccaaagccacacgaaccaatacggaaaataatcaatccaccccctatcaactaaaacggcatgataaaaactaaaatccccaacactgatgtgctaacccacccacccatccagacccctccccgacccgtctacacaaggagcagagcacaaaccgcacagcaaattgcatagcatcaacgagaaaacaaatttccgagcagcagctctgcaaagggggaggcgcgggggatgggatcgatcggccggtcggtacctgacgacggcggcggcggcggcggcggcgcgcaggcgggggagcagcagccgcagcctcagcccggagagcaagttgggagccagcagcagcaggaggaagaggagaaggcggcggcggcggattctttctgcaggggattaaagccgattagggcatatgcttgggaacgacgtgggctttgacggctttgtgaaactaatgggccgagcttcaagtgaagcctctaatgggccatgctcatagagggcctgtctgcgttcgttctcctaagttgggatagcattccctccgcacgaaaaatagagcgacctattttcttataattaattaaacatttatttttaaaaaaattattaatatgattttttaaaaaaacatctttcaatatataaacttttttttacaaaaaaactgtaccgtttagcagtttggaaagcgttgcgcggaaaacgagacggaggacttgggaacagctagaacgagcacagccttaagtatgtactccctccgtcccaaaataaatgcagttttgcactattcatgttcaacgtttgatcgttcgtcttatttaaaaattttgtatgattagtattttttattgctattagatgttaaaacataaatagtactttatgtgtgactaaatatttttaaatttttcacaaagttttcaaataagatgtacgatcaaacgttgggcacagatattatccagtcaagtccatcggaaattcgatgtcttaggtacggccaactccatttttcgtacacatgttttccaaactaacggtggtttctttaaaatagatatgaggaaagttgttttaaaaactatacagcatttaattatttttttaaaataaataaatacttaattaattatgtgctaatttattgttttgttttgtgtgccggaaagatcctattccaaagtcggatgagtaaggatcattggtctcgtaggtggtagctgatcgcgttgtaaggtgaatgactctggatcgaggctgaatctttgcatgaggagaatgattacaacagactcaatccgaactgttcatcttttttttatgacatcatgaatccatggtgctaatcctcacacttagggaggtacattgcaatttgcaatgctcattctgtgcctcccatttctacaacgatcttgcccgtggcatggccttccatgctcttagcccaagcctcctgtgctctgctcagagggtacttggaatctatggtggtcttgagcttcccttgcttggccatgtcgaccagccactccatctcctccttcttgggcatcaggatcagcggcacgagcctcttcttggagaaggtcaccctgtgcaggaacgacctgacggtggcggcgacccccggcgtgaggtcgaccacgacgccgccggcgtcggccagggcgtccctgaacaccggccacggcgccggcggcgcgcagtgcgccaccgcgtcgtacctcctgcccgacgggctccgcagcgcggcgccgtcgggggtcctgtagtcgagcgcctcgtcggcgccgaggccgtcgcggacgaaggcgaggttgcgggcgccgcaggtggccgtgacgtggaggccggcgagcttggcgagctgaacggcgtagtggcccacgccgcccgacgccgcggtgaccagcacgttcttggggccgccggcggcggcggcggcgtcggcgtccgcgtcgaacctgactccggccgccttcagctgctggagcgcggagcccgcggccgccggcaaggtggcgccatcggccgcggacacctcgggcggcctcgccaccgtgagcgacgccggcgccaccgcgtactcggcgagcccgccgcagttctgccacggcgagacagatcgtcaaggcgtgcgaatcgagacgaaatggcttacaacgctgaagaagataatatatagggtggaaactacgtattaaacttgcaaattaccgttaaatcaaaaaataggtgtatttgtccatgtcatcacgagtaaaaattttactcgcgggttcccaggttcacccatactcatggtaacatgaacgaatatcagacattaatttttcaatccaacgatagtttccactgtatttgtagtatggactaaatatttttccctgaagaagatgctcaccgggaagctcatggaaacgaccttgtctcccggcttgaagccgctcacgccgccgccgagctccaccacctcgccggatagatcaccaactgttcgaccatggcaagagttcatggattagtctgaactttaaaagtggcatctgttaacagttgctcagtaatcagtatgcatctcgttcaacattttcaatagcttcttctacaaaatcaatgagtagttagagtacttgatggtgatttacaggagtaaatatcaatgccattttgttcttgaggaaatactccatccgtttcttaataattgacattttttactttctcgttgaccattaactacctttaaattattagaccaaagtgaacataagttactacacgctacttcgagtatcttagccaactactactgccgcgttgttgagcatccgaccatttcccaatcacgccgttttcgtgatgtaatgaactccgaaaagcaatcaaagggaaggaaaaggacgaaaatgtacatgaaaatgaagtgaaaggtagccgaatacgaaagggaagcgaggaagaataatgtcctcatttgcacgtacagatagcgatcgcattcttcttcttcttttttttgcagtcttaaacatacttgtatggacaaatcttcagatttattaaaaagaaataaatgtatcttacgattttctcatggaaaaaaagcattaggcgtcacccatctttagccaactgaagtactgaattagcaactctttcatactgttatacggaagaaaaggttgtggcttgatttcttgtgtagctgaacatgtatcagtcaaaaaaattcagaagaagagcatagattgttgacacctgacaggagtacttacatatcaaaattgccaggcaaaactgaaattcagttactactccctccgttttacaatgtaagtcattctagca

SEQ ID NO: 11864 - DNA, 21149 bp, Oryza sativa
tgctagaatgacttacattgtgaaacggaagaagtaattaagatgcagtacggtgagatacgcgactttcagccgtcaatttgttcaggtttgtatctgaatttctgaagccaatgtcctgcgactgggagaagacagatactggtactagtactatatctaacctggaatgaaggggaatttcttgggcaggaagaggcggagcatccccttctgaatcttccagtcgatggggttgatgctcgccgcctccatcttgatcagcaactccccttccttcggcgccgggatcggcacttccacatgctgaaaatttgaaaatccaccagcagcaatctcatcagaattcagaaacaaacacgcagcatatgttcagttcttgtgaactgtaattatcagttggtgatgctggttttttttaccttgaggccttctggtcctccgccgtacttatcgtactgcacagctctcatcgtctttggagcagcgtcggcagcggcagccatggctgagacggagagcacgcaacaccgagagagagagagagagagagaggagatggaaaagctggtgattttggtggtttgtgtggcgatgttgatgttgatatggttggtgtcgtggatggaagtgagccgcttctgtagcatagcaccggcaaatatcagcctcgcgacaacgaacccgcgctgtaaagtttgcctggttgattaccaatatattcctttcgttaaaaaaatactaacctggagtatataagataagatataacctagtataataaatctggatataaacatgatcaaattaaagttagtattttttggaacgagggaatatgcatctcgattgttcaccaccgtgggtgtccatttcgggttgctctgaaagcatgatagtatatggttccgagatgcatggattgtttgttatttgttcatgtcagactaaaaaatatataaataaagctgaatctgaaatcttgagtgcagcaggagattgttgcggatcaatgcatcgatggagttctaaaaacagaacaaaaaaacaccaataacaccaatggacctccggcagttgtcagagcatcaccaacagtctatctattctatctccaatcctatttttttgggattttggttttaaaaaactgatccaacatattcccaaaagagctctggacgttttggagttaccatctccaattttctcggtacgtgtatttgagggcgagagaacgactcccaatcccctccttccacgcatttctcccctccttccgtgtttctcctctccttcccgcgtcggggcgatctccttcggcgcacgggaaaggaaaaaaattagaatttctgttggtagtttaatagaagggcccacttttagttttggggattgaatttaggctatctcttggaggaatgggttttttaaccacctattttcagtttaggaaacccaaaaattaaattttggggatagattattggtagactgttggtgatgctctaaagttcgctatcaccaaaatacttcctccttccctaaatgtttgacgccgttgacttttttaaacatgtttgaccgtttgtcttattcaaaaaatttaagcaattattaattcttttcctatcatttgattcattgttaaatgtactactattactcaagtttttgaataatattcacaaaaatttttgaatgagacgaacggtcaaacatgtttaaaaaaatcaatggcgtcaaacatttagggaatgagggagtaaatgaacaagccacttttcaagtgtcattttaaaatatataatttcctgatagtagggtcgcatggtcacaggtatgcgttcccaaggagtacggtggactcggtgtccctgacttagagaggatgggaattgctctaagggcgcgttggacctggttgcagcgagtttcaccagagaaaccttggctgggtctcaacatcccgtcctcgccgaaggagcgaagcttcgtcgccgcctccattttgtgctctgtggggaacggcgtgaaggccttgttctgggaggatagttggctgcagggagaatccatccgctgcaaggcgccggctctctatgctattatcccggctcgcattcgcaaaataagaatggtcacataagctctgtctgataggcggtggatcaaggacatctccggtgcccttggtattcaagccattcttgagtatttatcctagtggcaagacattcgtgcagtgcacctcatggaccagcccgatgtgctttcttggagatgggagggtcgggcgattactcttcccgatcggcttatcaagcgttgttcctagggagaacctggttccagtctgccccgatctggaaatctctcactccacctcgatgccggtacttcgtctggttagtggtgcttaacaggtgctggacgggtgatcgattgaggaggcgcgggctgccacaccccgatcgatgtgtcctctgcgatcaatgcgatgaaatcatcgattatctcctggtcgcttgcccagagtcccgccaactgtggtggatggcactgagggccattggacaaacaagttctctgccgatgaacgaagtctccttccacctctggctttgcgatagccgaaagagattgaccaaggcagctcggcatggtttcgacaccatcgcaactctcattgcctggacgatctggaaagagaggaataacagggttttcaatcagcagcaaaagacttgggcggaagtggcaagggcaatggccgccgaggcggaactctagagacttgcgcgagcagccattccggagttcttgccacagccaattgtcgagaggtcgcaacatcggttaggagaatagatctttttgggcaattgtattcctgcatcccgtccccttcacttcttgtattttctgtaattaaacttttttccatccttaatacaaagatgcgctctttgcgtattccattttttaatttcctgataaacttgtgaaacaaaggtgttctacaataaatcgtgggcaacagtgatcacatgattgaaacattaggttcaatctttcggaggtactcgtaaagatagagtgtgcgtgtgtgtttataggagtgagtgcacgcgtgtcatgaacgtttacgtttgtaccgtgtttctttaaaaaacattattttcatacaataacagttaaccgtgcgctgccactgaacatactgttccaacatccaacggtatctccctgcgtcgtgctcattcttcttctccgattttgacgacgaccttgccggtggcgtcgctcagcgggtggcacgagtcgacggcgggcttgagcttcccctgcctcgccatggccaccaggagctccatgtccgccttgctcggcgagaacatgaacggcgtcagcctcttcttggagaaggtcaccctgtgcagcagcgcggtggccaaggccgcgggggaaggcgtgatgtcgacgacgacgccgccggtgtcgccttcggcgaggacgcggtcgaacacctgccaggggaggtgcggcgcgcagtgcaccacggcgtcgtacctcctgcccgacgggctccggagcgcggcgccgtccggggtggcgtagtcgagcgcctcgtcggcgccgagctcgccggcgacgagggcgaggttgcgcgcgccgcaggtggccgtgacgcggtggccgcccagcctggcgagctgcaccgcgaagtggccgacgccgccggacgccgtggtgaccaggacgttcttgggcggcggcacgtcgtccaggccgggccccgcggccctcagcgcctgcagcgcggtcaccgccgcgagcggcaggcacgcgccctccgccgcggacacctccggcggccgctccaccgtgagcgacgcctgcgccaccgcgtactcggcgaagccgccgccactctgctcggataaatcacactcaaaaactgaactcaactcgatcgatcaaaagaagagaaaaaaaagagaaagaaatcaaacttctatcgtaccgggaaattgatggcgatgaccttgtcgccgagctcgaacctgcgcacgccgccgccgaccgccgcgacttttccggcgagatcgcacgctgctcgaccacgtatacacattagcgatcactagctcctgttattcttttagcttgctagctagtgcatcctactatataaaaaaaaaacaaatcctagctacgaatatagacacgcatatgtccaaattcatagctgttcttgaatcttaaaattttacttgctagctagtgcatactgcatactactatatatattaaaaaaagcaaatcctagctataaatctagacataactgttcttgaatcttgaaatcttaattgctagtacctggaattgatgggaacttccatggcaggaatggccggagcatccccttctgaatcttccagtcgatggggttgatgctcgccgcctccatcttgatcagcacctcgcctttcttcggcgacgggatcggcacctccacatgctgaacacaaacacatcagaaaaccagagaagcagaagctaagctgggagtgggagtgaaactcgcaggcgtatgtaaccttgagcccttcggctccgccgccgtagccgtcgtactggacggcgcgcatcgtcgtcgcggagggaggaggagacggcgtcgtggccatggccgccgacgcgcgcggtgtgtgcgtttggtgcgccaatgtcggcctctgcgtctggatatgtacgcacgacggcgtccgacccgtggtggtggtggtggacgactggacgtgcaccgtccacgtcggaatctaaatagcatgtgcaccggagagggattgatgaacaatccactcgtttattgtaagttgaccaaaattaataagatgattaatacgaaatatagcgttccacagacagacaggttgaaaattcaacttgtataaattgcgagaatgctcaacgtcgggcgcgcgggggaggggaaaaaaatcggtcgctcccccctccccccatcacgtgcccacctggtcccaccacatatcccgtgtccccacctgtcacttatccatataaaacaaatcacctacatattttggaaaccatctattaaggaaatttggtttgttttttttcataaaaaaatgtttcacctagtgtattcgtactgtttcactatatataaacccaatgttgcagtgaagtgaaatattgcattgcaacaaaaaaacccacatatttttaaaaccccatattaagagaattcgttttattttttttccaccgaaaaatgtttcacctagtgtacttataatattttactatgtatggatcaaatgttgcagtgaactgaaatattctttcgctatttactggaacattgtttttatataagataaaacaacacccgatttaaacgagtgaaacattttcgatctacttagtgaaacaattccgatatatatagcggaacattgtgcaacattttaaaataattcaataataagcttaaaaaaattcgtcggaatatatccatgtgtggtcttgttttgaatatttaattgcaacgaatttaatggtgcaatcggatcatgatttggataagtaatttaagagaaaaatcagtttaaagtagttttgcacgtaaatcgggtgttgacggtagcgcccgatttttctccaaaccgatcgggcgcctgactcgtagactcatcctataaattatgacaaaattaacttaaaatatatgtatattagtacaagttgaatttaaaagttgcatgtttgtgtactaatttattacacactaaggacacataagagaaaacgagttgagggttgaaaactcacaaaaatcaaatctaaagtttaaactcaactttatttgaatagtaacgtgacactatttacctgaattttgtttttttctctcaaatgaagttgagtttggtgagaatttattttacatctacatttatctatattattttaaatgaacttacaaaacatattttttatgaattttcaaaacttttagacatgattttcacatttctaacacttgatatttctccttacacattaacctatcctgtccgttttttttttactatttagttgacatgaataatcgaatagatatctacccagatgattaaaagagttccgtgcacgttgacatacatttttcttgcaatgacttttactgaataatttaccgacggttggagagtttagattgggttcacctcatgtaaaattaggagtaaatttctcgaagatatttacgctgtgttaagatgcattcgtgaaaatttctacagtgtcacattggatatacggacacagtctaataacaaaacaaattacataattcgtcagtaaaccgcgagatgaatttattaaacctagttaatccattgttagcaaatatttaatgtagcacaatattatcaaataatggaacaatcaggcttaaaagattcgtattgtcgcaatttgtgcaattagttttttagcctatatttaatacttcattcaagcgttcgatatgacagggtgaaaaattttagtgtgagatctaaacatggccttaatttatcgtcataattaaatgaatataatccgtagtaataatcggcccaacaatccaaatgaagtaaaaaggagcccttcccaaggaaacaaaagcaatgataatcccctgggccatcctggactcctgatgttcggcgccaacacgatctcctcctcctccctcctcgtcgcaggatttgccaataaatagcaagagagatcgatagattagatcgaagtagaacagcggagaaggagagtaggagcgacggcgaccgcgcggagttgattcgattccgggtgtcgccgccgccggccatggggataacgctcgagatgaaccgggtcatgcccacccggcggaggcggcagcgccgtcgccgccggcgaaaccgacaccgctgtaagctaagctccctcggcctcctcctccggcttatataacttgttcagattgttcttttgcaacaaagcggccatgcccgtgatggtgtttctatccgggctagtatgtttctttgtaggatttctttaaaaaaaaacctgttttcttttcatcagggggttaaacctagtgcattggttggtaacaagattaagtgttcctcattgtttttgtttgagtaggctaggtatccaaactggcgtctttctgaacaaattttaatctacaatttattttctcatgattggggggggggggggattgtatgagatggactccctcccgtcccataaaaaccgaatctagatgggatgtgatatattctatatgtccagattcatagtaataaaatgtgtcatatccaataggattggttttttatgagacggagatagtttttttttttataacaacatgagatagttgattcgttggtgaaagagtgatgcagcctatcatagcatggggcacttaactgaacatggcaaccagagctgaaacttgtgacttgggtttaccgaattgtgagggtgaggagaggagtggggaatttagggattgggaaagaaggatgtgatttttcactgattcgtctgctccaatgtattgctgttcagttggatactttggagtgcaggagatacacactttggggagactgcggtatttacaaaattttgcgcctgcgcactatgaattgttcttttctcttagattgctacaagttggaaactcaattggcattcaaaagctggataacagaagaaaattttgatttccctgtgcttgtttgtgtgcttcgatttgtccgcttccttctgttattgtttgaattaactataaccatgcatgatgtgcttgcagatagatcaattgctaaattgggtaaaaggaaattctcaccctcccaacaagatgatgattctcagggtgctaaaagaatgaaaaattcagggatgttgctttcaaaggtatgacatagaaaatgaatgatttacatttcaagggaatatcactatgactgctccaacacagattagtacacccgttacgcttgtttcattggtatgccatggtctaggtccactatttgctgtttattcttaccagaatcctctagatgcaagttgttcttagcctattccacatcgagcacattccatcttcattctactaaagaaagaacttttccccccaaaagcaagactcatatactatttacctacgaaggatatttacttgaattcgtcggaaattttcatactaatgtgcatttcattcttatatttcactcatgctacaatttttaggacaccatgccagaaggcctgcctaaattatatttcaacgaattacactgttagagcgaaacaattatatcgaatgcttaatttaggcaccacaattacattctaatgctcaatatgcctatgtcatgcagtgtacttgtgcaatcatgagtgaatacctggggtagagatagaatgataccccatatggttttgttctgctttttcacccaatcaaagtttatcacaatcacaatatccaaactttatcccatgatggtgtgtgcaggacatctggcgccgtatacattgcctgatgccaatgcgagatgcggctcgtgttgcatgtgtgtctcgtgcctttctaaattcctggttatgttatccaaacctcacctttaacaaggatacgctgggattggatgaacatgtttgtgagacagatttcatcagcaaagttgaccacattcttaaaagacactcgggcacttgtgtgaagacattcaagcttgaagtcccgtatgagctagatgtctgtgaccatgttgatcgttggcttcaatttgctattacaccagcgatcgaagaactcactcttacgctgtatggaactgctcaaaagtacaatttcccatgctcacttctatctgatgggatggcagattctattcggattcttgatcttggccattgcgccttctgtcccacaatcgaacctggttcatggagaagccttaaaaggctatgtttgtcttttgtgcgtatcacggaggatgatttagggtgccttcttttgaattcgttggctctcgaggggatggaactcaggcattgcgatgagatagttagcctgaagataccttgcacactgcagcagctcagctatattacggtttcagaatgcagcagggtgcgagttatagagaacaaagctccaaatgtatccagtttttactttactggaaacaaggtaaaactttcacttggagagtggttgcaagtgaagaaactaaatatgcgcagctcacgcattgtccgttatgcccgtgccactcttccatccatgatgccaaatgttgaaactctttccataggttcgctccgtgaggtatacaccaacactttagatgattatatagactagtttgttatccatattatagtactcataccttggagtttggttaatctgagacatctttatgcaggtgttcaacacaccaatgctacctaccaaattcccctacctgaagtacttgagtatttctctcattggattgaccaattcgccagcttatgattatctctctctagtttcctttcttgctgcttctcctttattggagactttcttcttggctgtaagatgctattcacttttcatttcatcctgcaaaactatctactttggtgaaagcactaattcaagtatattattacttttcatcttcagatatctcagcaacaagcagaacaggaatcgatatttggaagttcctcacttatgaggcagattccggagcaccgatatgagtacctcaagagtgtgacgatcaacggtttctgctccgcgaagagcatggttgagctaacatgtcatattcttgagaacgcagcatctcttgagcaccttactctgaacacgaaccttggcttggctaatcgttctgaacagagtcctggtattctcaaggaagtgcctaaagctctctcggctatccagaaatacatcgcagggaaagttccctctactgttagattaagtgttctggatgctagtgaatgaaacgctatagggcatcaattatcattttgtgaaccacgcgtccacgctcattttgtgcaactttttgatgaaccacgctctgtttactaaattattggggtcgttaaaagtttagttggagtatgctttcttggttacaatctttgtaagacttttgtggtgttcttataatatataaaatataactggtgggcgaatgcctgtcagttttcctggtcaaaaaaaaggtgagtgtttagttcttcagtaatttatcagcaacaaagcgggctgctaatagtgggtaactgtgctgtaaagttgtactgtaaaatatagattttgaatgacctggagttcggttggatgtgttgtgactacaatacttgtatgggtaaatttggctaaaatgttaaatgttgctcacttttgtacttccatttgataatgctgtgatctactgattgggtaacacggatgtgcagtaaggatttacaaattgcccattcatgaaaattagatttacataatgccaacaagaagcaacatgaacagtataacagatttaggacaaatgtggtaacttgtaatgtgcatgtatccaacaaaaatactaccacaaggccagaaacacaaatctgattccctgttagttcccccgcgaagctcccagttatacgatgattgagtggatttcacttgttagtcggtgtaagtttagttaaagacgtcacgttagtgtccgtgtgacatgccacatcgaatttcagaccaactaggataaccacataaaaccacaaaccaacaaggatctaaaaatataaccatatgcacaaggaacacaccatgcattttgtttttatatttttttaaatcctgcagggtgtatttgtattaaaggagaaggaaacactgtacaatagccttagtgcctaggaggttgcatcaagaaaggaaaaaaagaaagcgggtgaggcatgatgcagcttaaaaaaaaagagacgtgtgggtcttgtgactaggctaattacgtattgtcggttgcgctttcataattgtttggcattaggcattgaatgccctttgccctgcctgcatgccataaccaaatctcatcggtcactctatcaatgatttcgtgcggcagtgtctctatgtaactatgttccttaaaacctctctatttctctctttccaaatttcccaagagagtaggatgaggctcgatttgatgccctttcttttctccttagccatcgcacgaacggtttaagtccaccagttctcgagtagtgtcgtgtgaggccaattttgcggctgtagccgagggatgtctagccttgtcgatatggctttttttatttataaataaactaacaagtactggcagtatttactaccatgacaaccatgaattttttcttcttacaagagagagagggcttcgtgctatcgacatgttggcaaagagacggggtactttatattgatgtcctaatcgattgcccatattttctattaagataaaacagtttattaccataagaattaatttataggtaaaacttaaaaaatacatgaaaataccttaaaatcaactttaaaattaaaatttaaattttaacctttgttttgatttattaagacagccacatgggaggggactctgagaagataagaggaaaaaccgaaaaagaccagtattttcctggtcgagttgggtttcgtcacgctccgcttccccgacggcgcggcgccaacacgagatctccttctgctccgccccccgcgattcttcgggtgcgcgctctcgattcccttgcctcgatcgtcgcgcggcgccccgccatgggcatgctcctgctgagccggctcatgcccacccggcggccgcgccgtcgccggccacacaaatcccgccgcagtaagcgcttctaattgccctctcagttgttcccctcaaccctgaaactcattagcattataacgcaaaagtttggttaatggagacagatcgattggatttctctatgctcgtttgtgtgcttcgattttttatttttatttttgtttttattttcttctgttaatgcctgaatttatctgtaaccgcgcaggcggattgattgctaaatcggctaaaaggaagcgctcacactgccagcaagatgatgatgattctcagggtggtaaaaggatgagaaattcggtgccaacccttccagaggtatggcatgtaatgttgatataatcgaatagttatactgaaagtaaataccactatcactactctaacacagattggtacacctgctgtgcctaaagaacaaaagttatgaacagatgagcaaaactttcagtgctatatttacattatcaattatagtcttactgcattagtagctttgttttcttctagatatcgtggctttcgctctcgagctgcaatttgagtccttgataatatggaacaattttggagtaaacttcctagatctatctccctaattagcagtagctagagcatatcccttatttactcaaattcctcagaacttagagcttttcaaattaatatgtacagagggccttgctaatgtttttcagaaatctacagagggcaaatactacttaactaaattatattccaactaacaacactgtcaataaaagataactctatgcaatgtttcatttgcgtgccattgcattctaatgcatgcatagtacgcatatgtaatttagtgcacattgtgcaatcttgcacatagcacctgggttgaaaaagaatgatgccccatatggttctattttcccctctaatcaaataacccaatccattgaaactctatttttccccctctaatcaaataacccaatccattgaaactcacattgcaatgttgaaattttatcccatgatgcaggacatctggtgtcatatacattccctgatgccaatgcgagatgctgctcgtgttgcatgtgtgtctcgtgcctttcttagttcctggagatgtcatcccaacctcacctttaacgagcgtacactgggattagatgaatatgtttttgaaacagatttcatcagcaaagttgaccacattcttgaaaaacactctggcattggagtgaagacattcaaccttcaagtcccctatgagctagatgtgtgtgatcatgtcgatcattggcttcagtttgctattacaccacggattgaagaactcaatcttatgctgtatggaaccgtgcaagagtacaacttcccatgctcacttctatctgatgggattgcaaattatattcggtttcttgatcttggccattgcgccttccgtcccacagtcgagcttggttcatggagaagccttaaaaggctatgtttgtcttttgtgcatatcaccggggatgagttagggtgtgttctttctaatttgtttgctctggagtggttggaactcatatattgtgataagatagctagcctgaagataccttgcacactgcagcagctcagctaccttaaggtttcagaatgcagcaggatgcgagttatagagagcaaagctccaaaagtatccaatttttacttcactggatacaaggtaaaactttcacttggagaatggttgcgagtgaaggaactatgtatgctcagttcacaccttgtctgttatgcctgtgccaatcttccatccatgatgtcaaatcttgaaactctttctatatgttcactcgatgaggtattacacaccaacagtttagatgattatatagactattgttatgcatattatagtattcatgcattggactttgattaatccgatacatctttatgcaggtggtcaacacaccaatgctaactaccaaattcctctacctgaagtacttgagtatttctctctctggattgactgtttcgccgtcttatgattatttttctctggtttcctttcttgatgcttctcctttcttggagactttcttcttggctgtaagattccgttcactgttcatttcatcctgtaaaactatctagtgactatggcaaaagcatcaattgatgtatattatttttctcatctctagatatctaaggaacaaatgaagcgtgaatcgaaattcagagattcctcacatatgaggcagattcaagaacaccgtcatgagcacctcaaaagcgtgacgattattggtttctgctccgcgaagagcttggttgagctaacatgtcatatcctcgagaacgcagtatcacttgagtgccttacactgaacacaacccttggctttgctagccgttctgaacacagtcctggtacatgctttccaatgggcaaggctgttctcatgggagtacctaaggctctctcagctatccagacatacattgtggggaaagttccctccacagttagattaaatgttatggaaccatgcaacctgtgcaatggtattgggcattaggtgttatccgaattgtccattgtgtaactcttctgatgaaccattctctgtttcctaaattatcagactcgttaaatgctaaattgtgtagttatcaacacgagtggtttgttctccagtaatttttcagtaacagagtggtctgctaatagggtgtattgctaaactgctaaagtgtgcgctgtaagttgttagtaaaaatatagagttatcctgaaggttggatgtgttgtgttgtgcctacaaaattagtatgggtaaatttggctgaatttttttcgtgaatacgcaaggagtgcatttttgtattaaggagtaaaaagtctatacaacagaacctaagagcagcaggggacaggagaactggacacgggggaactaaagcctaatctcaggggacaggagaactggacacgggggaactaaagcctaatctcagggtgcgacctaagagctcctagctactagaggcgaatcgtcggtacagcagcgttggctaaccgccacaacgccgcctcattagccattcctctggccacctgcacccaacttctttgttgctggttgaagactcggttgttttgttctttccaaatagaccatgtcgcaagtgctacgatggtgtcaaagccacgccgaaggggttttgcaatctgctccctgctgtcgcacaaccaaacgtggaaagagtcttcattaatgggcaagcattcaggatgccctatggctgagagaagcatccacaagagttggcacgattcggggcaaccgaccaagatatgatcaatactttcctcttgttgatcgcagagaacgcaaaggtttggatgaggaaaacctttgggtcacagtctatcaaccgtccagcaacgcttgaggcgaccaaccagaggaaatattgacaacgcaagcgacctccagattagcaccgactgaaataggatccgaccgagaaacagggcttgataggctgaactagaggagtaaacaccggagctctcccacttccgaacgaaacgatctggccgatcctcaagctggaacgactgcaccctcgaccaaagaaggaggtagtctaggatggggagtcctactcggcgcgtgtgcgccaagggcgcacacgacccccctccttttccacgctaaggcagttagtaatctattagtataattacatttagagataaatgacggtagtagttagaattttttttgtgagatttttttcaattaacaaattcaaaatgaaatttatatctaaagtcaaattttcaaaattttaaacccatatttgaaaactttcaactcgaaatttgaattttttaagtcaaattatgaaaactttcaacttttcatgttaaatctgaaaaactttcaactcaactttgaaaacttttaacccagatttgaaaactttcaactcgagatttgaaaactttcaacccagatttaaaaacttttaactcgagatttgaaaactttcaactcagattttgaaaactttcaacctagatttgaaaactttcaactcgagatttaaaaactttcaactcaaaatttaaatttgagagaaaaattttggaaactttcaactcagattcgaaaactttcaactcgagatttgaaattttcaaatccagatttgaaaattttcaagtcaagatttaaaaactttcaaatcaataacatttgaaaaaacacgtgtgctaaagatttaaaaaagtaatctgaaaaaaactgcaaaaaaggaaaaaaaacgcgaaaaagaaaacggaaaaaccggcatgaaggaggggaaaagaaaaaaggtgaaaaaaagggaaaaaccggcgtgtggggaggtgacagctggcgcgtgcgcgaattagcaaatccggtctaggatagcctgtgtcctcagggcaccctggatatcatggatccatcttctgttgagcagaccttccaccaccattctgcggcaccagacgcgcactggaacacagtcatacaaagccaacgcaagcgagcgaatgcacgagccatccagccagcgatcttcccaaaaccaaatcaaatccccattgcccacctgacaggaaatcgaggctgcaacaaagataagttccttctgtcaactcgggatggacagaccttgccaaggtttatcctcagcagtgcgctgcgaccagatcccacgagagcgaagagccactcccatgagttccaagttagcacacccaggctgccataatcagttggggagcaaaccttggcccaggtgaccctgcaatgtccacctcgaggggaggccctgcccccccaaaggaagccatgtcaaaatttgtcgatccctttgatcacccattttggaggatcaatggtgatgagaaagtagatgtgaattgagctcagtaccgatttaaccatggtaatgtgcccaatcggtgccatctgttcagcctttcaaagaggtaagcggttggccactttgtcgacaaggggttggagatctttcctttcttagctcgaagatggatagaggcagccccaaatatttgcacgggaacaaagcaacaggacaaggaagttccctcaccaccgaactgagaatttcctcggagcattgaatcggcagagcagtgcatttggcaaaggttgcctttaggctagaggcttccccgaaggtgttcaagatctcgccttgatctcttccactgaaggttggataaaagcgaccacatttggctgaaatgttagatgttgctaccgatgtgggtcttgctccgttgcattttttgtacttactacatctgataatgctgcaatcttctcattgggtggtacaatgaagattgctaaaaagaccctccatttttggctgcaatctatttgcaactgctgcctttactatttcaatatgactgactaataattgatcgaaatctatcaggactgtcaatgcattactgatcactgataatatatatgtggtccttcaacctcggggtttagagggccttgggaggcgaggcggcggggacgctaccggagccgtgggaatggaagctcagcgatggcgaatatgacggcagaagagagagggggagacgtatctcacctacgccattgacggcttttttttagccgggccaaaggttggacccaaggaaggacttggagtcaatggttttaagaaggaagaggtaaatatttcccctggtgagcgcgctcgacaagggtcgaacccgggccagcggggtgcatgccagcgacccctgccactgcgctactagcgcatctcgttgacggctttcggccggccaccgaggccgagcgtggtgcagggcggcgccggcgagcattcgtgcggttgtgcgtggggaggtgtaatggcaatctcgaggccatactggccgtctaaaaaattgacttgagttttttttttctgccacgagaattagacccttcgaacaatgataaataattcaacgaaaacaggttaagatgttaccattctttaaactgcagttacgagtcgatgttatgctatcattcaacgaaaacaagtttgtatttgatatactcctttttttcattagctaaacgagcaaatcttacagaagtactgcaaggaaatgaatacagtaaaatccagtgatgtgatgttgcaacaatatattaccatcaatttctatcgcaagtggagtttaattaggcagctagctaacatctcaggtattaaccaaagatttatttgtggacgaagacactaacttatgaaaaaaaaaacacaaactggaactacaatactcccaaatgccaatcagaactaacattagagtcatcagaacttgtcctactctagcttcagtcacaaccttgagatcttcttcaaataaatacgatgtgcgaagaacatagcacttcaaaacctcaccaaggaaaaaaaaacatagcacttcaaaaagggaatttagtagattcttgtccagacaatttttttttatgaaattgtcaaaccaacttcatttcaagatttacaaactgccggcagcaagcaatggagaacagtataatagatttgggacaaatgtggacatgtggtaatttgtaatgtgcatgcatccaacaaaaatactgccaaaggttagaagcataactgagtccctgcacagatcaccagcaaacgccccaatttacttttgcaacttcacaatgaaaacaaattttgagccacttactcatagcaaagggcattgatctgcaattaaaggatgatgagcctaaaccatggaaacagctagatcaacaaacatattcttaaaccacacaattgcccttaaatgttacagtaatacagctacagacactgctgcgttaattaactttcaacaggattcacattttgataaataaaaccaactgctacaagtaaagtttctgggttaattagcagttattcataagggtaggaatggacacacttccatcaaaatcattaaccgagtatgacaacttttggatgcaagcagagtgctaactgctaagaagttgtaatcagggcgtgatgttttcataggagaaaacatatcctccattgctggagtacaaaactggattaccttccaaacttttcccataagacataacaaaaacccatgaacccttcccaacagatcattatttaacgaaccccagcagattagtatttagcatgacaagaaaatggaattcagtagctgcgaatggggcacacaagaacaagctggtccaatggcgtattcactgatcctaattaagaggcacaacctgggggtcaaagctactacaacaatgcactaccactaacaaccatatatgctccaatgcatctacacctttcagtcagtattggtcacaagtgagacaatgcttatcacaattaccaattttcagtatagtatggaactatcaatcagaagttgacaagcttatgtgatctccccatagcaataggatacaatgtagtgaatcatatgaagccaatgctgattattgcttgtgcaactaaaaatgcagaaaaaaaaaggtaaaagctatctactgctgttcgattagacatctgtacgattccacgggggcggcaattgcagtgttattgttcaacatcaggtcaggggcgatggggatcagggtgacgtactcaatcctcgtcgatgaggcgatcaccggccgcggcgtgatctcgcgaggtgatcaggcgggggcgcgcgcgcgaggtcgatgcggtgagtcctcatggtggcgatgcgggagggaacggtggcctgcaggtttttgaggagccaaccatcgccgcgggttcccttgaagacatggctgacatgtcgccggagaaccagcgctagcgccttcgacttgcggcgcgcgtagcctccgatgaggcggccgacgcggtggatgctctgggcgcagcggcgaagctcccggttggcgtctgggtcgcggaggtcgttgaggaggagcgggatgacaccctcgctcacgacggcgaggagggcgtcgagcttggacaggttctccacgaggcggaggccgacgatcttacacccatggtcggacgacgcggactcgagaaggtgaaggagcgcgggcgcgtgcttgagctcgcgaacggcgagcaccttcaccgcgtgcgggtgcggctcgacattgctgaagaagacgggctcgaagtccgcgaaggtggagaccgcgacggagaggacggaggcagaggtggtcggcatgggggagcgtcatccggagtctggatcttcgtcgcgacgctgggggcgcgcgcgggcgcgaccgcgagcgaggcggcggcgctcatctccatcgcgactgcggcgacagaggaggtcttcgtggcgatgctggaggcgtgcgcaggcgcgtcggcgacggaggaggaggaggcgcgcgcgggcgagacgacggcgcgcgaggtctcggcctccccgagagaggcggcgccgctcttcttcttcatcgcgtcgaggtgtgggaatggcggagaggacgcggtggtgagacgcgacgcgagtggatgacgtggctatgggtgggcgttgcgagccggcattttatagccggtagggagccgtgctggagaagaaattctggaaaggagaaatcaaaatttgaatttcgcaaggggatcacgagaatattgagcagttggcccaagtgagcggttacagctaggcctcagcccaaccgtgctgggcaagaatgtctccagtggcccattttggggcaaaaaattgagtaaattgcgttctgggccacattttattatctaagtttcactttggccacctttaaaccttctatctttacaatttaaaataggtaaatttgcagtttggatcacccccaaacgattttttcagtacacatcaatgaccttaaacacatcggctctggtatacgggttaactcatccatgcatggtcgatatatttgccaaaaagaaagttagatatggcgagaaaagatgttcagggtaatccaaaccataacaatgctaaatttacccgatccatattgaaaagataggtttaaaggtggtccaaag

SEQ ID NO: 11865 - DNA, 33291 bp, Oryza sativa
  unsure (1)..(33291): unsure at all n locations
ggtatcttccttctcgtctcgcctctccagccgggacggcgccggcctccgccgcgccgcattcttcctcctccggcggcggcgcagaccgaagccgagatcgcgcgcgggtggatgccctggatctctaccccctccccgacctcgcgcctcgatcttcgtaggtaggagaggggcagggaggagagaggtgggccgcctcggggtgctctcgatttcctcggctcgatcccgcgtatgccgccatggccctgctcgcgctgaaccggctcatctccatccggcgggagcgccgtcgccggcgaaacaaagcccgcagtaagcgctttcccctcggcctctctgcacttcatctctccggtgcgttgtgtgtgatgtgctgctcggactttttttgggagattgcggccagtatttttccagaatggaaaattggattggtttggtgaattgtttctctaaaattggaagaatttggtttggtgaattcatcagcattctcgcgcaaaagttggataaggaaacattttggatttctatatgactcgtttgtgaggttgaatctgttgttctcttctgttaatgtctgaaattatctattacaatgcatgatatgcagaaggaggatcaattactaaatcggtgagaaggaagtactcaccctgccaacaagatgattcccagggtggtaaaatgatgacaaattcaggggtaactcttccagaggtactgcactgcatacactgttttttttaaaaaaaaaaatctatgaattaattggaacatttcaaaatactactatgcattccattcttaagtatgtgcccttgctagtgtccttttaagactctaaagaggaccagagacctacctaaactatattaaactaccaacactgttaaaggaaaacagctctacgcaatgcttaatttatgcgccattctaatgcacaacatgcctatctaatgcaacgcaccttgagaaatcatgtgcagtactcctggggttgaaaaaaaatgatacgccatatggttctattcatgtttctctctaatcaaagtagccatttaggtttataattgcaatgttgaaatgttatcccatgatggtgtctgcaggacatctggagttatatactttccctgatgccaatgcgagatgctgcccgtgctgcatgtttgtttcgtgccttcctacgatcctggagatgtcatcccaacctcacctttaacgaagatgcactaggattgaatgataatgcttgtgaaacagatttcaccagcaaagttgaccacatccttaaaaaccactcgggcattggtgtgaagagattcaagctttcaatccactgcaagttagataactgtgattatgtcgatagttggcttcagtttgccattacaccagggattgaagaaatcacagttatgctgtctggaaacaagccacagttcaacttcccatgctcacttttctctgacaagattgcatactcaattcggtgtcttgagcttggcaattgtgcctttcatcccacaattgaacttggcccattaagaaacctcaaaaggctgcatctgtcttgtgttcgtatttcaggggatgagttagcatgcctcctttccaactcgtttgttttggagcagttggaactcaagtactgcaaaaagatagtcagccttaagatgccttgtgtgctgcagcggcttaactgcctgaacgttttggaatgcaagagggttcaggtgatagagagcaaagcccctaacctctccagtttttcctttagtggaaacaaggtaaaactctcacttgtggaatcatcgcaagtgaagaatctatacatgtgcagttcaaacatcatatgttatgctcgttcagatcttccatccattgtgccaaatgttgaaactcttgccgtagcttcacactgcgaggtataaactaaactttcattattatagactatgcaaaatgtacagtatatacattggttatacctttgagtgactattctgagatatctttatgcagatggtcgacacaccaatgctaccaaccaaacttctgtacctcaagcatctgactatttctctttttgcatggaccttttctcgagcctatgactatttttctctggtttcattttttgatgcttctcctttgttggaggtattcgtcttggatgtaaggctctgtgcaacgttcccttcatccacaaaaatatatgttaccacggtagaagtactgattcaagtatatgtcttttttcatcttcacatatatcaggaaagcatggagcatgaatcaatctttgagagttcctcacatctaagacagatgccagaatatcaccatgaacacctcaagtccgtgacgatcagcggcttctgctccgcgaagagcttggtcgagctaacatgccatattgtttagaacacaacgtcacttgagcgccttgaattggacaccactcatggcaatgctaggtgttctgaagacagttctgatgaatgctttcctgtgagccaaggtgttctcacagaatcccctagagcagtcttggctatcagaggatacatcgaggggaaaattcccaccaatgtgaagttaaatgtgttggaaccatgcagccggtgccatgctggtggtggttaggtattatctaatcctaattactagccattgtgtaactttttgatgaaccataaccatttgttttctaagttatcacagtagttattaaatgtttgactctctgtagtcagtagcacaaaccaagtttatctaaggccctgtttagatcacctgacagaacttttcaccctttcacatcgaatatttggatacatatatggaatattaaatataaacgaaaaaataactaattacacagatcgcgtataaattgcgagacatcttttaagcctaattgccccatgatttgacaatgtggtgctacagtaaacatttgctaatgacggattaattaggcttaataaattcgtcttacagttacaggcggaatctgtaatttgttttattattagtctacgtttaatatttcaaatgtgtgtccgtatatccgatataacacgccaaaactttacaccaatagatctaaacacgccctaagtgctagtcagtagtgatcaccatagaccaagtacgagtatttgaatgacattggttgcatcggttgataagccatagaaaaataaacaagacaatggtgaacaataattagggtggggtctttatattttattcttagctgtttaaaagccaaaggttaaagaaaacaaataataccaaatttagtttgaaaacttaaattttgatgattgtggcttataagctaacaaacaaacaaacgatgagagtcaataaaagactcaagcagtacatctatacatgcacagttgcacgctacaaaatcgtatcttattctgttcttccaggccacaaatccgtcgagctcacactcactgttcgtctcccatctcgacgatgatcttgccggtggcgtgccccgccatgctcctggcccagccctcctccgccctgctcagcgggtgcctcgactcgatcaccgccctgagcttcccttccgccaccatgccggcgacgagctccatgtcctccttcgtcggcgacacgaacagcggcaccagcctcttcctggagaaggtcaccctctgccgcagcgccgtggcgaaggccgcggcgcccggcgtgaggtcgacgaccacgccggcgtcggcgagcaccggcgcgaacgcggaccacgggagccccgccaccgccgcgcagtgcaccacggcgtcgtacctccgccccgaggggctccgcagcgccgcgccctccggggtggcgtagtcgagcaccttgtcggcgccgaggccgccgacgaggccggcgttgcgcgcgccgcaggtcgccgtgacgcggtgcccggcggcgctcgccagctgcaccgcgaagtggccgacgccgccggacgccgcggtgaccagcacgttcttcttggcgccgccgccgccgccgtcgccggcgtctaagctgacaccggcggtcctcagcgccacgagcgccgtgacggcggcgatcggcaggcacgcgcccacggccgcagacacctccggcggccgcggcgccgtccgcgacgcctgcgccaccgcgtactcggcgagcccgccgccgccctgccattacacggatcacagcaatattatcacgtcgaaatcaacacaaactaatctactctgccaaaactcatatcatataactaacaatcttacagggaaattgatggcgatgaccttgtcgccgaccttgaagctgctcacgccgcggcccagctccacgacctctccggcaagatcataaactgttcgaccatccatgaatgcatcagtgattaatcaacaattgaccatttcaattagcagttggtgtgctatgccaatgccatgcatgttttgatcttggattactactacctgggatgaaggggaacttgttgggcatgaacgggcgagcgacacctttctggaacttccagtcgacctggttgatgctgccggcctccatcttgatcagcacctcgcctttcttcggcgtcgggatcggtacctccacatgctgaagcagtagcacccacggtacaaaccaacacaatcagacataatcacatatgcttgatgcattgcttaatagctaaccatggacgttaattgaacgaatcattgtataccttgagtgcttgagctccaccgccgtacttgtcgtactgcacggcgcgcatcctccgagaagaagtggccatggcccttgcccagaggtgaaaccggttacagaaattcctaaccgactgagcctcgttttcgtacgaggggtaccgttctgcgactgagaagagggaatcgggggcaatttgcgacagtagctgccaggcgcggccgtacttatggcagcggcggatcgaactagtctaccatcgagagatagatggagagaggccatgggatcggatcgcattggcagtagcctttgtttgaccggcggcttggctcctcgccgaggcgaggcggcggcggacgtggccgcgctccgcaccgcacgccggtacactgcagtagtaaactagtagtagtactttactgcggcttaggcattgacgacaattcagtcgggccagtgtgtagacaactcaacatgaaaatttcaaaataggagaaagtccacgtaacccaacgacgggtcaagtttcgttcgttggcgtccctgaaccgtagaatcaggtaaaaattactttcaacaattcaacttctaaaaaggatacaaattaagtcactcgatactattaacagcggtttcggctagcacgacatctacatggcttgctgacttgattttaattccatgtgacgtttatgtgcacttacataacaatagaagcaaaaaaaatatcaatggaatccacatggtgcctcctcactctctcgcctcttatctcccttcacccatctcccctcccgtctttctccggaaatgcttcctattagacgtctgacgcaacaaacaaaaattagacgggcaaactactacctccctatccactccatacatccatacatattataatgatcttcaaaataattttttcttatgatttacttatccaatctgtgatatgatcacaccattatatttgttataattaaatctttataacaagatatcacatcattacattccaatgaaagaaaaatgtatgtttcagtccgttaagtttaatgtttcagacgcagtagcaatatgtttcaacgtgagttttcattgtgtttcatagaaaagttaaatgtttcaataactgatttttttttgtttcaccacgtataactcaatgcttcgcgctgaaaaaatatgagacacatatgcctccactctctctctcgtaccattttattgactttctccccacaccatacatgcatacaactatttagtaatcttaaaaagaatcttccaaactacttatttgatgagcgattcgatcacaccgttgaattcgttataattaaatctttataacaagatatcacgtgattatattctgatgaaagaaaaacatgtgtttcaaacaataaaaacgtaatgtttcatacgtgatagaaatatgtttcaccatatgactttattgtgtttcacagaatttttatatgttttagaggctggattttttgtttcaccatgtataacttaatgttgcaccaacggtcaactgaaacatttatccgtccgattttttttacaacatcggacgttcgatttgtagctctctgcatctctctctatctctctctctctcatgtggccaatgacattggaatgcgaaggtggtgcggcggcagcccgatatgctctttccatcggcaggcctcgttgggctcctcatctggctaaaccgcttggatcttccctgggaacctcgataaccctataattgaggaaagcgagaaaagggaacgagatggtgtggatgctgtaggcttggtgggaacgagaaagctcaaaattgctctcgatgccacggagagatttgatttgtactaattttaaaagttcgtggacgttctatagcctgttttatagttgagagatgcgaatgaaactcaagacacgtagttgaggacgtgaagtcgacctttccctctaaaatagtactccatccgtcctagaatatgtaaggtactttgatcgaatgggacacatcctagctgttcagatttgtagtattaagatgagtctcattcggtgaatgtaccttatattttaggatgaaagaagtatgaacgagttaacaacgcaaaatgggctttatttcattcggactttacaccatgggctcattccaaccataaagaaggaccggaaaaagtacattgaaggtccctcaacttgtcatcgagttacaaaatcgtccccaaccgtaaaaccagatatccggcgtcccttaactaatcaaaaccggtcacaattggtcttttggtggttttgacaccagttttgtcttacgtgacagctgagtcagcgtgggacccacatatcagaatgccacgtcatctctgtcctccctgttctcttctctcttgcctgctgagcgcgagcgcgaggctgtactggactgcaggcgagcagaggtgggggaagacgtcggcgccgcgggggaagcaaccgctcctggagcacctcgagggaggaggggagctcgacggcctcgagctcgccggcggggtcggaggagagcggcgcctccgtactccggcggcggcgcggccgccttcgaggagagcggcgcctccgtcgcccccatcgccgttgacctcgcccccatcgtcaagtccctccgcggcctcgacgtcgactgccaggacctcccccgcgccgggctgcggggcgtcgacggggcgatgtggaagaggaggaggacggcgccgcagtttttctcttgcaatcttttctctcagtttgatgtcatacgcagttggctctacatttagggattccttttttgtatgaagtgaaactatctgttccccgtttaccaggttcattccgagtgctctgatcatgaggtttcagttgaaactactaagagccagaagcatcatctcaagaaggtataggtacaatagagatttcgttcctaaaatctgtttgtatactattgttctgcggtttgaatgaagtaaatatgctcagcagtttgttgcagatcaagcataatgatgtgatggagcctggcatgagaattcaccttcctgtgtcagtggcagagggcgagattagagatgagattgagaaggcctgtcatccacaaggtaatcaatttagtgtattttttggagcttactgtttttaatttacatcattcagagtcataattgtatgcaaaattttgaaatttcaggattctgctatacttgtgcttaacaagcccacgaaagtgcccatgaagggaaatttgccagtacataacagcatggatgtgcttgcagcagcagctctgttatatggaaatgaagaaggttcaaaattggtgagctcaagagtctgttcatcataggtcagcatgtataaccataagcttgcactgaagatttttctcgatggattttgtgttttgaccacaggttcatcggcagcgggcgtccctcctcctcgctactgctgagcggggtagagaccggcgcgggggtggtggccggggacctcgccctgcgagtgacccccatcccggcgcacaagatggctccgctccagggcctgcgcggcgaccgtaacggcgaggagggcgacgacggctagaggagagaaaaggaagaaggagacctgaccagtgggcccagcctatttattattattatttttggatgaaactgccacgtaatcgccacgtagtatgaacacctagtcaaaggagccacgtaggcgccaagtcagccaaaaccggtaacaataccaccgagggatctattttgcaccagtttttgggttgagggatgattttgtaattcggtgacaagatggaggacctccggtgtacttttttccaagaaagaccatatgtcctcaaaacccttaacaggccggacaaacagaaggccaatcgatctcgcctacaagcccagcaacgttgccactcgcccccacgtagacgcgtgagacaacatccaccgacgcgtgatcaagtcgtcgcccttcctgctgtcgtgcgtgcgtgcgtcgtgcggcagcggaccgcgtcgatggcgcagtcgtcggtgtttggttgcggtgtccgtccgtgtgcagtgcagccaaaatgacgtgcgcgtcagggttcacaatttcagtggactgattcatcgaatacataaaccactcagatttttaggttagattaaaaaaattgaactgaattttaaaattttgatagaatttattcagattttattggtttttgtcggtttatcaatggattcagcgaaaatccaatgatacttatggtgagcggattttgatccgatatcagaattgtgaaccctatagccacgcacattctaaaggaggaaggatggatcaaaattgtgaaccctatagccacgcacactctaaaggaggaaggatgaggcgagggggtgatttggttcgacgagaaaaggcaggaggacgagggattgtgcgtttcttctcgctttcctctctttagctgcatcatgttattcctcctactagctactccctccgtccaataatataagggattttgaatttttatttgtattgtttgaccactcgtcttattcaaaaaatttgtgtaaatataaaaaacaaaaaattatgcttaaaatactttggataataaagtaagtcaaaaaaaataaataataaatctaaatttttttgaataagacgagtggtcaaacagtacaaataaaaactcaaatcccttatattataggacggttagagtaacagtgctactgccaaaagccaaaaggataaagaaacaaaagcgatggaaacttcctacacatatatgctcgttgcacattctctcttcatctaggttgcgttcgagcgcaggagaaagagagaaagattgttttgtttttcgcgcgcacgcttactgaattactaaacggtgtgtgttttgcaaaaaatttctatagaaaagttgatttaaaaaatcatattaatttattcttaaagtttaaaataattaatactcaattaatcatgtgctaatggctcaccttattttacgtatcttcccaacctcctcaatccccttctcctcaaacacacccctagtacacaacactgtcaagtgtctaacacaacacatgaagtagagtactctttattctttgcacggttttatgacaggtcgcatctaattaaaacaatccttaaaaataaaggagaaaaggccctagtgaaaaaaagagacaaaaacaataggtcgattgcaaagccaccttcaccaaatgaccaaagtgaacttctcccccaaaacggaggatccaatgacccctgaaacgaaaaaaaaaaagtaggcaaaaaaaaaaacagaggatccaatgcacaaaagcagagaaggcaatgggcaacggccaatgccacaggtaaaaatatacaaatccacaggctttccctgtaattttctcccatatcgcctttctcctcgcaagcatgtgtctcctccccactttgcacttggcatttgcaccccagctttgcctctacctcactagtagtagtaaaaaaacgttaattacattgtttactcgaaagcccacaggattaaccgcttaacccaatgcaaccgttgtcaaggctaaccctaaacactttaatttaaaactcctacttaaaaccccccttccagaagacatcccgctccagtttcccacgccaccgtcgaacaccttcacccatggcgtccatggccgccctcctcgtcgtcgtcttcctcgccggctgccacggtgagcgccgccgcccaccacctccgccttctcgtgttcttacttgagatatggctaaatgttttttttaatttttttttggctgggagtgggggtagtggtggcgcaggggaggagcaccgcggcggcgcatggcatcggggtgaactacgggagggtggcggacgacatcccgccgccggcgaggtcggtggagctcctccgggcggtgggggccgggtcggtgaagatctacgacgcgaactcgagcgtgctccgcgcgctggcggggacgcgcatgcgggtgtcgatcatggtgcccaacgagatcatcccggggctcgccgcctccgccgccgccgcggacaggtgggtggcggagaatctggtgccctactacccggagacgcgggtcaagtacctcctcgtcggcaacgagctcctctccgactactccatcgccaactccacctggccccgcatcggtgccggccatggagaacctccacgtgagcctccggaggaggaggatcagcagcgtcaagatcagcaccacgctcgccatggacgcgctcacgtcggggtcgttcccgcggccgccgtccgccggggcgttccgccccgacatcgccggcgacgtcgtgcgcccgctgctccggttcttgaacgggacgaactcgtactacttcgtcgacgcctacccgtacttcgtctgggccggcaacaacgacaccgtcccgctcgagtacgcgctcttccagggcggcggcggcggcggccgctacgttgatccgggcacggggctcacatacaccaacatgctcgacgaaatgctcgacgccgtggtgcacgcgatggcgaagctggggtacgggggcgtgaagctgggcatcgcggagaccggctggcccaacggcggcgactacgagcagatcggctgcaacgcccacaacgccgccatctacaacaggaacctcgcggcgcggatggcgaggagccccggcacgccggcgcggcccggcgcgaagatgccggtgttcgtgttctcgctctacaacgaggacctcaagccggggcccggcacggagcggcactgggggctgtactacgccaacggcacggcggtgtacccggttgacctcgccggagcgcggccgctccggtcgtacccgctgctgccgccgccggagaacgacgcgccgtacaagggccccgtgtggtgcgtgctcgccggccgccgcggcgagaagctgaacgagacggcggtgggcgacgcgctggcgtacgcgtgcgggcaggggaacgggacgtgcgacgccatccagcccggcggggagtgcttccggccgaacaccacggcggcgcacgccagctacgccttcaactcgtactggcagcagctgaggaagaccggtgcgacgtgctacttcaacaacctcgccgaggagaccaccaaagatccaagtaagcctgaaaaatatctggaaaattttactccatttttgctcagatttcgattgatacatgcaaatgcaatttatgatttccatctttagtgatctaggttgatggatgaatttactttggatgctggttctttagaaattagaattctgtaaggtctagaatagatgtggcgttttgctggtgagggaataaaggcgatgtctttatggcattggtgatgaactcgtgaaagctggtcaagcttgcaattttttgtgagcattacagcactaggcgatgtcttctcgtttagttgtcttttctgatgattgggttgatgaaaacaaataatcttacgtatctcctgggattaggtttgattatttaaatgacttctgaagtcagtgtcaactggagaaggatgaaatttctaggacagtaggattacaagtgcattgtcaataagaaactatttgctggaatcagattacaggtgcccaggatataattgtacctgataatattaatcaacagcacttcagttgacccaatacattatgatctcgatcccgattggttttgatttttgaatgttactaatttaagcatatctaatgctagtgttttcagataggttcatatttagaatttgggttaccgtagcttgtgtagtcctataattggaactcctcgctaggattttggaacatacatttggtacttaatttaaatgataaagtataattttaaagaatgaaatttctgaaccatgttgaacaatgagcatatgttaaacactactgtagaagctaattcatttgttcatgctaatataataccccaaaattccccattagtcatttgcgtagtgcatatacagtagaaggcatctttattaggatctatttatgatgtttgtctctccctggctcacttccaaaagattttcagtctgcacatttgttctgaaagattcattcagacgaatggagctgactgcttggctgtcattactgcggacaaagtatgatccgtgggttgccttccatccaaatgccacagtacatgctcgcatgcttgtgaacttggaccatatattgatttggtcaaaagactcaaacccacctgcacatttcgcatagccttgagtaaggccaactgcaagcctgcaacctgcatccctgcaaagcatacacaggcattgncagggccatgactataaactgttcttagacagctggacatttgggagtggggaaaaatgctgagacactgcctctttatttttctcctttacaacgtacttcctctgctgacaaatatttggcgtttagaacaagggttggtcaagcttctggaactttggccatgaataatttctcaaatgcttagttttgccttcaaaagtactatcataatattataatatcattagattttataaacttgttatgatataaaattgattatcaaagtttcaaaagttcgaccaaatcttatcctaaacgtcaaatatatgtgacatgatgagtattctctagcaagttctctgtgtgcagaagaaaatagtcatttcattcatgacagtgtaagcattttaggtgggacgtcagtgtaatgctccctttcatagctaaacatccttggacactagctcgtgtatgtatgatcttcttctgttctttagcatctcacttagcttataacttggtaaaagtagccttggtggatgttgctttcgactcaaaagaaaggtcctttgctaactcaactaggagaaatcaggataccaaatctgctaatggtgcactattatctgttactcttgggcacgcactttaccattttctgcaagcacaagcaacttattcggtgtatcttaatatgcttctattttacacttcagtggttaacctgccgtgctgattaagtgattagttcgaatcactgattttgttgtgtgtgttttttgcaggccacggatcatgcaaattccacagttctttggactaactgattgcatgggaggacaatatgaaaatgaacaacattgttctcgatttattttatttttgtcaaacctgattagatttagacccaggaagttaggtagttgagtacttctgtatctgctcatcgtctacaaaacctgtgaactgtgatgtaacagcgaaatttgccgtctgtttttctgtggcttaatcagtagaagaagatctgtggcttaattagaacgaaattttcagaactgaaccacctgcctctgcatgggcctcacatgggccatacatgggcctgcacctgcctctgcaaccgagctaggagtagcagttctgccacacggcccgtctacaaggatggtgttgtactgtgtcactcatccttcgagttttagttttttttttgtaatatcttttaatagtttgcacatcatctacagaaatattttgatgtacgcaagttatttaaaaagaatcttttatattttcaaacaaaaagaatctttgagtgtaacacttctcttaagaacaagtactactagtaactatagcaaggccaaaaaagacaaatcaattcagttaaaattgccaagctgaatttcagtagtacatgtgatcggtgtttcagccaaaaaaaaacatggaatattcatgccctttcctttgtcacactggccactacgattggttcaacaaggacatgagcagaatagggccatttacatcggcgagtgactcagctcacacagcgactgttactgctctgtccgtgcgctgcagagagatcacgcacatttacatctcaaagacctttttttttccttctctgtgcctctaactgcactgtactgcttgtcagttactcgacagcaacatccaccgattttttttcggttttcatgaaaaaaaaacgcttcaaaaccaatggctccatgtaaaatctggtcaaattttgtatttaaaaaacagtttgatttttataaaaactttactaggaaacgagcggtttctattctcgagccggcttggaagtgcagttttttagtgaaaactggttggtttttgtcggttttataaaccctaactgccaccctatgatgatctatccatctctgaatctcactctcacgaccaaagttttttgttgttgtcgtcacagctggaagaaaatgtgattaaaaaagagagagaaaaacagccgacgaaagaagcagcttctgattgcagagataactaccactacaagaacaaactaatggtgaggatatggttggctttgcttggcgtaggtgttaagattcagagattcctccgaccatgcgagagatctatctttgctactgcctaattgcctatagtggccggtataatgaccaagggggttacctgtccacttcacttcaccataagctgcaaaatgcaatggctgcaattgcatcactacgtcttacaaacgtacttattgcgttctgaaataattggcacttatactattcaagtttattttttcttttttctataaaatttataaatgttgaaaatatgttattctatcaaagtgtgtaatatcataaattcaacacggctgtaatcaacggtgtcggttattcgatattggagggggtattcttgtagttttttttttagataatgagttcgcaaacatgcattgcttgagatggagataatcatgagatggtgaattggtgatgactgatgactggtgatttgggtttatgttttcttaaaagaaaaattggataaccacctcagccacttcaactgctagctaagctagacaatagacagatgtagagatggatagatgtgtagccatagatagcttcttaaagctccaacacacttatacctgcaacaagaaaagagcacaaattacttgcaagtgagctaaagtccggtagctagctagctagataccaacacacacatttgctgccgtagcttactagattatggtggtgttcaacgagattagtgtggtgttggttgggaactacctttctcaggattagagagccatcatttttgttctgtgattccaggtcagtgagcagttaagcattaattgaaaaaaaaagaagagttggacattgacagtttgacacattgttgttattattatctaatgactcctgcagaaatagagcacactgcacccattccggaaaatctcatggtacctttgtcattaatcatgctgagcacagcacacatggctgcactgattgccctgtgaaaattcctactcctggctactacccctgctcctgatccaatcaagacgatgattaaatcagatcaaagtttgtgcttttccagcaaaaacacagctactgcaaagatagatttcaaagccatttatctgaaaagttgcaaagaaaaaggggtacaagtgccatgaactagttcatgatgggccagcagcagtggatatcatgagaaatagatggcgctctcaaaattgcaaatcaatcaagtgccatttttaagcaacacgtcaaactgtgcaatgagtaatctgcaggccaaacaagctcatttgctctagatgaactcccaatgcaaattaccaacacaacaacaggcaaacacaaatttcagaatccaagattattccactaatccataaaataatgcaccactgaacctcacattttgcaaagaatttagtactcactaattctagtatattaaaactcctaattaagttatcctgactccattggaaagagtgaaaagcacatcaaaaacctcagcgaacaaaaagaaacaaaaggcaaacgcatcattttagtggagccccaccttcacgggctcgctggccggttcacccacatcctcagccgtccatcacccccacgtcggacggccagatctcccgccacgtttcacccccgccgagacgtgcgtgtctcttacaggtgggtcccacgtaagttttccctccacgaagtgccctaaaaaaatatataaccccagcgaaaaattttcgcgctcacgcacgcacacacgcggcgcacatgggccgcattgattgcggcacggcccgggctgacccacacgcccactgacgtgacggccccacctagaggtggccccacacgtcatactcttggagcgggtttgggtagagctccacgtcgcggtgggctttactccaaaccccccgcctctaaaaggaggaggagtttagtagtaacctctttcttcttccatccatcgccgccgccgccgccgccgcattcgccgccgtcgagtcgtcgtcgtcgccggtcaccgccgccattggcgagaagcggagaaggggaggggagtgggggggcatatcaatggagggggaggaggggaggaaggggaaggaggcactgagcggggggcacctctgccacgtgtgcgggtaccagtaccccaacgcgaaccctagcgcgaagctccgccgctcccaccggaagaactgcgggaaggcgccggccgcggacgagcgggaggagggggaggaggtggacgccgacatggagcgcaatgcgggggaggggctcctgccaggtacggtttatatttggtgtgcttctccttggattgggttgtctcgggttcttgggtttttgatggtttcgcgcgttcgtgttcgctgcagttagagcaggaggaggtgagtcggaggggaatgcaggctctccatcgctcggatctgcgagaggagatgctgatttggtggaggtgaaggagattgcaggtataatctctagtattttttttcatcggtaattttctttcttgctttctcgtttaccgctcaatctatctcgtgtatcttgctggtaatttttctttgttgccttttcgtttaccgctcaatctcgtgtgctatattaaattcgaggttttcgtgtggggttcgttgcaattatccttgattttgcctgcttgcattgtgagatgtgagagctgacaaaatcgatgatagatcgcgatgattgctgctaactaaatccgcaatctttcataagctttgcttctgctgcgtgcaacgttgtgctttttgttgtcttgcttggtttgttgctagagaggctgaaaaaggcaaaaagtatggctgccttttgctcatcagtcccccccttggagagggacaggaaactcacatggcatagtgagatggtactgttctggggtactggagtaaaggtccgtgtggttcttggttagcattaaagctgaaagcattggtactttcttgttttctttggagttggagagatacttgtgtgagaatgatgtagaaatagttggagtgaattgtttttctgacttgcaaactgtagatctgaactttgctgagtcacttggtgttgagtgttaaataaagtagtaaagctaatcactgagattcaagtgttccttccaccgtctagcacctagattatctctccgtgtttcacggcaagttggtggcttggtaatgttagtcagcagtaagaagcctttgcttgtctttgtggtcatatacttcatcggattctttctcgaaactggcagtcagacaaggtgaactgatttgttggtttcttggtacatctttcatgctaaatatccgacatatctgtcattactcttgttggtaggtaagatagcttagaagctgtcttcctacacatggtcttacaccacatgctatcctagtgacatgtgcgtttggtttgctatgctgaattgtttagtctccttatgtggatgcatgtctcttgaaattttggttgtatccttattataatactgtgaagtcatctacttggacagatcattcagggtgttgacatgagtttctgtaatttattacctaattgttgtgactagtccatgtttttttaaaggtctgtggccatgctgttatgtagtatcgtccattaattctggagtcattatgctgctaagtttctaatgactgcaatcccattatactatttacagcaaactcgtctttcaattgttttatgggcccgattttcagggttagtcctctatatcaatataaagttagctagggcaaacttgtgcagcagttacttaagactgtgttattaatcaaattatgaattaggcgtgtacagtcttctgtgaatagtaaattatgaaataggtgtgtacagtctttccaccttttgcggtgattttttattgtcttctgtgaaacctctcattttgctcctattagcaaataatgacagtggaaagagtgctactgtggaaatactaaatatattaggaaataaacctacgcaataaaaatagcttttatgggtcttatttacactctttagtttctgttagtaataactccctatgtccacaagctaattttggtgcacatcaggaatttagagacattttctcccaataacctagtatagctcacgttattaacttattagaacatatccttttccacaataacttagcatgagttcttaacatttcctgttacttcgtctagtcttttgtatccttccatgcttttattggaaacacctttaatggttactgatttattatgctgacaatcctagtaaaatattaatgcttttgagttgtttttgatcattcctgccatcctttgtttcactaataagtgttcttttccacgttacttattatttcatgttttagttcatctaacaatgtgttggtttgattctttaatagaacatgcttctccaaacgttaccggagttcaagtcatcactggttactgcagtgaagctggtgtgattaattgcgcaagtcattctgatgaaatttcaaaagaaggtatgaaaactaacttatgaaggccttgcaccaatgaagtcaaaattaagttgcagaacattactctgaaatttcaccacttgcagttggacgtccggctgaacgagaagatagtcttgatgagtaccaggacgcgtctccttttcttcatcaaccagattctgaagttggtgcagcagtagcacataagtcagatttttctattgaagaaattaagaatttggatagtgtttcaccagcagcaagtgtagcagcaaatgaaatttctgtggaaatggatggagtatcgaaagatcagttatcaggacaacccaatatgactaatttatctggtgaatccatagttggaaaagaagttgagcctactgtgatgcttgagagttcagatgaattctcagttaatgttcacagtgataatacatatattgttgacagcaaacctgataagacatctgagtttattggtgatgtgaatggttcaacttcatttatttctgacctaacatcccaatctacaagtcccataatggttgaaagcttgatggaagatagcatggatgctctgcacatcatatctgaagtatcaccaagtttggaagaaaaagcaggatcagccaatgctgaatctgtaacagaaaattccagaattgactttgtgcaaactgaagatcaactgaagctcaccaatgctgtaaataccttgacagattgctcttcacagtacaagtgtgttaaagatactttagatgcccagctgcctgttgagaatccgttcctgggtaattcagtatgttctttagatggtcatcagagtgaccatgttgttactaatatggatagcatgtggggttctgatgatgaagatatttgtagtgaaggcatcaaagcgaagggcagtgagttgggtttttcttgtgaggagaacccacaacatgtcgagttggttgataaagcagatgaaaatccttctgtagagaagcctaatggattatcagaagaggtggtctgcagcaaagagattggccctgaggttcctattataggccaggtctctgcaagtcagcatgttgccttactaatggatcaagtgtccacaaagaatccgttcattctagatgataccaggagcgacgacttatttgagcttccaactgagaattaccattcggaagcacaaaatgttgctgaatcaaagctgcaagttgactttacacctctgccattggatcagctgataattgtggaccaaactagcattgctgaaggccagcaatttgtcatctcaggttaggattgttttaccgtggattatgtacaagccagtaattctatttctgctgtatgttttttaatgtcgttaattcattgctgaaatttaatgcgtccaggctatatatgctttagtctagcttttatttgacagcctgtacatgtttgtttggtttttaaagaaaattggtaaaaatgctaagctgtggagggaatttatctaaaatgtcacgtggttaaggtgttcaggcaaatgatattctgctttagtgccttacatggatataaagaagttaaatcaacagcggtagattcttaaattatatgtactacttcctgcataaatgctcactcacgagtcatgacgatggcttcacttgcttgctggaattcacagtagacttttaaatcctaatcttgttagcagtattttcttggggatggctactgtacaaacaacttttatcatagttttcctctctttgcatggcacatgttgccttgttatcacctctggagagaatagtggataatggtaaaatgattgtgaatacagagctagttgctctgtattgtcatatgttaaaatcgtttcaattctccctattccaatgttactgtatgactttcttctagcagacgttactagttttgattacatggtatcagtcactgaaatttgttgctcatttctggcaggtgatcgtgtaccagctatctcaagtacctgtggaaatgaacctgcagttggcacagaggatgtgtctgtcagtagcacttctgatcctgcgaagaacatttccttgcatgatgcctcagtgaacaatagcagacaggaagacggggagcctacaagtggcatcaattttgtgccatctgaagtatttcttccagcagagtttagcacaatgcctacttctcaggatatcaatgctctcaagaatgatggtaacgagaagacgccacttgaagacataagcaccaaggatatgactgcatcacttagtgaagataatgttgaagaaaagaaagagaccgaaggcactagtgtgaaggagatgaattcaatactgaaagcagacaatgttgaagaagagaagttgactgatgacacgagtgcagagaggaatgcaatgcagcacatagatgacgctgaaaagaagcaggctgctgacactgtttcgagggaaacgagtgctctacaaaacatagaagaaagggaaaacgttgaaggtactggtgctaagggagtgccagcagtagggagcttggaaaatgctgatgcggagaatcagactgaagacaccagtgcaaagacagaatgtaaatcagataatgctgacaacaagaagcagagttacgacacaagcacagaggagatgaatgccaagaatcaagctcaagatacttcctcaaaggagatgaacaccatacaaaacacatctaatgctgaagaaaagaaccaaactgaagacccagctgtccaggagggaaacaagcagaaggaaggcatctctcccacagtagcgaagcagagttcagaaagagttcatgtccctctcaaggtgctcctagccgaggcgagtgtggagacgaaagaaaagaaaaccactgccaaggagcgtgttttgtcattcaggcgccgagtatcgaaggacgactcatcgtcggccaagtccgggtccccaaaacctggtgctgatgacaacaaattctggagctccccagcaagattgcccgagaacaatgctgagaagaaatccaaagcaaggaagcagccatggatgccgttcatttgctgtcactcggtgcactaagcctgccatccatcttcagcagcacaaagcttctccaagctgctgctatacaccatgtgcatgttgcatcttgagttattattgatagcactagtagtagtaacagtagtaaagggcttggctatgctacgatgctctttctagtatttgcattggtctacatttgccgctgtaactaaagctccccacatcttttgtgtagatagtccatgcaagtaagattgtttggtaatgtcgagctgatacttgctgatctgcattgatgttcagactttgtgaatcatgtgcgattttgatgttcatagtaaacttgctcgtgaatggatgtggattcagccctgtgcgctgcattggatcttagacactgtttgaaacaaattttttttcttttaactagaaaaaagcccatgcgttgtaacaggtaaaatctatttatatcttattatggttatatgggctatgtttagatccaaagtttggatctaaacttcagtccttttccatcacatcaacctgtcatacacacaacttttcagtcacatcatcttcaatttcaaccaaaatccaaactttgggctcaactaaacacatccatggtttagtttaaatcttattatggttatatggtttagttaagatgaaattgactgctggaattcgtttggatatatatatatttttagaaaatcatgagctgcagttaggagtccgtttgtctaaagttagcacgtgagttttcttatacgactcattctgtattaaattggaattcacttggatatatatatatttttagaaaatcatgagctgcagttaggagtccgtttgtctaaagttagtatgcgagttttcttatacgactctttttgtattttcaaaagagaacgaacttaaaaaccgactcaaatacttaaaaactgactcaaatatggatatgtattttcaaaagcgaacaaattgaaaaaccgacttaaatacggatatgtattttcaaaagcgaacgaaataaaaaccgacttatatatggatgacgtaccaaagtacaggtaaaacatcttcaatttttataatagtaacgacttatgcgagaattgagcaactttctggcatacttgtacgaaaattttgtatagcaaatttgtgcgttccattccacaaaacttgactacgccatgttattatctgattcagattttggaatcacttttttcttggcaacttttaataataaactttgtagtagtaattcgtccatcaatttcagtcttttttttttcagtctccgtcgtctcactcaaatgacgcctacgttgtgatacagtgcggcccaaacagtcttacatattcatggagtgatatattttatattaatttatgttgttaaatttttgttttattttttgataactatttatatacttcctccgtttcattttaagtgcagctgtagttttctgtgtccgacgtttaaccgtttatcttatttgaaattcttttaggcaaaatttgcttgtatttttgttgttattagatgataagacataaatagtactttatgtataacttatttttttaaaaaaattttaaataatacgaacgattaaatattagacacggaaaccgcgactgcaaaatgggacggggagtaacatgcaagcgagtggacctaaaagtgaacttattcctattcggattgccgtgcgggccaatcagatagagtttcggcttcggctttgttcccgcgaccgtgatcgattccgagtcggcgcgggagatatccatcccagtataaatcttacgagcggcgggcgctcctcctcctccacagatcgcttagggttcgcgttgcaaatcaatcaatcaaggcgcgtgaatttctgggacgctcttcatcgatcgatccatccatccgtcagcatgtcggcgatcctcatctgtagcgtggctgcagcgtctgcttcagccaatacgtcggcggcgatgaggaggacgcgccgcgcgcgagatggcggtggcgcgccgccgccgccgccggccgggtactccgcggcggccacggcggcgagtgttccggcgtctctcctgttgattctggggtcgtgtttggtggcggcgtgcatattgttgtgatcgcgcgacggcgacgtgaagcctctttggcggtggcgcgcggcgtggcgttcacgactaattttgatcggaatttaagtagtagtttctgggattgattgtttctcccatttttattccttttgttactgctaagttttatatatgtcggaacaagcaataggaagattaatgtctatatttaatcaagatatattgtttttttttctgatttatattaatataggaaatattaatgacctagagtgagtgcgcgcttaaaaaaatacgaataacagggaatgatctaatatcgaataattaaaaaggttagacctcgaagaaatcaagtgtggagctagctatccgtgggcgtttctcagagtgtgtgcttacacattgatgaattggtcgaagaaatcaagtgtgcgtcgatgcgatgattctgacgtcgctagtagtaaacttgctcatgaatgtggattaattttggcatcttgcgttgcctagcttggaacacgagatgttttaacgatgcaaattcccgtgttagatgatgcctactaatctgttccgaccctgtttctgaatagctgggccgagtggcccactctatgtacataaaaatctctcttaactatgttctacatggttaagcttctgacgttgcttttaaatcgactatatttctaaatggttcagccggctctgtttctaaatggttggttgagccacggatgaagaagctgcctattaatctcccgacttctggcagcgttcgtttatccaacaaactgttggatgaaattttggattatcgtggcacgttttttaaactgttaaacggtgcgttttgtgtaaaaactttctatatgaaagttgctataaaatatcatattaatccatttttcaagttttgtaataattaaaacttaattaatcatacgttagtatcacctcgttttacgtgaaacgtttaatttttatctttatttttcatcttccggagattcaaacaaatcgactcgaaataatggttgagccgtggatgaagaagaacaacgacgcattcgctaagtttcgagtagtttcctggtgattactgattaattgttgttctttcccttttcttttgattctgattatatatatcgaaataaagaaatattattgtactgcatggatatagatgagtttgacgcacatgcatcacttgctcagagtaaaaaactaattctgaaatgtttgctcgatcaacgtctgctgcacggcttattgcgtggctgtgaacgtccgcaccgccagtttggtggtgatgaggcacccacgagcatttgcgcttcgtcgacagtttcgcggccacgttgtccaaggttccggtgtattgttacacggttgtggcggcttatttcgccgtggcagcggtattggcgcggtggccattgctcaatgatcgttgaagtaggaattaagtatagccaattgctagctttaaaaattaatatatcatatatgatctctctaaatatcttattcatagggctgatcggaactgctggctgctgcagccatcacggctatggccctttttggctgctgctgctgcagctgatttttagctctcgcagccgtagctgctgcagcagccagcactgccgatcacgctcaatagttttatataaattatatatcgcaccattaatactttggtctacgtattacactcacgtaatatcttgaagctcaggttgtagctagatataaatttataactcgtttttcttctcacctcttctctcttattcacatgtgtgtaaacctatactggctagtacagtacttgctcttagattcattgagcgtgtgatgctctctctacgatagcgaaggcgacacaagccgcaacgcaggcgacggccttgggctcgctgcacagaaccgaccgcgacggcccatgtactcctacagtctcgcaggttctcggcccaatcgagacgttcgcgtgggccgtgattttcccggcccactcgcggcggcccatctcaccgagcccaccgcctagggttctcgcgccgccataagaaccccttcattccccacccagccgccgcccgccgcaggggttcgcgaaggtaacgtgcgctccggctcgccgccgcgtggttttccggtgacgttctcctcccccccccgtatccctaacgcggctgtttttcgcgtgcagatggcggtgccgttgctgacgaagaagatcgtgaagaagcgggtgaagcagttcaagaggccgcacagcgaccgctacatcggcctcaaggtttgcatcctccccttcctcaaatccctcgctcgcccctcccaggatgcaagatgcgctgctgctacgcgcgagccggatgcatttttttaacggtgtttctgatggtataatgcattctagagtgatgttgaaatatgatcatccgatgcttaggaaaacagtttatatgcctctaatttgtaattgtagcttaggcaaggctactctcaaatgagacgaggatgtttgttgatatctctcgctactagctaaattgattctgtctaaagtctagacatgatggctaatcatgtaaagctaagatttacacatgtagcttgagcattgtgctgtctttgtatgcctaaagacaatggattccgaataaaaaggccatctaatgcaggcttactcatttacatgaaactttcgaattgagataaaaaaattgaattggtcgtgtttttgatttttatgtttgatgttcagagtgaaaggaaatgatggcttagtaaaaggtctgagtgagaaaacattttcttagtgaacattgggggtaaaggaagagggccctagctcttgcactagtgtagcattgtggctctcgcaacctcttctacagcaattacttcattgctttgtgaagtgggttggatcaaaaggcgtgggcttcattctgagtatgaatgcttgcctagacttctccctacattttttcccgatgttcacttaagaaaatcctgttttttgcatgataacaatccttatgtctgatcctttcagcgaacaacttttgcagttgcatatattagtgggtgaacttctcaagtgcaggacttaagttcttattatcgtgttacatatgaagttccttatatgaactgtcatttggatgtactctccaaagttgcataattgatagtcattagtatttagttatgataatcatttatgttgtaatccccatcgtgtgcacagtataccactcaaacaactttgttttaaaatgaactgcttctagaaccaaaaggctagctgcttatagttgtattctgtgtttaactaacaaattatggatgtgtgaaatgataggttcataggataggctagcttttaggattttggcatgctgatgatttgtttctaacttgaatacacttctccgcttatttcttttgtgtgctgccttgcttaaatttggtgttctttttacttccctatatgtagacaagctggcgcaggccaaagggtatcgactcccgtgtcaggagaaagttcaagggatgcactttgatgcctaatattggctatggttctgacaagaagacgaggcattaccttcccaacaaattcaagaagtttgtcgtccacaatgtctctgagctggagttacttatgatgcacaacaggtaacacatgctgccgattcaatttagtgactgaagttgagaagtgaatattctgaagttctatgctatgctgtccactcttacaaaccttgctaatggttaggattaattcttgttattgcacatttcatacaaacaggacatactgtgctgagatcgctcacaatgtctcaacgaagaagcgcaaggagatcgtggagcgtgctgcacagcttgatatcgtggtcaccaacaagcttgccaggcttcgcagccaggaggacgagtaaattgttacgctggttgagctgttttttggtcgcgttgtttgtaggaggaacattaccctgcttcgagaagttcacctaatcgttgtgtaattttctcatgtaaacgtccttaggatttcagtaatgagctgtgctcctataattatttactgtactcgacttaccttttcccatgtacactgatatcggcagtcagatgagaaaattgcatgctttgggcactatagttctacatttttactgctctctgatgaagcactaatagaggataaataatctcttgtgatcgtcgaggacctgctgaatgcgcatcgcattgctgcgaacctgcgatgtttggaacatgaataatcgttgatgggctctatatttcctccgcattcctttgtaaattgtaagagactacaagtcataatttgccattctatgatgtataaattgacactgtaaaatgtaaattgcagatctcaacgcttaaatttattcaattgagttatgattatgaaaaaagagatgtaatcatactttttgccgttaaatgcttcggaagttcggatcggtcgaccgagccatcgggctctcatgcaaccacctgcaccctattatcttgcaatcccttttatctatgcatgtatgcatctagcaatatttaaaatatttttttctcctaatctatttatttcatctatgatcgatcaaaccattttatttatggcaattaaaaactttgcatcaagacatcacacgattttattctaataaaaggacataagtttggaacaattataacccatcaattcatagcgatttgttttaacatctattttcactatgttttagattttctttttaaatgtttcaatgcctgttttcttcatcacgtagaggttaatattttattcgatgatcaataaaacatttgaccaccaattttttttcaaaggaaatgggacgatcatttgtagttttctcctagtttgtcacgtcggattttgtaaaaaactgtttctactacgtgtataaatatttttccttgaatcaaatcaaactactctgacaacaactagttcatactctgcatctaacgaacattaaaacccaaatcaaaacagcccaagagattcaggaagaataataataataaaaaaaaaggccatgctgccgctctataaacaaacagtcacccttcgccctcctcgcggaaaatcctagaaacagaaagaaatcgcactcatggcgaagccgcagcttcttctggtcgtcgccgccgccgcactgctactcgtcggtaagtagcctcgatccatggccatggggggcgcccctcaccccctacgcagcgacatctctgatccgatctgagcctgactcctcctcgcctcgtcttgcagttgcagcctccgccaagaaatccggcgacgtgacggagctccagatcggcgtcaaggtaacccgctcctcccagggggattaccctgccctctcgcctgtgtttccaggcgttggttctcttgcgctcaaagactgtttgtattcttgcttgggctggatcggctctagttgactgacgcaagaattgtttgtttagaatttcggattttattgggtcgaggggcgcgtgcttcgtgcgtattagatcatgtcgctgtatcgcgaattgtacgggaattagtttttggtggaaacaatttgtgaggggtggtgttgtgaggcgggcgagtttgcctgattcaactggattcacatctgaatctatagttctttcttcttttttttttcattggaatgcaaaatgttctgaagaaagcggaaaattgaggctcttttgtggaattgattgggcaggtgttaccttgggttttgatcaaggttttccttcgggaagtttagccttctattactgtatttcctgtacattttaattgctatcaaaattagttcatggagaaatgaatctctgcgtgaataattgcttcagggcttttaggttccgtagttctaatatcccatttgccatcgagtaaagctacttaacaaatcgtaggaggaactacaaactaatactcccttcgtttctaaatatttgacgttcgttgacttttttaaatatgtttgaccgttcgtcttattcaaaaaatttaagtaattattattttttcctatcatttgattcattgttaaatatacctatatctatacatatagttttacatatttcacaaaagcttttgaataagatgaacggtcaaacatgtgctaaaaagtcaacggtgtcaaatatttagatatgaatggagtattacatagtaccttcctgtaagggacagggcgtcttgaacatatgacctcggacataaatttattctctaccataggataatctgaaatattggtgttacgctgccatttcttataggaaaaaaaataaaacaaaaatctagcttgccccacgcagcatatcttcagaattagtacagccttgccaaggaaagaacattgtaattgtcaccacattggtccaaaaatatgcattttatttattttgatgctctagagaaaacggtagccttttacaaaataaatggctctttcaagaagctggatctcaaatttgtgtgccatatagaatttagatagtttaaatatcatatgctactttcattttgatatatttattttattgggctcatatagtcatatatttgtgttgtgaccttgtttcacttgcagcacaagccagaatcctgcagcattcaagctcacaaaggcgacagagttaaagttcactaccgtgtaagtttgatattctgctgtatggcctgttttgtttttatttactggcatcactttatttatgaagcctgtagttcacttggcctctgtcatccatttacagggaaaacttactgatggaacagattttgattctagctatgaaagaggtgacccaatcgaatttgagttgggcactggccaagtgatcaaaggtaatagtaatggtcccaatcaatagctagctactcatttaattttagtattgtttaaaatttcaatgctccattgtctatctaaaaatttcaatactccatttgtagggtgggatcagggcattctgggcatgtgcgttggcgagaagagcaagctgaagatcccttcaaagctcggttatggtgctcaagggtcaccgccgaccatccctggtatgtcgttttgtagttcttgtctcttgagtttatgccgctgtcaagttagaatggtacatccttttcaagagaagttgtgtataataaaaatagtttatcatacaacagcacatggccacattgtctgagggagctgctgcaatgctatattttttctagtcgggactttttcactacatatgtaatatatctgatctgatctggtgttgttatgttccggcctgcaggtggagcgactctcattttcgataccgagcttgttgctgtcaatggcgagccagccagcaaatccgatgaggacgatgatgacagcgagctttagatagccaggatggttcacatcttacgcgccaaaacaaagtctagttgtcgaatcaaatagtgagtagtgaaatgcaatgcatttcaaattcaggaccccatagagaaatcaactctctttttttttcaccatgaccttatctgctattttataacataagcttctatttaacttttagcctttctgaacaattgcatgatctgtgatgcatcttttgttccaaattgtagacttgttttgcgcttcgttttgtttggaaaatggttacaaacataactgctgtgccggtttggcttctatgtgtgatatagcatccgaattgtatgaagttcgaagtggacatatccaggctaaaacctgatcagtttgatttaatttgagttaatttagcttatactccccaaacaaattctggtaaagaatagtaccacatgattaaggagatcaacaaactttttcccaaacaaatacaaacggaaatccgtaaacctgattcgatttgcatcagctgccaccgcaatgtagcctttcagaggtgaaatcccagatcatatatgcaaactaaatccgtgaaatttctacccccagaccctcaaactaaatccgtttaaataaccaagaattgcaattagaaattgcataaagatgttcacagaagagggaggcaaacaaaatgctatgatttgcttgcattttcttcagtctacctcactctcgttcatctcggtgaaaatcaattcaattcgaattctcatttcccaatgtcaaatctcagcaaaatctgggccagaaatctgaactcaaa

SEQ ID NO: 11866 - DNA, 1566 bp, Oryza sativa
tggacaaaagcatgctattatcttcttacctgaagctttgctgacaaagacatattgcatcaaagcaatatcacattagcctgattctgataatgatgcatcaaaagcaaatcaacttccttgactaacctgcaacactgtcatcaatcacattagctgttattcgtcaacatgattcctcggttgatgacatggcgctgacgtctccgctgagcggctaaaaaaaagagcagctgaaatgggaatcaagaaataggcagcatgagagttagtttggaatgtctcttacctttagggatctctatgactttgcccatcacttagtgatgcttttttggctctggtgatgattgattggatgcacatattgctgctatgattggtgacatctaatctagagagcaagtcatgaaaaaggcagcagcaagcactgataaaaaaaagcaaataatgcaggcttaggtcagaactagagccttcagaagcaggacatgatcacattagcaaacagtaaagcagcttttgttcatgctttgcacacagaaaaaatgcaagtgcgtgtatgcatgcatgcggctccattaggcgcatgcgcctaagcttctccatgaattgagtgggactgtctgaataatgggcaaagtggatggtcacaacacaagtggcctctctgattgataagcaattaggcagatgtaagcatcaagatctaggcaggtgctgatggtgatgttgctctccacatggaagccatcccaattcccaattcaaagcaggtcagcatttgggcagatctaaagcaccagcctaatttatcttctgatgcagaacaccatcatcaccaacagcaatagagttagatgtaatgctggtgaacacaatgcttcccttgcaatatgagcaaatatttcagaaacagtgaacaacatggcaaggaatggctataaaatggaagtaatgttacattaaggatttcattggtttacattccagtacatctgacgagtgcaaaaaggaaagggaacacatcaaaaactcttggctgtgatacatcaaaattgctattgcaggagtataacacagtagagcaatccatttcccgatacaagagaaataaaaaaaccattgccatgttggtgctttgttggggagattgcaaaaacattcttccaagtagctttcatgcaagtgacgctccgtctccatattgctaacaagggagttctgaccatctacttttgtatttcggtgtgtccacaagctagaagttacaacaggcagttaaaatggagcatgcaaaggccattcgctgtgtctaaatctccagtacccaagaaagatggtgaactgaacagcatggggaatataatcaatatatttacacacactaaatatggagaaaatgttaccgcctcctttttctgcccttccctagctgtccagatttaaaagcatgttcctgctcctgaaggaaagccatggcttttccatacttttcagctctctcttgctcttgttttatcctctccttctctttcacagcagacaggaaataattatctttac

SEQ ID NO: 11867 - DNA, 11950 bp, Oryza sativa
  unsure (1)..(11950): unsure at all n locations
nnnnnnnnnnnnnnnnnnnnnnnnnnnnnnnnnnnnnnnnnnnnnnnnnnnnnnnnnnnnnntgtgtccacaagctagaagttacaacaggcagttaaaatggagcatgcaaaggccattcgctgtgtctaaatctccagtacccaagaaagatggtgaactgaacagcatggggaatataatcaatatatttacacacactaaatatggagaaaatgttaccgcctcctttttctgcccttccctagctgtccagatttaaaagcatgttcctgctcctgaaggaaagccatggcttttccatacttttcagctctctcttgctcttgttttatcctctccttctctttcacagcagacaggaaataattatctttacgcagttcgcgcattgcacccttcttctcactcttaaggcgtttcttcattttcttcatttgtgccctttcccgatcagggtcataatcaaggcctttaatgtaactgcagaaagagaagaaatggagtcaataaagaatgaacaacagaaaacccttcaagaagaatacaacatgctgttaacacagaatagaacaccaaaaaatgcatacttctcttcaaatttcggattcaactgcctgattggttcaggcttctgctttcgcatttggagtggctgccttgatgcatggacttcatcacttctgtttttaatcaactcaatgacttcatgtaaaatgtattgtaacaatccaggcaagtctgatttatccataatttcttgcatcaaagaagagattggcaggaaaatttcggggaacgaacatagttcttcgtgtataataacaaatccccttaaacattcagccacagatagaagtacactagccctgttagaaaatgtacgagtgtaagattatgtgttaagtaaaccaataatattcaaaatgccagagaaaacacatcctcacttgaaattatcagaggagaaataaggagcatcagaatccatgcatatgacttccaggatattcgctggattcacctcgtgcactttttcatggatatgaagccatggttccattgtcttgagctccaaaaattgatcattgatctatacaaagggtcgcttgatatcaagcagtgagcaaaaaaagaaaaaaaaagttcaatgcctgaaactaaaaaataccttttttcgtaggtcagatcccaggtttcctcccagagatgttaccaaaagagattgcagaaaaacgacagcttcagggcagaatttcttagactctttagtagcctgcaatcagagttattattatgcagaactggaagaagagaaaaaaggaaattcatgtcgagtaagaaattcagctaatagttcttcatcattcatataagaacttaatggaacaagatttagagttacagaacataccacaagcaccatggaacacaagaaagaaccaacggctacatctcgaccagattgtatggggcatcgcatcaaatattcacacataagcaaaagcattggagttgctaccacatggcggaagtcagagcagggaaatataagagaccataaccgcagaagaagtaatgttttcaaacttggccagcagctctttcctataagatatattcaaaagcaatcacagtaaatcacacagtttattgataataaaaccaatttcctaccaagtccaagttctcagctcacagacctgaaacctttatatcttcacatagacgagtacgtgtgtggataagtcgctgcctcgcacagatggcagcaaaatatggagtctccccactcatctcaattaaaggcttaacaagggtgtcaattagtttgaatctcactggactctgagtagctaatactgcaaagtactgcaggagaacaccatagaaaacctgccaaaagagatcacaatacttgaggatacatttaataaatgccgtgtgaattgtaagatatttaagaaaaaaatcagtaaatatttgtagaactataaatacgatattgatctcagtaaaaaaaaaagttacatacttgcatcttctttctattttcagctgcaagccttattgaattgcatgtacgaattcgactaataatctcaattatttcagtttctgaccaaccatctagcaaggagcatagatctttcaagttacttggtgcttctatcacaaaaggaagattgtcatccttgacttgcgattctgcattagactctttctttgaattttgtagatcttttttcaccactttgccactgatcttctgttccttttgtttgagaccttccatttcatcttcttccacggtaacctcatcatcgtcactttgctcccagtctctagcagacatattaccaaagtcattatcacttaaatcctcttcttcatcttcatcctcagcatcatcatcaccatcctcagcatcatcatcatcgtcatcaccatcatcatcagattcttcattgtctgacccttcagcatcttcaccaatctttttaccctctctttcataaatttcatcgacccagcccttttcctttcttgctggctcatcagtagaaaaggaatcaccaagatcatcaccagatataggttttgagctgtctagcttcgtgctgcggtcaccctcctcgtcatcatcatcatcttcatcagaggactcagcagttccaagcattcgtttctgacgctctttctagaagaccaaccagcatcagagagattcaatatcagtatttcatacgaaaagacaaccatgatgtgatagaattgcatgtataaaatttaattagatgcttgattaaatcacaaaacaaatggtgcaccagtgtttgcataaataaattgttaaagaatatatggcatccaatgacaaagttgatgtaagaagttttaggtaagacaattgcatccaccaggagaatttgtggcactgggacattttaaataaacaagaatacaataactgcattcaaccctgaaataatatgaaacaaacctccaacttctcaagacgttctttttcctcctgagctatttcttctggtgtttttgtcctgtctgatggacgagcacgttgatccataaccatttctttcactaatttatcatatgcatctggtttttcctggcaacaaatactgatcagactttaccatcataacgtcaataaaaaatacatcaatgtgaatttccccacagccaacaatgaaagtctgttgacacaaaaacggagcaaagacaaatgcctgtaatctataggtacaaaatgaatttatccaaagaaaaatgacttcataatgtcatagtaccatatccaggtccttaaggtgaacgaaacatttaaaaagtatattaacagctaacaatattaaccattaacataaaccattttaatcatttgtccatctcatggacatgcatgcaaaaccattttaaccaactgttgcatccaagtgaccgggtgcaaacccattcttctaatagaacatgtgttgaatgaataacagtgtgattattaacaacttatgtagaagcaagaagcgtagcactaagaacataccttattaaaaatctccttggcagtcaaaccaaatgaatctttctggactgtacttgaattatatttatttgcatccattctagctgatcgagtcaaggacaacatcgcctgtgtctgggctaacattgcaaagtcactatccaacttgtctacaagatgttcatcctcttccctctccttggccttttgggcctgcacaaggaagaaattttgtgttttaagaaacagcttcatcctcttcatgtcacacacaactaataacattccggaaacatgagacaaaaatactgcaagtatagcgtatgttagtcatgtacagcaacttagatctttttttctcgaatacgcatgagaactgtgtatctttgcattaataggaggaaaagatgcatccatgacacagatacatgctgaaagaaacaaaagccaaagcgcccaacaaggctcttacaacatcataacgcacacgcctacataagcagggtccatatcaaagatagccccttggccccaaccaaattccataggcgagcctcctcacttgctaaaaacgattgtgttttaatggggtttcctcaagtatttcagcttgtttgattttagcaatgtagatctaataatgagcacgtccaaaaagtaacaggatatagtgcatattcccaaaatactataagaccaacagagtattactggaaacattcaagaatactttatcattgcttgcgacgaatacagggatagaaggttaaagccaggtttcactggcctatctccgagaatggttcgcaaaaagcaagggctaagcaaaaaaactgtaagtagtatgatggattaaatcatattagcccctggactgaattcagattattttttttgtaaagtttcatagttcaacatataccagaaaaacagcagaatgacagttcgatcgatctacttaatattaaaacaaaataaggtcctaaatgatcacacaagaacaaaaggacgggtaccaaagtaacacatatggcatctaatcacagaagatgctgtaccttgtaaaatttgctctttaaaatgatctctgacataacttccttcttgctcttgtgaacctgccaacaagtgtaattaaattgaggtcacaggagacggactgattaaatttggatcctaataccatcctatcaaaacttacattagttccttcaggaagaccaatttctgaaggaacatcaccactttggagaggtatgcggttcttcgagaggatcatgtgacctgaaaattacagaggattaagcacgctgaacaaaatctaatcataaatgttgattcatgtggatagggactctacttcattttggagactactatgatgcaagaaaacaatttcatgtaataatgtcatcttaatttctccaatggtgaagttaacaaataaaatgatgaaaagaaaactaaaattagtgcatgtttatgagcctattacaggtaagccatttatttattataatatgtagtatatgcaagaaaaaggactcactttttatagataatgaaccattaaaaatacacatacctacattctacacgtaagggggaaaaatcgctacctgccagtatcaactaaaactgagcctaaaaagggttacgtcctcaattgcacaaatgatcaacagacaggattttgcaggccatcaatagttactgggctagtttgggttgaagcctatttttgccctactgaaattttgacaacttcaatagtatgaaatgaatgttcggtttgctaccattttttgcccacacaagctcaaattctatactacaaaatttggtagggcaaaattggctccaaaccaaacaagcacactgtttcttttcaggaacaacacaacaaatatttaatacattcatcatttgaggcagaaaacagaacgctagcttcaagaaaccaaaatttccatatgaatgtcagaaaaggaagattcacaggaatccaagaagaaaataagatgattatatgccaagctaagacactaagacagagtatggaacaaaccttcttcatcactataatcatcaagaggcacttcttcatcaaaatcatcttttcccgagagagagtgaggcaggtgaacatcaacctcatcttcctcatcatcagatagattgtatttgctttctcgtttcagctttgcctagatagaattacaaaagggaactcaacaaactatagtaatacaagaaaacacttataacgatatcatcctaaagttactaaccagagataagaacaatgtggttacattacaaggcgaatatcactaggaacaattgtaagcggagaacaaattaatttttcctcattgaaaaagctctaaggttacttcatttttactagtaactacaatccatcaagtttattcatctgtcctgaccagagaaatgctacaggtgttgactgttctacgcaaaacatgcattctctctcaaaaagaaaatctccaaccatgaatccacagcgcagacgcgtaccatgtgctcacgctgctggcggaggataactttgtcgaactcgggcagcgtctcgtccctctccccgatccgccggtcctggaacacggacgacttggcgctctgctcgaactccttgagcagagtgttctccctctgcacatcgccaaaaaccaaaatcatcagccgatcgattcacccatcccaaatcccgccccttccactagctgattgattgatcgattgattgactgtttaccttgtggatggcctcagagcgggcgcggccgatgcggcgctcctcccccttgcgcttcttgcccagcacgtcgaacttgcggcgggaccagatggcctcgaaggggttgttgctccccgacgccgccgccgccgccgccgccgccgcggcgccgcgggccttcatcgcgaccgcagccgggccgttcttcccctgcttcttcttcttgcccttccccttcttcttgtccgccgcggcggcggcggcggcagccgccatgggcttcgtcttcgccattgccgggggacggggggaggagaggagcagcggggaggctagggttttagtggaggtttgctccagccgctgcctccctaattttgctgttgttgatgggctgtcggctaatgggcctattaggcccgtttggatttggaggcccaaaagcgtttagcccattgactgctgcagctgggattgccacttatcatttgatcatttcctggtttctaattgatccatggatcttatttttaatttttaaaagtaaaatttcataaaaccccattcaagttgcacaaaaaccatagtaattttgacacgtgaaaaataacctcaggtattatggtccgaaagtttcagaaaaccacaacgttaaccaattttacatagtcgtatatcaaacttttaaaaagcttaatttcatgcatgtaatatttatatgatggataaaagattataaatttaagatgtgatggtagaatttaaaattgtgatagatcaaacttaaaataatcaatagtgcggttttgtgagactttctaggggctcctaatcagcgtgtcggtgatatgggcctgaggatatcaaggctagagggaagaggctaaacccggtactcacgtggcactcctgttgactaccaaatttggtaaattgtgaatcaggttcgacattgggattaaggcggattcgacaaagagatcgattcgaagaatagagtatgcatcggctgcgaaggcatcgactggagtttgcatcggctgagatggattggatagaggacagccaacacagccgatagaggtgatacagccgattccgatgaagatggtttcaaggctgtttctggaatcgatcaaagtgcttcacagggattgccacgatggagataaagctctcagataggcaattatatctattaattaggatatttcatgtaaattccatagagatatgtttgggcaaaaatatgccgcaaagacttatggtatcttaaagtttgttagagataagtgtcgtgtccggcaaggatatatgttgtatctcgggtataaatagagcccgaaaccatgtaatcaaaacaacagttcaatacaatctcggcgcatcaccaccctttttactttcgttttatttcgacgagttcttgctttcgggttgagctgcatcgattcgatcttcaactagaggtaaagtttgttatggcggcttgcattctcggggttaatgcttccatctttatgacactttaatcatgttcatgtaatccatcgagttatcatatacacgctgtaatctagattggttgcgctttataacttgttatcggctgttccttattgttgggaagtgatcgatagggttatgttacgttactaatccaatttatatggtgtatccaccatctcttataggttttcatcatcttgcctagatcttgtacttatttttatgcttaatgctgcatcggttgagttcgatctattaagtaatatttattattatgatatctggcttgttttatgattgtcgagagagatagtatcggggtttcagccgatcttacctgatttagctattctatatcttatatgcttaattgatatgctagatctgccctttatattaagatcttattcgcaataaagtatattaggctcctgtttgatatattatatatgttttaatatcttaatataaagtggtatcggagtattagccgatacatgctagatctatctgatcggctatgctataaacatttatagtcctcatgttaatgtatattttgatctaagtgatttatactgtctcggcatgatgactgatctatcccaatcacttggtttaaatatacatcgatagaaggattgtatatcgttaatatctacagccgatcgagcagatttagtcatatcttgcttgtttacaactactgatcgattcacatatgacatcggcttgaaaataaatgatatgtcatcggcggctggccgatcagctatcgtttatagatttaaccatggtttttcttgtctttgtttcttgttgattgcaggatcaaatcaaccggcatgctcacgaacctaaaagtaagattttggacctgcactgaagttaagcagatcttccaggccagtgtgtgtttttcgcatcaacaattccctcgaggggggtcgcgcccggggtagaacagtgcccgccccctccatgcctaggggtcgggccccgaccccctctgcaggacaccacgtgtacggagttaggtgggcggtcccaacgcctacctaaccgcatttaaggcgacctgagcgggcgcgccatgccgcacttaatgcgacgtgctatgcgcctgactggtctatgaccagtcgagtgaccaatagtaccgagatagtgcgcctgcgcactggtcacatgtcaggcggcgtgccacctaacatgccccgtaatgtcatgatgatcaaaggttttttagtctctcatcctagccggagtcagttcgtctgacctggtcaacgcggggtttccgtttcccggcgcgcatgaggacccagaagtcttcatctattaaatggtaaatgacgcaggcgtcccccgtgtcagccggtgcgatttgatgggccccatgccatggcgcccgtgcttatggcttccaagttaagcgacaagacatgcatttaatgtagagaatgtcctccctcatccctaggtagacttttgggcccatgtggcagccccttgagatataaaaggaggtccaggcctcgtgagggagggagagaaagagaaagattctttggctaactcacactagtgtctcagagattcaagggttgtattccatactcgatcaaccaagcacgtgagtaggcaggggcacagctacaaggggtgccgaagggggccaacacccccctatccgaccccatgcttattgtactaactagcgcattagcatgttaattagtccattattaataaacatggtatagaaaatcaattaataagaaagagacggagagacgatgcaaatcaactcctcgtcatcattgcttcggcttcacacgtctctctgtcctcccattgcgtctcgttattgagcatggtgtctcaagtctcaaactgtcaaacatctaatgatacaactaaaaagctaaattcaagcttttttatggcagaatacattgtgtattgttttatcgtcggtattacttaccttgacttatgacttgttcaccctgcccacaccccctagctataaatcctggcttcgcccctgggagtagagtgttacgcttctcagcggtccgaacctgtatagaccgctcttgtctcatcgttcttgaggggcccgaccccctctacatcacaccttccaccgagtcctcgattctcacccgctgcccccagccgaactaacaagggggccttactatcccccacttgaggaattcaccctctgacacagcgcgtctgcagcaggaggcgacctggtgcgcacatcacgtgcccacgcgggcctagttacgcgcttagcgttaatagcgtttaacattaattatggttttgaatcatttttcgtaataaagtattccctccgtttttggttataagatgttttgactttggtcaaagtcaaactactttaactttgactaagtttgtagagaaaaatagtaacattttcaacccaagacaaatttattatgaaaatatatgcaactattgatttgatgaaactaatttagtattataaatattactatatttgtctataaacttggtcaaatttgaaacagtttgactttaaccaaagttaaaacgtcttataacctgaaacggagggagtaatatataagaaaatcaagttaaaaatttaaaattattagttgaaagtattcatagcttaagttgaaagttttagattttgagttgaaagttttcaaatctaagttaaaagttttaaattttgagttgaaagtttcaaaatttgagctgaaagcttcaaaatccgagttagaagaattcaaaattgagttgatttaaaaaaataaaatagagttgaaagtttttaaggcatcgtatggtatggttgtaatagaatcgtatcaattaatccccataatatttatcattttgaactattctattcatttgcctggtctgtgtcactgtccggccgcttgttatggtgagatatgcttgaaccctctcatgtgtcaaattctatatggtttaacttagatcacaatatcactcatatctaaggtccatacaactattagcgtcttacagcgattgatcaaattttacatatgttgatagaagttagtagcaaatccggcaatgtgcgaagtccaggagatgcctacaccgctgaaattaagcctaagaccaggtaggttgcaaagcctcgagcctttcccatcaatcctaaaatcaagttctaaaaattaaaaaatatcttttgattattatccaaaaactttgccaggtaaattttgaaaataatgattatcattttttcccatgcaaatatgtaaaacttcatgtttagaacgttcaactacgctactctacgtaacaggtacatgactaatcatctcttactataaagtcacatttataaagatgacacatcatcatccactaatctttactattataaaaattaaagatgtttttaccgatactttggtaatcatctgtgtatgagtcgattttaagtccgttcggttttggaaatacatatccatatttgaatcggttttgaagtttgttcacttttgaaaatacaaaaagagttgtataagaaatcactttaaaaaaaactcgcatgctaccttgagacgatcataactgcatatatatgattatatatatatatatatatatatatatatatatatatatccaaacgaattcatcccacattaaatttcactttaattaaacagtataacaataataataagattaaaatatccttcaccagttgaacgcacggatattttttctagtaattattacatttaagtatcatgcaagcatgatatattatctataatttaataatttattaaattttagagatttaaatataaacatgttaaattcacataatatatcaatatatctccattatttttttatatcctatatacctatatacttcctccgtttcacaacgtaaatcattctaacattttccacattcatattgacgttaatgaatctacacatatatatatatatatattcattaacgtcaatatgaatgtaagaaatgctataatgacttacattgtgaaacggagtgagtaggggatcctctagagtccccctgccggcatgca

SEQ ID NO: 11868 - DNA, 7174 bp, Oryza sativa
gtacgagtggcaccaccctcccgcgcatggcgcgtaagcgcaaccgccgcccaagctcgccttcgtcgccaccgccggtggcggcggcagcttggaggcagcgtggtaggcggccgccacccgctgcacgcgctttctcaccctcgtcgtcgtcgtcgccgcggccaccgccaccgtccggccgccgcggcagaacgccggtagcctcctcccggccattgtcccagctagctagctatagctaaagtaagaattgaaggaattgagaagaagctagcagaagaaggtagtggctggagtgatctctggctttttagcgccggtaggcgcacacttatatgcaagtgcgcgcgcaaattagacaattagttatgctagaaacatttaaattatgctaaaacactgactaataaattaattaactcaacttctccttaacactgctgtgtctaagacgtgcagggcgtgaagaagagttgttaggtcgtcgatcacaatacctacagaagttaggatgtgctaacaatcatctaattgtgtcgataatgttaattaaagatcatcagcttatcaagacccaagtttcattgtttacggtcatgatatggatattaattgattatcgtaattatatatatatgcatacattttgcaatggcaagaggggccaattataaatacatacatacaccccgcgtgcgcctgttatctgaatctctgaaaatatatagtgcatggtggtatgtcatatactagctggtagtggtactagaattgattaacatttgtgcacgtataggtctggctaattgccaattggccaaccgcctttattccagcgcgcatgcacaccgatttctccagcaaccaacgaccagcctgcgtttaggttgtctctagttggaaacaatgttctactattagatactacacgttgctaaggagcaaaaacaaacccgatacctgaaacacccaactccgtccacgtctttaggctggagaggaagagggtgcatgagaagatgaaaccactccccccctaaccagcccatcaacatggtcatcttgtagtggctcaccgacaccaaaagagacaccagcattgagaggtttgaaagggaatggatcttttgaaatgacgcattcaggaatgttacaacaccaagaaagccaccatcgttcgtcttgaaactaagacgtggttttcacttgaagagatccaccagaaatagaaagagagattacacaacaatgtcctagtagggtttgatgaagaagtaggtcgcgatcttcctattggtattggataagtcgattgtggagcctcaacattgatgatcccaaggctccgaccatatagatcgaacccctcacaattactgcaccactcctccattggctatcacctgagttgaaacacggttaacctcgccgataaggttatctcctataagcaaatcgggaacacaagcaagagagtagaagatacgatctgaatatattgcggatataagatgaatgtcacaaatggcagaataatcgaagcaaaacccaaccctagttcgacgatggctactgaataaatatgttctaggatcgaccgatgacccctggatgcgtcccaaatggactccaacacaatacatggcccaatgggtttaaagacaatggcgcaacacccggatagattttggaggctctcttgttcaacatttcccattgacttagaagatgtttttgccgtgagaccagaccctttaggaaggtagtcccgttagctttcaatacatatgtaaaatgtcaaaaaaagagttcggatgagctctgggcaatgatttagtgtgggctggtcctggatttcgggttgactctaacttgatatgaatttggcctccatcttctagcatctccaagtgcttcctgatcccccccctcatatgtatccagaggtgtgatgccctcaccaaagttacaacgtccataagtgtcgccattgttagcctcgaataggctagacttttgccataaaccttctaccctctcatgtcaaagcacctttagcgtggaaccatcgtgccaacgccacgctgccaactgaccattaggtagggcttgacatttgcaagccaccctacgccaaactcacttcccacgttgttgccgccttaggcaaactaatcgcttcatcatcaccccatgatgttgttgcctcttattgtgttgtcccatgccatcgcccgcccgcccacctcctaggtcaaggcttgcgcctcttggctcccgtgctacaatggcttgccagccaatctcaccaagacaagaaggggtgagtcgcaccaccatgctgggagggtccaactacacgtagtcatcgccacctccctgtgtgccatcatcagttacgatacctctagcccgcatcatcgccaccctctcgtcatatcatggcaccttggccatgcactgccacacagtggatctgaccatcaccaagttcgctctcccggtgtcccaaaccagttgcattggctagatcctcattgccacaacctccaccagtgcacaacctctatctgtgccaccctatctgccacgtcgcactagcttcatctataccccccaagcattgcaccacattctagcccacgcctctagggttttcccccctacttccttcatagctcacgacgcaacttactaacggcttgctctggtggtggcgaggccagaggtggatgagttgggggcactagaggcggctagggcccacatgggggtgacacaagtgcgaggggaaaagttacacagtaaatagggaattttcaagccattcttgttgccaatgcttctcatcgggttgtcatcattaccctctcctgtcctcctgactatcgcttccctccccctactcctcctttttatacgtatcattgccgattttatcggattaattttcctttatctccttttccatctccaatggttttggcactagatatgccattgctgcctgtcataagttactctcggcacttggtattggcctattgtccttctttagcatatgacttggatatgggaccatcatttcctttccttgctgctacttaggccttagcaatacctctctaaacccatcgtctctaccaaccctaccaccctcccgttccatccctataaccctagtgtggtaaagccattagcaagtccttgctagctatcattataagaaagagaaggtgcacactagagtttatcggggtacaaatttgagggtaaacacaacactagaatgcttattcacgcatatgcaccatgggcacacacttctggccacaccggcccaaccctggagaccgatgaccgaaccattgttgtcttctcgagttctcgctctttcccaacttcctctcattcgactcctcgtcgccttcacaccttgttgcggtcatcgttcctgttgcgctgctagtgcctggagtcggtgcccagccatggtctccatccctctcattctccctcatcctttctattttatccgcccttagctcatctaggggtggcattttccctcatcctttctatttcatccgcccttagctcatctaggggtggcatttgccctgttggggccggggatccggcgaggacctgcccctatgggaccaagagtgggggagaattttcacccacgggtgagtaggggcggggccccgacttcgtgcgtggctagggccgagtcagcttcttcacccgctggtcatacataggggcccggaagtatagaaacaagggttaatttgatccatgccacttcgaatttgccctattgaaaaaataccattatgattcatgaaatcttctatgtgccactaaaattttataaaatttgaaatgttccattgccatcaagatttctatgagcaccccgtccaagtctcttctttccccacctgctagtggtgtccaccgatggcataggtagagaagcaaggagacggcggtgctatccttcccgttgctaccagttcgtggagtcgtgatggccaccaatggcatcggcagaaaagttgggaggagctaggcctcgacagaggcttagggtcgtcctcacagaggagccagaccactcctgcccatcagcacccatgcctatcatattggcagggcctttagaagtagtgcgggagctagggtaggtgctggtgtggcggtgggagtggccggagcgatgacgaacggcgagatgtccttggcctctatttagtcagatctaacgtgcgatgatgttctctattagtagcaggttggtagtggtagtggtgcaaaagaaaacaacaaagaatcgctttgactagctcagccggcaaactgagctcataggccatgcctttatttctttcgtccatcttatcaactgcactctacaaggccaggcgaccacttgcaagattagctgcgaattaagaaagaaaacgctcccgaattaaactactcccctcatagcattcagaacctgccgtagctgccggccacttcgtgctattcacgccggagttggagaagaacaaaggagagagaatgaggatgtgaaaagaaaggacaatttggatatttttttttgcgctaagacggagatgttgacaaaaatgttgacgacaatcgaacggttcgaattttacaaaatttcagtggcatgtagaagatttcacgaatagtaatggtatttttgcaatatgacaactttgcaatggcatggatcaaattaaccctagaaataatgttgtccactagcagtctaaagcccatcggaaacaacccatacgtagtagccataaaaagcctagcaagtatatcttgtgcaacccattagagaagataaaattaaaacacaaagtaaaccctaacccatctcaacaaatccacaacgaacgtatcgttcccaacagcagcggctcaccatagtgcattagtgtgacgctcatatgaaaaaaaaatcatgcgaggctgcaacgagggacacacgccgcgtcgctcatcagcttcaccacaccctgctagtgcccatcgaggctccacgctgcattcacatcaccgctctcagtcacaggcgctcaggtgcgcggctccatgctgctccatgtggtatcccccatctcgccggccggccactactccttgcgtcgttctactccctcttcctccgattgtaggtgccccatgcattctcctctccctctggctgccaccggcaactaccgctagcactgagtgtgtgggacccaggatgagtgagggccccagaggggccgggccggggacaaatttcgctccattcttcaatccggggctacaacagggtttacctggaaccatagttattaagactggaccggtaattgaaccggtgaggctcttggttcaatggttcacaggttcaaatggttgaaccgttggcttaatccggttcaataactcttaaatatattaagcattctatctatacacaagtaacatgatagtttggtggttggggtgtttacttcctcccatgtggtcctgggttcgaatcccacccatgcacattttcgctcattttccccccaacagcagccgccaagcccggtttgaagcggttttattccctggtttaatggcggtttttctccaaaaccgggcggtctaaccggttcatcgccgcttcgattgcatgttggtcttttacctggaccggaccggtcgaggctctggttccggttatttccggtccggtccggtcttaataactaggcccatgcacattttcgctcgttttccccccaacagcacccatgcgcgcgtacagcagccgccaagcccggttggaagcggttttattccccagtttaatggcagtttttctccaaaaccgggtggtctaaccggttcattgctggttcgattgcatgtcggtcttttacctggaccggaccggtcgtggctctggttccggttttttccggtccgaccatcggtccagtccggttttaataactaggcctggaacgaagcgggggtagggtcgttcttgtccaaacctagccccgtcccgccccattgccaaccctaagctcattccaccatgtagtgggacaccctagcttctcaaccctagtccttggggatgtcgcaactgtggtggcagctgaggttgggaaggtggcaatatggcagcaacgacaacggtggttgaggttgggaagacggcgaagtagccatgctggcggtggcaaccaggatgttgtggaaactgaggttgaagacgaagatggatttgagtatttagatgaaatactctatgtctaaaccgaaagttttgtggattttagaagaatgtttaagactttgcattgaaagtttgtgtgattttaggatgaaagatttagatatttaattgaaattattttctatttttgttatgaaagtgttagacttgatataagagttttagacttgaggagaaaggtttgcttaacttaggatgaaagttttcagacttgatttgaaagtttttgtgatttaagatgaaattttcatattgttaaattgaaagtttgtgattcttacataaaaattcggacgacttatctttgatgtatgaatcgaattctcatggcatgaagcccaatggggacaattgtgtgcgccgcgcactactacacaaatgatttttccagatgagcaccccaatagattttagatgagccataagtgtccgtatctacaaaaatctacccgcatttttcatacgactgcttaagaggaccgtatgcaaaaatcaatttacgcaaacggacctcttgagaaggactgcattgtgaaaataagggtattttcatatgcgggcctcataagtcacccgcatgcaaaaatactccctcctcttaccattattttttaattctccccacctccctctctcccaccacctactcctctcccgtctctctctctctctctcccaccacccgctcctcctatccctactccacatctccccacctcctctccccactcctcctatgcccaccttctttcccctctcctccctcccgacggtaggctcccatagcgggtgcgacgtcaagcaagggtgaccgcgatgcgaggatgaccgtgacaacgggcgttctgg

SEQ ID NO: 11869 - DNA, 8892 bp, Oryza sativa
  unsure (1)..(8892): unsure at all n locations
ctctcacatatacattgctgaactatatgtccatatttttttaagactatatatatataattatatggccgtctgatccctacgtcctttatgtgagtgtacaatgtcacggaaactatatattctctctcatcgtacttcgcttcctcgttctaatctcgttttcattcatttgaaacggactacgttatggatatgattctctcttctcataatgatgcgatgtgaaaattttcaagcaattaatgttgactagcgaatctagctaattaattaacgacgttattggttggaagaggagatactgcagaagattagtttacaggcccacaatcacggaggtgatgagatgatctgattttaattaatttgatcttcgttagacaaatgcttggccttttgttctctttttccttggcgctagtcctgtctatcaagaggacttctatcaccccatatgaatgatgcataacccccaatcattcgttcagagaacaaaaatataacaaaaagaaaacgtaaaatctatttggaggcctctcgtttttaccttaaccagtgacgcctaaatatggagaagacgtggagtctactacatcgtactcgtactacatgcatgcatttttttaacgggatggctatttggcagtcacatgttttttcttggctctatcgttcgttttttaagccatcggatttctttgtgattcgtactggcttgtagttcattttgtagtatcggtgtgtgggcttatgagctttttatttgtgtctaggcttttgggcttttttttttgtgtgtggtaattatgtgggacccacatcagaaatttttttcgacagcctgtgtgggacccatgggcactgttcgaattttgaaatccgcgcttgtcttttttgtgccgacggagagagagtgagtcagatagagggagagagagagatatatttctctcgttctcgtcgtctcaggcgacgtggcagcgattccgtcgggcggagcggcggagtttccgtcgggaggagcggtggcgattccgtccggtgattgtgcagtcctgttgcgcagtttgcgggaggtgaaggtggcagatttattttccattttttattgatttcttcttctatttgttgctcttgtgttgattcatctcttcatttttctcttctcgtagtttttggtttgctggtggctacgacgcggctgtgaagttggagctgattttggtgagtttccccttcgtttttctgatattcccttgtgttttaggtcgtcgattcgtggggcttgtagatctgagtttgtttcgactcggaatctatgtatgtgtttgatatggtgaatccccttgattcatattcgtttatgactcggtgatctctgtgttcttagccctatatattgtcttcttgtgcactagatctgcgcttttgcttttgtgaactagttacgtgcttttttattttgttctagaactgtgttttttgcttttttctgaactagatgtgtgcaaataagggagtaatgtacatatgttcacctatctatatgcactgattgtttttttagtaatgcattcaggatgtttttattctagaaatctgcaaatgctatatgttaattcaatgacaaccttatatgagcagttaaatttgttattgatattatcaattgttttttgcatgactaagatatgctggtttgtactaagtttcaagttttatgtctttattagaatggtatttatggttgttaattttttttgtctctgatgcatgttccatgttcaggttcagtattcaaaatgagaaaagtactgttatgtttatggttgtgatttgtgttcttagccctagatattgtttatgtggactagatgtgtgattcatttcattttagatatatctttttatgattgcttttttacatttgtgaactagatctgtgcttttgcttttgtgaactagatgtgtgcaatgtacatttgttgacccttctgtatatccttgatttgcatgttctgtgcactgattgattttgtagtaatgctttgatgtcagtttctaaatctatgcaagaaaatgctatatgctatttaggtggatgtttatgcactgattcaggatgtttttttttctagaaatccacaaatgctatatgccatttgcattttagtttggtatttttaatctttcaatgacaaccttacatgaggaaataacacaagttattgaagatttctgtactagaatgttttttatagtagtcaatttttgtctcttcattttgcatgctcaggtttagtattcagaaggagaagagtattgttaatacatttgttcagaaggagaagagtatagtattcctagtcatcactatactctgatatatgacatgagtttgtgctacacatttgacactactctatgaaaataattatttctactatatgaaagtaatattattttcatatgacatggtgcatttaacttgtatgttttattctgttttgttatatattttagtccataatacttatgttttgagatcttttttctctccttgcagtcatgggtcatagaaaaagatcaaaagttgatatttctagtgaatctaacagtgacaatgattgtagtttgagttctgataatcatgatagtgatgttcatttatctaatcatgatgaaagttctgataatcatgtaagttcatttgtcatgttcatttatcatggaagtttattttttatttcaatattttttttgaatcttcttgtttttttattaaggaccaacattttgaggaaaatgatcctttgcttcatttaactaaagaagagcttatgaagaaattgaaaataaagcttggtaaaaggccatttacagatgaccataaaaagaaggtatgattaatgcatatttagatttttgtaatttacattatttttttaatatgatatttttttattttcagagacataaagttgaatcagactcaattatcgatgatgcattgttagagattcacaatgatctagttctccattctttgaaaatgaaattaagcatgcttggtgaacagtctaaaaataaggtaattttattaccttattacattggtgaataattttttctttagtttttttaatttcttttctttaaatttttttggcagagaaaaacctttgagaaagataaccaacaagggtgtgttctgactgattgcaaattattgttttatatgatcatgatctttaattttttatagtttttgatatgctatgggataagcttgacacttttatatttacttgctgaacatttagctgtgattgaatgcttgtgcaagcatgtgctgctccatgttagaatgtctgcatactttttttttcttgcaaaattaactgtaactttaaatattttttcatgtaatttttttcagtttcttcatatatgtaagttttgtactgttactgcagtcaagaaactgttaatattgatggagttcactgcaaattctcatcttttggttcttcattcaaacaaggtggagaattatcaaattttgtaatgtctgtgttctgtcgatatatgtttaaatcgattcatccttcaaaatccaaaagacactatttcttctcttcaattggggtaagtgtttgtaatttttaatttttttattaaatacaactcagttacttgcaaattgagtatgtattttttttatttcagaatgatcttatgaaacacccttcaaaaactaattttggaatggtccaaaagagtttttctggagcatcacttgctagaccaattgagatatgtgacatggtatgtacttatgtaatgtttaattgaattagtttgtattagatttctctgtttttacatttgtttttattgtatcatttttttcagctgtttttcccaatattgcatttgaggcattggtttctgtttgttgttgatttgaaagatgagagttttgttttcattgactccttatttgaagaagaagaagaagactatcaatacaatgctagatgcagactggtatgattttttttttgcaaattattatatgtatagaataatttatttttatgattgtttcattttgtcatatatcaaaattttcaattgtatggaggaaatttgtccctgaacatccaattaactttgctagtttcaagataatatacccccctcgtccaagacaaacaaatcggtaaattacaaatgttaactctttgaatgttattttaattctagtaatttttattatttatgacttatgttttttttatttctgtttttttagccttgattgtggtatttttactctgaaattcatggaaatttggcgtccaagagttctgctaaccaaccagttctctcaaaaagacattcctaacataaggattcaatatgtcaacaaattgtttttccatccatgcaacattgtgctgaactctgcaacaaagaaacttgttactgactattatgcaaaggtaagtagtcattttaactttttttaaaaaatatgtttttaaattttttttcttctgttacctttacatttagctttttttttctttttttttgtagggctgatttaattcaacaggaatactttgaaaaccaagattactttagctcaacagtttatagtagatttgtatagatacaatttctgcgccatattgtaactattatagtaagataacaacttgaaaggtcacatcacaaaaagtaccaaacttcatatattgtaactattctgaacgactattacaattgttcactacgcaggaatataacttctcatattcagtataactattttctgcttcactactttctaacttcaactttagccatctgtctttcttttcttagtccctttttgctccattaatacttgtgttgttgcttcttgttttttccctttatttgtcttctttgaaccatcagtttgttcttcctctgcattctgcaattgcaatcaaattcaaattaaatattttaaatcaaatgagaattcttaaaataaatacttttttaccttttgtgctgtgttttttgtctttctaattttctttcttggcaaatcaaattcaatgtgctttagtgggcatgttggaaaagtgtgatctgttcgttgacaataactgcaatgataaacttctttactctgtaattcctctctaaatgatttgtatctttgagatggtcttccctttgactttgctatgtctggatctatcaaaatttcttcattgttttcttctgtttcttcaatgacttctccatttgttgtatctattttgtctatctccatttgctgctttgttctttgctctgaattcattgatattgattctttttctaacttgtcaatctgatcaactgtaaattggaacgaatcaatactttttgatccttgtgaggctatttcagcacatttccttgacagaatattgaatctgaggattgagctctccgataaaggtataattctatcttcaaaatcatatttttctttgtaatccttttttctccaccgatcgataatatatttctttggaatcttcataatgttgaggtgaagcataattttcaatatgtgggagcaaagaaggccatctttctcaaattttgagcaaatacaagtgtattcctccttttcagagtcaacaattacaaggtacttccttcttcttactacttttattttctgattcaatgcaagaaaaacttcataagtcttcaatttctcgacctcaatcaattgtaatcttgttgtcctcttaagttcaacttggaactttttgaatatttttgaattgtacagcttgacagcttggtactcaatgtagtaatgagaccaaagtttgcttggcctttttgtccttgaattatgatcatctagctgctccaaattctgaatagtgtccattactctgacatattctatcaaaaagcttattatactgtattgtggaccaacatctttcttaaaccttgaatttgtaccttcacttagagctgtgctttttatgaatggacaaaaatttgttttgaagtatactggtatgaatctctttctaattgaccacatgtgcttcaaaaagtagatgtgctgaacctcataggaatcaaccatttcattccacaaatattcaaattcttcttcagtaactgaattgttcattatatcctcatactcatcatacaacccttcttttgacttgaacaaagttccagacagattgaatgctttccttactatatgaaagaagcaattcctatgtgttgaatttggaaaaatctgtcttattgctgacctcatagctccgtcctgatcagttataattgttttttatgctttttctgacattgctttcaaaaaagttatgaacaaccatttaaatgtttctgcagtctcatcatgcagaaaggcacacccaaaaacaattgtatttccatgtcatgaaatcccaacaaatggagcaaatggaagattgtatctatttgtgaaatatgttgtatcaaaactaacaacatctccatacttctcgtactagtcaattgaccttccatcagtccaaaacaaatttgtcaccttcttattctcatccaaatcaaattcataaaagaactttggatctttcccttcttctttctgaaaaattgaagaacttgcatcatatcattgctacttgtctctttatttatacaagttctcacattactaacatccttcttagtataaggcaaagatgtcagccctcctctcaaagttgacaaaatcacaatcatatgccttgtgggaatattgcattcctttagtgtccttatcatcattttctcttctgttgtcatatttttgtgtgacttcaagaatctaacttcatctcttggactcatcttatgattgtgatctaaattaacccttataattctccaaatcaaatttctcttagaaattaccagtgcacagttacaacttgtggctttaatctcattattgtttctctctgctactactgtctcttctgtttcttcttcttgtgattctgactttgcttttccatgtcgattgcatttgaatgttactctaatcacttctccattcctttttttgcttgtactgtggtaactgtgagcaatgacaacagaaaatccagccaacaaagcataaaagttaaagaaatcgtgtgcttctttaattgatttgaactgcatatcaactcttggaatgtacttcgcatcaattgctgcattatttccttttgtagcttcttcttgttcttgctccaaaaaattgtgtatatcttcttctgtcaacatttctccatttgcatctaaatcattactttccactgtatcaacatttgttgttgcttgatttccaatttcagtactgttgtcagctgaattttgcacctgcttattcaaaaattcaatttcatatttcaaacaattattttttaaaaagtttttttctttaatttcacaacaattattatcaaatcaaattttatcttttagatttgaataacattcttcaaatgtaaaattttcagtaatgaaaagttcttagtaaatcttacattttgaccgtttgacagattgaacatatcaagattccaattttccaattcattatcttccagatcctcatcttcaacctttaaaaatagttagaacaaataatatcataagtaaactcaaacattaattgtatcacaaatacgatttatagaaacaaaaaaataaattaattcatacctgatttgtattagcataatccatatcaaaaggaatatcttatgttctacttgttgtcaatatcattgaattctacacaaaaagtaattcaaataataagacaattatttaaaatttaatacatatttactattttctttcttcttatgaaatatgtgagtacctgaaatgctcttggtgtagcaacaaagtttgattctgttgatatttcttgctgcatttgaaatttaaaatgttagttttacacattaataatattgtttatctgtcttcaacattacatttattacacttgtaaaatacctgaacttcagatattgaaggttgagatgatataatttgttccatgagacttgtatatgaaaaattttgagcctgcaaattgaaaacaaatttattttatgacatgtattgctgatttttgtttgatattataaattctgtcattccaaaacttactcctaaaagagaccattcatcatgtagagtacaattgttgtactcatcacttgaatttgttttttctctatttaatttcatcttgtcgttgatgcttatttcttcttgagatgcctgcaaataaacataactcaaaatataaacataactcattactcattactcattttagtctctgcatataaacataactcaaaatatgaaagtaatgatttgttttctctgaatttttcagatttgctgcagagtccaacaaaattaaataaaaggtaaatcaaattgctttacttgtttatatgaaatatatactgcttctaggagttacatgtatgttcaactctatttgcagtgttaattctatgtttttttttaatttttggactgtaatttgtttttatgttgattactagacatatatatgaatattaagaccattaagactgtgcaaatacacaatatcactctgtgatatttttttaactaaagtgttaatttttttcattagttacagtgaactaatattggaattacagtgtttcttaactgtaattttaattttatttcactgtaacttatttnnnnnnnnnnnnnnnnnnnnnnnnnnnnnnnnnnnnnnnnnnnnnnnnnnnnnnnnnnnnn

SEQ ID NO: 11870 - DNA, 13777 bp, Oryza sativa
atatgaaatatatactgcttctaggagttacatgtatgttcaactctatttgcagtgttaattctatgtttttttttaatttttggactgtaatttgtttttatgttgattactagacatatatatgaatattaagaccattaagactgtgcaaatacacaatatcactctgtgatatttttttaactaaagtgttaatttttttcattagttacagtgaactaatattggaattacagtgtttcttaactgtaattttaattttatttcactgtaacttatttgaaaattataatatctacatagtaaatgagtgtctgcatatttatttgtaaatgaaattgtttatgtcatcatgaaatcactaattatctatttttgacagatattttgacaatatatgattcaaaccagctaaattttattttaactatgatgttttgtctaaatgtgatctttgcagattatatttgaaactaattatgtttcttacctgaaatcaatgtatttgcgttatgttctgtcaaaactaattgagtcatattctgaatgtttccatgctgaatgcttctttctgcatctttgttatctttgtttcctgcagaacataatttgtaatataattcaaatcagtacatcagtaattaaatttgacatatatagatatatccaaagaaagaaagatataactcaaagtggtaatagtacctgtatccaaagaaatacttcttcctgcttcatagaaattaaaaatataataagttatttcactgtgatatttggagaatatctagatgtaacaaatattcaaattaaaattcacctataatctctgtatccatagaaatgcttctccctgcttgtccattatatttgtttcctgcaaaaaacagaaggtttaaaacacaagaatataatttgcagtgaactaatactagaattacagtcatttttatatgtaattttattttgaagggagaagcattgatttgtgcttgtattttaaagttttaggccagtgatgaatctctatttagtattagtttcagcgaaaatatcttttttgccaactctgaaatttatctttatattaaatatcaattttttttattgtcctctgtgttgtttgtttacttgtctaagagcaccaataataaagaaaatcttctcatcatcataggcgaaatttttgccttcacttgtcaagcacctttttacctttgcttttcccaaaattagtccatcatccttgtacttcaaattaacatctgtaaagcaaaataatctagtgtactagcttctttttgtttttatatatgctaatttgaagtgcaagaattatatactagtttttgagaatggtgcatgtaaaaaggtgcttgacaatctatagctaactaattcttttgagcttgcaaaattgataaaaattttgcctatgtgaatattgaaaaaaattatagtctaatactaagaaatgtccattttttttgtactaattgaagtggacaatttctgaggccatatatatgatatttttttgtttttgtatacctttttttgtgtctaaagaaatgcttctccctgattgtccattatctttgtttcctgaaaaaaacagaaggtttaaaacacaagattataaattacagtgaactaatactagaattacatttatttttatatgtaattttattactatttaactataatttgtttcaatttgctgatttcagcaccaatttttaattgtgaaattaaatagtttttgaattgaattcagtaccattgtacagcttagtgtttttgttttttattagattcagctgaagtgtttcagcttagttttttgcttatttttctctctgcatttcttctatgcttggagtactaataacctgttatgtgcttgatgaatctgaaacaatttcaatttgaaaataaaactgccttagatttaaagttccctgtatttacatgcatattgaactaaaattacagtgttctttcgtatatgtttttattattctttcactgtaacttgtttgaaaattgttaaatgactgaaaataatgtaagcaaatcttaattttgcttctcaccaggcaagaaaataatttatacctgttcttgattcttgtctattcactttggtggtgtattccttgtgaattccttctgcatttgctggaacttgagtcatatctgcacaatcattgacgttacgttttagtcaatactagacatttcatttttgctttgaattacttttttttagatttgttgtatagtccttataatgttgtaatgaatagtaataaaatttgcttttagttgttgatttgatatgaaatatgtactgcttctagaagttacatgtttgttgaactaaatttacagtgttccttctatgtaattttataaatatttgactgtaactagtttgtatattgatttgtagacaaatatgtgaaaattaagaccattatgtgctcttttgaatatactgctatcatgcaaatacacaatttcactctatgataattggtgatttctaaaatatttgaaatgaaacaaaaataaaagtcaagtatgaggaatacatacctttggaagtgtcttttgattttacttgttcatttgtctccatttcctgtatgcttgaagaaccgatgacttgttctatgcttgatgaatctgaaaccatttcaatttgaaaataaaactgccttagatcatgcttttgttagaatttgtacagtgtttcctgcagttacatgcatattgaactaaaattacagtgttcttttgtatgtatttttattattctttcactgtaacttgtttgaaaattgttaaatgactgaaaataatgtaagcaaatcttaattttgcttctcatcaggcaagaaaataatttatacctgttcttgattcttttctgatcactttggtggtgtattccttgtgaaattcttctgcatttgctgaaacttgagtcatatctgcacaatcattgacagtacattcagattgactatatgagttcatattagaacagattcacactattcaccattctgaaaatttcagtgatttgcccagttctaaaatgacagttacagtgatttgcccaatttacttacagtggtcagatttactttcagattgactctatttagttcatattagaatagattcatttttttagatctaatcagtttctacatttctaacctcattaacttttctttacagatctgatcaaacaaattccaaaagaagaatcaaattctgaaaagaaccaagcaggtaatatttggagaatttttctgttcactcacctttgttcttcttggacttgtcttttgtgctctttctgctcttcgattcttttttttggagttctttggattgacctttagtaccagtttctttgatagatttgatattctttcctgacatttccttcttttctggatcttgatcttttcctaagcgtatctttctcttcttgatctcttctgaattcatcttgattttggattgatgttttgggggatctttctcttcctctagctccatctccctagtataatatggattgttgcggcgtgtgttgtgtgatctctttggaaagaggtggtcctagttgtgatctgtaatagttagctgtcatcacatgcccatcaacttggattgcaagctttctaaatatgtttgttttgtgggctctgtttgatcacgtgcctttgtctctgtttttctagggacctttttagactttattgtgggcttgtcaatttgtttttaagatagatgggcttttttggcctgtattggtctcaaaaaaataaatctagacttttataatatgttattgtagcagtttttgtgagttgttagatgtaaatcgtgtggtacagaaatctgactgaaataggacacaaaaaacatgcgtttgcagtatagaccgtccctttttttaatagacatgcatgtatttttcctcttcaaacaaagttttctctcaaattatttatccgatctacaatccaattacaccattgtgttcgttacaattaaatcttcgtaacaagatcttacattattatattatgatgaaaaaatatttatatttataaattacttttattatatatgtaagttacttttatcatgtgtataagttacttttagatttaactaaattacttcttagacatatacaagtaaattcaataaagtctaaaagtaatgcacatatatattataaaagtaacttaaaaacaaaacggaagtaactttgtcacgacattagaagtaaattcgttgtagggataaaaatatgacttcacgtccaatgaaaaaaggcattcattaaagttactttctttttattataagttacttccataatatatgtaaattacttttagtctttattaaatttacttttatatgtctaagaagtaatttggtgaaatctaaaagtaatttagatatatgataaaagtaatttataatttttcatcaaaatataatcatggaagatcttgttataaagaattagttgtgacgaacacaacggtgcaattggatcgtatcggatgagtagtttaagagaaaattacatttaaagtataagtggataatatctctcttaaatggagtggtagctggctaccactagcctagctgtctagtcacgtccgaaagaaaagtatgagctgccgaaattcccacgtgctttctaaaatgcacagcgacggcgtctagggggacacggcaaaatttcccatgttacggtcaggtcaaaattagctttcctttttttaggatcgtgtgtcgaattgttggttgatccaggctaatatctaaggccgagtgcatttctcttcagtggacgagttatctaagttggatatgtctctgagtttcacagctggtactgtacaagagtagagaaaagccccatacataaggtgatgatgcctctgagtttcacttcccaaagccctaattcttagcttcaagatgcccgagaactgcctctcctcacaccttaaaaaaaaaaaaggcccgagaacttcacctattatagaaagcgcctcgaaagaagaaaacactaaaattatgtagtaatattaatattagaaatcatgtgattatgtcttaggctaaggtacatatagagataatgaagttaggtcctacatatatccctctgtttttttaaatatttgacaccgttaactttttagcacatatttaacgctcatcttattaaaaacttttatgaaatatgtaaaactatatgtatacatataagtatatttaacaatgaatcaaataacttaattttttaaataagacaaacggtcaaacatatttaaaaaagtcaacggcatcaaatatttagaaatggaaagagtataacaaaactataacaaatctttaatgtacagtagtgtaagcatccacatcaatatgagtaggtaacccacgaatttagtgtgttaagggggaagctactgccatcaatatagtactaccttggtctaaaaagaaattgtatttttttactgttcgtatttatagccatagctgaagagagagagagagagtggtaatagtatatatatactcccttcgtcaaaaaagactcaattcctaagttttggtgtttaatgtttgaccgtccgtcttatatgaatttttttatgattagtattttcattattgttagatgataaaatatgaataatactttatgcataacttatctttttaaatttttttataattttttatataagtcaaacggttaaacgttagacacggaaacgcaggaatttagttctttttttactgagagagtactccgtataaagcaaaattccatgaaaccatcgaattaagttaaccggccgccatcaaaattaattgatgagggcccctttgttttcatgaggtcaggtgccgggcacgttgaagtctgactgccgaaattgagtttttgtcctcatcattaattagtactccatccgtttcacaatgtaaaccattctaacatttttaacattcatattaatgttaatgaatctagacatatatatctatatagattcgttaacatcaatatgaatatggaaaatattagaatgatttatattgtgaaacggaggaagtaatagatcctaactccacagatgataaattgatgttacgtgctgctaattgttgtctgaaagctacagttttaattaacaattcactttggttagtccaattctgatccacaactttcttgcacggtcctacacatcagtctagataattcataatctaggatcggattgaatggcatggcctgctgatttaattaaggggacaaccggccggcaatattacgatggtacgttgtcaaagaatagaaagggatcgtccctgcatgcactgcttcagaaaatgatgagctttgtcaagatccattcgtcgtaaacgttcttcaattcactgcctatgtatacgtgaggacttttactgtacgttttactgcgtgtatatacttgcagtatatagaagggtatgtttggtatttgttaaaaatttaaaatgggttgtttagtcatttgaaattgagatttattttcatcaagagtaattgtccataggaagtaattgtcctggatctcgtcatctgttcgtgctagcgcttcttttgaatgtatcgtgcatccccggcacccttgcctcccgtcccggcgcctccatcccgattcctttaggctaggaagccaaaagaagccgagcctttatgcgcctagcgtctcctgtgtccctggaccccggcgccttgcctctcccccgcatccaacctcccacagcttctgtgttccccaacccacgctgcctccccccgtctcacatatctagcctggcctcattgccctgcctgccctgacgccgctgagtgtctacacaagcttagacttctggtaagacacggacctatatttggtataactgtaatgattaattttcgcaatggttgttttgttctgcaatttaaggtgtgcttaactttcatgtcgatatgaaaatttgctgtcacattaagaaaaagaggtgggatttaatcttgttgattgactttgtatttagaagatctgcctacgaacactaggctgtctttgatgagagaagtaggatgaaaatctgtaactagaatcgcattaaacctaggtgtatagctagatgagtgagctatgtcaaattaatgtcacagagctgtaaattgtgctacttaaatttagtaaaaattaaggtattatccatatatgtcataaagctggttccattgaacgtttatatattgcaagttgtcataaatcatttgttttaacatttgccaatagttcgtcaagcctttattactttgtagtttgtaggatgtttttcacaaaataattttatcattattcttacatccatttttctatttgtgatgtgatctgtgtgtgacacaactcgtctttgtaactacttgatttatgtgaagacttgcaaattttaatatatttttgtaagtgatgtatgaaacgcaagatgttaattttattttaaaatatgctgatatggttcatctctctgtctatgattactatgtacgtattgacagtggcacacaatggctgagaacgaagttagcttggaggagatggaggagtataacatggttgctagtaagcattttagaagcgagtaagatggttacaagttttacaatgaatatgcaaggtgtaaaggttttagtattagaagagacaaagtgaagcaatttagtggtaccgagcttgtcttctagaggtgattttagcaagtatatttacaatagtttgttgtgaacatttgtgcgtgtaccgttttgtgcaatacactccattatcaggtagtcgatcataccttcatgctgctactatgaactcctatcaacacctgacccattcgaactctcttaaggttttagaattggtaaaaaaaagtaagacgtcctcttttctatcgtttcttctcttacatactccctccgtcccataaaaaatcaacttctggctataaatctagacacacgctacgtctagattcgtaaccagaagctggttttttatgggacggagggagtaagtagtattggtgcggaaaagctaattggcgaacgattgccctccggcctctgcgatcactttctttacgcattctcattccatattccttccgccactggttcggactgagcatgttttcggcgttggagagacgagccatgtcaggctacccatgcactttttttttcttttgttacttgacttttctattgcgtgcatgcaaggtggacccacaccatatatttttaagtttgcatgtagtttacaaatactacttaacctacatctttctatttttttccatttaggggcatatagaaagtttatatattctttttacatatttttttatttttaaaattcattcatacacttttttaaaaaatcaatatcaaaaagtttatatgtgcaaagttcatatataaaaatttaccatgtataaagttaccatgtgtataaactttccgtgcagaaagttgcaatgtataaagttagtatataaaatgtttatatagataaaattactatgtatgataaattagtagtatatgtattgggctatagtctaagcccacataaaacatgtacatagataagagaactctggatgagaaagaaaaaaaaaatacttgagctagtgggcctggaaaggtttttgcacgtgggctagagaacatggattcaggggttgttgcgtctgtcatgcgcacacgaaaacgccaaaaaatgaaatagcgagagaagccgacacgtgcagatgtaataggtcttgacatgtccgccgtactagacccacccatgttggtggggctcgggcccaatcccacctaggattatgttgtgttatgattgttactgattccaattataagtaagtcgactacaccatggacaaattatattctcccttctatttattttggtaccacacaaaaacaatgaatgccaacaaaagcatggcattttgatttgatttaaggtcactacattttagccaaattgattaggatcctctgactttggagaatgctccagatcagtataccgatctatccggcactgtaaccaactaattatcctactgtttttcctactcaatccatccatacatgtatatattgtttttcaaaatatattttctcctaaagtacttatccaatttacgatacaattgcaccatcatgctcgtgttaattaaatctttatgatagaatatcacatgattatattccgataaaagaaaaacatatgttttaaaccgttaaaagtgaatgtttcatacattacagctatatgtttccgtgtgtttttagcgtgttttaaagtttacgtaacaacgtctttcacactctctctctcttgtcttgtactatttgcacactctctctttccattttagatctttaaaatattttttcttctaaactacttatccaatatgtgatccaatcacaccattatatttgttgtagttaaatctttacaataagatatcacatgactatattctaatgaacgaaatacatatgttttataccgttaagacttattgtttcatacatgacagcagcatgtttcaatgtgtgttttcactataggcttggtttagttccaaactttttcttcgaacttccaacttttccatcacatcaaaactttcctacacacacaactttcaacttttccatcacatcgttccaatttcaactaaacttctaattttagcgtgaactaaacacacccgtactttaaaaaaagtcaatgtttcagttactaattttttttcaccatgtataacttaatgtttcacctaatggttaagtgaagtatttaaccacctgatttagagggaatcgaacgtccgatttggagttcactcctcagacttttagttgaatataaaggcataggtgaattaagtcgaacttaatttgggatattttccgatatccaattcacaaggaattaataaggccaaacatgctacagtactattgaacgatgattatttttgcatcatctacactgttgtcaccgtatttgcaccaaactcatttctgtgtacctttgaaaaaggtcagagaatctgattctcatctgtatcactacatattttcatattcacaacctttctcaaagctaaagcataatcgatttgatgctaatatgtcaatttatggatgcgattgtcgcctgtgcctactgcctagtgttcagtaaatttgcgctagaaacagaaaagaaagaaaaatagtgtccacgccagcattctaattgtattgtactcctgtttatttttatgttatatgtttagttaaaaaagaactaatcaacatcaaacatttcataattaacagagagagtatttcttttttcaaatatgttcactgtttagcaagcccacgcaaggagccagcaatgatagtaacatttgatatttcagagagacttctaaaccatgcacgcatctaacaagctatcgatatacatgcctctttgcgttaaggtcaattaaccctttacttgaatcatactacacaacatataattctgtctgcacagtgtacctgctagttcattgataaagtagcttatcttaagcaagtaagtatgttaattagtggcctgagagttctaaaacgtagtgtaactaacctccctaataacttgtctagagttaattaattagtggagactgtgggtggcagacaaataccaagggaggaatctgtgtggattatgggcatgctgacaaagacattcttctttggtcttaagtggggagcagcatatgtatgtatgtgtagctaagtgttcattaattgccatgattggaggatatagtccactaaatacagtaccaaatggggattaaattaggcaacccagcactccacaaggacagttttggtatagaagagtaattattataagtgggggcaagttgatcgatcaccaatatagtctcaagaaaatgaaaagtgtaacatggaagctgccccgtgcttccaacttctttgtttgtatcgggagacatggataatactatgaagattgttaagagttacattagttacatatcgattcttcttttaatagtggtgatctttcaaaaaaatatgattcttgttttaatgatagattaattgttgatgctagctttaccaaaagttgcaacatgacttcgtgcgtggtgaacaaaagatatagcaatgacagttgacaaataatgaatgggcatctcgaaagaacaaacccaatagaatcctcgcctacatagctgatattttccccgtggacaaaagaattgaggatgttataggctctgttctattcgttttttttccagatttttaccacagattatgttgctccacgcttataaaaatacgattttttttaaaaaaaaactagtaaccaaatattctaaattactactttgttccaggaaaaatcaaattctagggcattggacaaaacgtacatctagatacatctttaggatttgacagggtatttgtgatttttatatgttgcatctcttcacccgttttcctctatcctagtacaaaatatatatgcttggctcaattattatggtcgtacttatacatatcataggttgttttttatgaaattaaatatcactgttggacagcggcaaatcctcattttttccacgactgagtgagatcaagctagatatatatacattaaaccatgtatttcggttcctcacaaaccaaaatataagtatgtatttcagttgacaagtcagttggtccattttatacaatcgctgatgtggttaaccaagcatgacgggcgattagattgccattttggcatgtcattttctgaagcacgactgttatatccgtaggcccacttgccagtgactaggttggtcgaacatcctgatggttcaccctcaataaccagggctacgctaatcatagttggtggataggtcaaaagaacgatcgatctgaaaagcctgaaaggtgtggctactaatcagggaattaattgaacaatttcaatccaagaacttgtttaattagcaactaaaacaggggtatcacgaaagctgattaattgttgatgcttctcttctttacatacgggccccctgtttttaagaaagaagggactttgggaactttttccatgactcaatccccagcctcactatgcataaagttttttttggataccccacaaaaaaaggggttttttttgacaattcataaactagttggttattcacgtgaattaaaaaaatctaaagaaagctcgagagtacaaaatggtcgtcatattacatatgtataagtttaaggttattgtaatttcaattattgagccagattactataagttgaattataataagccaacacagaataaactataagctatttgtttctttagattattagatgtttgttagctgttagccacccaataatctaaaaaagcatagttagagtggattactatattatagtaatctagcttatagattgtaataagctactcctaataacccagattattataatcctaagctaaatcaaacatggccttaactgggtcaggatacttctttgttgaccttttttttctctactcctagcttgtagtattatattgtattcttgtgataaattttagaggtaagtgaactagtgctgacattatcttattaatgtgcctaaatttatgttgagtaaataactagcataaagatagtgcatcctccaatgttggtgccatgtgcacccaaatatatggctgtttcaatttaacccacacttccattatgcttagcagaaggttatcccataaatcattaatcatttatgtatccttaatcagttactattgtttgttattgcgtttttcatgactttttcagcaggtttagccgtgatgagcataaattgaccgtacaatgaaaaaccaaacccaacagaaaagagtcgattctcttggttttcggttggtccggttattccagcttggtttttgtgttgtggtagattttttttaaaaaaacagtaatatggcaataaagtaccgctgaggagtgaggactcatcccagtcaactgaccacgtcaccggttgccgtagcttcatttgaatcccggataaaacaggagagagagaaagatgaaggggtgaacgaaaaatgagggataatttgattcaagtttttttataaatgtattgaagaaggggtaagtggtgatatatttcactttttatttaaatataatagcatatgcatccaaataggctagtagaaataatttctttttaaaaatcgaggaagttgtaatggcatagatcccgttcgaatctgcttaaaaggatgattaaattttagattaaagtggcgcgtttttcaaactgctaaacggtgcgtttcgtgcgaaaattttctatatgaaagttgtccttaaatatcatattaatcctttttcaagtttgtaataattaaaacttaattaagcacacgttactaccatctcattttgcgtgaaacacttaatcttcatcttcagaagattcaaacaccacactaattaaccctaaaac

SEQ ID NO: 11871 - DNA, 25555 bp, Oryza sativa
  unsure (1)..(25555): unsure at all n locations
aaagaaagctaaatttccgtcaaaaaaaataaaagaaagctaaatcatgctcaggtctattggcttgcatgattttggtgcttgtgtcgtaaagatctttttttttctcgcagagtatgattatgagaatccaaagatgacattacaatgcaaccacaatttccatctttgttgtatttatgagtggatggagagaagtcaagcttgcccagtctgctcaaaggtacttgcttctacttcacttttaacttcacctcagaagtgaagcgtttagcttgactccatcgacattaatgatacctttctcactacaggtaatgctgttccatgaggattcatgatcataatgctgcaacgtttctgtgatgttggagagtggagactcacggggactggatcacctagatttgtgtacatagcttgacgaaaatcaaagtcgctagattgtttgctgaaacttccagcggcgcaaagattttttattatttttttgtttctgtagagcatataattcttttctcatttttcagaaaaaattggtagcttgtgtcaatccacatatcacatttcgattggatgttacagatgcgcgtttgagtgattgcatttgcttctgatgctgaaatacgaaacttctgaaagccctagcatctgaacttgtgcttcctgtttgagatgacgagagattctttgcattcttcaggtcccatcgtaataagccaaacagcatatttgcaaacgaaaaatatttgtgaataaaacttttatatacgtattcttagcgatctaaaagcaaaggctgaaaaataaacttcaataaaaaaacgttaaaattagcttcaaatttaaggttgaaaatttaaattttgtctaacaagtataagcataaacgaaaagacgaggcccgttcttgccatgactgagttaagtccaatgaacatttctactattcctactttgtggacctatctaatattcctgcatttttcattacaaaactatatcacgcctgcttgctctctctcaaaagaaaaaggaggaataatcctgcttgctctctctcaaaagaaaaaggaggaataattgtattgttgcaaccacaacaaataggagtactaattttcgtcattgtaagctcgagtgttgttaatttagccaaaaaaaaaagggaatattttgagctttcatgcggaaaactggtcaggaactgttttaaaatgtctcaaataaagaataaattgcaaagaaaaatttcctgctatgttactaccacttttcacttcaaattttgtagattataccaaactggatttcaaaatgccttcaaacatttgtggtattcaaaaggttccaaaaaggcaaccaatgaaaaacttatccggatttggagctatagtctaaaatcctatataattatttctagaaagctcagcccaatagcaacatttttttattagccgcatgcctaaacctttggtccatgattggtgaaatcgtccatcaccacacatgtgatgcttccaagtccttaatatttcgttactttcttgttgtattgtactcgaacggatactcttggaactttataggactctgctgaactttgaattttactatttcatcaccggcaatctgtgagcaaaggcatagctgtcaattacgatggcagatttatgcaaatagagcatcgcaccatctattctttagttcttcagttgcacagaagaggggtgattttttatttttgagctaggaatgtaaatcggcacacaaatcattgcatcaccattcatataccgacaattttccgtaattaggtaagtgttcgcaagtccattagaattcggttcagatttcgtaaaattcaacctcttcagaccaggttaaatacaaaaaccactaggttcaaactgaattttaaattttcaaaatttaattagattctatcagcttatcaacagattccacgaaatctaatgcagaggattgtgaaccctgattagaactatttgaaaatgtacaacagcattcagtaagatagttaataatactttaataattttcagtaattaggttagtttgaaaatgtaagcatgtagtaatatagttaacaccaacattactactaataacacattgaagctcgcagtcagattgactagcagatttataaacacaatgaaatagataactcaggagactatcatttaggagatatacttaaaaactaatcataaccagctcacagagcattcgataactgaatcatttcttcatctcatcacaggcaaatagagaacagcaacattgcttctagaagatagttcactggtttcagaacacaagtaccaaaattttaaaagtgcaaacagatattatcaaagtctgcaagggttggattccacagtaacgtaacatcaaagcacataggcttaacgataacggcgaagagagacagtctggttgcgcttccaggtagccctgcgggacggcctggccttgtggtgagtgtgacccttgccgcgcagaccacggtacttcttgccagcagaggtgagaccacggagctcacggtgcttgtgcacaggcttgcagagccagttgatccttgggtcattgcggatagcactgtgagcaacatccacaaggatgatctcaaagtacttgtaggtggagtcctgcattaaaccaaagaaaaccaagtcattaatggaaggcagatacattgttgataatcatctttgaaagatctcagtaaagtgaaatgtactcgttcacccagtaggagttgagcaccctgagtccgcccaacttgcgcccagctctctcctcagcaactgacctcttgttcctctggaacttgagctgggtgataccctggtgcttgggcttgccgtagacaatacccttgggcactggcctcttcttgccaccacgcctcacacggacacggttaaccacataaccctgaggaaaggtaacgacaaatagttaagcacaatattttgattacaggacaaaatattcaaatgtgattatataaattggtaaataaatgggagcacccgtacaaaattttgctcagagtatcaatgacaaacaatgcaatttaagttcaactacggcagcaaactgcttttgcagtaagtaacgcaccaaacaacattacctatgccaattacaagaaaaggtctcaagggatgatactacaatggcaagcatctaccatccaatcgaatctaatggagaacacaagacaagtgatactgtccaagaaagcactaaaaacagattaactcaatgttctactaacagttaacaaatggcagtaacaggttccaacaaatcaacagcacagtcgttgaacctaaatcagcagaacgataacctagcagagtctagatctagacaaaaaagtaagcctccatttctacaggacagatcaatacttcaaacattaacaccatcatcaaccgcgggcacaagagaacatttggaggaggggaggtaacctgcttggccttgtagccgagccgccggcccttttcgggccggtggggcgggttaagccgaacaatggccggctgctgcctgtactcccagcaccgcacgcgctgcacgaacctcatcacgtccgactgcttcctcctccatagctccgacacgtacttgtacgcacctgtgcacagcaaaacgacggaggacggatcaggagagagatggaggtggaggggtgggaaactggagacgagagtgatggagggaggcggcgtcggaggaggagctcacccatggcggcggcggcggcggcggcgatcggcgagaggcggcggcggggaggtggagcgggagaggagactagggttcgtgcggaggcgcgtggcgagaggctatatagaaggaggcgggggcgcggtggccgtcagatggggctagggtttttctcgtgcggttggatgttgcccggggaaggaatggatgggttactgatgatgggcttggcttgggccttattaagtgcagtggtgccgcacaagactcagcccaggagccagcctgctgctctttctcagcctgattaaaaaaatagagaatctattctatttattccactgagttggttcgagttcatgatttgccatcaacattatcactttctataatatactggtgaatttatcaattgttatacaatacgctattaggctgggacttgttttaaaaagtacccaaaatacccttatacacaaacaaggttaacaattgatttatcttattagaagtttcaaaaaaaaaaataaaaacttttatgtggcatccttacacaacatggatatttatatacaagtttcaattttttttatttttttagaaaaatatataacttatttgttatatgatacataaaatacttttttattgttgtttttaatataaatcatctttcatacactatataagataattttttgctattatttcttctataaaaaaattattttgcatacaccacataaaaatattttttctaaaaactaaatataccagaaaaaaattgaaacatgtatacaaaattgcatgttgtgtaaagaggacacataaaaattttcatattttttgaaacttctgatgagataaattaattgttaatcttgtatgtctcaaaggtattttgggtatttttgaaaataaggcccaacccaatgacatattgtagaacaattgataaagtcgctggtatattatagaaagagataatgtcgatggcaaatcgttgaactcgaacaaactcagtggtatagaatagattctctctaaaaaaataaatgatactagtagtttgttattattctttattatttattacggtcttggagatacaactttgaccccaaattatataagtgtataaaattacttcggaagttacatctaagaatatcatttttatgttttcaaactaattattttattaaaattcattgatacatattgatatgatcttatccaaagcatcatataatttccagtgaaaagactaaccacgaaattagtatgagtaatagaatgtgttggaacagcaataaaatgaaatagacaatcaatatattaataaattcagaacaccttgttgttcacataaaaattgcttgatcactccaacaattcatctcctaaatttaagccttttaatcgtatacatggtggatattgagctagcttagcttgggttgttattctaacgagataaaaggttgggtcgacttgatctgtttgctaactcaagctggcaacacattggcgttggctggacctcataaaaacggcaggctccatagcaccagagctagtcaacgaggacttttgtgatggtgccaaagctcgtcaatttttcattggagcatggagtcaaacgaggcgtcggagctcgtcaatatgactgctcagcaatcggtgaaggggatggcaactggaggaggagagttagaaacggatccaaggagctagcatttgggcgggcaacggtgaactaggggtcactagtgctagcactgccatggctaagcaaggacttaaccatttggcaacaggctaggattaatggtgttggcactgctacggacagccaagaagagcgaactggtgactagagaaggggatcatctggtgttggcgctgctatgaatgggtgggcgacaaatgaaagtgatgacgacaactagggtgcgaggcagagatgattgagtcatatatagaggtggatatcgagctagctcgattcagttcctataggaaccggtattgttcatccattcaagaaaaagggaggaaactttcctaccatgctaatttggtagaaaactgcgtgaaaaaaaatcgagtgcaacatctttttctgttcccattgcataggatcgaggcaaatgaagtcttgatgccactaatgcaaggattaagcatcatcaagcttttctactttttattatttagtactgttatttagagataagaagctaactctctaatcaactttgcatgtaccgttgcttcctatgtttttcctatggtttatctagtgcatttctaacctattcttatgtgttctttctattcatgtgtttttttactctacattccaaatgagctcttaatagttagccactaaatttgcatttctatgtttcggcaacatgtctttataaaaccacagctaaaacacagggggagaactcgggagaaaatcggtgttcaggacaaagtgctacgtttctcagaagagaaaaaaaaagggggcacagacgcacagtgcgttgctgctcctctggcgcttatagggcctttggggcttcttgggccatttggttggtcgttttggttgcccagcccaacatgatggtgttgtgcagcagcagtcaagttaggatagttttaagttgggcaagtcaaaaatggtccaactctttacatatcctcttgcagttacaactttctaccataaccaattcaacttatcaacaacaacaacaacaacacaaggtcagataccttggtcgaaattattacagaagagcaaagatgagaccttttacagaagcaagaaagatgagaccttttacttttacagcaagggcaaggtgcaactggagcagccgtaattttcacaggagccaaaaaaaaaaaagccggtgcgtgcatacacttaggacatgtattttcttcacagcgttctcaatttttcatggctatatacagctgttaaaaatgtagaatattatcatcatcagattacaatagattcaagtacctaccgtgtagcaaccatatatcagcaactcttattctttcctgcaaaccagcttttattctattttgcacatgctttaagtaacctataagtgtttcccacacgcacaatcattgagccccatcttttgcagcaacatcaaaagcccttgtgaatgcatttggaggctggccgccgctgagctgaaatttcccatttatctggaaagtaaagaaaaaaaaacacagtagtttgaattatcatggacaagtatccagtcactgaccaagtgataagataaaaagtgcaagagatgatagatatgatcatttaattagtcctcataccacaaagtgaggaacaccagaaattccagaggaatatttgttgagttcttccttgaccttttatccccaaaagaaatgttaggatatttgattcgattgcatctgtcacaaaaagatggtcactagaagtgaacatcggtggaaatgtacctcatcgactcctttgttagaatcttgaagaagttcttctgctccttctatgcccacctttcttgcagcatccagcagaacttgccttcaagcatttggaaattattcacaagattgaataatattgtataaaatcacttattgtcaacataaaaatatatatagggaagcaggatgggtagctaagttggcaggtggacatgtttgctgaagcaaatcaagaagataaagggtacttttcttgcccaaacatcaaaactcctacaaaaatttatcattgatagatagcatggaatcatttctgactgcaactttgcataaagaaaaggtgcctaaaaagggacatctaggaaaaaacttcagcagtatagtaaatgctgagaaactattcacaacccttacgcaccaaaacaaagaaattggttggttattttcatttgccaatactgaagcagcacatgtaacaatggaaaatgcacaacgtgctatctgctttggtttaacattctaaataactcgcatccatagtagaatgtgataatctagataacgattccaatatgaaaaggtctgacatattccttttcggaatttcatcagtcattcttcattttagcaacataaaatgagtatgtttattacgagtttgtctcaaggagtaatatagcacagaaaagaaaaatgcacgcccttcaatgtaccactaccaacaggaaagatgtattatgcatcttgctgaaagcctcatacatagaaaaacgattaagtatggctgatttatgtgatttctcatgttgtcccatttctgacatgttctaaatcaataatagtttgtcacaaatatatatgaccgaatatgcagaattgacaaagaaaaataaagtgcaataagattataaatccattcctacaatcttgaatacatactcaccgatcaccaataaactttccatggcaaaagtaactttggaataattcttcaacaagagcactttgtttgtcataaccttggtgcccagcaagagttatgagcctatggctgtccattgtatttccactgtattaagtatttgtatcagcgaactagccaatgatgcatgctaaaaaaaaattcaagactatagcttacgtcaacccagacatgtcatattccatcccaagtcctctaaatatctgcaaaaagagcaaataaaaggctgaatatgatatatatgatgtgaacaaactctgcctttgcattgttcaaatgtattaaccctctgtcatacgagcagttgcatgctcaaactgaatagggccaaacttcatccgggagtaatcagatttcttgatgccttccttaggtgcattcggatttaaaaagaatggatgccagcggacctaatcagcaaaaagacacgctagttttacgctgtatgaccatgaagttggacaacaataattttgaagaagtgaaacctcgaaatcaaacttgtccttgttttgctccatagctttctcgaggttctttttcccgacaaagcaccatgggcacaccgtatcagagctcacatcgatctgaatgagcttcttgccagcgtttgaagccatgtaaatcctgcatgtgtataattcacaaagaagctaatcagaaatcggatcaaggcgcctcatggatccggaaagcaaggactgaaaacaagtaaatattttgaatggttgctggtacaggccaagatcctaacacctgtcaagctagtgatccgaatttttcatcgaacacacaagctagtgatctgcagatggcctcaaaacacggtttatttgctatgcgatctgcaactagaaacagcaaagacatttgatcttcaactgtgtgggagaaaatcaccaaccagagtggctgtcagaaaattaaaagagttggggatgtggaagaccatctcaatgaagttctatatacagttggcatatgtgggaggaacatgatatgaggacctttcaaaatgaggagcttgaggcccatgcggtgtcattcttattaacgagaacattgataagtggaagtgagcaatgtaacagtttggtgtaatttggtgacttaattattcgatgttatatcgtcctcccatagcctcgtaatggccctagcattttcttttggtttttggccatggctactagctgcttatccaagtgtttgtaacctaaattctattacatattaatctttaagagagaatcccttatatgccactagaatttgaccagttcccttatatgccactcaaaattggcttctcccttatatgtcactagtttaagtttttccacccttttatgccactcccaccactatagtgttagttgactgttagtcaaaggttagtttttttcgtaaatgaccaatatgccctctcaactaaaaaatgtgtaaacttcaaaaaatcataactaatttattttaaatcctttttgagtaaacaaaattttatcagaaccagtgaaaatgctctttatattaaaaatattattggaaaactgcatatttcatgcttacattgaaaatttatttgtgatggtaatggctaaaattgcatgtgatgcaaaaaaaaatcaattttcatatattgtatccagtagctatattagtactaaaatacatattattggttgtatactaattctcaaggacaaatgcgtctttttacaatgaagttaacggtcaactagcggtggactggcggcaatggcataaaagggatgagaaacttgaaccggtggcataaaaaggagaagccaatttgaagtggtatataagggagccggttaatttggagtggcatataagggattctctctaatctataacagggttccttcctttctttgaaaatagaaattggctgaaagtttcctctgcaaaaaaaaaaggctgtacaaactgtgattatgactccatggttttgttatcactaagctctacgccaaacaaacaaaaagcaaaattggttttagaaaacaaataaaaaggaaaaataaatttaaaataactgaaaattgacttaggtgcagaattggggattaacatggcttgtagaaaatgaaaatggtagttcatcttctcctatctttgctcacttgctctaatttttctcaccaatgtattaatctagccaaccggttggcaatatcaatgataaatcgatgatcatcagtctttggaagaaaatgtcttgtggcatggcatcagcataaatagcaagaaacagcgcctgttctctnnnnnnnnnnnnnnnnnnnnnnnnnnnnnnnnnnnnacagaaaggtagtaactatcaaagtatcaattgatcaatcaattaattaaagatcagtttcctattgaaatatagtaattggcaagttcccctgttggtttagtaaagaaaaaaaaacacacagtaaagatcagttcttgcatccctagagagcaggaaacaactaacaactgtactggaagaaattagaaccgtctgttttcttgggatgaacagaagagcagacatgagtatatgcacgtttgcatggatggtttcattcaaaggggagagggagaggataggattgagctggagggttgatccgaacctggtccaattgtggagaggggatgcaagcttgcgcgaggagacgactccaagaagaggaggggagggagacctctgccacggaattttggttaactttgatttggggatttgatttgatttgattcatgtccacgtctcggtggcggtggccggggacggggaggtaggtgaagctgcccggtggtagaggaagaggggaggtgggcgttggtgagcttggtctatggagaccacacgcttgaatcacctcaccgatcggtgcgtcctggacgcggtccacaggacggcagtgtgggttggaataaatggcccaggcccaatttaactcaattaaaatctcaagagcccataagtaatgttagagacaacaatactgtcttgcaaatctaggtggaagaatctcaacttaaatagggtgatattagagattccttgttgaccggttgaggtgatggttgtactgccacacgcgcgcgcgcgccgattcggcctcggccgtgggcatggcgagccgaggcggccgactgaagctgagcctgcttgctgctctttcgttatgtaacagacgagaataaagtcaccattaacaaatgagagattcattgtgatgtaaccttcacgacaaatgagatttattttgtggtaaccttcacaacaaatgagatttatttgtgtggtaatggagatctttctctatatataatgcaaggcaaaggctctcaaagaacatgtcttcctcctgctattgttccttggtgatactctccttctgttcctgcgatgtctctctatttccccagttctgttcatcccgcgcgcacgggtgatcgaaacgagcaggtgcctccgaaactccgtccgcttgagaacctgcacgggtaggcgggcgatcaagtttttgggtaacgcttcaagcgcaactgctccgcatcatcttcaccaatatgttgacaaccagcgacaacaacaacactggagacttggggagcctcccgtcaacaccaacggaggcaatactgcctcaaactccagtgaagggccattctcgaggtataatgtttcacaattactgtttgttcttcgtttcctacaactgtcagtcacaatattattgcgttctcttgtctatgttaatgcttattctatattaagcatgctcatgttgtacacatctagcactgtcactagatctactcaaattacaaatgtcatatttattgtcttaatattttggattaaaatatgctgcattatgaccaaatttcgattaaaatatgccgaattatgaccaaattttgattaaaatataccgaattatgaccaaatttccaacagtgtggatgtgcgccgctgcacatggcttgccgctgtgttcagttccccactcacaccaacggcacgccccgccccgccttgaacttccaggccgcctgtagccatctccagccctatcattttgggtataagctatcccgtatatttgcaaagaatagataacttgtaaataaaatttttataagcgaaaagatgagtccggattcttcgccgttcctgcaaagtccgcatcgacgccgctacccgctatctccgtggctttagcttttttctttttttttataagaaaatcatgttctctccatcggattttcgtttgctccgttttgggttctggcttcttcactgtacactccatacacaaagaagctgcgctgatatgtggacctgtgaactatgaagcttacatgtaaaccactcgaatcaaactcaaaatcaaaggacagtaaataagaggatttggttcctccatacagccatgttctttctccaatagaagttggataaagttttggatactcgtggcacgcttttcaaactgctaaacagtgtattttgtgcgaaaactttctatatgaaaattgttgtaaaatataatatcaatccattttttaagtttgtaataattaaaacttaattaatcacatgttattaccacttcgttttgtgtaaaacacttaatttttatcttcatcttcatcttgagattcaaacaccaccacaatattgacgacatatgtaacgagtttttttgggtggataaaaaggataaaaatgctaaactatatgggtatatgtgtagcttaattctcataggtagagtacgtagcaaggttgggcgccttcttttgaaataaaagaaataaaagtagcagtacacaatacgtgtatgatctacaccaagctaagatttggtgtaatggttgtcgtgaatagaataagaatgttgatcataacgctttattaacatcatagcttgtcttcagtcatttctttctgacttcgaaatttcctctatttatccatgtcaatgcatttgcacttagataaaaaaaaattctcttagtattgtaagaaagatccaatcttattgggcttcttcacagtgtccagctaagaaagtagttctaattacagtatacatgaccccaacgtaaaatagtttctccaaatgctactttggatagtgtacttacttttcttacaaaatgggagcctaaggctaatctaacctgcacgatggacctttacttttggacgacgatggtgccagagaatataactgttgtttgttttgcccttctacaataaaacatctgagcataggaacatttggaattgtcaccaactttggacagttgatcaatttcatttcttcaagcactggaattgtgaatacttctatcacctcatcttcttgccacttttccaagcttggcatatcacacaggataagactcttcaacctccagaagaatcgataatagctgacctcaatgttgtccatcgatacattgtcgcaaaaaagtgtgagactgtccattccttcaagatgtaggacctcaagtgatggaaaatactgcacaggaggaagcctcttacatcttgcgcaatctttgatggttagtttaaccagattagcaagagtttgacctggccaccaaattggaagtatgctaccagggtatcgccaaaccttgagtgtctgtacacacataggggttctaagagcctccatcacttcctcggcattgtatgcatttacctcgtcattcctaaacataccccaacacaacaacatattggacattcttgtttttagagataaatttgcggcctcggcttttgatttgtccctcacgttcttcagattatatatttcaagccgcccaccgagatccatgctcttgatctcttcaattccatacccatcaccattgcccactatgtaagttgtcagtgtttgaaggttctgcaattgtcccatatttgacggcatgttttctaatcggaagcagccatcgatataaatgtgccttaaattctccataaacctcatgttttctggaagttgctttaggtaaaaacaatcggagagcctcagagtttgcaggttatagatcatgaaaaagtcctctggaagcgacgttatccaacttcttgacagatcaaggtacctgagatgcttcatatcttggcaactaaatggaacactggcggacaagagaccatgcaggtctaacgctctcaaggagttggatttccaaaaatcaggattagacacacttattcgacatccttctccttgtgacaacagtgtgtggataccccatgcattgggtagaatcatatcaacatctaaccctgaaccaaccactgacaagtgatggagctctggcatcacttctgtaagttggtggccttgatgtaggattcggatctcttttccagcagctgacgttgctatgccatgaacaagagggtgcatcttatagattgttactccattgtaaggttgactgacatcttgaagaaatgatcttgactgtagcctatctaacatccaagcccccataccttcagtatcgtaccataccatatcattagccatccacagctggatcagcatatcaccatccacttcaaaagcttcaggaaataaagcacagaatgcaaagcacctcttggtgtctggttgcaagtgctcatagctcatctgaagtgcgaccgaggctacacctgccgtcgtggtcagcatatcgctttctgcaagagccaaccattcattggcagcttctatgacactagaccattcattagaggttcccttctttctcagcaaatccccgagtgttacagcagctagaggaattccatgacacttttgcacgagggattgaccaacctggatgagctcgggtttgtcatctaggccacataacattcgctgcctcattatggaccatatctcatcatcactcattggtcccagctcaatgatgccagatgcaggtgcttctaaggttcttgcaacacaaagttcacgggtcgtcacaatgaccgtgctccctgatgctccagatgccagtgaggttctgagttcttcccagccattggtgttctcatcacaaacatcatctaagacgagcaaaaaccttctttcatgtaaaatgttctggaggtaggattgcaactccttctcttccttgtgatccatttgtgtctccaatggctcacaggttgcaacctcaataatccgttttgtgattctcattgcatcaaattggcgagatacattcacccatatgcacaatgagaaatattccttcacattgacttcatcaaagattaattgaaccaaggcagtttttcccactccttcaatgccaactacacataggaccttgaggccttcatgcttgtatctgtccagacagaatagtttttgctttatctcttgcttctcatgcacccttcccacaatattattttgcattaccaatggcacgtggttgatgaagccattgatctctgcacctagtgcattaagttggccggtgatcattttaagcttcctcttcatgcttcgaggaagaactaatggaatatacatgttgcgcatcatcctgttcctgtgcccgtcaaccaaagccttgttgtgctgagcctcccatctcaactcctccagtagatgctcaactttgaaggtgagtaacctcaactcagccattgaaaatcttagtgtcatatctttgttgttctgtcctgccaacgatgaccgttagccaaattagacatcattgagtacaaaaaaaaaactctagcttgacatattatcgtagacttgtcacttgtcacaagttaggcatattttaatatcaaaagcacatcggtccatgaataaatattaaaaaaatggcaacaaactcataaaaccatgatatgttctttaggtatatttgaagatagagagcacgtcagttcaaagataaattagaagaaaaaaaaggtttttatagagaggcaactgcattatcccccttattttcaactcaaatgatgattttacccctgcttttctaactttgtgattttgccctcatttttttgaactgaagcttgtgcttgcccccattccgtgtcatcttaacggtgtcaaaggaacgtatgctcttgcagatttgcacatacttttcttaatatttttgtgattttgcccttggtttgacatcaagcattttgacatgaatttttgcccggttttcacttgaattttcacatattcgatttgaaaagatgagggcaaacacaatcttcaaatgaattttgcccctgtttttatatgattttggacattgttaagaggagacaacaaaatggggataaagctcaagcattagttaaaaaaacagagacggcaaaatcacaaagttagaaaaagtagtggtggaatcaccattggagtttaaagtagcagtaagatcgcaattgctactttttaatggtataccaaatttgtcatattgtttctatttatccgagtgttaatgttgctttctcatgggtggtaaagttcatttatatctatcttaattattaaggaaaatggtatctattactacactatattaaggaaagaaacatgttttttttattattttagtatcaaaataactctctgaaaataagaaaaataatattataaaaagcaatattttctagtgtgtatatttacttggagtatcagaaaactttatgagtattataaaaataaaaaatctagcatttacatagatagcatggatattaacatagaaaggataactatgtcttgttactactttccctctttcgtggatgtatttgtggaagaaggcgataggtttttatttaggaaaaatcgtaaaaaaaatatggctgggattttgtgaaagctctagctcgagagagtagatgagtcacttaaaagaactaggaaaaaaaaggcagcaaatagagataacaaaataaaaacatgtaatgcattaatatgaaaacccttgtgtaagaagccatgggcacacaagtaaaagattggttacgaggcgataaataaaacaggggattaatgtacctttttatttatttaacattttcagatgtatcatttcatagcttcagcatttcatattcctaattgtcatgtgaaaatgacattaatagatctttcatgaacatcttattatatcatcaatttttatgaatgacaagtaaaagaacttcatatacactagttaaaaaacgattttcctggacgaggagctatttagattacagacggaccgttttcacgtccgcccgcaaaatcagcctcccattttcacgtgcggacccttaagaggtctgcacgcgaaaatcgattttcgcgtgcgggcctcttaaaggcctacctacaagtctatccttactccttttttctctcctcaacactttaaaatttcatccttatccacccatcatgatccttatcctctctcactctctcacctctctctcactcccacactgtctcctctctctcactctctcactcagtcgcggctcgaggatggacgtggccaacggcatcatgcagctcagcgacaggcgcggtcagcggcaccgcacgactcggcagcgggcgcggtcgtcggcaccgtgcggcttggcggcgggctcggcagcgtgcgctcggcggctggcgaccaggagcggacgaccgccacccgctcggatccggcggaggcggctacccctttcccggatctggtggcagcggccgtcccccgcctggatccggcgggcgggcgggcttggacggtggggaggcggcggatccggctaccgcgacggcgacgatggagaccgcgacggcaatgatgatgacgaccgcgaggagggtagtggcgtcaactttagggttagggttttgtttttttggatttttttcggttttttatttttgcgtgcgggtgacatagccaccccgtagatttttgcgtccagatgcgccacctgtacgcaacaatagcgatttttacagatacttcgttacagacggttgaaagatccgcacgcgaaaatcgctttcaaccgcacataaaaatcgttattttactattattataccagtggcttctatggttagaaaagaaatagctgaagttgtttattgtaaatcatggtgatgtcctaaatgacaagtagaaaacaacacaaaaagtaaggctataactcgtttcttttctagattttgtttctgaaacttgccttttgttctcaaatactagatttcttatagggtttccagcgctgtttttcccaaatgggccgctttcaaggaagtaagcactaaggacaagtcaggaggcttttaattgaattgattaataagcatcttatgttgcgctgaagtctaaacagcatcttaaaaataagatgtagagtatccttagatgcatattgtaatttgtaagaactattaatccagagtagccgaataagttggccgattaattatagcatattaataacgtgacactgtttcgcatgatgactaaggtggtgtgtttgcaaactactccctccgtccagaatgtaacaacctattcccattctaagacaatatatctgggtattgtcctaggttgctatgtacgttctgggacgaaggtagcagtagacttcagcaatctgctgctgcgcccttttttttttgcatttcattctttttcattttccagggggaaaaatgatatattattctctcaatgcatgcatatactacgggcatgtttgttacagctctaagttctaaatataactccagaagttgagtctagagtagagttgtggagctgcctaaacccagctccacaactctagtacattttgtgagagagctccacccaattccactcccagttttggtggagttgaaactgtttggctgagctccagctccaggaggggtggagctggagctgaagctgtgccaatcagacccgtaccctctgtttttttaacatatgatgcccttgacttttttgacaaacatgtaaccattcatcttattcaaaatttttatacaaatataaagaatttaagttgtgcttaaagaacatttgatgataaatcaaatcataataaaataaataataattacctaaattattaaataagataaatagtcaaatgtatataaaaagtcaacagtgtcacatattaaaacagagagagagtacctgcttattggcttttcaacagtaccagaggcaacctggttcatgaagtttacatctgtaaactcaaaccctcgacaccccccaccctaaaaaaaatccaccaacaccaaatatatgcctacagtatcacagaataactatttgattgagccgcacagaaacacatgaatcagatgagaaagataagctcaaaagaaaagtttccaagaggttagagctcttgctaaatttcctctaaaatatttgtaggattgtccattctatgataatttcaaaggatataatgggacttaatcctgtttcaaagggttttatagaaaattttttctataagattaaaatcctccaatatccctacgtttttcctccaaattaaaggagccctaattgttgattgagccataggaaaaacacagaaattgaataagagaaatagggttaaagaaaaaaattttcaagaggttggagctataaaattatccatttcatataaatctatataatcctttgttttaaaactcctcgtagaaaattcttttatagcactaaaattctctgaaatttctattttttcccaacaaatcaaagaaccaggaggggtgcatacataccagttcttccagcggattcagccgcttgtcggagcatctgcagactttcgcacagggtggagtactcgcgggcgatcgtgaggacacccatgaaacctctaagaaatttgtcagatgccttctgtaccaggctgttgaggatggccgtcagctgtccgcccccgtcgttgtcgtcgtcgtctccgccgctgcccgctttcgtccgctgcttttccgggcgaaagccgcctctaaagcaactcgccatgtatatttcccgtacgtgctcggcctcgttctcgtgcttactaggatgaatgccaggatgtgggaataggcactcatatagtagtagtacatgtgtactactcctatgtatagtactcctagctcttacgttggtgtttggatcagagacttaactttagtctttatatttagacactaatttagagtattaaatatacattacttataaaactaattatataaatgaaagcgagataatttttttaagcctaattaatccataattaaagaatgtttactgtaacctcacataggctaatcatgtattaattaggctcaatagattcatctcgcgaattagtccaagattatggatgacttttattaatagtctacgtttaatatttataattagtatccaaacattcgatgtgataggtactaaaagttttactcccattcaatgtgatagggacttaaagttttactcctatctaaacaggtctaattccttctcccaaatatcggagcagaaggcgaagaagatgcgaatgcatgtaccagtacgaatgaaggcaaatccaaaagtcaaattttgctacttagtgtttacacatactagtacgaacagaagtaaggcccgcggtttagttccctcgcaacaaattttataccctatcatatcgaacagttgaacacctatataaagtattaaatgtaggctaaaaaaataattaattgcacatattaggactaatttgcgagacgaatcttttaagcctaattgctccatgatttgataatatggtgctacagtaaatatttgctaatgacggattaattagatttaataaattcgtatcgcgatttactaacggactctgtaattagtttttttattagtgcccgaacaccctcgtgtgatattctatatagtaatacctgatgtgacaccggaaatttacatcctggatctaatttcgctaaatccaaaagtcaaatttcgctagctctaaaagtcaaatttacaccctggatctaatttttaaacacccctaaatccaaaagtcaaatttcgctagctgttggtaatcatcaccgacggagaccgaccggctatcgagaagagatatgattgcagcatttatttttctttcctttcattccttccaagatacttactccgtcccacgatataagagattttatctaatctagttgtttcacgatataagaaattttactatactacttgtcacatctatcaactctaattcaaatttttatccattttaaccatcaactacccactcaccaataagcaaatatcatttaataggggcattttagtatttttttttgttatccttaaactaccaaaaatgaataatcccttatattatgggatggagggagcattgctatcttcttcctccatttaaaataagacaacctattgaaggatatgacatctagaaagggataaatgattgtccagattcgttacatctctcttgtaggttgcttattttttttatgtagagagtacttcattcatcttagaatataagaatttaaaaccgaattatactaatattatagatctggagaaatagtttgttctaaacaaaagataaacccgcatgtcgttatactacccacggtttatttttctaagacggatagagtatacattactgctagtcaacttttgcatgcgcaatctccaaaatccttcaaactgcagcgatgtgatgtacacaagtgccaacttaaaagctactacctccgtagtgggctagtgtgtgctattggtcaacacacggatcacctggtcaagtagccagtgcaatatttgaagagcaaatttcttcggagagttcctttgacagctaatatatggtttaggtggtgtttagattcggggacttaactttagtccctttatttagatactaatttagattattaaatatagactacttacaaaactaattacataaatgaaaactaattcgcgagataaattttttaagcctaattaatctataatcagagaatatttactgtagcatcacataggctaatcatggattaattaggctcaatagattcgtctcatgaattagtccaagattataaatgggttttttactaatagtctatatttaatatttataattagtgtccaaacatttgatgtgatagggacttaaaagttttagtcacatctaaacagggtcttagttccctaaattttttttctcaaaaacgttatatgaaatctttagacacatacatagagtattaaatatatgccgggtttagttcccaactttttctttaaacttctaacttttccatcacatcaaaactttcttacgcacataaactttcaacttttttcttcaaactttcaattttagtcaaactttcaattttggcgtggaactaaacacacccatagattaaaaaaactaattgcacagttatggaggaaatcgcgagatgaatcttttgagcctaattagtccatgattagccataaatgctacagtaaccctcatgtgctaatgacagattaattagattcaatagattcgtctcgcgatttccaggcgagttatgaaattagttttttcattcgtgtctaaaaacctccttcgacatctggtcaaacatccgatgtggtatccaaaagttttcttttcacgaactaaacagcccctaaacaattgttcaaagaacacaagaaattttacaacatatgattgagatttgagaaaccgtacgtaggaattcttgttccatcatgagctttgattgtaggattgcctccaaaattcctactcccccattctaaaatataagcattttgaggacattgataagtcaaatatttttaactttgaccatttatggaaaaaaatcaatcatatttaattgacgccagacttgaaagcgcggattacagaagcatcggtgatttcggggatcgtatttttgcactcattaaagcgccgaatatagtccctcaatgactcgcccggattctgcgtcaacgcgtgtaggttgtcctcgatcgccgtggcgctcgtatgtttcttggaagcaagtgacgaactgttgccacagttttggccacgaagaaattgagtagggcagaaggtgaaccagccatgaacgtgcagatcccttcacacgcacccgcaagtaattcgccaatgcgttgttggctactccggcagcatagagtactgtggaatagacatgaagaattcttcagggtcggtgcttccgtcggatttctctattgctcccgggcgaactttctcaggccatcgaacatcttgcagagtacgagtgaaagccctgcaccccttgcaagggcaagtaggttgtcggcgatcatacgctcgtcgcggatgtctgtccgatgaagatgacgaagatgatgatgatgatgatgagtcacttggttccggggcgcggtttcgaggacgacgctcgagtatgtgagccttgctgtcgcccatcgttgttgtcccggcgtcgatcttcgtcgtcgtcattgtcacggcgtcgacctcgactggtatcgcccggcacccgctgctcgcgattagtatgttcgcggcggttgtggcgatcatcacggtctcggttctcgctcggatgtcctccttgtttgccgttcttgcgatgtcacgaagagacgcgatgtcgggaatggttttcattatcttgagtgagtcgcgcttctcggcggccatttagatggttgcggagatcactggtgccgcaaggtggaggggtagcttgacgcagtggcgtccgctaatcaggctgttccccattagcgtcgccggtcgacgtttgttctggtggcgccctcacggcggcctctgcgaatgcgttactaaggttagccactgattcccgtagtcgttctgcccattgatcgagatcagcgttcaggacgggatcgaaggggctttcgctcaatatcgcattgagggttctgatatgttgggccagcgtcggcgtaaccgattgatcctccattcctgtgttgccgcctctagatgtgctggttccatcgatagcgtacacgtcgcgtggtgtacttgttgatgatgaggccaggtcttcgagtagatgtaggacagatggctcgtggggatcgatatcgattaccccgacgaatcgatctaaagtagtcgccgcaccttgttccttgtccgtatctctaggagagatttgtgattgctggaccttaggggatgacaccttcatggcgctgagaaggaccttgcagcttgagaggtcgtgagtctttgccttatagataggacaatagacatcacgagttggagaaatacgttgaattccacgctctttgcaggcacagatttcagcttgtacgctgaggaaaaccgagcaagcttgcaaggtgtgcttgctagtcctgtggagtggacaccaagctttagtcgccccggaagttgtccttgtaggctcgtgcttcttgtgggtaggacaagatttggccgcattaggatccttctcgggcttggatattgtcgacgttccgttctccgcttctgcgggaagatctttcgacatggagtcgaccggggtcgtaatcatgctgttctcactaccgataattgctgcgccagtcgagatcggcattgtggtgttgaccgggaagacgatttcacctacttgagtccacatcagcatcgtcgaagttgaaactccttggtcgatgccggtgttgacgttgtcgtcgagaaggcttgaagtcatagtagtagaaccttgagcaccaagtctccctacttggcgcgccactatcgacagtggatacccgtagatcggatatagagggtattggggtccgttggtaccaggatctacgtagtacgacatcaagcaaaaaaagacaaggattatactggttcaggccccttagtaggtaatagccctaatccagtggatatgggattatatgatggaaaccacagattacactgggaatagcagaactcaatgataccgacaagccgtagtcaagttggtccgactagatctcacggcgacttggctcctgcacgctccaactccctagactgtggtgggtgtgttggcagtaatattcgatgccttaggtcctgcccaaggggnnnnnnnnnnnnnnnnnnnnnnnnnnnnnnnnnnnnnn

SEQ ID NO: 11872 - DNA, 8332 bp, Oryza sativa
  unsure (1)..(8332): unsure at all n locations
nnnnnnnnnnnnnnnnnnnnnnnnnnnnnnnnnnnnnnnnnnnnnnnnnnnnnnnnnnnnntcttcatcatttgcacgtgggacccacccgtcagattcatcttcttcctttcaccctcccttatcatattcctcaccatctctctgtacggcggatgggaggagcggacgagcagcgaggtggcggccgtcattatcgccggaatgttggaataaatggctaggcccaatttaattcaattaaaatctcaagggcccacaagaaatgttagagacaataataccaccttagagattaaaagtggagtatctcaacttaaaaaatgagttgagattccctgttgaccggttgaggtgggggtcagacagcaacacgcgccgagcgaggctgagggcgtggcgaggcgagcggccgctgctctcttaagttttgcaatggttgggaattgaatccacctacgattatttctgtaacggacgaatcaattccttgattgattacgttgttactacagtaacggaagcaaaagtgaccgggattgattcttagcgatcgggattgattctcttccccttcccctcctgctctcgatctggtcgatttggttaaccacaccttcgcctgagtacctgcacgggtagatgattgattgcgttgttactacagtaatggaagcagaagcgatcgggattgattctcttccccttcccctcctgctcttgatctggtcgatttggttaaccacaccttcgcctgagtacctgcacgggcagacgggtgatcaggtttttgaggagtgcttccgcacgactactcgtgtttcttcctctgtttgtcggtgtaaacatcgtcttctgcttcggttgttcagcgaccatgtcaacggacaatgccaacggcagtgcgcctggagacggcaccaacggaggcaattctgcctcaaacatcagcggagggccattctcagggtataacactgctttcatcgtgtttatgttctttttttcatatgctactgttaggagcaatggtttcattgtattctattgagatgaatatctatgcttatcctttactaagcatgatcccaggtttacgtttattgatcactagtttactccctacaaatatcatacttattgtcttaatattttggattaaaatatatcaaattgtgaccatatttccaacacggaaagtttgaatcctcacctagacccatcattatcgtcaggggagggaaccgagactcggagagcatagctacagccatggcgccgactcatcacgatgcttctctcgcgcctccaccgtccaccctgctgtcgccgcaccgttccccatgccaccgtcgccatagatttgcctccaggaggtcttgcagccgaatttgcggcttgtttggtatctcgagggaaggggattgggagtttacacgagggaattgatgatgagattaagatgggaatttgattttttatcccaatatcttgtttggtggaggtgatggaattgatagggagtttagttggagattaggtcattaataaaaacggatggctgagatttgcttaaataaattaaaggaggaattccctcccaattacctgcccctacccaggtattgaaaagtagggagttctttccttgattttccatccccatcccaccaaaattcccatgtctcccaaccaaataaaacacttaatagcctcgtccctctaaactcccaatccctccttaaaaactttctccaaccaaatgggccgttggtgtctgggactgacgacagcaaaagattaggacaccctctctggtaggcctctctcttctttcacgggctggcctatcccttatccgagctcttctgtagccgcaacgctcaacatgatgacacgagaaaaaggtttgggtgatgcagtgttactctgatccactcgtttggtcttgtgcagatttttcctttcactgtttcatttttttttcatggtaactgattggcggaggatcttcgagtgtttcgtcgaaacaagaattcggcaataataaaaaggtagtacacaatacctaaaagtggatgaatacggagacaaagaatttaaacaggttcaggtactttcaatgagaggtaataccctactcctgtttggagatttgaatccaccgagtgtagtattgatctgactatatgaatcctctgccctagaggacctcctatccgtcttatataggatggagggcaggattacaagatagaaaccttaaccaatacggtatcggtttcctaaatctactttataatattatcaaaccaggactttaggtcgttccgtaatatacaaggaaatgtaatacctaagtcataatttgtacatttttcatagatataagttatcccctataactagtcggataaccatgccgtgtgggtatggggtacccataatctccacagtaacccccgagaccttcatagtcgaaaagataattttctctcgaactagattactccaaagccgagtgcttcaatcatcttcgccatggtctcccgagtacttttaccaaatctgaagactgtggagggctgaaaaataattaaatgtaaacttaggtgcatcgactagatgcacctaataggtgtagcccccaactatgtggttagttgaataaactaaacatatagtcaaggagtaaataatctaaccaaccgagtggttttgataattgtagtcaaccaagtgacttaatattaatggtcaaggcaaagcatgatcatgaagctggggtgtcgaagagcaaggagaagggggcacgttgctataagtgtcatgagtttggacatataaggaggaattgcccgttactgaacaagaggaaaagtgcgattgcaagtttagcagctcatggtgatgattcagatagcagtagtcatgagattctcacagtgtctaacgagaagtctgaagaagcgtggatgttagactcagctagttcctatcatgtgacatcgaagcgggagtggttctcgtcatacaaatatggtgattttggtgttgtttactagggcaatgacacgagttatcgtgttgttggagtgggcgatgttaagttcaagatgtatgatggaaacgaggtgctactttcggatgtgagacatgtgccgggactaaggaaaagtttgatttcacttgggagcctacatgagacaggttggttgtattaggtggattctgataggaagaccacgaatatcatgaaggacagcaagactgttatgactggtgagaggacaagctcatgttttgtacaagttataagggagtgatattgcaggtggagtcatggaagatggatatactggtgttgatgttcacaatcctaaaggcggcgagcctagcataggctcgtcgggcggctcggcgtgagcgatagaagaaccaactcaagtcctagtacacggaggttcaagcaagtaacagattcaagttggcgtggcatattcgtcaaggtggagtttgttagagtttgtgtcgaatatgtgtacataattggttacagtttagaacttatagttggatagcattacgactagagtatgagttggactctatcctaggatctctcataaatagagggacatgcctgttgtaactgcatgatgacttagcatagcgagagggagtggctgccggcaacgtctggccgtgagtcgttgtaactctcatacgctgtatatgatggatcggggaggagcgcccgtaataagtgccccagagatgtatactacggctgaactccattaccaaatatcgtgtctcggtgtcgtcatcatgtttggatctcctatgatgttttcttccgcgtttagctaccgatgtagatttcgggactggttttataacaatacggtctacggatatccccgccgataatggtattccctccgtttcatattgtaagccattctagcattgtcctcattcatatagattcatgccaaaaagtcttacattgtgaaacggagaaagtagtttttatgggatgagaatggtgaattgagggagaaacttcctcctattcaatatacacaccttctgtcccataaaaaactcaatcctaaccggtacggatatgaacacgtgggtgcctagattcgtagttatgattgaaaattttctaagaccaagggaatacttggtaggaggtgataattgagagaaaattattcctttacgtcgcctaaacagatcaagtctcaaccattcgtactccctccgtactcgtaaaggaagtcattttggacagcgacacagtcttcaaaacacaactttgacttcttgtttctataaaaatatttattgaaaagtgatattgtcagggttatggataccacatacataatagtagttgactaaatctcggcaggatccaccacatactatgtcttatacggaaactggcctcgagggagttccggataaggaaagacaatcagagttctacatagaaacgacaaggactactcggattgtatccatattggtttccctagttctacttagacaaggggacacctatggatataaatacaagatcccctaggaggagaggggagggggaccatggaagacacccatgacaatcaacgtacgcccaccagaagacacaacatacaagcctacatacgccaagacacgccgccggatatcgacttcagggataggcatggctattcccctacggtgtctccggataatgtcatgagatacgaaagcgctatctctgatctcgccggacacggattcgaggaggaaggctaccctgttgtcgactaaaagtcagaccttcagaccgccatgtcgacaatagttagataggctaccccacatattgtactggtgtgattatggtgaataaaaagcaacatcggctccgaccaacaggatgtagggctattacctgactgctcagggacccgaacctgtataaaaatccctgtccccatctcttttacctcagtctcgcatatatcctaacactaacgatccccatattgtccaaataccgtagtcgagacatcaaacgtcgacagtggtgcgccaggtagggggattttggtgctctaggatttcgacgagatgggtttaagaagatggactctccgacaacaagctactcgacgactttagctatgaggagatctaacccaaccggagtacgtccccgaatgagatcggaaccatcaacatcaacaattttgatctgttgagatcatccaaccttcaaagatgacgccgccgctgcggagggcatctgtacggtatttccgaccattgacgatcttgaggatgatgccggaagggtacaagacgccgacacctctagagaccgaaaccgactactacactcatcgggtttaagtgcggttttggtcagactcggagtaacaggccggatatacttcctccgtctcaaaataaagccattttgaggttggcacgggtattaagaaagtaggtgagaatgattggaggaagtgtgtgattggttgaaaagagaaagtaggtgaagaagaatagttgtgattggttgagaggaggaggtaggtgaagaaatagcttcattttgggacaagacactgtgctagaaatagctacattttgggacggatggagtaccactgtccgacatcaccacgtactgatcgcttctgacatgtgcacatgcatatgcacagactcaatacgtgcccaggcatgcattggtttgccgtcatatacatgcaccgaagacaattcaacggctactaaggctagttaaggtaattagtagattaattaatttaatcaatctactaattccatagatatatccggcatatatctacacaagtacgcaatattttatatgtaatttatcgtatctatccagatcatgcagcattgtcagatcaataatttattatgtttacctagagcatgttttttatataatgtccgttgtgcgagtacttccgacgataggccaactacggtctaacgctgggggctcgctctattttcttctgtataaatcatgcttgtttacggtttacataatgcctgatatttaatctgctcgttatatcctgataatactagaagatccatgcaattttttgagtacatactcgatattatctgctatatatcttgccttctagaaaatatttttcaggaacaattgagcactcgagtaggttatggtcgagtacactccattatcgagaatattctcgacaaatgtggagttatcgcacccaacctaccaacaaagaccgacgacctatctcatagcaccggccatggctggactactcgagaaaaggttgttaatagataattcctcgtgaacgccgtcggcttgatcacccgacatgattgcgaacggacatctggatatgctataagttgggtacgtgattcatgctggccacatgaaatacacttgcaataaaccaactctagcacttccattggtgtgcgagagataattccgctcgctcactggttctcgcactagtacgcagcaatctctcacaccgcaacgtccattggtgttcgagagataattccgctcgctcactggttctcgcaccagtacgcaacaatctctcacaccgcaacttccattggtgttcgagagataattccgcttgctcactggttctcgcaccagtacgcagcaatctctcacaccgcaacttccattgatgttcgagagataattctgctcgctcactggttctcgcaccagtacgtagcaatctctcgcaccttaacttcagatggtcaaggtacgactacggcagcgtagcggtcctcgcaccatgacttcagatggttgaggaacagctacgactggtcttcgaccggcagcgtagccgtcctcgtaccacgactccaaatgatcgagagacgcctattcactggttctcaaccagttgatcatagtgatctctcgtacatttgcttcaagtggtcgagttacgactactgcctggtcctcgaccagcgatgtagcgtctctctggctacttcgactttcagtggtcgagttacgactactgcctggttctcgaccagcgatgtagcatctctccggctacttccactttaagtggtcgagttacggctactgcctggtcctcgaccagcgatgtagcgtctctccggctacttccactttaagtggtcgagttacgactactgcctggttctcgaccagcggtgtagcgtttctcccactatttccacttatagtggtcgagttacgactactgtctggtccttgaccaacggtgtagcgatttctccccctacctctacttcaacaaagttggtagcaggtacacaatatcgccaagttttttacccagagatcccttaccacgacgacacctagcgttgaaacctatcctactgtccctttacgccgtcctgacaaggcctccgaggaacctaagggatcttcggctggagacgcccagagctgataagaccttgtcggatcctgtagagacaaaagaccatgtaagatctggtcgtgtaagagttctcgccgtgcgtattaaccaagccgtgtaatcggaaattgacttttccaacttcacggctgggggctaggatcagtgcttattcaaccaaggcaggtcaagggtccaagagccttatcatccgagaacgattatctgacgacaaggctgggggctagggagagtgcatgactctacaaactgactgatcgaagtcgttaagagagaagacgctcatacacaaaacattgatcggtaaaattaattcatttttagttttccatacatattataacatgtcaccctttgagcattcgctcgggggctatttctatttgatattcttttctgagtattgatttcaggaaaattctattcgacattgatgaagactccatgtctctatggttctacaccaagatcgactaaggcgagttcgacaaatgtcgacaaagctccgtcgcagactctacgccttctcgatcgcttgagaacggttgctggatctcgacaaggaatacggaatgaagaaatggtgtacccgccgagataaaatttcttgacttcaatccaaattctcgattacagcaagacgagagacttagtcgtacgctctgtactttctcggtcgacatcagagattgacttagacaaaccctttcggtgcccgcacgaggctgataaaggaagtctaacgttatctctaaactcactgagaacggtcacgtgagctcaataacagtttctccgaagtctgc

SEQ ID NO: 11873 - DNA, 13250 bp, Oryza sativa
aggtagcactcgaacgcgtcaaggtactcgagcttccccagcgacgccatggacgccggcagggtctcgaggttgtggcacgccctcaagtcgagcacgacgaggtcgcggaggtcgccgatggactccgggagcgactcgacgagcgagatgccccggaggctaaggtacctgaggttccggcacgccgccgccgccgcggcgcccaggacaccatccggccggaccatctcgacgtggtgctccggtgacgtctgccaccgcccgagctggagagtccccatcccccgctgctcgcccagccacgcctcgtccatctccaagtatcgctggctcaggttgtacaccgtgacatactcgccgccgccgccgccatggcggctactaccacgggtcctgcacagagtgacgcgccgtgtcgtgccggggaggcactcgtcggtgggttcgccgtctcggtcgaaggcgaagtagctgaagctccgcgcggccgcgacgaggaggtcccggaccgacgggtggaccctgcagtagtgcgccgtgtggcagtgtgggcggagcatcgccggctggaggaggccccgggagaggaggtcctggaagcacgccttcccggcggcggccgaccgcacgatgccctcgccgatccaccagtggatgagcagcctcctcttgatcgccttgccgctcgggaacacggcgaggcaaagggcgcactgcttcagctgcgggtccagggactccaagacgctcttcaggtggccggagccggaagggaacgcctcgtcgccgccgccgtcgtcgtcttcgccgccgcgggtgttggtcgtcatccgcatcaccttctcctgcagagctgctcgcaccagctgcacggctgatttgatctgctccatgaaggagcagagctcgatgtggtccagatcaagaacgtcatcctcatcttcgccgtcgccgtgaccatcgtcatcaccgtcgccgccgtacctgtgcaaggtccgaagatccatttgcatctcttcgaccatcgtgtcaatcttctgcagccggtgttggatagcagagaaaacatcgattggttcccggcgagctaacatggttgagtgtagacacgaaggggaaaatgaggcaacctgaattgtgctatgcacctaccacgacccctatcaccctatgatgtttatagtctttcaaaattttgcaaaggttggagtagtagatgtttattagtgttctgattttttttttaaaaaaacacacacaaaatttgggatgttgttgccgcggtgctaagaaaggtccatgggcgtgggggacgagcgagtccaggatggctccatagaggttaccagatagcaggttgagcccacgttcctcgtctatcctagcgagaatggggtcatcactgctgctgctgtgcctggaaaggatgggatcaccatcgccattatcgcgccgagggaggacgaagtaagtcgcagtcattgtgctgagggacgacgggtagcgtcggcaccggtgctattgagtgagtatgagaaaggtcgttgccgttacactgagaggcattcatggagaccacccttgtcactgtcagggaggaaggggagcattgccaccgtctccagacgaggaaggaagggggtcagggaaatgacactaccaatgggaaatggtacggtggaacaaatatccacgtcatttttgcattttcaatctgttgcctttgtcagggcgtctctaaaaattggaatttttaaagtaggcaaggggctgccgtgaaatactgatgacatgtgtgatgccttcactcttcaacctagacgaatcaagagacatgacgagaggcaaataaggaaatgaacatatcgttttgattgtctgaattaggagcttagcaactcactagtcaatactcaggatgatcagcctcacgctaatgcccaaacgtgtggtggcgaagctgcacttgggtgctagccagatgaaccgtcgagacgtcagtgcagggcatatgcatacagtcaatgaaccacatagtcacataggggtgttaccgtatcagatgggtatgatttgtgaaggcagcgccttagcactcatcaagctgggccgatgggttttgctctcttcgattttgggcccccaaaatttctaggggccctattccatcgctcagttggctcaccctcttcgacgaccatgatctttatagatattatgaaatcggtatttgggtatcatatttggatcgtggagtgtcggcttacaccgacaaggtatggtgtgcagatggatacctgatcttatctaatattgtgataccatataaatcctaaactacacacgttgagagatattttctctgtcctaaaatataagtattcttagaatagtgacaagttaaatatttttaactttgactattaattaaaaaataaaaaagatcaatcatataaaattgatgtaactagatttatcatcaaacaaactactatcatactccctccgtaaaaaaaactcaatctaagatgggataagacatattctagtacacagaatatgttacatcccatcgtaggttaggtttttttatagagggagtagtatgcaattattttcatttaaaatgttttattattatagatattgttggtcaaaataacatctcgaagatcgtgtcgaagtctaaaattggttatattttaggacggagagatcatgaacgactctcattttctcgtgtgtttcacgcctggctaaaaattaaaaaaaaatctactcctagcttggcacgtgacctatgcgtgatccgcaaccgctctcaacctccaagagctcgtgagtcgagaaatttccggcgtggtcggtgcccattttggtcagaatcgcacgagcaaagcaacaccccccaccccgcctgagaaatccccacgtcaacggcagcaaccctcccccctcgatctccgcctgtaatcttcgattcgtcgccggcaaccgccgcccgccgccccccgtcgatctccaaccgcagccttcgccgtcccgctaagttggagagcagcacaagtgctgctgggagccgcttgggggaagccggttcgggcgactgaacgccggggagcgccgccgccactcgctagctccggcctccgggggcaacgccgccgagccacgtcgccggtcaggtatatttcggtttttctgaatacggaaattccatcaacaccagtatccaagcttaagttaggcctcgcaaatatttcaatccagggatttgtgtgccgcatgataacctattagtattattaaaccatccttccattgctctaaaatttgagctctgtattggtcgatgattccacgaaagctcattggagcccccccaatgacccatgttaaatccacccctgattttagttcatatgctccgctttatcatttttagctaaagatgcatcatatggtagttcgttcgcactgtaatgttgcttcgcctgcttgtttgattgagtggctcttcctgtatgcatgtcctaaacaaacaggcaatggatatggatgatatgctcggtggcctgcgtgttgccggagtgccgaccaagagcgcaatttacttatgggggtataaccacagtgggcagacggcacggaagggcaaggagtgccacttaaggatccccaaaagcctccctccaaagctattcaaatggcaggatggcaagaacctcaggtggattgatgttgcctgcggtcgcgggcacactgctgcggtcgcttctgatggatcgctctacacctggggtaggtcctttatttttccttctgttctttaaatcagactcgaataatttgctaggtgaatggatgaaacttcaaatgaatttattaataccattattgtttatactgaactttgatagtttacttattatgtctcgtgtattttttcctcaatgttatgtcagcacaggcatttgcgtcagtgataaaaatactattatgtctgctcacactatttataagtcgtatcagtgttacaactttctgttttctgacataaccatgttgtatgtgtagtttagttaaaatagctatatagtttctaaaaggatcacagtactccccaagtgtacctaattcaatactaggatataaagtgcttagtttagtgagggttagtttgcaaagtcattttatcaattatagcgcttgagcgccagagctaagatgagttaattctgttgcacccataacagtggttttacttgttcctgaagaaaatcactcacatccaacttaaaaatatgtaggggcgaatgattttggccagttgggagacgggacagaggagagtgcaaaggaaccccaaaaggtgaaggcactggagactgaatttgtgaaatcagtgtcctgtggagcacattgtacagctgctgttgctgaacctcgagaaaacaatggcactatatcaagaagtaggctctgggtctggggacaaaatcaggtttgcccctcatatgattactgtccaatatgtgtgatcagcaatttatttaataaaatattcagcacttgcggtatccatgcagggctcagattaccctcgcctattctggggagcttttgcaccaaatacggtaaatttggattgcactgatctgttgttctttttgtgtgtttctagtagatatttatgagatctaaagtttttacctagtcagacattgcaggtcatcgatgctagtatttttcaaactcatcatatttaagtaatcacccatagtcttcatttcctatttatgtgttaatcttttatccctgtttgctgttgatacctgttatgccatggccacaatgcttagatagcagttcaaatagatgaactcttaattagttgtgtcatgtgtatgttgatgtaccttgggttaactgttacagaggttgtgtacatgcatgcatccaggagtccaaattccatagctgttactattcctagagttggttagtgccttaagataattaggaataagagataagattctaattaggaatatatatcatttgagttaatagaggcaagtgaagattataatatttctatatccttcttcatgttgttcctgactttctatatgtgacatccctgttgatgtagttccctgcaaccagctgctgggaagaacacgtccattgatctattgctactagcttataacagctaccttctcacattgaccacaaagtaaacacaataatgtatacccgcagtctgcattaagataaacctgtttagatttcaattggatttactctggcatattggcatcgtataccattgcctttatggtttgagtaaatatgatctaatccacaaggtaatgtatttgaggaaatagaatccaaatttcctcacgaaaattggttctataccatggaagatctatcttcaaatttaaccaccgaagttcactagtacactttaataccataaaaaattacaatctatttattgttgtttaccattccttcatattgcaaggatagaactgttaaaagctgacatttacccttaaatacaccctcacttaaccactttatctgtgcacgcatgagttttggaatcatctgtcttcattagctaaattggcagtgcacaaatgtattcaggtgtacaaaaccaatcatccaacagtaacaatcacaattatatgtgagattgcactggatggatgcacataggcatcgggtgcaacagagcagtcaaccatcacctgcgcttccagccagttcctcagccttcgctgcttgagccttgaggtatcccttccactatgattcccctcccagtacctcctaatccacatccctcccccatctcccttccctcccgctcattgcagccatggcaacctcaatctcgatccctctgcaatcatccagcaattccccatttccaaactttcaccctcttctccttcctctcctcccatcccttgttcctgcaggccaagtagggactgccccttagactaggtgcagcgctgtattgactggcagagagaggtggcattaaatgcaggagcagcgccatagtcagggcagcaaaggaggatttgatgctatggacagatcgaaacaggaggggaaaaggcggtattctcattattgaatttgataaaagaaaacaaaacaaacattagtcctaacagaataaggtgaaacgatatgaataaatctaaaaattaggaactttggatggcattaaaatgtaccggtgaactttgatggtaaaaatctaaaaccaggatctttcaatggtttagaaacaatttatcaaattccttaatgcctttgatgattctaaaccccatttgaagctgaagtgctcaacactgagagggttaaacataatggccatgtttcttttgcactagaatgcagccgttgctgccacagctgcagacacgtaatactgttcgggttggctgcactgcatctgaaataagtgcagctgaacagggccaaagtctttggagttacatttgcttattgaccaagaactatcctgtctgtgcccccaatatcctaataagctagtaaaaactcccggcatttgttaaataaaacaacaagcaaaagtggatgtgccttttttgtgcattctaggttctgcattctatgtgtgcatgcatctcatgtttctctgttattctaatgtgtacctgaaagtgtatttttggtcatttttcacttgtcttcgtttcagccacaaacttgttcattcattaatgaaaagtagatgcatatgcttgtttcttggctctacagtctgcatctacatgtatctcctagcattataagctgatctctaaagaaactgattggaagtagaaaatcaaaattgtgtcaggtgcacatctacagttggtttaagagaagtgaacaggttgctatgtgtgcttagaatgccatttatttcactatttgatatttttgtacttatgaattgcaattacttgttattttcttaacttgagatttgtgtcatgaattcattcttaaagatactggttggatgtacttaatatcttccatatgtacacaggtgatccatcaggtttcctgtggagctgttcatgtcatggccctatctgaagatggcctgctgcaggcatggggtaatgtgcaaaactaaaactcatttccatcctctatacacgtttttaaattgtgaactttttatgcaactgtgacactttgttaatctgatggataattggtcaatcagtagtgctagatcgttaggctaatgggatagctggttacgtgatgatatttcttgcaacaccacacaaacaagaggatataccccccaacttttttagttgttttatttctagctattaacaagatacatgcaacttttcttactaaccaggctataatgagtatggtcagcttggcagaggttgtacttctgaagggctacagggagctcgtgtattaaatgcttatgcaaggttccttgacgaagcccctgagctagtgaagattgttagagtatcatgtggagagtaccatacagcagctatatcagaaaatggggaggtgtaagtcatctcaaaggatgctgatctctgctgttggtgacagttatgtggtttctcagctgaaaaaaaaaggattgatttatagtggccgaactatatagtgctaactgtaaaaataaacaggcaaatcgtctctctttctgtccttttttttggaacatggcacagcagaggaagcccctgcagttagcttttcattaataaaaaagatactaatttacaaagtagaagtaaaagaaattgaagttacagggtcataatacagttcaaaagttgatctctcaaagtatcattaatcctaaaaaaagaagataacaatcctccttgaaaagcattgacaagtcaaaccaacttttttttttcaactgatgacttccttcacactccctttgctgctttattaagatcactatgtacgacataatatatgtgattttctaattatgtagacaccttctcaccttctgtgaacagaaaatgtgtcatatgcttataacagttaaatcatggtattacagaaaataattatgtagacaccttctcaccttctgtgaacagaaaatgtgtcatatgcttataacagttaaatcatggtattactgtacttaaatggcttgtcaggtggttttgcgaattatttgatttgctagtctattttttttatcatatgctcgctttgtttccaactagatgtcagatgtcaatttataatgcatgctaccaaacctttaaaactttgattagtaaaatatacaaaaaaaaaggatccattacatggtaattgtattagtagacctgttaaaattaatttcacaccattgcattgtctatacttttacaatttttactaatgtatagctataaaagaacgatcaagctgtgtccatgtaattttctaaaaaaactattgggaacagagtgcgcgttacaagtattttgagaattttgttcaaatccttcatgtgggttgtaacagcttattttatgccttctattgtggaacatatgtctaatagactaacaggaacatgattgtttctttttaatttttttaaatatcacctaattttgcagatatacttggggactgggaagcatgggacagcttgggcattgctctcttcagtctggagataaggagctgatcccaaggcgtgttgttgctcttgacagaacagtaatcagggatgtgtcttgtggtggggtccactcttgtgctgtaactgaagatggagccctttatgcttggggtggaggacatgtgggacaactgggcctaggacctcagagcggtttcttttcttgtgctcttaatggatctgatatgcttcttcgcaacattccagtcctggtcataccatcaggagttcagcttgttacttgtggtcattctcacacccttgtatctatgaaagacagccgcatatatggttggggctataatagttatggccaagccgctaatgaaaaatctacttatgcttggttcccctctccagttgattggtatgactctcagagtaatattctttcatctgtattgctatttttggtagttaattacagtatgaactttgaactttgcacatttcgcaatcctcagtcttaacctgttctttttaataatataggtgtgttggagaggtaaggagacttgctgcaggtggtggccattcagctgttttaactgatgcatgttctctaaaagaactgtgtgagttcaagctagcagagacagttaacatgtccaatgctcttctaatagaagatgttgcatcgcggactggtggtgatgccttggcacgtctgtgtgagaaattgaggtatgtacactgaaatttggagtcactaatgtttcttgtgtttcatatggtcaagtcctcatgcaatctgttttccaggccagtgagaaacattggtaacataaatcatcattagtgtgatcttagttccatgtgagagtttccatgtatctcggatatgcattctgcatagttgtctcaattattgaacgagcataaaatccacagtacatactaactttgctttcgctgttttcattcattacattagcctattagtttctcctctctgctactgattttggcatatttacagggagcatttggttgagcaaggagagtgtgagctgttggaaaatcaaatgattgaagaggtggaggctaaagcctaaatactctagtgattcatcgctccttcgtaggcattgattgaagcattaatcgtcttgttgcacttcatatgaagtgtgattgtagtgtctggactgaaggctctaattaattgtctattggactgtgaagtcccattggtgtctccaatgtgtatcaaagaaatggggactacatgtatgttgtatgtatcatgagtgactgttgttgtagagaaccaaataacctttggcaacttgagagctgtgctttgtcactgaaactaactgtaagattgagagttgccaggtcatagtagtgtgattcatgtctggtctcttttgttaactgtacacgttggaacgctagactccggttcatgttctcggctatgctgtggtttggtcctccgaatattaagcttttcactaaactctctaacaacaaagtcgttgtagtatagtggtgagtattcccgcctgtcacgcgggtgacccgggttcgatccccggcaacggcgatttctttttccctttctttgtttttttggctgctggcaacggcgatttctttcctttcccttgagattaacccacgcatttcagtttcactacttctgtagtcatcttttttattaagttatttgaaattgggattaatccgcatttcaatttgatttttgtagttcatctgtgctcttttacaatgcttttcaatggagtgttggttagtcgtgtgatttctgtctctcctgaggatttggaggaggccgtttggtttgtgacccaaagtgaaccatgcttaaaacaaatgtcttcgggaaaagaaaaaaggcattgttaaattgccactccttctgtcgtagaatatagcgatctaccattggacaggacatattctatattacatgataatatattaacctgtcaatatcggtagtttttataatacgtccaattatagattgttatattatgggaaggagggagtgtgccatattctctcgcatttcttactgtcaaacacgcagctttgccaaaattttgatctctttacagctcaccaaataatagcttagctaatctcaccaaaatattggtaacagcctagccagtctcaccaaacttttgacaacaatccaaacgaacacattttaccaaaggtgcccattcgctatgagttttttaacacacccgattttgcaaattccagttccagctagatgttccaattgcagagacgtgtaggcatttcaatgctgctgctcagagccccattggttttcctaataaatcaaagcaaaaatttaaatttaagtttggagttgatcttaaaatatgttcacttttaagtcgctaaaaatacaatttttttgtttataaactattgttattctctaataaacagttttgacttgttagaaaatgcaggcaaccaatgagggccttgaccattcgtccataatgcctacgaaatgatttagaaatataatatggtagtgcatacaattctcagaacaaccaacaggtatagtgatttgcaaaggttattaaatacaataacaccatttagcaaccaaagcacgactatcaaaattacatgataaaattattattgtcttgaattatgtaaacgatgataacaaatccttttccagctacaaaagaaccagcataacaacaaagaattataaagttgcttaagtaatctctcccttcatctcaaaaagagctatatctagggggcctaggccacagcaacactttcacttaaagggtactttccatcctgcgacacacaagctcccaggatcaatctacttggccttgccgttctcgacagcagcagtcgaggggttcagctcatcccaggcctcgatccaggtgaccatggcatcggcaagcttgacgaagtaggggtcgatcttgccgagcttctccctgacctgctcggcgagggagaggtagcacttctggacggtgtcgcactccttggggatggtggcgttctggaagaaggggatgatgtcctcctgccagaagatgcccttgtattccttcttcaagttcacgaaggggttgctagccttgctgtgccagatgtacggcagtccagtcttcactcccaggctcaggtggtcacagatgacctaaagtttcaagaattaatattaattattattttgtgaatggaatgttcaactgtgcaatgagaaaagacatatcatgtaatagattcatggtaatgacttataacttttcgacagaaacacaaaccttcatgcaccatccagcccacatgtcgtcgtagcgaccaataggctggccatcacccatgagaccaaagtacattgcaggaccgatgagatcacggtcaaaagcaaggttcatgccacacatggggaacaaggttcccttgggcacagtcatgacagcatcaacatacctgaacaaaacaaaaaaaaacaggggtcagtaaaacttattgatgcaagagaattgctgctgaatatcagatcagtcaaagaacatgcagtacctggagttcctctcacgaggcttgaccatctgagtaggagcatcatagtcagggatgttaagccacaggccgtgagagacagcagtcttggctccctccctgaggctgaaggggtaaccacggacaaagtcagcgccttcgcggtagggatcatacaaggtgttgaagaagaacggggtggacgggctgaggaggttcttgatgtgctgctcaagagcattgatgtccttgccagatgggtccttggcaacctacaatgccaagtcattcagttggtatgagatctataatgcaatgctaccaattgaaacattattacatcaagctaagctattaccattaccaatagaatgaattcgatcgcaacattactagaaaatgctacataagctttgaacttgaatggaagatcaaactggttcttaatatatttgattaagaaaatgttgtggatctcgcacaggagagagagccaaaatcacatcattatgtcaatttcatcagaaaagtaaaaaagcctgaaattgacctcaaatgcaccctcaacttggatcagatctgaagcaattatcccagatctagcgataccaaagcactctgataccgtttggttaatacttgacaaactgaacttgtcacatgtgaagcagacaagaccgcgtaagataagacgaactcccctaaccaaaatgaaaaggacccatctaatgacaatcatttaactaaccaactaactggcaagatctaacatcaactagagaaattgaggcatgcgtaattatcatatactaataattttaacaacacataaagccagaaaccaaacaaaagtactaatccttttcgaacactgcacctacctaccaaccaaaaaaacaatgtgatctaccacactagctgatgctcacgctcaggtgaagcaagggat

SEQ ID NO: 11874 - DNA, 20063 bp, Oryza sativa
cacatctccaggaagtccaggtgcggatcgtcgggatcacaatgtccagctcgtccttgagcagcggcgtcgacggcaccgacgccgacggcaccgtcaccgtccccgccatgatctctccctctccctctccctggatctcgcgcgcgcggaggaagaggaggaggaggaggaggtgatggtggtgaggtgtgaggtgtgtgtgggtttgggtgggtggggaggaggaagcgatttatagagcgggagctccgggaggacgacgactttgttattcgtttccttctttgctttgcttcgcttgccttgctttttttttaaaaaaaattgtgtataattaattagataggagtattatattattttgtgcctattttgttttggtttgcgtcatatgtttgccgaattttgggatgcgtccaaatttattttgggttggatctgggagagacctgtcggtgcatggaaagagagaacgtgtgtaccagtgtagaaggtttgaatttttattttttttggtttgttccaagcggtggataaaagataggggtatcttaatatcgtttttattggagataaggggtaaaagtgttaaatcaaatgaaatgcacaatagtggcagtggtttaaagctctgcttatctcaaaatcaatggaaagaaacggccgtttcctaaaatagaaacaaacaaatactccatccatttcaggttataagatgttttgactttggtcaaagttaaactgttttaaatttgactaagtttatagacaaatatagtaatatttacattaccaaattagttttattaaaataataattaaatatatttttataataaatttatcttggatattactattttttctataaacttgattaaacttgaagaagtttgattttgaccaaagccaaaacattttataacttgaaactgagagagtaagagtaagaaacttattttgtctatataatatcacttccaatagatgtttttttaaagcttgcagtttcaattggttacagtttctcaaaggttaaaattcctacttttatattaggtccgaggcattacgcaatgtttgtcttgataaaactagatatactctctactatatcttaagccgctacaagcgactcaacatttacaatcatgagaacctaaaccactattaacgcctcgtcatttactgttatggagaacatgattactattttatgaacaattgttactaaaatgacaacatatttatagttgcgagatatacttacaatctttgtgaggatacattttactattttgtatgaatacatttatgctcacgagggaagaatggtactattaccttgagctctactaagcacttactatttgcttatttgtttgagtatggaataaaatcgggtgcaatagctatggtgactgtaactttgatggtcacaagtgcatgcaaaatgaatccaataaccaactttccgtctcatgcgagaaggtgaatagcgtcgtcaatgatgacttcaccagcacccgtaacttccatctctctaccagtgtcgaccacctccaccgctaccacgttcaacacggagcacatctccacaaccaccgaagtatctccccgtcgaattccaagttctttgtttcgtcgtggagattgctaacttttcacgctcatgtaatcatttgcaccaaacattgcaattaatcgagctttaaaaaatcgggtgcagtagctatggcgactgcaattttggccaatcactatgatatagagcatgcaaaatgaatcaatgttattttttaaagcccgcagtttcaattggttacaattttttttaaggtttaacttcccaattttattttatgtctgaggcattacgctacatttgtcatgttaaaattagatctaatctctagaccttaagccgctacaagtgcaccaagatttacaatcatcggaacctaaatcactactaacgccctgatatttaggatgacctaatctaatctctgtcggcttggcggcatgaatctctcactcgcagtcttcggctagcatagtgatgtgaccatcaagtatatgcatacaaacaagcatgagaaatataaaacaatgccaaagaatacatcggatgaatggaggatctacaagatatttgagtctaatgagttttggaatccagttcgacctccaaagacaacactgacttcaaacagacctagcgccttcatgtcaactccgatttgggtgatcttagacttgatggaaagcttatctcatcgcctttcaaatgtatccggtttcatatccaaattcatctcgagtcaacaggaatcgtaaaaacaagacattattgttgctgaaaccaaacttgggccttctaatagactagctaggcccatctcggaagtgtctccctccacctccacgaattagcacttaactctagatctattttcctctgtaaatgtctatgtacaccctctggaacaattgggtttttttagttgaattttggcaagtgccattcaccttgtctctagtgctcgctcgattaatcagcgagtatagatttagagcccccaatagtgggtgtgttgatttgccgggttgattagatctatcacttcaatcgcaactattactttgtacttaatcacctattcgcaatatttagattgcatcttatcttgttcttgcagtgttctctcgtttgcattgcagggatcatcaaccacgcgccgcggttggtacgacatcatttgtagtgtagcgattgcacagtgtcctggatttgttctggttggtagccacgtgttaacagcgaaatttggtaatcggcaaagacgtcatcggcttagaatcattatcggctgcagcatctcggaatcagccgatggaagttatcaagtcgccaatagtcggattcctgctatattcggttaaggaaatcaatctactaaaggaagcttatccctaggtgaccgagtttaaagaggatgtggcatggcagtttatctattaattaggaatagtttgttagtttccttttatctttaggaaagtgtgtttagtgtccgataaggactttatatttcccttttatctttaggttagtttctttcttgtccgacaaggacttgtatcgacccatgggtataaatatgtacacccggggtctatgtaatttatcttcacgatcaatacaattcggcgcatcgccaccttttaccttttctactttattttatcgtccggcgggacttggcacctgacgcggggctgcatcggtgttcgatctccggcgaaggggtaagtccaatgttccgtcggcccaggcaattgtatcgtttacgttggcgtcgttcaaggctgcatcagtacattcgatctcttggattactctggtttggatgatatatttgcctacctatttatcatatgtctatgttaatctagtcttaacatatcaatttagctctatcggttgcttctcgttttagggtttctgccggtatcggctaaatcgtgttgctagattagattagcttagacatctaccaccctgaaaattcagtcaacggcttgattgtctagatattatgtttctttttatacttagtgctgcatcagttaagtttgatctactaagtcgtgcttagaactataatctctagcctgcctcttgattgccaataagggtttcatcggggtttcagccggtgagttatctggacgttgcatcggctcataaggattgcatatacatataagttggattttagccgatgacaacaaaggtttcactgtttaatctaatcttatggatttcatgatatcggacctccagccgatgtgtgctttaaccctcggatcgatgcttatttattatatcttgtttctagccgattggtttctacaagactatattgttattttattatatcatcatcagccgattgcctttatatcattatctacattggacatatagccgattgcttaaaccctatcgctatcggctggtatcggcatcggctgttatcggctatcggctggaactactccatcggcttgtcagccgatcggctgttttgatctactatttgcatatcttgtcagttgcaggatcaaactgactggcacgcccgcatctaatcaatctttggacctgcacaggagctaagcagatctctcaggccggtgtgttcgattttttcgtcaacaccacgtcacaaacatcgcactcgatcaaagcgagagttatcccctttaccggaagatcgggccacgagagagtgtcatcacatagtcttcttcctcgaacatgaactcaacgagattagaggtagttctagatccctcgtgtcagcctatgttgctcctacattgggtttatctagatctgtattggctcgtcttccattggcgcagctagatctgtctagatgtgttggcgcgttgcctttgctccctcctcctagggggccttgtatttataccctcggatgtcctcttgcccaagtaaaactagtgagacaaatatggatacgatccgagtagttcttgtaatgctagagtagaaccctgcttctcctttccttatccggaacacctttctactcgatataaataccacttaattttcctccttgcgatggctcccaaagcatagtgtaacctattgctgctttcttctaatggaatggcgtgttgcgtgcaaccttttatgtatttgtgaaaaaatgtccttgctataaaaatatcacctgtaaatgaatccataatccatcgaggttatcgatcacattaggattgtgttctcccccttctttcccaactcatctccctctttttacgcacacatgctttttaaacggctaaacggtacattttttaatgttttatatagaaaagttactttaaaaataatattaatctatttctcattttttttaatacttaattaataacgtgttaatgggtaacactgtattccgtgcggtaaggtggagtttccataatgggcagcactgtttttcgcatggacggtgttgctgtttaagattcacacagaagggaagggaagggaagggaaggaggtgggcttggggttctcatcaaagaagatatgacgtgaatgaaagcaacggtaagctggagcacaattaatatatgctcatatactccgtatgtatatggcatattccgttggaatctcttcgtacataacttaacagggtgaaattggatgcgttgggatgaaatcagatggatggtaacaacagggtgaaagggcagggccggatcggatcggagctggtgctcatgattttggtgagcagtggaattcaattgagagcaacaaggtttgccgtactcagcccggtgagacgtgagtagcaaagaagcgcgcagctagcgtggaatttgatttgacccagcttagctactactactagactactccactgcctgcctcgccttcacctcacctgtgtgatttgtgaatgtgctaccgtgaccgtgatgaagggaagcagtgagaggttggcctggtcagtggtcagcacgtcggccacgggccgccagctagctagcgcccagatctgttgggtttctgtacctacccggtaattggtgcgccgcccgctccgctcggttgggtcgcactcgcgcacgcggttaggcgtgccgtatataccatacacacacgtaggtggagtacgcggttaggcggcagcaagcgagaccggggtgtggatcgatcacatcgcgcgcgatggaatcttggaatcggcaaggggtcaggtcaaccaaccatgcgcctgcggtagagagacttgttccactccactctacgactcgacttttccactcaagccggtgtttctttttcatcctatcataggaacgaccacatgtacagattattgtaggcacgcatagcacactcgaacaaacgaagacactcgctacttttttttttctcttgcagtctcactaatttcctactaataataataaataggaaaaaaaccaaattacccgtgaactatcgggtgattacgaattactccctagacccgacaatcggtcatatttcatcttcaactattattaatacaaaatgaaaaaaccctcaattttacggacggttttggttctatgtggcattacaatcaaaatttacttttagaaaaaaaaatgatgggatgaacatgtcatattctacctactatctgctctttcccctccgacggtcccacctctctatctctctctatccctggccgaggagccgtggcagttgcgagcctcctctcgcacgtgctggtggcgcctacggggctccttgcacatgcaccgacagaggccgaggaggagaggcgcgagctgacggaggccgaggaggagcagcggtgaaagctacgagccttttcacgtacgtaccggcggaggttgaggaggagcggtggcggctactgggctcctcgtaacgtgctggcggaggccgaggaggagcggtggcggctccgagcatccttgaccgcgagaaagctcgaggcaacagcgggctcgtcgccgcttgcacgcaatgtcctactccactgatgttgcaatccatgccgccttctatggccccatcggcaccatcctcatgaacgaggtcgacggtgcgagcgatggctctacacaaatcacgccaccgccactggcaacgaccgccgctgcataaagcatgattttgtcccggctgctccaatctccacccacgatgacggtggcatcgatgtcctcgaggcggagcttcagcaccggcagagctgtgcctccaccacagacacacacatagagagagagagagagtacgctgggagggagattggctcgtgggagatagataacaagtgtaccgtacaattattattattttctttgttgactggatttccatgttgacgtcatttgtgcaacatcatggtcaaacccgcccaaaacagtgttagtggtaatttatccgatattaataattgatggtataaaatgtccggtatttaagttaagagggtaattcatactcattcaatagttttaatagggtaattcatacttttttattattataaataatagaatcaacgatttaattctttctatgaactaaaattgggttgttcagctgtgctgcacattgctgcgtcacaggttgatataattaatagtgtgtgtctaatgtataaatacgtgtgcataggacatgtttaatggtatacggagtacaagattattaagaccgcgcgtttttagatgagatgataaaaacttaactattaaaaaataacactctaattactattatttcatttttctttttcatcatcatacaatggttgtttccattttatagaggcaagaatcgagccgttgttaagcataacaaggatgttttgtctcaattctatctctttctttcatgtcaacaaatcccttctttctataaagttaaggctaaaagctcaaacctcgtgcttccacgtcatcatcaaattgtgaaccgttggatgaatacattagatcacttctcagatgttatatggaatgcagcataaagcccaacccattagttaccaggtaagtctcttcgcctcctcaatgctaaatgtagcctacatgaacacattggcccatctctatacacatctacatgtatccaacccgtcaatccgtataaaagagctttatggctgaatgtttcttcagttgacatgtgctacctaaattatctataaattttggatagggctgttaaaaaaaatttctctaagaaagctatttgtttcttcttgagattgtacctcatatctaataaattgatgttaactaagtcccgcagcaacgcgtggggtatcatctactatttctaataagcaagactaacaaccctttattaatgatcattgtacatttacttagcacccacacaaagccttcgccctctgaaagttttgaactttccacataactttttacatatgtgtattttcaatagaactttgagaggaaggctttaataggaattatggctagaaacttaaagtcttccaatgtacaaaacttggttataaaaatgaaaagttcctcctgttcatgggcatcgtaattatagagtaattatatgaaagttatactatagttatatttgaaagatttattctgatactccctccgttttatattacatgtcgtttgattttttcgtagggaaaattctttatgtttggccaagattataaaaaaaattagcaatatctacaacaccaaattttcatgaaatctaacgttaaatatgtttgattttgtattgaaaatgtaagcataatttttataaatttgatcaaatttaaataactttgattacgaaaaaagtcaaacgatttataatatgaaataatatggagtagtagattattcatgagaaagactatcaccagatttttagatatatcctataaaaaaaatcttgcatgattttggtgcctaattgtacaacctttccaaactaccttgactctgcctcaccggacctaactacaacataaatatccctttgactcattgccaagcccacgacgtattgtgttctctctctttaaacccaaatgaacatccctgaccattttaacccaaacactacatcatgaaccatcattatcgatcagagaagaagtgggacgtggccgtggactttgtggtgtggagatgaagaaatcctattgaaatgagaagtggaggccgtcgaggacatgaaggaatattaaggcacgcacgtcgtccgggagagccggagaggtggtaatgaactatactccctccgtcccaattttgagtttttatttacaatgtttgaccactcgtcttattcaaaaaatttgtgcaaatataaaaaatgaaaaattatgcttaaagtacattggataataaagtaagtcacaaagaaaataaataataattgtaaaattcttttgaataagacgaatggacaaacaatacaagcgaaaacttaaaatcccttatattataggacggagggagtaactaacaaggtcacaaggtgcaatatcaaattataggacttgcagctaattaagcttgcttctagtttagccgactgattgatcatgcatcagtaagtcggtattagtaccgtgtggtccgctaatcatcatcatcatcatcatcatcagcatcaacaacaaccttgtacggagctgaatttatgcataccagtagtagcttgttgactctagctcgatcgatcaccaattcggtctaattatttgattttttttgttaataatagtagttttattaaacccagctaaatatattgttctaataacacttctagcctctccaccgtaacagtgcaaacaaccaaacacatatccacacactaagaagataaagtcaatagaaaatcaagagccatctattcgtaggctagatcatcacctatgtgttggggtaaaaaaaaaacttgtttacatgcttcaattgtagacaaggcgtaatgacaaaaccctatagctgggttctcaagaataacccatgactggaggcaatgtgtaattagaaaataatctacaaaggaaaataagcattttttctttaaaaaaactcattatttctcgagagccaattgcaccaatgagttgttgccaccacaattagaataagagatctaagctcttgagtttgtcaccaagcctaaatatacgtggcacattacttggcgaacaaaatgttcaatgcaaccaagattaaagatcaaaccaaccgggctaaacaacattaaaaaacaaatgttttattatttctttcttatgataattcttattacctttctaatgttttattgatatattttcttgatgtaagtaccacaaaaagttctcattttgagagaggctttaacttacatatatttctgttaacattaggaacacgcgtatgtaccaacacacgctaatgagatttagctgagaatctcctattggttgttagtttctatttaaattcatcttgctcatgaaacaaaacttattagcgatgcaggtaaagagatgattatgtactaccaacttagagccatcaatatctcaatgccaagtgaagttaaaagggattgtttggaaaacatttgagatggtcacatgtttatgtcttacaaccatgtagatatgagggtactgttctcataaagttgtattacctaatcatttatcttccaaaaaatcgaacttgagtgctatccttacccgtagaagaatcgaacttgcaaacattagatttggtccaaaagcatgaatcctcatgtttccattatacttgaaatagagtttgtgatcccatatatttgttgcgcaatatttattgtcacacttcattagttgtaagtaacttaaaaaccatttgaagaagggctatatttttaagttctaaatcatgaatatccaaaaccccttaatctttaggacgacacaaaatgtcccatcttgccaattgttggtatttgttattgtcacagataaatccataaacatatggataccactacaacacttcgcctcggagtattccaagggtatcgaatcatagggaacgtgtgtatatctaagaatataatccaatccaaggacaacaactaatgataggcttaggttagagaggattcatatggtttaattaactagacataagttaaaggtaaaaccctatcgattgctttgggcaccagctctcctctggtctgtcaagctgagtcagcctgtagctatgtacccgaacatgtggagggatacaaagaacggacatagctattaccacctgccgcctacttcattttccgtggatcacacaacaaatgaatgtaaccgctaacctagacatcatgcctaagttattgattacaactcttgtctcgctcaggaacttcttctttatccaaattcctagtactagagcacttaatataaatactaagtgacgaacccgcaatgatgagaatatatctcacttaagaaaataaattaaataccaacaggaaatctcaaacacttactttattaaataagcattcgtcgaggtacaagaggagaatgttgatagcttcggcactctttcaaacctttcccccactattctacttattttctctacactactaaagtgatgtctaaaatataaaagtgagttatactctactttattgtgtgttgtgaaatggcttgagctccttcttttatatgtccatatgacggttggaatggcagttgtgaaggccagtgcacccacaaccatcattaggaggtgcacctggccatccacgttgaaggtggagatgaggggcccatatgtcagcccctagaggaaagcggtggagacaggtagggcccacattttcgatcgaaccttagtttttctttgttatgatgcctcttagtttttccttttgttttctcccttccctccttggatcaggctcctctaccttcaaaatcatttaactttctcatataaagacacgatgcatttaaagacagaggatctcgatccctctcgtgacggtcgacaaatctagacccgcaaagataaacacactgttgagtttactagtccaccgtgctagctagctaggtgtcgcgttcaactacttgtgatgtctctggagatcatatcgctaactgatcagtactaactacagtattaaccaatagctgctactctgtccttttcatacttttcatattataagtcgcttaaacttttttctaagcaaccgatcaaatttataaaaaaaattagtaacatctacaccactaaatataacatgtttcattaaacataacattgaatagatatattttgttttgtattacaaatttgatacatttttataagcttgattaaaatttaaatatatgataaagctacttataatacgaaacagacgagtaattaattacgatatatacatactccctccgttctataatacaagagtttttgaagggatgtgatattttctagtgctacgaatctagacagcctctttgtccaaattcgtgatactaagaaatgtcacgtctttttaaaatcttttatattttgggataaatggtgtagtacatatatagtagtgtaggtgcaagttacattttcggttgagacaaatatttgctgggatacgtacactagtagtgctccttctatatattttatattcatcatcacgtaagtataaaaatgtctttttaattgatccttatataacctgacccggtccttcacttaacatgcagtattattatatctatacatacatgtaattggggtattagttaagaactcgttccttgtatataggagagttaaagtctgcttgtttcttatactcacatcaaatgaaatacatggaagaagttaatagccctatcgtttcgcttattagtggaataagtcaaatggcatacttataaacaaaaagtaatatgtgaataaaacttttatatacgttttcttagcgttttaaaagcaaatgctgaaaaataaacttcgatgaaaaaaccttaaaatcagccttaagcataaatgaaaagatgaggccttatgttttaagaaaactttgttactaaatatatagttttgcgatacttcactttaaatctatagttatgtgataaatttggtgctaaatatatattttttgatacatctctataaatatatagttttgtgataatttggttaacgtatatgtagttttatgaaatttattgtaatgataaatagtatataatagagaggcagtagtatgctaaggggagaagctatattgtgttttgacgggtgcacatgaacccttcaaatttataatttcacttaaaatcactaaaatatatagtgttgtactgaaattttctagattttcaatgacagtgcaccctcttgttttaatactagcttcgtccttatgcaaccagcaggctgaatgacgcagccgttgaaagtcaaaatttaaagcctcgtaccccagtacaagcagccacgcaggcatcgagcagcgacacatgcaagtgcatcgcgttttccccggcctttttccagcacatccagcctgtgcgcgcgcgtccctttgcgtgccccatcggccatcgccagcccaccaccatcagctgcctgtgcccaagaaaaaaaaagaagtttgcacgactaaactcgatggattgataaaggaagagtattagcttttctttccctttttttctcgcctaagtgtacttattatatctactggtaatagtagtacgtacgatcgctagcctaactaatttggttctactaattaagatcgttcggtcgcagattttgtcatgtagcgcgcgcatcctgtttactgctttgtgacccatgtacagggaattaacgtacagatctgcacacagtcatggattcccgcggccaaactattcctcctcttattaatagtcacatgatttcccggatgcccacccgccacccgcacgcttgaagaaatcccgtcagaatatatactccccctgtactttcataaatgacgccattgactttttaaccaacgtttgaccactcgtcttattcaaaaattttatgcaaatataaaaatacttatatcatgcttaaataacattttgatgataaatcaagtcacaataaaataaattataattacataaattttttgaataacacgaaagatcaaacgtttgtaaaaaagtcaacggcgtcatacattaaaatacggagggagtatatttctattcttttctcataattagttaggcacaaaattttagagcgatttttcaattattaataaatggaaacttacaaacttaaagtgaggagaattttttttgagaaacacggtataatcatagacgcttacaacacgtgcacgctcatatctttatgaacacatatatacactttatccctataaacatctcccaaagactaaaccggtatgtcatgagattgatgaagtcattatggatgtctcgttgttgacaggtacatcgtctaccaccgaaagaataattagccataaatacgagcaccggtgtcaagtatagaacttgagaattttgattacatgaaagacgcgcagagttacacttgcgaatgtggagtgctcctccttaatacgcgctcgaagagacgaaggctagcacaaaaactttagcttacaaaaatactattaaaagcatgcaaacatgtattagtaattgtaagtatcacctactccctctgtttcaggctataagactttctagcattatccatattcatatagatgttaataaatctaaacacacatatatgtctagattttttttggaataatcaccggaggggagagtttccccacctgaatccactactagaaaaatcatttgttggtacgaaaaaaatcgtggcatcaatactaaaattgtggcaatagatgcatgttgccacaattttaaaatcgttgctagccgtggtaataaatagcgtggtaataggttattgcaacgatttttttttgtggtaataaatttagatgttgccacggaatggatatggcaaaaagtcatattgcaacacttcacatcgttgtaataaaaattattgccaccactccatatgtggcattagttttatataccaaactaaaagttcaaatattaatctatcatcctatctattttatctatttattttttttgatattgtgtcttggctaggattcgaacccaagacctatccttcacgcatgctctcctttaccaactcacctacgcatcaattctgttgaaaatgcatatcgttccatttgagcctacgtaactgagatttgaatcatagatttgaatatctaaaagatttcaaatgaaaaggttattacctataaaattatagatctcgtcgagagctataatttccatataaaatttgtctcaatccgtgttcatatgaaaaaattaagttaaattatgagacgataatttttttattgcaacgaatttgttgatcgtggcaacaaaaaatagtgaaaagtaccatgtactatgtaaattgccacaaaaaataaaattgtggcgatagaacatgtttttttgcaacaatacgattttttgtggcgatatctcattttctattgcaacaaaactactaaataaaacaacgattgtatatcgttgtaataaaatataattatttaccacggaaaaattatcattgcaatagtacaatatattgctacgaattattttttgtagtaataatttggtggcaatagctcaattatcttgtagtgatcttccattgctaaagaaagatagttctgagttacagagattgggctataccagcggcgagccattacagattaaacagaagaaggggggaggagaaactgagaataagagaggccaccaccttccccaaagagacaacaaattgatgttaggcacctgcaaaaaacccaaccaaaagccagagcaacctaatgctagcacccaagctcatcaacaaacatttccttatgcagacttggaaacaccagtactcctcgtcgaagggcctttctgccacaaggtcagcttggtttaatagcgaccaaaagactgtggaagtcaaaaaccacccgcatcaagccatcaagaatccaacttaaacttgttgctgcttgtatcagtgcatgccgacgccctttgggggaaggaagccccattggagggagggccactgaaggttgcggccataggccgctcgcatcgagttttctttaatccggctataacaatttcttgcaagttccacgccctccaacgcccttttagggaaggaagcctcaaaggaggaagggtcgctgaacaatgtggttgaggacatgccaaggaaaagagaggagacgaatagggagctagacaagagagaagtggtagatgggggaatccaatagatggaattccaacaactgcggcagcagggaagggctcaagatcagatgctaagccagccgaaagagaaccaccagctctaacaacaagacaagccatcaagcaaggagcaagcctaaaagagatccagagagaggtgaggcacgagcaacacctagatgatggatgagagccaagctggtcagggcaaggagtagcacaggttcggtggctaaagagacatcacagttatagagcgcctcaaagaggagggaggacaggggagggaagatgttgctgggcaaggtcacatttatagagcatcgtagaccacagccgttgaggccacagcccgccgccggcgccacagagccgaccacgagccgcgggtcggcgcaccgccagccggaaccagctacggtgcacaagccgtcgaggccaaagcctccaccgccagccgcagggggtggggggggagacgaggcccgctgccgggcgccacagccccggccatcgcaacctccgcccccgcggcctccgctgtcagccttcgccactgctacctccgccgccggtcgccactgcgtcttccgcgcgcgccgacctcctgtgccggctgccgccagccgccgagtcgccagacgctgccacctccgcctcccattgacgccgcacaggagtagcttgctccggccagatccggcgtggaggcgccagatccacccgtggggaggctggatccaccgcctccaccccgcgtcattggactctcctccgcgcgccggcccgttttccacgcacagagatgggacgccatcgagtgttggcctcgctgccgccatcctggctggccgcacggaactccgacggcgcgctccggcggcggcgagggaagggagagtaggagaaagtggcggcggtggcgctaggtttcccccgagtcgcccgcgcgtgggcgacgcgtggggcaagaatcataaggttctgtacgtttccaggtaccatatatgtctagattcatccatatatgtctagattcattcgcatatatatgaatatggacaatgttagaaaatcttataacctgaaacggaggaagtatatatttttgaacttgggatgaagtttaacaaggccacgacagagacggctccaccactgctacatttcccaaaaccggataacttaaaattatatttaatttatgtttcaaactgttgcaagactatcattttgttccattcaaaacttaattttgcagaattttcatactaactatgaattctatacaagtttactgttttaaactaggtattttaaagtcgaactttactgttccattgactcgttttaccatatttgagcaaaggcaacacaagtgtctatcgacgtcatgacgtgacctccacggatctggtgttgatcgatggactggatgaggtagagccagagagctcgctatggagctggcgattcgagggagagtaacttgttactagggttggagtggtaaatggtttaaccttttagcgtataaaatttgaggattggatctaaaatttataacctattcatttgtaacctaaaaattattttagtgctagacagggttgtgaaaaaaaatccatggaccttaacccattactaaccatggaggcacaacttttctggtttctgctgagactatccgttacagttagagcttatttggaacgtaggattttcaaaacatagctagggatatgaaaaatgtgggatcaagtgtgtcatctcaaatcctttgtatgaaaaattacaggaaaattgcacgaataaccatttggatggagcacagaaaaaatacgggaataaaaaatagagatagattacaaatgaatttttttcgaggggtagaacctcatgttaagaattctccaaaatctcctatgatttgaggcactcctaaggaatttcaaaagaatttagggaagccatttgtttgttccaaatgaccatatagcaattttttccttgaaaaaacaaaccctctaaaattgatttgttccaagagagcccttagggaagtcaatggcatcactgtatcgtgttgattgatgctaattatccagtagctgcgtgaggatgaagggtcaaaggctgaggtatatggttcatggaaagatacaataagttaaaaaaaagatagtggctaacaagtaggccatgttttaatatatatatatacaattttctatttgtatgggtcggactgtaaattaagttattcgtactaatatactccatccatttctaaatatttaaagccattgacttttttaaatatatttaaccattcgtgttattcaaaaaatttaagtaattattaattattttcctatcatttgattcatttttaaatatacttatatgtatacatatagttttacatattttacaaaatattttgaataagacgaatagtcaaacatgtgctaaaaagtcaacggtgtcaaatatttagaaacggagggagtatgacacaggctaaaagcgaaaaaaatgaagtgctaacctgtaaaatttacatgggcccattagaatcacgttagcatttaaaaacacagtattctttcatggttgattcgtttgcttttgcctacgtagaggaagggcaataccgctcgaggctttcctgcgttgtaaatgcctgagtgcctacccagcttcctcctcctcctcctcctcctcctcttcgtcgtcgtcttcttcttcttcttcttcttcttcttcttcttctcctctctctctctctctgggttgtcaagagagtgtagtttgggctaccgtttgttggaaggccctagcggtttagctctttttaaaaagttctaccctacatgtaagtgagatgatcactaacaaccgtcatatagaaagcacaaccgccggggagaaaatgatctcaggatcggagccctgtgaacctttttctgacgtacgtcactgactcaagagattaaagaaaagacactgattcaatagtaaactcctatatatatatactctttttttcttaaaaaaaattacactcgtacgcttgctcggtggtaaaggcacaagtccttaaacttgtcttgactctatcatctatatatattcttgaactctcaaatatattttgggtttccgaacttttcggggtgccatcataagtccaaatggatatcaacccactatgcgtattaacatggcatgccacgctggatcctcctcctctgcggggacttggtgctaacatatggatccaacgtaaaaggaggaaccgactgacaagtgtcgctcacaaacttattttttcttctcctattcttttctttttccttgtcttcctatagttcgccaaagagcagatgctgttgttgacgatgagtgaaggacggaagtgagagatcgatgccctccattgacgtactgaggagccgcgggacagaaccagcggcgaccgcaaccgtgaactcattggttacgagggagggagagaaagaagggcgagtgacatggacatgctagccatgggcacagagtacggtgccagggatttcacctcaccatctgcaagtcgtcaagccaaagagatgggggacaacctccaccaccgccagccctcggaggcaccatcctcctccacacctctctccctcactcatctgtgccaccgtcttctaggagggcgataggatgggcgtgtccctccgcgtcggtagcacatcgcctatgttgttcaagatcgaacagatggtgcatgctcgatgcaatcggcgatgccgatgagctctgtgccaagcacctccgcacctccactccctctcctattgatgcctccatgaatctctatgcctttctcctcatgtttttaactccatcacaacattccagttgaccacaagtggaaaggcgctcacgtctaggctattgtcgggcaacatctccttcttgtcaaagctaatagctagggcgccgacttttgtcgggcgagatatcgcctggcagggg

SEQ ID NO: 11875 - DNA, 324 bp, Oryza sativa
aagagaaaaccccaattaacaatacattaaattatcggaattgtcctggagaattttttttaattctctttgctatgaaaatcactaacatgacttaaagagtcaagctaataatttcttcctttgcctttggtcatgaattgttcccaattcactcccctctcagtccgcggtttcgttttgcatgacgaaccgtatccgtttcagttcacggaaccgtttccgttcttttcctaaaacggcaccgcattgtttttcctttttgggaaagtcctagtctcccccttgtttcctttttccctccccctccccagccggccgtgc

SEQ ID NO: 11876 - DNA, 1851 bp, Oryza sativa
gtgtcctctctagcgtcgcggtcgtcgatgatctcgtgcttgccgccggaccgccgctgccatcgtcgtgttccctcgccagttttgctctccggtgagaacctccctcttgttttagggttagttttctcctcgttttagttggtttgagtcgtgctgctaaaccctagtcgttgcaccgcgcagccccgcctagccgccgctgtgccgcaccgtttagccgagccaccgccgtgccgcgccgtctagccgagccgccaccgtgccgagccgccgcagcgctgctgtgccgagccgagccgccgcctagcagagccgcgccgctgccatgccaagccgccgcctagccgagctgcttgccgccgttgtgccacgatcgcgctttgctagaacctagccgccgtttgtcccgttgcatggtagttgagttgtttagccgcaggtgcaaccctaggttcataccgacctatcgtttgccgtaccggggctttaccgtgaattgtgtctagcccgctggtttagccgcagtcattgttgagtcgttccctcgttcgttcgaacgaggtgtcctccgtggatcgttcgttcgtccgtgttgagtcgttctttagtttaaagccgttcagagccgccggttccgttcaccggtttcggttgatcatttgggtgatctcgtgtcatgtgaaattgactcgttgagtcggtatctcgtgagtctcgcttgctagtcaatctatcatttgttcttattttcctttcgggcattaatctcagtcaattgattaaggtttttatgttattagtaataacgcagagcatcttgtaaaattcataactaaataatctgagctctgttttaacccattcaaattgcagtaaattcgttaaaatgtcaagaatccatgaaaattggtttcttttgctgttttagtagctttttagcttgtattcattgtgtgccttgtttgtcgtttagactccggcagtttcgacgctccagtttattttgacgtggtcgctgaggttccgtcagctcaagagcaaggcaagtcatacagatatcatttatcatattgagcctatttgcaaaacccctgcttttctcttaaaattgcattatttttataatgtcatgcgggatggaatttaccgtactcagtctttatttaccctgattcattgatagcctgggataataatttgactagatgattggtttaggaatgcttagacatgcttagatcaactagctcacaatgggatttactataatatagtccttaattttatgatgatgttatgccatcttggcatatggttaattaattaaatatgctttattggtgggtcgtgggtacatgcatgatttatttggtggtcgtgcccataacaattaaggaccggttctcgggaatccctggaagatatactcgtactaaccacaagtcagatgggctccaggctgaatcttaagtataatcttttttagctagcacaccaatggcaagggtaggcatgatggagtatggatggaccgggaggtgatctatgctgcttccggatttacctaggcacaagtagggactgcccatcgccttatagggatggggtgaaaccggaggtgggtgtgctggttaggtgtggttatatggagggttttgtcacgatttctgcatgatttatttggtggtcgtgcccatgacaattaaggatcggttctcgggaatccctggaagatatacttgtactaactacaagtcagatgggctccaggctgaatcttaagtacaatcttttctagctagcacaccaatggcaagggtaggcatgatggagtatggatggaccggg

SEQ ID NO: 11877 - DNA, 9980 bp, Oryza sativa
ttaatactgcttaattatctactgttttactgatttcaacattgatttataaatgctgcttttactgtaaaatatcttatgagccaatcctttgattacccttgcatcataccttccacttggtatgacttgttgtacggtggttgtactcagtcttgctttatttttcccaatcccccagaagctaagaaaattttccaatccccagaagctgagaatctgtcagattgtgagttagaagctgagaatctgtcagattgtgagttctatgaagattaggcttgtgccagacgtcaagattttgcctatggagtatggaggaagtttcgctttgctgagaagattaagtttagttggtctttagttttttcgctgcttttctgagtttattttatatttttgtaagacgtggaactgtatcaaattgtcgatttaagggttgaggcagcatttattatgacttttgcagccttggagtatctagtgaaaatgttcaattcaatattttacatgacatggacatgttagctatacttggcaaccaatctcatgtcgctcataaccagttactgaacaaggcccttgtgtcacttatcattgctatgacattgtttgatcttgtaactaggaggttaaggctgatgttgtaccgctcaatttaactaggaggctaagtcaccctatcctgctaggtgtaaaattgacggggaccaaggccccctagtcccacccgttgtaaaattgatgtttagtgactcatactagaagaacatcttggatttaatctaaaagattataatgatcttcatagagagagaaaagatattgcaagatgctaaaaaaatattaacagtgtttcaagaaacaagtcatattagggttgagataatttttctacataaacatggccagctgtaatcctttactattagcattctatgaaacaacaaatgaatacattatttcccttactccactacttgttgaaaactatttcatttatgacgaagaagtatttgtgtattgttattgtttctagccatctgagaaaacaaatcttatattgtatttgtatactaatttttttatgactttggcaatgcacccgaaccactacaaacaagtatggaataaacatgtcatttttgtgcccctacttagttataagcatcatttttacattctctaacaatccttaactgtaaaatttagaaataagatggaaaaatttcatgataagacaaataagcatcattttttacatttataacaatcctcaactataaaatttagaaatgagatggaaatatttcatgataagacaaaatagtgaatttattctcacaaaaacttagaaagagtttatcacatttttaagtgtttttaaatgattttaatcctcttaatgccatctatagatttcatggttttaattataagtaacactatccaaattcttattccaaattcatataacaaccactgatagtaatgacaactccaatctaaatttttaggtttctgttgttagtcggatttgccacatgattatatagatttgtggggtttgactagtgtaggcaaaaactacgtatcaaacaacatgtacagagaaaacatggacttcttattgaggacatcaccactgaaagtctcatctagtgacactttgtttattggatcagctagtgacactttgtttgccaaggtcatgactaactcaaccaaagagcagatgtatgcagttgagtagtgttttggtaggtgtatgcagttgggcagtgttttggtgttacttatattagtaattgtaagaggtgtgtcaccaaggcattacaggacatgcaacaagtaagtgtttcaaagatggatgctatgacattttatagcttatgtaacctcagaatttctggtaaagatcttaagtgcaatattagacatgacaatgcttatttagtaagatggttatgttatttgttgttgctctggcaagatatgcaacatacttatcatgctacaggacgagaacaggtaatacgaaatggatatataatatcatatatggactcacaaaattcttaattgagttaaaccgtttaggatgccagatttttgtggggatctagtctctactccacattttcaaatttgtttggtgatctagtctctactacacattttcacatgtcaacatcagtagcgacttgaatattctttgatcttgtactcgctctcgatgtaattaggagtctaaggccgatcttctacccgctaaatgtaactaggaggctaaggcccctatcccgataggtgtaaattgacggggggccaaggccccctagtcccaatcaaaattaatgttcagtgactcacggtaattgtatttaaattgattatacactgtagcataaatattaagtctattcagaattactggtgagttgtatcttgttacatatataaaagggaaaattgtaaaaaccaccctaaatgtcactatgagtttgagatgcctccccaaaagaagatttgttgcaaatccccacctcctaattcatcttgttggtttgatttaggcaccttctctccacacgtgtgtgattcctgaagaatctcatggcgaaatcaatcaagccccactcgacgggagcaagagattgtgttgtttgttctgtataagacgatcatttcgttgggttctcatggccatttcatagtgtttttcatggtatactagctatatatttcaaactgattcatgtgtactgaacaatatattcgttttttttttcagggacgtaatgagtatatagaaacatttgaacatgaagcagtaatcatatagccagattataactgtataacttcatctgttgcaattggtcagatggcccaaaatagcagatttcagtacagtttaatcaaaaattaaggccacacaatctaatgcaaaaggaacttgttgacaaatcatcacgatgagcgggacttagctaatttcaccacgagatgctctaggaatcacgcagtgcagagggaaggtgcctaaatcaaaccaaagtgaattaggaggtggggatttgcaacaaatcttcttataggggggcatcccaaacttgaagtgatatttggggtggtttttataattttccctatataaaaaggcgcaacatatttggcctatacaatgcttggaacatgacaactaaacaatatgaaagtgcattaaggacttgttgatttcactgagttgagataataaaattgatataaaattaaattcaagaaaaattattttcccaagatacgatttccttccaacaaaacggtgtttaggttaaatgcacaggtagccagtggacaattataaaaatttaaaaatatattttaagagttcgagaatttaggtgatatatataacaagtaaatttagaaactgtccattcacttaactaaaaagagtaccttcccacaatcgacagaaagaataaaccattgcgaaatattttaccttacgatagcttgtcggtcgaacaatttcagtttttctcgttaattatttgctctactcgtaccgataattgccagacacgttttcctattttctgtgattggtttcggtctcgacgtatcactacagtgtaattaggtatatgcattagatgtgtcctcctccatcgtgtacgtccatgatccactatggtgtggtcttgacaatttgattagttattaagcgtgtgcacatgtgcatgctgaaactgaagagctttgcactgttcacttcgatcgtacatttctttttcgtgccaagacaagcatgctagttaagctggacaatccacaacacgcattatatgtgcatatatgtctgtacaaaaacggaattaattaagagcaatcttgattcttgaaacacaaatcatatgagatctacctaagctctcaatgattaaccacacctcccccttgcgatggacagatatgatggttttggtctctcacactcacaggtcatagcacgtgcctgcatgaccctttccgtcgaggccacgagctaaattacactgacatgttacttccattaatcaaccagctgttagttaatcagtgactagcttaggtaggtgctttgctactttctcttttttctctttctttcgcttttccagccatgagatgtaaaattaatccagctagatagttaattaatctaagctgcgtggatcgatgcatggatggatggatcgattcatcatccatgggaataatcgcagctgcagctagctagctagtttagcagttgccatcacatatcgggatctgatgcccagctgcctgagctgatgaatctttttgcagcggtgtagcagctgaacatgattgatgggtaggttgctcgatgcccaccgacactgacgaccatctcgttttatattaaccgacagcttgattaactcagctgatggggaggctgcatggagcctgtgtaaagcatagatccccaaattgttgtggcctgcctgcttcactagatagtgcctgcataaatatctaattaaatatcccattttcttttgtttcctgcataaaagagtctcttggcatgagttttctggagattataattgattagaaggtacaaataaattgtttctaaaacaaagaaggtacaacaaataaattctacagggaaaatttgatctcccatgcatgtgagtgtgtagcaccggcacaattttggtctgcttaatcaatttgatctgcatcaagttgtagttgactcggaggatatataaacctgcttactaggaggttgctctaaatgtgcacacgctttgttggttctgaatctctctgttacaggatgccttggaccattgggttaatgtctcactatgcaaacctattgaagcattagtcaacagggttcggctatgaattattaattagttagaattaaataatatctgaatgccattaataaagaagaaaaaaaatagaaatgccaccccaccaaaatcagtgatcacagctaaaaagctttagaaaaaatactttaattttacactagttagatattaagtattctatgaaaaggtgaagcaagttgaaatatggttcccaattgtactgttttagaaaatgtcctggcgaaaatttcatagaaaataaatcgttttcttttaatgtacttatttgttgcattcaattgtatttttatcattagtttttgccattgaaaatacttttatggtattataattgtatttgtcagggttatggataccacatacctaatagtagttgactaaatctcggcaggacccactacataccatgtcctatacggaagcaaccttcggatataagaggagttccggataaggaaagacaaccagagttctacgtggaaacgacaaagactactcggattgtattcatattggtttccctagttctacttggacaagaggacacctatgggtataaatacaagcccccctaggaggagagggaaggggatcaacacccaacacaatcgatatagaagccacaacatagaatcctacatacgccaagacacgccgccggatatcgacttcagggataagcacggctagtaccctacggtgtctccggatactgtcaggagagacgaaagcgctatctctgatctcgccgggcacggattcgaggaggaaggctaccctgttgtcgactacgagtcagatcgtcagaccgccatgtcgacaacagttagataggctaccccaaatattgtactggtgtgattatcatgaataagagctataccggcttcggccaacaggatgtaggattattacctgacaatttaggggcccgaacctgtataaaaatccatgtctccgtctcttttacctcaatttcgcgtatactctagtaccaacgatccccatactatgcaaataccggaatcgcgacatcaaacatcgacagtattattataaaaaaaatagaaatgcaatgatgatcaaagctgagtatcaataaccataaatcgcgtttttagggtaaatcttcaagtagtaaaaataaaaacagagtcactactagtttataccttaacggttcattaaatatctttgtgtgaattattgttctgaacgaagaagcacctaccagtagtgctgctagtagttgaatccaatgtcccttttttttttttgaaaaaattaatgttccatgatgcgagcgtgcagaaagatgggatctatgttggccgagcatcaagcgactactggtcctccaatctgatgaggtccagactactactcttgtttttgagatgtcatgataacaagtgtactaccgatcaatacatatttttcacttaaatggtaataagatggtatgcggccctttatgcaactggtactgtggtagaaatgaatctacacttgcccagttttttcttttcttttcttttttctgaatgggtgtatgggtaatctaattttatgataatctttgaaggtacagacggatgaattaactagtatttgatttagcgacaggtataaggcgacggtggaagtttcggtgacttgtaaagttgcaagagaaactatcaaatacatgtacagagaataagacgacatgcaaatcacctgtgaatgtgacagtacagctaaacacaaatcaatttttcatagccccaaaatccatgttactagtggtacacaggcagtatgaacagaaagctccaacttaacaactagcttagcaagtccgcagagaatagcatgttagttgcaccgacggatttagaatagcatgcatttgacaaatggacatgcctgcagtactacctgttctaacattaatacacaaggatttaagagctctgtttcaaggcctgagcttctgctgcagccatggggtctgcattggtatcagtctcctcttctttctccccttctttttctgcagccaatttctccctgtgcagcttctctgctgcctgcatcgctgcacgctgctctgcctgaaggcgttgcatttcttcttcctgctgctgcctctcgaaccaagtatctgcatcagcccaaactgaaaagagacaaacaaacttgtcagcattttaccattaatcaatgtttagaagcagtactaacaaaagcacaagcaacaaagggatgctcgacatacagtacgaatcaatcacattatcaaattcgtaatttgttcagatgtatctagtgtcctgatggctcatatatagtagagtttatatagatgatattgcgacaaaatgctatctttgatttcagctaaggcgaatcgtgctgcaggcatagagggtttactagtatataagcaaacagttatacttaaaacatgtataaaataccttgacatcatttttaccctctgatccagatcagaaagtatacctggtagaatcatctatgaaaacatagtaatatggtagaagttcttagcagttagcagtgttccacaatacataatttatcagctgctttctgctacaatcattttaagccttagaaaaaacaaatggtataggcataatgctttcagggacttaagggtttcagtggcaaaaccaggcacaccattatatggtaagaaaataattttcccaacttttggcaaagtaagtgttttcacccctctattagtgaggactaacgtggtaaaaactaaaaagcttgtatgctaccatgaatataggtggtaggagctgaataattccacacaaccattggtatttcaatttccaaaaataatgtcttgatttgaaaaaaatacaaaaagcttgaacaagaaattatggaaggcacaagcattggaagtacaccagaagatctatcagagtctgtgcagtagttccctaaatatgagctgatcacttgtaatgtgcatggtagggataaggggctactaagcctaattaaggtgttgcttgaccaggcaacccaggtgcaccgtctgggcagccccacttcaagggcaaggaagaggagggagataccaaagacttttatttacttcttggttaatgaaaagagatacaaacctcatccttacatcaaggaatttgacctataagaaaattctctctaaaattaaggaaatacctgacagctcaacattatcttatctctaaacaactatgatgcacaaacacttcagaaaagttgagcattggtgtctaatgacatgtgcagctctgatacgcttaggatgcttatcgaccaaatgtcggatgattatacagaaaaaataacttcttttattctccgagacaaggtcgactcatccccgaatcatatgtgacaacccaacccacttggccaggacactaaaccctaaccccatctcaatccttcagctcccctcatctctggttaatagaattctagaacatatagacatctactgaaattgaattctaggagttaaggatcctatttgaggtacattttccttgcttaaagctcgcaatacattatttcagtggcaaacgattgaggatgtgaaaataatgcatatatactacttttttattagaacgtgtagtggtgtcaccatatcagtgtcatgcacgtggaacagaaaaagggccctagagtgtagtgattccttctactatatgagtctattgggtgatacatgacagcaattatgcaataacgaaaatcaagatgaaatgaatatattgcaaaaaaaaatgaaataaacaaaaaagatttcagtgcaggtaagtggtatgtacagctaggactcaaggaaaacatcattgagaaagatatagaagacctacaagattgcaacacaacattagacttgatggttgctcagattatttagctaaatatttaaaatgatgtaagtgtttgtggaacaaagaatttctcttgaacattcaaatacacaaaggacagttccgcacaagtgatgctttgatcattaagtaactatggctggattaaatcattagatgcatggcaatactactctgtggcaagataatactactttttttgtgaacgccgatgcagtgattcaggaacaccgctaatacaaattgtagtatgtacaataaattatatagtgtggtcattcttgttcttttcattctcataaaaaaatttctaagttcatttctattcttgaaatatagcagtcttgtaataaactgatggttaaggaagtcttcactctcatcggatgttggcgcttcctaaaacattatccttcattttaaaaggggcctaaaattgaatgatattttcagacgatgagaaatggagaatcaccaaaatgattaccatgacctaaaaaggacttcattaacattgcattatttgtttgttcatattatcaatacaagtctctaagaatagcagtctccagtgcattgtgaagggttgcaagtcctggaggaagaacatcaagttctatattatgggaatagttcattactaatagtatcgacgtgctttcactacacagggatcacaaagtttagccttctacattcctgtataatctgctaatcatgtattcactttcctcaaagtatacatcaacttatgaaataatttaaatgcccagtaaaacaaatcgagcacattaccaggctaattaatgaaattataatactgacatagttagcagactgcattggacagagaacagttaataacctaatataggttatcgaatagagtgatgaaacagtagccagggctaagtagccattcttgactggcatttcaaacttccagattttaggaacagcaagtgcatgcaaatgcagtacgcacctttggtgctactagtgttacacgtttttctcagaagaatcccaagctagcatgtcaatagagtccgtcaaagattgttagaaaacacttacggcatccaatattaataggaataatttcgcatcattggctccatctattagc

SEQ ID NO: 11878 - DNA, 1314 bp, Oryza sativa
ttttaagttgagatactccacttttaatctctaaagtggtattattgtctctaacatttcttgtgggcccttgagattttaattgaattaaattgggcctagccatttattccaacattccggcgataatgacggccgccacctcgctgttcgtccgctcctcccatccgccgtacagagagatggtgaggaatatgataagggagggtgaaaggaagaagatgaatctgacgggtgggtcccacgtgcaaatgatgaagaagataaaaaacgtgatggcgatggcatagttacaattttataaaatttgagtggcacgactataaatagacgaattgtaatgacatttatctggatatgcatatttataatggcacatatcaaattaacccttaaattttagtacctacattataacttttgtagtacgaagctctataagataatcatgatggaaacaattgattacatacttgtggaggagatatgcgagatagaaatatgcttgtatgctgcatacaagagatatggcaattacatattaccttctgtcagggttatggataaggtataccctctattcttggatgtacgttgaataccgatacggtatacccgcgcgtatacggatagtttccgtatacgttaaggaaatctatcacgtgatagagacggaatctacggatggaaggagttctactcagacgagactgggtctataccatatcgtgaggggttcgatatctccgagtcctacttggagatcaactgacccgcggtatataagggaccccttgggcaggacctaaggcatcgaatattactgccaacacacccaccacagtctagggagttggagcgtgcaggagccaagtcgccgtgagatctagtcggaccaacttgactacggtcttgtcggtatcattgagttctgctattcccagtgtaatctgtggtttccatcatataatcccatatccactggattagggctattacctactaaggggcctgaaccagtataatccttgtctttttttgcttgatgtcgtactacgtagatcctggtaccaacggaccccaataccctctatatccgatctacgggtatccactgtcgatagtggcgcgccaagtagggagacttggtgctcaaggttctactactatgacttcaagccttctcgacgacaacgtcaacaccggcatcgaccaaggagtttcaacttcgacgatgctgatgtggactcaagtaggtgaaatcgtcttcccggtcaacaccacaatgccgatctcgactggcgcagcaattat

SEQ ID NO: 11879 - DNA, 2507 bp, Oryza sativa
actaagcttgctagcccccgccgatccccgtggggttttagtttagctccgcgccacccaatcgccgcaggtgatctttcccgggcaagaactcgcggtaaatttttcccaaatctttgcttgtttttactcgagtcgagtcgcaatcgttagcagcagcactggtcggccatcgccgccgccgccgcctagtcgccttcgccgatgttttttttttctctttttaaattcggtttgcgactcgggctatctcgcagattcgggggcggatacggaggaaggaaatctgtggtggattcggatcgagctcttcgttttcttgctctttgtataaattgcgatcaggggcggcggaaacaagggttcttctctgtctctcttcattagcgccggcgacgaggtgaggtgaggtggtggtggaggcgatcgaaatggggtcggtgctgtgctgcttggccgacgacggccgccccgtctgctgcttccgcctcccatggccgatcttcaacgccgctcacaaccacaaccacaactcggtatgattctacctctgcttttttttttttttgcttcttgattgtttattttgttattacttttgcgaaattgcgcttctattttgtgttcagattgtaagcaacgatgaggcgctgattcacgattgagtttagtttttttttattagtttctggtgtcggtaatgtgtgctttgtgatcttgactcttgcacgcgttaggtgttgtgtcccggtgttattgaggtcacattgctgctgagatgagcttggcaaagtatgtaaaaaaaatgtgggtttgaatagagttcgcattgcattggtatgggaaaggaaagagtgattgcattgtggctttgaataaagaaagggttgattcgtgtgtttgcatgttaattttgttggatactttctctcagtttttgtgcattactattaactttaataatccagcaatcgataaattgtatggatatggagtactactagtatcaactcgctgctatttttagaaactggaattgcacaactgtcaactgggactgaataagtaagatgctgcatgttctcaaataaatattcctgcactagacttttcctgcaatttctacacatcattttgtcatctttgctcattattttagatcttctctctatgcctgatctttcaaccatgtgctatccatactcactctgttctaaatggtttctctacagggttccattgctcgtccaagagcggatacacgagttgcgcctgatcaaggaagaattagtctcactgctccatcacagcatgattcgatggatactttccgctgcccgccaaggcccttgccttgggatgatcctcgattcagccatcatacagagcatcacccactagtaggaggacatgacaaagcttcaacaacgttccacaaatctggtagccttggagaaagcaagaatgctgatagcatatctaattccaaagctgtcaaggatgatgggccttccacagctgtgaaggatgatggatcatcagtaaaacaccattcagatggtctgcacattggcaaagagcaagtacatgatcttttcgactttgaggacgactgtccaatatgcctagaaggttagtgaaaacagtaccactactcttttgttcatacatacactatcttatctttttctcagcagatagtgtttactatttaaatttctataatgcaaaatattaacagcaagagaaaggggggagcattcaaacattgttatgctgtagcagaagatacgtgttcatgttgtataattctagctaatgaacagtgttcatgttgtataattctagctaatgaacaatgctcaattgtggtggatcactacattgtgaccactctgctgccataatgtcagtgccatcataaaagaaagctaaatttccgtcaaaaaaaataaaagaaagctaaatcatgctcaggtctatttgcttgcatgattttggtgcttgtgtcgtaaagatctttttttttctcgcagagtatgattatgagaatccaaagatgacattacaatgcaaccacaatttccatctttgttgtatttatgagtggatggagagaagtcaagcttgcccagtctgctcaaaggtacttgcttctacttcacttttaacttcacctcagaagtgaagcgtttagcttgactccatcgacattaatgatacctttctcactacaggtaatgctgttccatgaggattcatgatcataatgctgcaacgtttctgtgatgttggagagtggagactcacggggactggatcacctagatttgtgtacatagcttgacgaaaatcaaagtcgctagattgtttgctgaaacttccagcggcgcaaagattttttattatttttttgtttctgtagagcatataattcttttctcatttttcagaaaaaattggtagcttgtgtcaatccacatatcacatttcgattggatgttaca

SEQ ID NO: 11880 - DNA, 750 bp, Oryza sativa
tgttacgaacacaacggtgtaatcggattgtaaatcggatgagtagtttaagagaaaattgtatttgaagtgtaggtggatagtgtttatcatagatggagtggtagctagtttagacaaatcagctaccatagctgtgtagccatgtccttaaaaatctgtggacccataggccacaccgtctcatctctcgtggcaaacagtggtaggaattatttcattcagaaaacaagaatatgcctacctatcttacctcatctccaaaccaaagtaccgaacacacgtttagattttgcagacccagagtttaaaaattatacgccgattgtaaacttgtggagtagatctcgtccaatgaatgtaacctggatagttcacgggtgatagattgggctgcccactctcacatatacattgctgaactatatgtccatatttttttaagactatatatatataattatatggccgtctgatccctacgtcctttatgtgagtgtacaatgtcacggaaactatatattctctctcatcgtacttcgcttcctcgttctaatctcgttttcattcatttgaaacggactacgttatggatatgattctctcttctcataatgatgcgatgtgaaaattttcaagcaattaatgttgactagcgaatctagctaattaattaacgacgttattggttggaagaggagatactgcagaagattagtttacaggcccacaatcacggaggtgatgaga

SEQ ID NO: 11881 - DNA, 472 bp, Oryza sativa
  unsure (1)..(472): unsure at all n locations
gagctcggtacccgtgaggttcctggagcgtatggactgtgagtggcggcagctgaggagcacgttcggtaagctccggttcgtcgacaagcggcggtgtcccgagctcagctcatggcggtgcgacgcccagggcatctggagaagggaagaagacgacggaggcgatcgaaactgagcaagctttcaaaatgcgaccatcggccttatcgagaaatccattcgattaggaactatttacggattgtttggcaagaggagtgaaagtttggacgagaaaattgatgatgtgattaatatggggctataatttttagtcctgctctctcttattttttagtctgaaggtctgacttatagtcgacaacagggtagccttcctccttgaatccgtgtccggcgagatcagagatagcgctttagtatctcgtgannnnnnnnnnnnnnnnnnnnnnnnnnnnnnnnnnnnnnn

SEQ ID NO: 11882 - DNA, 1482 bp, Oryza sativa
cattggagtcgctgagcgtgcggtggggcgccgccgcagcccacgccggcggcggcgggaggatggatctgtccctcctcccccgcctcgcgaagctcgacctgcggcgcgtgccggcggaggagctgcaggaggtcgtgcacccggcgcgcggcggcggcctgaggaagctgtgcgtccggggcgggaggctccgcgcgttcggcgacgacgtgacgtgggacgtcgtggagacgttgcgggtgaggttcctggagcgtctggactgtgagtggcggcagctgaggagcacgttcggtaagctccggttcgtcgacaagcggcggtgtcccaagctcagctcatggcggtgcgacgcccagggcatctggagaagggaagaagacgacggaggcgatcgaaactgagcaagctttcaaaatgcgaccatcggccttatcgagaaatccattcgattaggaactatttacggattgtttggcaagaggagtgaaagtttggacgagaaaattgatgatgtgattaatatggggctataatttttagtcttgctctctcttattttttagtctgaaggtctgacttatagtcgacaacagggtagccttcctccttgaatccgtgtccggcgagatcagagatagcgctttcgtatctcgtgacagtatccggagacaccgtaggggaatagctatgcctatccctgaagtcgatatccggcggcgtgtcttggcgtatgtagcttgtatgttgtggcttctggtgggcgtacgttgattgtcatgggtgtcttccatggtccccctcccctctcctcctagggggtcttgtatttatatccataggtggccccttgttcaagtagaactagggaaatcaatatgaatacaatccgagtagtccttgtcgtttccatgtagaactctggttgtctttccttatccggaactccctcgaggccagtttctgtataagacatggtatgtggtggatcctgccgagatttagtcaactactattaggtatgtggtatccataaccttgacagtagcccccgacttcgatgcaaatgaacgagttcatattctcaaccgcagacttcggaggaactgttatcgagctcacgtgaccgttctcagtgagtttagagataacgttagacttcctttatcagcctcgtgcgggcaccgaaagggtttgtctaagtcaatctctgatgtcgaccgagaaagtacagagcgtacgactaagtctctcgtcttgctgtaatcgagaatttggattgaagtcaagaaattttatctcggcgggtacaccatttcttcattccgtattccttgtcgagatccagcaaccgttctcaagcgatcgagaaggcgtagagtctgcgacggagctttgtcgacatttgtcgaactcgccttagtcgatcttggtgtagaaccatagagacatggagtcttcatcaatgtcgaatagaat

SEQ ID NO: 11883 - DNA, 1049 bp, Oryza sativa
  unsure (1)..(1049): unsure at all n locations
gagacttgtatatgaaaatttttgagcctgcaaattgaaaacaaatttattttatgacatgtattgctgatttttgtttgatattataaattctgtcattccaaaacttactcctaaaagagaccattcatcatgtagagtacaattgttgtactcatcacttgaatttgttttttctctatttaatttcatcttgtcgttgatgcttatttcttcttgagatgcctgcaaataaacataactcaaaatataaacataactcattactcattactcattttagtctctgcatataaacataactcaaaatatgaaagtaatgatttgttttctctgaatttttcagatttgctgcagagtccaacaaaattaaataaaaggtaaatcaaattgctttacttgtttatatgaaatatatactgcttctaggagttacatgtatgttcaactctatttgcagtgttaattctatgtttttttttaatttttggactgtaatttgtttttatgttgattactagacatatatatgaatattaagaccattaagactgtgcaaatacacaatatcactctgtgatatttttttaactaaagtgttaatttttttcattagttacagtgaactaatattggaattacagtgtttcttaactgtaattttaattttatttcactgtaacttatttgaaaattataatatctacatagtaaatgagtgtctgcatatttatttgtaaatgaaattgtttatgtcatcatgaaatcactaattatctatttttgacagatattttgacaatatatgattcaaaccagctaaattttattttaactatgatgttttgtctaaatgtgatctttgcagattatatttgaaactaattatgtttcttacctgaaatcaatgtatttgcgttatgttctgtcaaaactaattgagtcatattctgaatgtttccatgctgaatgcttctttctgcatctttgttnnnnnnnnnnnnnnnnnnnnnnnnnnnnnnnnnnnnnnnnnnnnnnnnnnnnnnnnn

SEQ ID NO: 11884 - DNA, 779 bp, Oryza sativa
  unsure (1)..(779): unsure at all n locations
tgtgcccgcggttgatgatggtgttaatgtttgaagtattgatctgtcctgtagaaatggaggcttacttttttgtctagatctagactctgctaggttatcgttctgctgatttaggttcaacgactgtgctgttgatttgttggaacctgttactgccatttgttaactgttagtagaacattgagttaatctgtttttagtgctttcttggacagtatcacttgtcttgtgttctccattagattcgattggatggtagatgcttgccattgtagtatcatcccttgagaccttttcttgtaattggcataggtaatgttgtttggtgcgttacttactgcaaaagcagtttgctgccgtagttgaacttaaattgcattgtttgtcattgatactctgagcaaaattttgtacgggtgctcccatttatttaccaatttatataatcacatttgaatattttgtcctgtaatcaaaatattgtgcttaactatttgtcgttacctttcctcagggttatgtggtttaccgtgtccgtgtgaggcgtggtggcaggaagaggccagtgcccaagggtattgtctacggcaagcccaagcaccagggtatcacccagctcaagttccagaggaacaagaggtcagttgctgaggagagagctgggcgcaagttgggcggactcagggtgctcaactcctactgggtgaacgaggtacattnnnnnnnnnnnnnnnnnnnnnnnnnnnnnnnnnnnnnnnnnnnnnnnnnnnnnnnnn

SEQ ID NO: 11885 - DNA, 408 bp, Oryza sativa
  unsure (1)..(408): unsure at all n locations
cgagctcggtaccccaacatacaagctacatacgccaagacacgccgccggatatcgacttcagggataggcatagctattcccctacggtgtctccggatactgtcacgagatacgaaagcgctatctctgatctcgccggacacggattcaaggaggaaggctaccctgttgtcgactataagtcagaccttcagactaaaaaataagagagagcaagactaaaaattatagccccatattaatcacatcatcaattttctcgtccaaactttcactcctcttgccaaacaatccgtaaatagttcctaatcgaatggatttctcgataaggccgatggtcgcattttgaaagcttgctcannnnnnnnnnnnnnnnnnnnnnnnnnnnnnnnnnnnnnnnnnnnn

SEQ ID NO: 11886 - DNA, 1500 bp, Oryza sativa
  unsure (1)..(1500): unsure at all n locations
cttatacattacagcatactccccgacttttagtgcgctttaaccccaccgtgaaggcgaggatcctctaccataatattactgccattacagttactgatatgtgagttccaccttctagtacctcgcatatcagggtcccattactatagaggatatgaaaccacccgtaaataacatcttccttatccagcatcatgtgaatcaaattgaccagtctacgcagcaattagctagtacaaagcactagtaattaattaaattaaattaattaattaagcgaggagccagaagtccttgtggcgcttgctggagacgaggtagccgccggagctccgccgccgcacgcccagcgccacgcacggcgcgtgctcgatgcagtactccaccgtcgtcgtcgacctccgcgcgccccttcgncgacagtacttgctcttcgccgccgncgccgccaccgncggccagagcgccagctgcagccaccgcgcgaccgccgnccgccgccgtcgncgttggcccagcacgagcagcgacgcgccgtggcgccttgccgtctacaccaccgccggcgcgcgctcccggncggccgtcttcatcacgcacaccttcaccttcacctacacacatgcacaacgccacttaattagcaaatactagtagaatttcttatatttctagtaaaatttgaagtgtacaaaaattatgaaaaatatataagtccttttgaaattctgaatattattttattgaattgaaactctgaaaaaaattaagtttagaatattctttgctttgaaagggatggaggacgatgaagcaaatatccggatccggaggctgcatgcttagctagaatagcttttgacgcctccattccgcgaaatgtgctaagtggatcactgcctataaggctataaagctttgttttctttttattttttttaaaaaacttttattgtaatgctaatggttagtagataatcgactgaactacttatggccgcaacgtaagccgtccaatcaacacgtggctgaactggagagacgatttaattgcatctttgacttctaattacatgttgggatcactgtttcttgtcaaataggagtatactaacctctcaaactttgctgtaacatatttttagaggacaacttactgtagaaaatgtattctggcattttaaaaagggggtctaattgaacagtcaaatcatttaagcatagcacgaatgaacccaaggagatttaaattacacaagttaactaagaagttgatgtgtttgttaattaattacctctggtctggctgattcacacatgctcctcatggcgtccagctgctggtagcacctcgtcctcgatatgttcacgcaggacgactcgccgccgccgccgccgccgtctgacgacgcgttcgccgccggcctgacgacggcgagcaggaggactgcgtcgttgcgcctgacggcctgcgacagcgcccactgcagcgcgccg

SEQ ID NO: 11887 - DNA, 570 bp, Oryza sativa
  unsure (1)..(570): unsure at all n locations
ggcgaattcgagctcggtaccccacatcatggttgtcttttcgtatgaaatactgatattgaatctctctgatgctggttggtcttctagaaagagcgtcagaaacgaatgcttggaactgctgagtcctctgatgaagatgatgatgatgacgaggagggtgaccgcagcacgaagctagacagctcaaaacctatatctggtgatgatcttggtgattccttttctactgatgagccagcaagaaaggaaaagggctgggtcgatgaaatttatgaaagagagggtaaaaagattggtgaagatgctgaagggtcagacaatgaagaatctgatgatgatggtgatgacgatgatgatgatgctgaggatggtgatgatgatgctgaggatgaagatgaagaagaggatttaagtgataatgactttggtaatatgtctgctagagactgggagcaaagtgacgatgatgaggttaccgtggaagaagatgaaatggaaggtctcaaacaannnnnnnnnnnnnnnnnnnnnnnnnnnnnnnnnnnnnnnnnnnnnnnnnnnnnnnnn

SEQ ID NO: 11888 - DNA, 611 bp, Oryza sativa
tgctcacttccacttatcaatgttctcgttaataagaatgacaccgcatgggcctcaagctcctcattttgaaaggtcctcatatcatgttcctcccacatatgccaactgtatatgagaacttcattgagatggtcttccacatccccaactcttttaattttctgacagccactctggttggtgattttctcccacacagttgaagatcaaatgtctttgctgtttctagttgcagatcgcatagcaaataaaccgtgttttgaggccatctgcagatcactagcttgtgtgttcgatgaaaaattcggatcactagcttgacaggtgttaggatcttggcctgtaccagcaaccattcaaaatatttacttgttttcagtccttgctttccggatccatgaggcgccttgatccgatttctgattagcttctttgtgaattatacacatgcaggatttacatggcttcaaacgctggcaagaagctcattcagatcgatgtgagctctgatacggtgtgcccatggtgctttgtcgggaaaaagaacctcgagaaagctatggagcaaaacaaggacaagtttgatttcgaggtttcacttcttcaaa

SEQ ID NO: 11889 - DNA, 746 bp, Oryza sativa
  unsure (1)..(746): unsure at all n locations
nnnnnnnnnnnnnnnnnnnnnnnnnnnnnnnnnnnnnnnnnnnnnnnnnnnnnnnnncttgattatgttctttgggtactttaaattaattaaatcatcttcagttaccctagtcctgccttgcaaagcatgtcgtatctctgcttgtgccttttgcatcacatgagggttcctcacaagctctgacagggcccattcaagtgttgttgatgttgattcacttccacctgcaaacatgtcctggccaatgcatgtcatgcatatgttagtgcatgttaaaaggaaacatgcatatttacagtgctacataaaatttatacattctgttgatggaggataggaaggaaagcacaaggcgggaagccatatatacataaatatatactccctctgataaaagatacttgacattggagttttttccacggtatttaaagtgtgactttgaccataattttatatattggataattttatgaaatctaataaatctttggagattatgaaattcttttcaagacacaaatctatacttgccactttatgttgtcaataattttgtcaaattgcaagtatatttagtgtaccaatagattcatattgcaaacgactcttagaaattaaatagagatttgctagattttagatgcctaaaaatttgtatattttcggtaacctaaaatttcatattactaagccttattcaatatggaatttaagttatcttaactacaattttggagtta

SEQ ID NO: 11890 - DNA, 689 bp, Oryza sativa
aaaccctagaccggtagacctttcccctccgatcgccggtatcaatggcagccacggtcgctgccgccagcagccggaagcgtgggttcatggacattcttgacgacccgtgcccctaccgttgcgccacctggcgaagcgcggccggagctcgtcgtcggccgcctccgcggctgattagatcacaaccggatttgccacatcgtgaggtgctgcaaattaaggtgaaagattagttttttttatagatttggtacttgtttatgtgtttccgcttccacctttataatttttgtagcgtcaaccttgtgtttgcattgtgttattcaacggattcgattatgtttccttgtgaagtaaaacaatggaaaactgattatgttaagtgtttatgtaagattggatgcttgggatttttgtccgtgtataatacttataattaatgtgtataatacttataaattttacacaccaacacatcgaatgtttggacatatacatgtagtattaaatataaacgaaaaaaataactaattacacatattacgtgtaaattatgagacgaatcttgtaagcctaattgcgctatgatctgacaatgtggtgctacagtaaacatttgctaatgacatattagttaggcttaataaattcatgatggattaattaggcttaataaattcatctcg

SEQ ID NO: 11891 - DNA, 399 bp, Oryza sativa
gcaggtaccagcgcctggtgttcaggcacaagctgtatcaactgcgggaggagagggacatgaagccccagaccttcgccagcctcgtctccgctctcctctacgagaagaggtaatgaactaaaggatgttgctagcgcagcgcgagttgaattgagtagtatatgaagcagagttaaattcaaatgccaattggagtattcaatttcgcggaaagatgcagaattttgtagatatgctgactgtttatagtgttacaaagcgcctgtcaagtagttagatttgttcttgttgcacaataacttgactatgtgaaggtacaattgttaaaggcagcaggtttatgtttcaaaggatatgtgtgctctacttgtgacagacagaaaacacattacaacc

SEQ ID NO: 11892 - DNA, 736 bp, Oryza sativa
  unsure (1)..(736): unsure at all n locations
cttnnnnnnnnnnnnnnnnnnnnnnnnnnnnnnnnnnnnnnnnnnnnnnnnnnnnnnnnnnnnnntgcaaccttgcatcccagccttctctaaaattcttcctgcatacccagcttgggacattgtaatgccttcttcagtctgtttaacctccattcccaggtaataggacagtaatccaagatcactcatactaaacatacttctcatctgctccttgaattttgctatttctgtccccaaagctcctgtaatgataagatcatcaacatatacccccaccatgagtctggcattaccttcccctctagtgtacactgcattctctgttgcacttcttacaaaatccagatttgcaagtgtagaatccagctttgcataccaagctcttggcgcctgctttaaaccatatagggccttttttaacttcagtactttgttctccttgtgctcaacaacaaaaccaggtggttggactacatacacctcttcctccaattcaccattgaggaaagctgacttcacatccatgtgatgtatttgccaaccctcatgtgctgccaaagcaaccagcaacctcacagtttccatccttgctactggagcaaatacttcttcataatctatgccttgtagctgaacatacccctttgccaccaatcttgctttgtacttcaatatctcaccttcggcacttttcttgatcttgtaaacccatttgagaccaattgcccta

SEQ ID NO: 11893 - DNA, 508 bp, Oryza sativa
  unsure (1)..(508): unsure at all n locations
nnnnnnnnnnnnnnnnnnnnnnnnnnnnnnnnnnnnnnnnnnnnnntgagaaaaaaagattatgtactgtccattcgacctctaatccaatatcatttcttcattctaagattctcccgtactgcagcttaagcaggaatttcccagaaaaggaatcccccctgctccaccgaagcatgccttttcaagaataaattcaagcagggtgcttctagaagaggttagccgttatgtatattgattaatttttgctttgttcgatgtcaaatactacattcagttgtgcttaccctttttgaccggtggttcttgaaatgttttgtttgcagagaaggaacgctttggaggagtggatgcaaaagctactttctgacattgagttgtcgagaagtgcacctgttgctgcttttcttgagctggaagctgctgcacgctcatgtatgttccgcttgacatattctattgaagacactttttcctgattgtgcattgatccatttattaacta

SEQ ID NO: 11894 - DNA, 625 bp, Oryza sativa
  unsure (1)..(625): unsure at all n locations
nnnnnnnnnnnnnnnnnnnnnnnnnnnnnnnnnnnnnnnnnnnnnnnnnnnncaccttcgagcttttaggcaagctcggctcgagctcgttcgagctcgagctaagctaccgagctcagtaataagtagtgtaagatatattttagtgataatccattgataagtataattattttctaattaattaataaaagagtaaaaaatgattaaaataaatatattgtgctaacacatgctaatttattgtgtaaatagatactaattaatatatatatatatatatatatatatatatatatatatatatatatatatatatatatatatatatatccattagtttattaaatcaataaggtaaacaaacaatataaactatacgctatgtataagctcggtaaactcagtagaagctcacgctcggctcgataaagctcgcaagtttttgctcaagctcgggtttggctcgtctggagctcgaatcgagcctagaattagccaagctcgagctacttgcaagcttcgaccttttttgacagccctaacagagactattattatacaacgtctccctcgtaatctactccattcaaatgtatattactaacatatgggtaatttatac

SEQ ID NO: 11895 - DNA, 665 bp, Oryza sativa
  unsure (1)..(665): unsure at all n locations
nnnnnnnnnnnnnnnnnnnnnnnnnnnnnnnnnnnnnnnnnnnnnnnnnnnnnnnnnnnnnttggatttataacaagggtcagtctctaattcatccataaaattttttatataattatatattggtcaatattataaatctttatagcattctagattatgtttaataaaaatatctttccacttattaaaaaactagtcaggtaccttatataaatataataatattaataaagataataattattgtttacacatgtaaaaacatagataattgttaacgaccaaatttggtaaggccatgggctgggttcaaagctagagtcaaagccagatttggaggaattctgtttaaggaagggagagtgcgtatcggctatgagcatcatcggctgccgtatgaatcggctacaggcggcatcgcctgtcgtatgtatcggctgacgctaaatccgatgaagacaacccgatgacgcttttctttagagatatttttggtaagagtccgcctaagggacttgttcatattttaaattgtaatagagataagagtcgtgtccagcaaggacatgttatgtacctcgggtataaatatgaccccacaccttggaatcatgggacgacagttcaataatacttccgcgcatcgacaccttttttctatt

SEQ ID NO: 11896 - DNA, 1143 bp, Oryza sativa
  unsure (1)..(1143): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataatagcatgcttttgtccactgacttgcatctgcttgccccaccacagaatttgaagccattgctgtcatgaagattccagcttcaggtgagaggtgagctacaataatttgaaagcaatggccaaaattgctgcttttaaaatgaattttctaaggagcaatatttttttgttaatctaacatatttcttataaaacaatatcttccacagttatatttacatgatttatctacatatgtacaatgtggacatggcgaattcgagtatatttacaaatgatgatgatctataaacaacccctacactactattccattcctgcgccactccactggtaagtcttgaacagaatgaaggccctctctgtaacttcctgaattcttgggcctcttcgtcagctaagaattttcagtgcggttttcgggatcggctcatgagatcagcgcatgaacatcccgaaactgtagagagatctcggtcgaaacaggttggcgaagaggaaccatgtgggtgactctttcttctgtggctctgatggctcaggctggcctttcacctgaatgttctggcctatggcttgcctgatggagtctattgtcttctgatcaaccgtccctcctgtggaatcgcgaacatagaatgtgttgacagccatccttcctctcgtgctcacctccgctcttgtgacagtcaggctgttctcgcggaagattcgggtgacctctgacaggaggccgaccttgtcatttgtgcagagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11897 - DNA, 455 bp, Oryza sativa
cagaaaatccagccaacaaagcataaaagttaaagaaatcgtgtgcttctttaattgatttgaactgcatatcaactcttggaatgtacttcgcatcaattgctgcattatttccttttgtagcttcttcttgttcttgctccaaaaaattgtttatatcttcttctgtcaacatttctccatttgcatctaaatcattactttccactgtatcaacatttgttgttgcttgatttccaatttcagtactgttgtcagctgaattttgcacctgcttattcaaaaattcaatttcatatttcaaacaattattttttaaaaagtttttttctttaatttcacaacaattattatcaaatcaaattttatcttttagatttgaataacattcttcaaatgtaaaattttcagtaatgaaaagttcttagtaaatcttacattttgaccgtttgaca

SEQ ID NO: 11898 - DNA, 757 bp, Oryza sativa
  unsure (1)..(757): unsure at all n locations
nnnnnnnnnnnnnnnnnnnnnnnnnnnnnnnnnnnnnnnnnnnnnnnnnnnnnnnnnnnaatctagacgtagcgggtgtctagatttatatccagaagttgattttttatgggacggagggagtatgtaagagaagaaacgatagaaaagaggacgtcttacttttttttaccaattctaaaaccttaagagagttcgaatgggtcaggtgttgataggagttcatagtagcagcatgaaggtatgatcgactacctgataatggagtgtattgcacaaaacggtacacgcacaaatgttcacaacaaactattgtaaatatacttgctaaaatcacctctagaagacaagctcggtaccactaaattgcttcactttgtctcttctaatactaaaacctttacaccttgcatattcattgtaaaacttgtaaccatcttactcgcttctaaaatgcttactagcaaccatgttatactcctccatctcctccaagctaacttcgttctcagccattgtgtgccactgtcaatacgtacatagtaatcatagacagagagatgaaccatatcagcatattttaaaataaaattaacatcttgcgtttcatacatcacttacaaaaatatattaaaatttgcaagtcttcacataaatcaagtagttacaaagacgagttgtgtcacacacagatcacatcacaaatagaaaaatggatgtaagaataattgataaatgattttgtgaaaaacatcct

SEQ ID NO: 11899 - DNA, 751 bp, Oryza sativa
  unsure (1)..(751): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccataaccttgacagtagcccccgacttcgatgcaaatgaacgagttcatattctcaaccgcagacttcggaggaactgttatcgagctcacgtgaccgttctcagtgagtttagagataacgttagacttcctttatcagcctcgtgcgggcaccgaaagggtttgtctaagtcaatctctgatgtcgaccgagaaagtacagagcgtacgactaagtctctcgtcttgctgtaatcgagaatttggattgaagtcaagaaattttatctcggcgggtacaccatttcttcattccgtattccttgtcgagatccagcaaccgttctcaagcgatcgagaaggcgtagagtctgcgacggagctttgtcgacatttgtcgaactcgccttagtcgatcttggtgtagaaccatagagacatggagtcttcatcaatgtcgaatagaattttcctgaaatcaatactcagaaaagaatatcaaatagaaatagcccccgagcgaatgctcaaagggtgacatnnnnnnnnnnnnnnnnnnnnnnnnnnnnnnnnnnnnnnnnnnnnnnnnnnnnn

SEQ ID NO: 11900 - DNA, 1032 bp, Oryza sativa
  unsure (1)..(1032): unsure at all n locations
gtaccctcatcgtttcagttaagttaactaataaaaggaaacaaattatgacctagtcaagggagatagacttactacacaatcgaatcaaatagatcacctctatcaacaataatcaggtaaccgaatcagacaaaactaagatccccaagtacactaaccccattctcctcctaaccaaggaggaattataacccatcggtgcccggccaccacaaccaaaatcgcctggatcaaccccaaatcacctactatcgaatccaaccggaaatgacagacatgcacaatcatatcaaacatttacaagaactgcagaaaaaaaaagatcgtctcaccatggaggtgatgtactcctcgaatgactcccggtacttgtcgtagagctgctgcgagtagtcgtgcggcggcttctgcgtgcacatgttgtatatcgtcctgcagacaacaacagacacggagtggggggaaaccctagatcagcaccagatcgaagcgaatcggaggggaaaccctagcgggcgggaggaggaggaggaggaaacccaggaggaggcggcggcggcggcgggggacgtacgtgtagagcatcatgtagtcctcggagctgaactgtggctcgggcttgccctcgaggatgttcttcagcttggtgatgcccttctgcatgaacgcccatccctcctccagatcgatcgtcctccgctcctgccccgccatcgccgcagccgccgccgccgccgccggtgaacggaggccgcgcggaccaaaccctaggggagagacgccgccgcgtgggtttgggttgggttccgcgcgagaaaaatggggaggaagcgggcgagagagatagagagagagagagagagagaggaagagggagcggcagactgatgacaagttgaggcggtgacgcggttgggggtaagtataccgcttatatcggtgtagtaagcgtgtcacactgtcacacaaatnnnnnnnnnnnnnnnnnnnnnnnnnnnnnnnnnnnnnnnnnnnnnnnnnnnnnnnnnn

SEQ ID NO: 11901 - DNA, 674 bp, Oryza sativa
tcatcaggcaagaaaataatttatacctgttcttgattcttttctgatcactttggtggtgtattccttgtgaaattcttctgcatttgctgaaacttgagtcatatctgcacaatcattgacagtacattcagattgactatatgagttcatattagaacagattcacactattcaccattctgaaaatttcagtgatttgcccagttctaaaatgacagttacagtgatttgcccaatttacttacagtggtcagatttactttcagattgactctatttagttcatattagaatagattcatttttttagatctaatcagtttctacatttctaacctcattaacttttctttacagatctgatcaaacaaattccaaaagaagaatcaaattctgaaaagaaccaagcaggtaatatttggagaatttttctgttcactcacctttgttcttcttggacttgtcttttgtgctctttctgctcttcgattcttttttttggagttctttggattgacctttagtaccagtttctttgatagatttgatattctttcctgacatttccttcttttctggatcttgatcttttcctaagcgtatctttctcttcttgatctcttctgaattcatcttgattttggattgatgttttgggggatctttctctt

SEQ ID NO: 11902 - DNA, 791 bp, Oryza sativa
cgatgacatttttgataaaattgtttgtacaatggtattttttagaactcacacttatcgatgatatttttttgtatttggacgcttgtcaatgacattttttttaggttatctcatttaaaaaaggaaggatgttttattgtcttggtcttgacgctattgcaaatatgataatcaaatttaaatagaggaagcaaccctttttttcctttcctttgtacaataaatgagctcactgctcacccatcttccatttctgctggctttcgtcaacgaaaaataaaggagaaaaaaaatatcttctcgccgtctcgcgtgctgccgtctccgtctccggcgatggcgccgccaccgccgccaccgacggcgacgaagtacttctggggcgactccccggagcccgacgagtactacgcctcgctgggtctccgccacgccgaggcctacttccagtccccctgcggccgcctcttcacgcactcgttccacccgctctccgccgccagcgacggcgacgtcaagggcgtcgtcttcatgagccacggctacggctccgactcctcgtggatgttccagaacatcgccatcagctacgcgcggtgggggtacgccgtcttctgcgccgacctgctcggacacggccgctccgacggcgtccgcggctacctcggcgacacggaggccgtcgcgagggcggcgctctccttcttcctctccgtgcggcggagcggcgcctacgcctccctcccgggcgttcctctttcggcgagtccatgggcggcgcccccacc

SEQ ID NO: 11903 - DNA, 6638 bp, Oryza sativa
  unsure (1)..(6638): unsure at all n locations
tcctgtacgggctgtttctctcgctaccgacacatgggcggtgatgccggacaagaggatggtggggagatcgatccgcgacccggcgaagctgagggtgatcgcgtccaacccgcggctgtaccgcggctcgccgcgggtggggacgatgcgggagctcgcacgcgtgacggcgctgctgcgggagagcttcggggaggtggcggcgccgttcctggtggtgcacggcaccgacgacggggtgacctcgccggaggggtccaggatgctgtacgagcgcgcggcgagcgaggacaagagcctcatcctctacgacgggatgtaccactcgctcatccagggggagtccgacgagaaccgcgaccgcgtgctcgccgacatgcgcgcctggatcgacgagcgcgtccgccgctacggcgccggcgccggcgcccgggcggccgacggccacgccgaggcgcccgcggcctgacgacacggcggtgcgattctactatgctcgatgtcctcctccaattcgctagattttttcctcttcctttttactagtatcgaattatctccacggacaaatgttttttttttaaataatgtaaatgatttacactcctggtctctaataatgtaaatgatttacatttgtggtttctacaagcaggcgcacaatcaataagtaaagagaagataaataaaaaaactcgaggttatgggataaatcccatctaggcatctaccatctccctcctgataatattcaactataataccaagtagaaaatacgtagaaactataacgataatatcaagcactagaaactacgccatctaaaatagaactcccacggaatatgtgtaggatgaggttgttactcttgcgaagattccaatatgatttctcatctaagataataccaacaaaacgatactcctactctataatattacgttcgttctcaaataaacgacctaaataaacattatctagtacaacgaatttaaatagatacgatacatatccgaaataggtaatgcacagatttattgtaatactccctctgtcccaaaatataagtatttttaaaatagtgccaagttaaatataatgtttaactttgactattaatagcaaaaatcaataaagatcaatcgtgtaaaattgatgttactggatttatcattaaacaaactatcataatatgcaattctttttatttaaaacattttacttttatagatattattggttaaaatagcatctcgaaaactacgtcgaagttcaaaactgtttatattatgggacggagggagtaaaatataattttgttatagcttggttttgattagtgtgcctcctcgtacaaacaaatgtctcacgtggtaatagaacttttgccgacagtcagacacaacatgcaaatgttcagagttgagttcagatgaagagctttatactatacttcctccgtgcaaaataaaaaggcaaactgtgggtttctgtgccaacgtttgactgtccgtcttatatgaaaaatttttataattagtattttcattgttattagatgataaaacatgattaatactttatacgtaacttatctttttaattcttttcataattttttcaaataaaacgaacggtcaaacgttggtttgtcttttttgggacggaggaattactactgaacagatcacatggattgcagatcagatcagttgactccacgagaggatccccaggtccggagctaattcccgatcagtgtggaaacgcaagcgatcgaccaacgacgtcgcgatggctggttcagcgtggtcaggaatgttcgttcgatcgacatagacctcccaacgcgggcgccgcaacgattcccggtagagtgtttagggtgcgatgttcaggctaaaattggaagtttgaataaaattgaaacgatatgatagaaaagttagaagtttgtgtgtagaaaaattttgatgtgatggaaaagttaaaagattgataaaaaagttggaactaaaccaggccttaatgcgctgatcgagatgacgattgagatgtatggtgccaccaaccggttgcgaacagccgacggtttggaccagacaggcgttgagctatgatctcgtcaatgcctcctgtggatgaacctggagaacgctacgcgtcggacgaacggcgcgagacgaataatcggacgcatccatgagccgtccgatccgcgcgcacgccatcagccatccaacgttatcaagcatgcatgcatgcaaaactatttaaactattttttctcttaaattattatccaaatcatgatccgattgcaccattaaatccgttgcaattaaatctttaaaataagaccacacatgaatatattccggtgaaaaaaaaagcttattattgaattatttttaaatgttgcacgctgtttcaccaagtatattggaattgtttcactaggtagatcgaaaatgttttaatcgtttaaatcggacgctgcttcaccttatataaaaacaatgtttcagcaaatagcgaaagaatatttcgagtcaccgcaacatttgatccatataaagtgaaacattttttgtggaagaaaaaatgaaacgaattctcttaatagatgatttctataatatgtgagtgatttgttgtaaaagaatttttcaattcactacaacattagatctatacataaacattgtgagtacactaggtaaaacatttttagtggaatattgtgagtacactagtgaatacttattgtaacactcaaccaatacatatgcaacatttacaaataaactagtgaaacacaataaactacttactgaaacatgcaaataacaccatgagatatattaaagaaagatatatgcatcgtgacactaaataaatatgtgcaacataatagaatttcagctgaaacatctaattttcacatgtgaaacattaagtttaattggttgaaacatatgtgtgttttttattataatatagtcatatgagatcttgttgtaaagatttaattgcaacgaatacaatggtgtaatcgtatcatagattggatgagtaatctagaagaaaaatcatttttcaagtttgctaaaaaggtgttatgtacatgcaaataacctcgtctcatctctctttcatgcatattaatgctcagaaataaagcgtatgtaacagagagagcatctgacaaagtctgtatgaagcaaagtcatagtaagatgtgtccgatttttttttcaagatcggacgaccgatctgaagtgttttcctagttgttgctatgtgtacagtgtcgtttgtagagcgtccgatttttctccccgtgtcgaatgttcgagacgaagcattttcgaatgaaccttcataacatcctgtagaaagatggtttcatatactttatgtcggggaaagcaatagaattgaagctgatcctggcctggtcgacatgaatccaacagaactacagtaagctttttcagaagtataaagaacaacaccaacgaacccggcccgtccggagatgacgataagtagtagcttactaagagcaggtacaatagcagactattagccagttataaatatattttaatgagataaaagatgagagagaagagcagcgggctacagatatgtagccagctgcagcacggactctaagacgcagtgtgtatatgacaggtgggaccatatattaatggtatagtaagcaactattgtatgaattgactattagattggctatagatgaattggagctagtagtgggctatactattaaacttttttaacgtgagaatgaataagggtgtaggggttcatgttcatgggttagacccttagaaattaattagatccctcccctatacaaatcacacagcaccgtataatttcacaaactcaattcctccctaatacaagtataatttcattctattacacatggtttagtaagcaatattctgctattggtaacctattacaaggttggtttaataggcagaatatatggttgcatggtaccaagtcatgttattttacgcgtgcgtgcttgcggtaatataacattaacctctcactctccttaccatcccacctataaaattaacactccatgaatatgagatgaatactattctttggacttcatctcaatttataacacatatttagcactccaaataacatcaaatgaaaaatttatgcataatttattgttgaaacaaatacaagttgagatgcatataatgtcaccagtcgtcgtttttccatattccttacattatgttgttgggattaacgtgatatggtataaacaatgttaataaaacatgagttaggttgggattgatcttagaaatttgaattttattgattctttgttatactaagtaacaaagatataatttttagatcttattgtttctgtatgtatactactatgctaataagttatatattagagtgtgtacctagatttcttcataccgtacattatgatttcaactagattattgatatggtatgaacaataatgttgataaacatgagttagcttaggattgattttaacttttggattttattgattttgcagtatactacagtaacaaaaatacaatttggatcttactgtttctgcatgtatattactatgctaataagttatatgttggagtgtgtaattagatttcatcataccatatattatgattccaacttgatgattgttatttttactcaatatttattattttcaatggttaattttgactgaaagattgtaacctttcttgtctctgttttatacaacttggatggtttatgacccggctaatccttgttagttgatatgataaatatcttaccactaaattccatgacaataacctatgtactttatttttgttgggaggataaaatttgttttttaaaacgacacatatctaatccttagcattaaccatctagttttcaaatttctatttaagatgacatgttagtgctatttgtttttctccaaattctcatagagcaaaacaatatactatcctatatatccctaactttcaacaaataaaagagaagaaaagttctacagttgcaggtgaatctgcaggtagactcactgtgtttatataggagatgattctatcatctaggttttgcctttggtcattcatgcatatgactacatcacgtatacatgatagaccagtgagcttcagaccagtgagcttcaggacattttccatgatcttttcttcagcatccatcttttttcatgaatgttcatgagtttgggaccggccggcggtaattatctctcacactcctaccacgaaagtacgtacaaaattttcttcttattacaggtctctcgtgtgccgtatatgccgtcttgactgctcattaaaccatcatgcatcatctgtgctgttggcctgccaccaacccttgttttctgcatgtcgaaaacataaaatttcatgtgcaagctagagttacgacgactgttttcttcttttattttgtaaaacaaaaattctaccgactatagggtggcctggtgtggttcctggccaaggccatgttagcatcttgccaccgttaagaaacaaaccctatatatgcatactttatcctttctgtagagacagatgcgggcctgcagcaaacatgggtgatgaacaattcgattgatctggctcgagacagaggacagttggagatgtccctctttttcttcctaaaacatggtagaaacgcacaagctaatatagacatgtgcacactcacttatagaaagacatatacacgctctacccctatgaggttagcgacctaggctagatcggcacacgcacaccccctatccctatgatgttagtggcatcttcgatagactgagttggtatatcttaaggttgatgaaatcatcacacacacatcaatattgactgtagatatacgcaccgattttaagcctaggaaaaaaatgctttttctctcgttctctctcgaatcctgtcgcatcccgtcttagcacagctctcttccatgccatcttccccattttcgcaagtggaggatagaggggttgggcttcacggctcctctagtagtagtacttttagtcgggtcctcctactttctcgggctattcccatggattttactcttttggtcttcgagatggctgttggcttcggatgccatcgtcctactgtcatgatgttagtctccgggattcctcctgctaacgagctgcagcatcgccatcatttctttcctagcagccaactgtggtactactagatgtgcataaggaaatgttgctccggcctacacatatctcttcggcgagctctgtgcaagagaggcagccttcttctagatctcagggaggattcctcaataggtggttgaagtggttaagattcacgaaggattaggccccatttaaaaatggacctcggtttccttcgtagttcaccatgtttcatctatcttctttgatggggttatagatctggccgattcttatgnnnnnnnnnnnnnnnnnnnnnnnnnnnnnnnnnnnnnnnnnnnnnnnnnnnnnnnnnnnnnnnnn

SEQ ID NO: 11904 - DNA, 20263 bp, Oryza sativa
  unsure (1)..(20263): unsure at all n locations
nnnnnnnnnnnnnnnnnnnnnnnnnnnnnnnnnnnnnnnnnnnnnnnnnnnnnnnctcagggaagattcctcaataagggggtgaaaggggtaaaaatcaacaaaggattacgccccatttaaaaatggaccttcggttccttcgtagttcaccatgtttcatttatcttctttgatggggttataaatctggccgattcttaatcctttattggatggtaccttcgaaccttttccaaaacctttgtattaattttattgtggtgcttaaacttcccattattttcttacacttgaattttcccatattggattccccttttgggtttgtgcataggcttatctttatgcaacttgccttgattcaggcttcgttggagtcaagctccaagcctttgccattgcccattggcatcacaagtagcctaagggtgtgttcggacttccaggttcccaacccctcttcctcgttttccgcgcgcacgtttttcaaactgctaaacgtatgaaagttgcttaaaaaaacaaattaatccatttttgaaaaaaatagctaatacttaatttatcacgtgctaatgaaccgctccgttttccgtgcgctgagataggttcccaacttcctccagcgaacacactctaaggaggactcaatcattttctatactctttttaagtcatgttctgcaaaatgctgataaaaggtgtaatttgctcattcttgtggggcttcttttgcaaaatgggatgagtgaacgcactgttaccacccatgtattttgtttatagtctttataaaaaaaaacaaatgcacgagtttaagaaaatctacaaagaatgaatctaaccaactgacctacacgactttggtcaagattttatttaaattcatgataagatcatggaactacctatatttcagtctacataattctcaaccaaaatcagtccatttttattcttcatggttcacaacaaactattatatagaaataatatcatgcattaaaaacataagaagttgtaaaatcataccatcaaactataatcaatagaaaagttcccaagtaattaacttaaaaaatcagtaaaatattccaagagctaaaacacaataagtgtttctatcaatccaaaatcctccattaaagagttataaaggacacctttcccaatactttcccaggagatagtgaggacacctcgcctgcatgtagggctgtcgagctcgagcgagctcgtctacccaagctcgagctcgacacaagctcgagccgagcctattacaccttcgagcttttaggaaagttcggttcgagcttgttcgtgctcggccacaagtagtataatatagtagtatattttaattatcatttctggataaatataattattttctatttgatcactctaataaaagagtagaaaaggactaagataaatatattatactaacacatgctaatttattgtctaaatatatactaatataaattgatatattagtttattaaattaataggaagaataaacaatatgaactatacacagtcaagttcggtagaagttcgagctctattcggtaaagcttgcaggcttttgctcaggctcggatttggctcgtttggagctcgagcctaggacgagtctagcttgagctgctcgcaagccttgagcttttttttttgacagccctacctagatgacacatatcccattagatcagatatatttttctattttgattagaggagatggttccgaaatcacatcttatagttacggtaatatagctttgttattcacatgagaaatgatctttcggacaccatcgtctgatttttggtatatacagttagtcatgaagcgctgcaagtgttagcacctatattctatatatactttcctgcaatttatttaccaaccgtctgtttgcatgtgtgggacataatcttattgttaataacatagtaagatgctaattgcatgagtaccttactgctagtcatgcccttcattggaaacatattatgatataacgaaaagttaaccttgcaaataatactcgttgttagttttttttttcttgaagaacaatcatatatattggccatgactgcatgatccaattgttaaaatgcaatccgatttttcccaatttctcctatgccactagattcaagtgtgagtgtgtgacttacagaaatgtcaacttgatgttataattaacagctcaggcggttggatgttgaaaaaaaaatcatccaaaaaaccctttattccttttcacatatgaataaggtgttagattgatctcttgccaccgagtcagagaattgcgctaatgggcttgcccacccacgcccacacgtacctaacgatgaggactgattccctcggtcctgagcgcacgttgctctctatcgcgcgatgatcggacgcgctatctacgtaacgtcgcccccgatcccctcaacgcacacacaattatctttttttttctttatgcaagaaacattatactttaggacggtagatagcactatacctcatacctcatctttttcttaaattaccctaacaaacctttttcttaattttttatcattattttcataggtcggaagcacctacggctaatttaattatcgagatttaaactacatgaaacatttcatgaagaatcttgaaaatgttttttttaacatagattaattatgttgtcaatatggatatacaaaatttgaacgtaaattttatattgggaaaaaaaatcaaccaatgctgcacggaagcaaagtggagccactttatttagtttaaactccagtggtaaaaaagctcaaaaattgtcaagctaaattacatagacttgcatagttacatagtgcgtgcatctccttgcgaaaatggttagcgaaaactgtctagagagattcacaagtttaaaattaattagagagtaagctcatcaaaataagagaatcaatcgacccactgaccactatgtagtagttgaacctaacaaaacaatgtgaacggtcaatttcgttatacataagtaccacaactatttgtttttctccgatatctcatatggcacatgtgatttcaaagagagatatatctgcaaatcaaaattacatctccagcttcacctttatggtgtggaagaagctaactaaataacctcatgctttgatggagcataccagccagctactctgctcatctaagttgtgcctaacgttcatgatcactacgttgatgtctatctatggccaactctcacatctttcaggatgtgtaaccttttttcaggtagctagaatatacgaagtagaacgaagtgtgtgccactctcaaatgcagacagacggttggacatgggtgatgatgcgatttgtctagttatgtcttctgccggctataacatggaggccgctcacatatccagttcgtgccctgttactaaatactgacctcccataagtgataagtttgtcatttgtcattgataactgccggctataccatcaaggtgacctaaagattggattactaagaaaatatggactaacaaaatggaaaaacacatgccggtcaaaaaaaattaaggtggactaggtatccataaccttaatatcaaaaatagatgcttgtgaagcaaatgactttctagttggttaatggtggaggtgtatgacaagactttttacgaaataataaatacatgaaggataaacttctctctatatgtctagcaacacaggtatttttttagtcctggaccggtctaattaaagttaaagatcaatttctaatatttgggtcttttagatgtggcaatgagacaaacataagattttggaaagacacgtggttgggattgcgtactttcaaagttcaataccctactttatataatgtgactcgaagtctactgccgcagaggttatgaccacaatgctgttgaatatttttttggagagccattgttggctaaagctaattgagtggaatggtttgattcttaggctagctaatataactgtcaaatgaaaaatactgctttgttggtagctccataagaacttatggccaattttcagtctctaatgttaggatccaaatgaatattctatgggactttatatggtttctttacaagaaagtaattctaacgaaggataacctgactaaaagaaaatgggggcagacaaacattgttccttctgccatgcacaagagataatccaaatcttttctttgagtgtcatattgcccagttttttttggagatgtgtgttttttttcttttaatatgcctctaccccgtaacacaaaaaatatttttggtaattggcttaaaggggtatctacgtctataaaaaagatgattataattggagctaatgatgtatatcggtcaatttagtgtcgttgtaatgatcaagtttttaattgtaaataattatctaaccctatgcaggttattttcatgtctttctattgtcttaatttttggtctacgatgctacaataggggaagcatgatacaatgtgcaatggtgctatacttttggtatcggtagctaatggtctcttattctattataggtgacttagtttcattagaattgctagctaataaaatatatgtggtttaactctagtcaataataaaggagagttagggatttgtcccatcaccttatgttttatttttacctttaccttttttttttaacaaacttatgcctatatatcttatgacaaaaatcgaaggtgtaatacattttcattattaaaaaaaataacatcaaaggctgctcacggctcacctcgccagttcatgcgctgttactaaatgaatattggcatccaaaaagtttgtaattttttactcaatacccaactgcttggatggagactactcacctgcgctgccctgtttgtttggctccgacatctataaggccaaataggccacctggctcggcacgacccatgcacgaccaggcctgggccgaggtcagtcggccggcacggtccgacctacacgtggggccagtccgtgcttgtccacgggctgcacccacggtccaataagactcgggccgtgccgggctggtccaaaggcacgacaacttatcgtgcttttctatagaataagtctatttttcctctctcatctctttggatggtgtcttatatggttggataagtctattttgtatctctcttttctttgggccgtgcattttatagctgaattaagtttattttggtcccttaactatttttcttgatcgcgtcgggctgggccggcccaccgtgctaaggctcggctcaggcatagcccaactgttggcatgggcccgacaccagtcataccgtgccatgtttgagcctggctctcgagccttatggccatctatgccgacatcttatctcactggatagaggaaacactcgtagctagcttaccttctggcttcatgaacaaaagatcgatcagatcaaagaaacgcttcccctcgagacttctatcataattgctacttcaatgccatctctttctacttcaattgcggtagacaccgcctgatctagatatcttcatagttcatcgtcaatccagttgcctcagggttttggctaacttagctgcatgtaaaaaaagaaacgtaataagcatatagttaattgaatattaattattaataaaaaattaaaataattctttaaagcatcttttatctacctctataaccgtgacgccgacgccatggcgtcatcacgcgcgtatacgcctaaaccgcggttgcccgcgtggctcgacgccacaaaaataccaactccgtcgtctatgtcaactttagtagcattgcatgcaagacgcccaagtacttgttcaaggtcggccatggcctagaggacaccggcaagccatttctatgggtagtgaagaagtcggaggtagctgcgtggaaacgagccgagccgtaaagtaaaataatcgatataaaaagatggtggtctaggctccgaaacaagcggctcacaagccagcttgggctcggctcatttcagcaacgagctgaaaaggaggcttggggttgtctcgtttggcttacgagccgagccaagcccgagctgagctcatgagcctgagccttttttccatcactgcatcgaaggtagaagaatggatgtcggccctagagatgtttgggatgacactcaccacatgtaagttgggtccgcgtgctcacgtcttactttctgtacccaataaaaggaggaagaaacagagaaaatgttgcaagtggcatacactcgccacacgcaagttaggcctgcgtgctcacgtattactttctctacgcaataaaaggaggaagaaacaaagaaaaaaaatggcaaaatttgttacaggacacgtaaaaaacgtgtaattagctgaggaacaccgcaaaattatgacactgccctaggatactacaaaatttgtgtaatttgttgaggcacaccgaacgcattattttatcatttcccggctgaaagtggcgatatttttttgaaatgcctagattgcccccgcgtcactccaccgaacgaaaaatccccagtccctaaccctagcttgcgacggcgacggtggcggaggaggcttcggcggcgcatgctaacgcggtgatggaggaccaggcgtaggtcatggcgtcacccagcgacacgcttgccggcgtctatgatggccatggcggccccgacgcctcccgctttcttcgctcccgcctcttccctttcgtccatggtgcgtgcgctcgccggcgcgtgcgcggcggagctccatcttttactttgatttgttaaggttctgagaatctttagttgatttgttggcgccaaaaattgaacagagttcgcggcgttgtgcaacggcgtggtggacgctgacgtgattaggaaggcgttcctggcggccgacgaggagtactagcagctgttgcggtggtcactgccgaacatgtcccgcgcggccgcctcgggctcctgctgcctcctgggcgccatctccggcaacatgctctacgtcaccaacgccggcgactcctgcaccgtcctcggccgccgcgcggcagccgattagaccgtctccgagcggctctctactgagcacaacgtggcctcggaggaggtccggagggagctcgccgcgctccaccccgacaacggcgaggtcgtggtccacgcccgcggcacgtggagggtgaaggggatcgtccaggtggcgcgtgccatcggcgacgtgtacctcaagacgccggagttcaagcacgacccagcggtgtagcggctttgtagctgctgtgctggcagcgccgccgccgtcgagctggggcaacatatagtatagagggtaacgcaggggcaatctgggcatttagaaaaaaaatatctgtcacttttaaccgggacatgataaaaataatatgttcggtgtccctcagcaaattactcaaattttgtagtgttctagagtaatatcatggtttttcggtgtctctcaactatttacatgtttttttacgtgtcctatagcaaattttgcaaaaaaaataaaaatcctgtgtttatcgtgttcactgtgattgtttgtgctcttctccttcgcgtccaagctcgtgtgtgttgcatggtttcgctacaaccgccgggtttcgctgacagctgcccttttcaatggggaagttgtactactccctccataccctaatataagagattttaacattttaattgcactgtttaatcattcgtcttattttaaaattttttggtattattatttattttatttatgacttactttattatccaaagtattttcagcacaacttttcattttttatatttgcacaaattttttaaataagacgagtgatcaaacagtgcaagcaaattaaaatcccttgtattaaggaaaggagggagtagtaattttcgttggcattagttatttaaggcttgttcactttgctaccatttttaactttacattttttttgataaagttatcgaaaaagtggctatatttagtttgttgctaaattttagtaagtacatatgaaatcttaccaaaattttgataaccttactaaaatttagaaaaatggtagcaaagtgaataagctttactttcatagatgcatgcatttttgctggctgcagagaattcatcatgcacatcaattgagtcacccgtcattctatttggatttggggtgtgtttagttctttgagtgtaaatttttttaagtatacggatacacatttgaagtattaaatatatactaataacaaaacaaattacagattccgcctgtaaaccgcgagacgaatttattaagcctaattaatccgtcattagcaaatgtttactttagcatcacattgtcaaatcatgatgtaattagactcaaaagatccgtatcacaacttacatccaaactgtgcaattagtttttttttctcacatttagtgtctatgcatgtgtccaaatatttaatgtgatgtttttggccaaaattttttaatctaaacaaggccttgacggcgtctcaccttcattgcttcatccaaatggtcaccttgaaattaatgttgaccacattcaattcatgcacgtagtactactctatccgtcaaaaaaaaaaggcaaaccctgagtttccgtgtctaactttgactgtccgtcttatatgaaattcttttataattcttatttttattgttgttagatgataaaacataattaatattttatgcgtgacttgtctttttaatttttttcataattttttcaaataagacggacggtcaaatattgggtacagaaaccaggatttgtctttttttttttgacggagggagtaggttctagcaagtctgccagtcctgccactagctaacggagtacagtgacaaattttagatgtactccatattaatctaaaattaatgcacttgtacaaaactagaacatgaatatatttctttttaacagaacccccaacaaaggaactcctgcaccatccgtcatccacaaccatatatttttaataaaagttaaacgacacaagatatgaaaaaaacagaaaacaaattcccgataataagttactggtaaaatgaaaacaataaatttgtaaatcataatagtagtataactcggtgaccaaaatatcaatcttataccctccttccctaaatgtttgacgccgctgactttttaaaatatgtttaaccgttcatcttattcaaaaacttttgtgaatattattaaaaaacttgagtagtagtagtatatttaacaatgaattaaatgataggaaaataattaataattgtttaaattttttaataagacgaacggtcaaatatgtttaaaaaagtctaacgacgtcgaatatttagtgacggagggagtatatgggtctattgatatagtatcgcgatgacacaccgatggacacgttggagcaacaacgataatgtagtgcgcctaacaaaaaaaagtttagaagagagcgaaaatgtagtgagggcaagttttataataggtgactaccatatctaattttatgcatgacatatataattaaattaagatgtgatatgtataataggttacctctaccacacaatctccaatttctttaacactctcacatatttattgaagtttgtgtaggggctgccccttgcatgagaggtgactatttctctctcatccttcttctctcctccacctcactatttagtcctatgtggcatcttggggcttgtgcttagatgcccatagtacttgccctaagagcaaggataatagtagagctcacttcctactattagtccatcttaaagccaacatatataatggattagctataaggttggttacaactatcttctcctgtctctatctctaacctatgtatttaatatatttatctaggagcttatgttaagctagctcttgcatgagagccaacattcttgatttttttgttatctctctcctccacataagcttgtagtagacttatagctcactattatacttgctctaaatcagcacccaaccgcttggacatgaatctctaatgcttccccacaatggagcaataatgataatacagctggctatgataacgaatacccaaccgctggctgctgtaagaagtttagaagagagcgaaatcaaaccgcacccgtcttagagcaagtttaataatatagccaactactaactctaattcatatatagccaatttaatagctcattcatacaatagttacatatcacactattaatacatggtcccacctgtcatacacactgtgtcttggagtccgtgctacagccagctacaaatctgtagcccgctgctattctctctcctcatttatctacttaaaatatgtttacagctggcttataacctgctattgtacctactcttaagcccgattagcctgatttattttgctccactatctcacaacctatcttaatttccgattgctctagctcaaccataaaaataatgtcctttaatttctcccatcttataccatccaatttataggactatgcaggcacgggtgtcatgaaaaccattaatccaattcttgtaaaccaccacatttaatttgctatgtggttatgcattcttgcatagatctaccaatagtgccatcaacaaatctcatgcgaaaaaactatcggtgtaattacggtgtaaaaacacatcatagttacaccgtatactatatatatacgactagtagcattaaaattgagttcaagagaaaacacagcgctagcttggtggcaaaaggagcactcgtgtgatgggggtgggtttttataaagaaaaactcatgcatttattttatatataggttagaaacataatatatgatgagttgttacagtgcagtgctaacagtacggatcactgggacacttccagttttgcgaaaaaccccttgtgaatgggcaaattacacttttgctcaacattttgtagaaaaggacttagaaagaaaaaaaaagcaatcgagtcattctccttcttggcctttgtcaccgatgaagaagatctgaagctcacttccggtggagggtgaaaccaagtgagctgaatgcactcaatccctaatgattcctcctatgtatggaggctaaggtgttgatgagcaaagtgaaattttagcaacaccacttgagatttctactattgttcttgagagaaattagtacaaagaccatagctactccaaagacaacaactagatgtattttgttggtgaagaaagcaaaagaaacgcggtgagctacataagaagccaagaggcatacagattcggtcctccacgagtgggaggttgagacatctttgatgcaacttgaaaactccagccacctagtgaagatttgtcgccaaggatcaagcatgaggccgccttccttggaaagacctcgccggagatgtcgatgtagacagacgttacctctctttgcacagatctggaggcatcctaggtagcagctgggagaagaagcccaacagggagtgattcgtctccgtggagaagcccgacagcgctcctagacacaaggacgaggccaaccgacgccaacaatcaccatgagaatcaaaagggaaaattaaaaccacgagaagaacctgaaccaacgggataacccgactattgctactacaagtactagaggagcagggaacctagtccctatcctaaccttcaccagcgatgagccgatggtggggagagagaggggttggaaaggggtgaactttactataatgagtattcatgagaggtcaaggaccaacgagagagcgttttctgtcacttatgtgtggctgcaatagggaggttgcagggtcgattctcaccccaccagcgtgcgcctgtgcacgaatcttgcaacgaatttaattgtctaaaattagcagatttcttccaaaaaaaaccatcacaggtactagaattaaaatctcaaagcaggaagagttgagcgatatggttaaaaatggctagaaaagaaaatcttaatcatcaaaaagcaggttgcaggtgtacacgtccattctcactaccataaacaaggggatgtattccaagcgaacagaaaattaaacaaagtcaaattactaagttgaaaacaaacttacatttgttatccatagattttcattggtaccattaatttcgcaatcactttaaaatcaagattgctcgggtgttcagtgcactgctcatgtttgatgctaatatagattggaccgagaaaaataatcaatgcaaaacccataaaagaacgtggggaatctatgcgtacgaagtgagttggcgagtagacaaatggaggggtggtttagaccgtgagaatttgtaatttattccaaggaggtattgtgtaatctagtgatgaactcataacgagggaatgccatgattttttttttctgcaaaaataagaacatgaaagaatttctgaaaagaaacaagcagtggcccgtttcaatggtgcggaccgtgcggtcgatgccttggtgggtctcacattctcactggcccagcctcgacccatggttattactatttcacatttctgggtgcacttgtcagtaggataataaaaaagctcgagactcgcgaaccgctcgagctcttaacgagccgaggcctaagctcatgagctttgtcgggcttagctcgatcttctcaccagcataggtgcacatttaatttttatcttttatataataagctagtaggtaattaatatacattcacgtgagaacttagtatatatattttgtagcagaaagacctctagatggtttaaaaaagacgcgaatgacctaatatcaaataattaaaagtggtaaggcttcgagtctaaattgtctagcccaccaccttgtggagctagctagaaaacctatgagcgtaattaggggtgggcattcggtctaaccgaaaatttcggtctcggtcttcggtctttcggtcatttcggtctttgaaaagtgaagaccaaatttatgtgaaaaactatcagaaccgacaaattcggtctcggtctcggtcctgactgaaattcaacaatattttcatatatgcaaagaaataatggaaattttcaacacaaaaatcacaataaaaattcgtaagcatttatgagtaaagactcttattaggttgcatgcctagaagaagtagggatgtgaaaattagagtttaatcctattaaacatagtggattgtagattgtatttagacattttttgataattcggtcttttcggtctattcggttatccgaggagactaaccgaattgaccgaacaaaattcggtctttcactatctaggaccgaattgatgaccagatttctcggtctcggtctttttggtctcggtctcggtctttccggttcgctctttcggttcggtccttttttttcccacccctaggcgtaatcactccatatatccaacgtcccatgttagccacgccatcaaagcttttggctggtggctgccgctcgcaccggctgcaaacgctcgtgctcaccttgtccatggcgcccacggctgagctcgatactgctacgtcaccgccgccgccgcacttcgtcatcgtcccctttccggcgcagggccacaccatccccatggtcgacctcgcgcgcctcctcgcggagcgcggcgtccgcgccagcctcgtcgtcacgcccgtgaacgccgcgcgcctgcgcggcgccgccgaccacgccgcgcgcgccgagctgccgctcgagatagtggaggtcccgttcccgccgtcggccgccgacgccggcctgccgccgggcgtcgagaacgtcgaccagatcactgactacgcccacttccgtccgttcttcgacgtcatgcgcgagctcgccgcgccgctcgaggcgtacctgcgcgcgctgccggcgccgcccagctgcatcatctctgactggtccaactcgtggacggccggcgtggcgcgccgcgccggcgtgccgcggctgttcttccatggcccgtcgtgcttctactccctctgcgacctcaacgccgccgcgcacgggctgcagcagcagggcgacgacgacaggtacgtcgtgccgggcatgccggtgcgcgtggaggtgaccaaggacacgcagccagggttcttcaacacaccagggtgggaggacctacgggacgcggccatggaggccatgcgcacggccgacggcggggtggtgaacacgttcctggacctcgaggacgagttcatcgcgtgcttcgaggcggcgctcgccaagccggtgtggacgctggggccgttctgcctctacaaccgggacgccgacgccatggcgtcgcgcggaaacacgcccgacgtcgcccagagcgtggtcaccacgtggctcgacgccatggacaccgactccgtcatctacgtcaactttggcagcctcgctcgcaaggtccccaagtacttgttcgaggtcggccatggcctcgaggactccggcaagccgttcatctgggtggtgaaggagtcggaggtggccatgccggaggtgcaagaatggctgtccgcgctggaggcgcgcgtggcggggcgcggcgtcgtggtccgcgggtgggcgccgcagctcgccatcctgtcgcaccgcgccgtcggtggctttgtcacccactgcggctggaactcgattctggagtccatcgcccatggcgtgccggtcttgacgtggccgcacttcaccgatcagttccttaacgagcggctcgccgtcaacgtgctcggcgtcggcgtgccggtcggcgcaacggcgtccgtgttgctgttcggcgacgaggccgccatgcaggtggggcgagcagacgtcgcgcgggcggtgtcaaagctcatggacggcggcgaggaggccggcgagaggaggaggaaggcaaaggagtacggggagaaagctcacagagccatggagaaagggggctcctcgtatgaaagcctgacgcagctgatacgccgcttcaccctgcaggaaccaaaaaactcaagttctataacagtagagtgcagtgcaaataggcacatttgaatccacagattgcagtgttttcctgaatattttttttccattttgttggcattaggtttgattgcaatgatttatttctccatgcatggacatccatgcacataagtcacctgtcttttcttattctgaagaagttaatggatgatgtaattctatttgcggacaactttcttcacaatgtggacttggaagttggaatattccaatgagaatccaagaagatgcatgcctccagaaatcagaatattcctaggccgtgtttagttccaaattatttcatcaaacttctaactttttcatcacatcaaaactttcctacacacacaaacttccaacttttttgtcacatcgttccaatttcaaccaaacttctaattttggcgtgaactaaacacacccctagttgacttggaattgttggcttttgtcaggatcccaatctaccctatagttcaacgttgcttcgtctgaacattttatcttggccgtgtttagttcacccccaacttccaactttctatcacatcacatcacatccaaaactttcctacacacataaactcctaattttttttccaaacttctaactttccccaaacttttaacttttttcaggaacccttgttgatatcaggctagctctatcaggttgtcagttgccacctttgtggcctttcatatttcacctttcgccacttatgatcatcttgcaatgccatccacattcagatgatctgtatggtgtaacaagtctgccacaaacaagtgagttcagtgtttaaattcatcaagaaaatacacttggtgatgtattggatctcgatcgatctgataaaccaacgatgaccatttgcttgttttctctctgtgtgtatgactctgctttaggtttgcctgtcattttcatgagacactagccaattagtcgtgcgttgcacaactttgggtgcctgtaatgtacaatcatacttaattttgattttttttcttacaaaatcatacaacttgattttaaaactatagattcagctcaaactatatttcaactgaaggttcaaatattatgtccaggatcaacctcttaccgtatacggtgaagaggtgagaatgtttactcagcaatacgatgcataaggttcacagttatcaaacctaacgcaatacacagtagcaaagtaaacggcaatcaagtccatgatttgaaaccaacacaaattgctcaaagatcatttggcctccgagtatctcaagaagataacataataaacattccaaaatgaaaatgtacaatttggttatgaagtatagtaaaaaatctagagtgatcacaattacagtagtttgtctatttatgcattattgccaaccaaaaatccttcagcccaagccaaggaggttttctcttctctgtaggcctgccatcaaccacaactcattcatttcaggaaattcgcatcaacaaaaatattcttggcttgcaaaagcaaagcaaaactttgtaaatcttcaggtagtttctcctagacagcaaacgaatgatgacaggttattctcatccttgtaagtgatggttctgccctgaataatagtttcagaaaatctagttcatgtttcttttctttgaagttggtaagctccacctctgcgagtaacttcatcagaacattatgagctccctagcttgttgattgatagcagatgcaattcaaagaacatgattcttccccctgaaatgaaagaatatttaggtgtagttgaagttttagttttggaacaaaaacaaaactaagatatgaatagactgattctcttatgagatgttaaggtggagacgtcataagtagattatacaaaagagttacaacatagaagaaaaaaatattttaagggtaaactcagtaagaaaatatcttctttagattccatctaatgttgtcaactaataatttttctaattcaacgcaactgaaaatgcttcagagcaaaattgtctcgttaagtgtagtacctcaggtcccctttcaatttttattctctcatttttttaatacctattattttatatcaaggagcaaacataattccttggcgatctctaaatgaaagtttaacgtcttgttagttttgctatataacttggttaaaggagactgtataatagcatgccacttgcaatttagtagtcttgcttctgtgtaatagcacctgaaagtatataattgaattttactgttggatggccttgaagatggaatcactacttaaagcatatgattatgtagttatgcattactaattaacttaaagaagtgattttagatataacaacatttgcattctgccttgaccattgcacaacaaataattacctagatgcgatgcctattctagaaaataaaaaacaatgaagaattaggcccatctttaaatcccacaaatccttgatatgactcacaaagcctcaaaatcctatatatgaaagaatgagatgtagtgttttgcataaatagtagaacgaatgcattctattgacctttgcttcctccacaccattactcacgatttatggtgatcctacaccagttcattatagtgtgctgacacatctatcagtgtgaaaatcaatgtacttcctccgttctgtattataagaccattacccacatttatatatagatgttaatgaatctatacatttctagcacatctatatgaatgtgggcaatgctataaagtcttataatacgaaacggaagaagtaatatttaccatgattgtagccatacagaaatttgtgcctcgctcttcatcactccatctttggcatcgtctcttttatttgagccgatctgcagtggtaggccacagcgtgggaagacagataggaggggatgggatatattgattatgtaacttattaccagatacctgggatgggatcatgggattcagtgggcaagggaggaagagatggcgacagtcttgttgcagtacttctgcttgaatttgcgatctgatttttgacctcgatccaccatcgtcgatctcgatcttgttctgttctttgcagctgtgattcggatcaatggggaaacacggcagcggcggcggcggaaaacgctgcggtggaaacgatttgaagcagtggtgcggatggggaggtgcggtgggagggtggcagtgcaaacgaggaggcggcggtggccagtggaggcgacggcaatacgggcggagcgcgaagacgagagaggcagtggtgcacacgcgattgggagtgtgggctgtgttttttttttttttttgccgggtaaatccgtgagaccgatcgggagtagtgcggtgggccgtggacacgtgggctttatatattcacgaggcttccagccttttcagtccaagactcaggaagactactcatgttacttcgaaatccaatggtccgtgttgatcacatggttgcatccgacggtcatttttaatccgatgacgtggcacattctggtggtgaaaaactttacttttttcactactttagatactctaggattaaaactagattgattaccgtttctcaaaaaaaataataatgaaaaactagattgattattgtgttgcaggctagatgctaagtcggtacaattagatctctgaagcccttttctcgctctccacattttcgatcagaaaaagggtctaattcgcacatgtagattttaaaaatttccattaataaaaaaatactcagttttttataatgagaaggtaggagtgccatttgattaaatgaaacatttgattctcttgcaaaatttgtaccatacgttatgaattgcagtatgcaagtatactaatttcatagttgcaaatatttgtcccaaaatgtaatttagtagtatgagatattttggatgcacaagagtttatcaccaatcattatcttgtgatggttagagaggtcaggattcatgagactgtagctccattactgaaaagagaaaaacgcagcttgtgatggctgcagaggccattccctccttcaatcttcagactgtatttttcattggagcagaatcaaaaagtgaaaattgattgacggtgcatgcctgcttgcttgggtgtgtttcttggcttgtgctttcttcctcatggagcggacagtatcagtaccaattaatcgagcagttcagctgcagctagccacatctgaacgtcttgagaccagatgttgattggcataattgtggactacgacaggttgatttttgcactattcgttttcatcttgccttcctaatgcagtgtctggatgagttacagaggtcgcgtagtcaaatctgaagatccaaccgtgtggttgaaacctagaacacagtttgtttcagatgtcgtaattttgtttcctggcgttctttgtatattcttttatccagcctatacacttctccaatgcaaatagtcgatcaacatttctatgtgatacatcacttacatagaattacagaaaatacatatatttatatttcgcgtcgtaccggtgctacgtgatcatgcgtgtgggaaacaacgaatggaggaccgggactgacaccatctctggcaacatatacgcgatcttcagagaaggaaaaaaatagaggagattgacgatgacggacaaaagaacgtaacactttactccatgctaaaaaattacctcagtcctagaataaatacagttttatgagtagaaggataaattaacaacgagggaaaatcatctagctgttccctatcaattggggggtggttgaaagtgtgaagatagttgggtgtaaattagagaacatttaaattagttgttattaatgggacaagtaacaagtagcactataagttttacttattttgggacaaaattaaaatcgagaattgcactttttaggacggatatagaataagacgtaaaatcgatcttgaatatcgtaatttaaccatttatttcttttataaattattatccacaannnnnnnnnnnnnnnnnnnnnnnnnnnnnnnnnnnnnnnnnn

SEQ ID NO: 11905 - DNA, 4032 bp, Oryza sativa
caaaagaacgtaacactttactccatgctaaaaaattacctcagtcctagaataaatacagttttatgagtagaaggataaattaacaacgagggaaaatcatctagctgttccctatcaattggggggtggttgaaagtgtgaagatagttgggtgtaaattagagaacatttaaattagttgttattaatgggacaagtaacaagtagcactataagttttacttattttgggacaaaattaaaatcgagaattgcactttttaggacggatatagaataagacgtaaaatcgatcttgaatatcgtaatttaaccatttatttcttttataaattattatccacaacaacaaactttacatcatatgaaacttaccagttgattttgctaccgaaccgctatgggaagcacggctgctccggtatccaccattaagataaaccctgatctctaccagtactagtattatagtactagtcttattattagtagaacaatctaaatcatcgatttatactacaagtaaaaaaaatctaccacaactaattgaagctatagtataaatagaaattattcattagataaaataagacaaatgcttacataaattgtgctacctctatagaccatcatgaaaattaccatgttaatatgcatgtaaccacatttttaggaaaaagggaaaggttatatgtataagtggaattcatgttaacttcagttgcatttgttccattgaagcgagagcctatagattaggaaaacccaacaaattaaccctcgtagcatagattttaacaaaaagaaaaagatttaagatgcggagaacaaataaaataaaatcataattaaaaatattagtaaaataaaagcctcaatttcataaatcataatacaactcggagattaccgtcggtcttatgcgacaaccgctatcgattatatagttttggttgtgatagtgttctcctattaaatatggaagatcaacaaatactatgagaaataaagtaacgaggacggaagtaatggtaacaactatgcacaactaaagtgaagtgcatgggcatccaaccatagagaaataaaccaaaacccagctgagctagatggtgtaaggagtatttaagaagagagcatatggagcaaccccgccgtcccttgggcacatagagctgcgcgccgcccttgttggcgaactaccggacgtagaagacccagctgagctagatggggtaaggagtatttaagaagagagcatatagagtaaaccctccgtcccttgggcacgtagagctgcgcgccgcccttgttggtgaactaccggacgtagaagacggcgttctgaaatggcagggtgttgagcgtgttgccatcgccgaacttggtgacgggcgcaacccggtgcccatcgccacccatcgctgccgccatggaccaactcaacaacggtcagcaacgccaatgctacagccaactgaacaacgccattgccatgaacacaacaacaattagcatccattggggaacaaatcaaaacagtccttccagatcaaaacctccaaaattcgggaccaataaaactaagacgcgacaatcttaaagagaaactaaactatcaagaagcacggaatagatatgccattttctccaagagaaaagatcccgatcacatgaagaatcaacaggccaagccagttactatcgattatatagttttcggtgtgatagtattctcctattaaataacaaagcagaacccagctgctagatggtgtaaggagtattaaagaagagagcatatggagcacaacacacatgtctacatctagcgtaagatttgtttcgctccactatctcacaacagttctatctccactatctcacaacagtcctaccttaatttcaaagtgctaattaaccatacaaatcctgttttttttcatccatctatacccttcaatttatatagtactccgcaatgaatgacatgaaattcttcatccaattcttccgagccacccgcgtttaatttggtaggtggtcatgcattcttgcatacatggagtcacctagcaagtagttacccggtcaagggccaaggctatcacttattagttcctactttgtctttattccgctgttcttcatgtgtttgtttcatcgaggaagcatacatgcatacatcacgtgtgagttggatgaggaacccctgacctacaatgatgattgtgtggctctaacgtgagaggctctcctagctagccttagcccgactcatagccagggttcaccaagggcctgtttagtttccaaataaaatttttcatgccatcacattaaatgtttggacacatgcatgcagtattaaatgtagaaaaaaaaccaattacacagttagccaggaaattgcgagacaattcttttaaccctaattgcgctatgatttgacaatgtggtgctacagtaaacatttgctaatgatggattaattaggcttaataaattcatctcgtagtttcttggcagaatctgtaatttgttttgttatttgaatatatttaatacttcaaatatgtgtccgtatatccgatgtgatatgcaggggcacaattttttgccaactaaacaagccctaaatcgttttggatgtggttaccatcacctcacagtgagacggttatcacgataacagcgtggttactatgaaaaccgtgcggttaccacaaggtttatagtgattaaaaactaagaaaattgctggacgtgataatagtgataatcacacgattttgtaaaccctattcatagcaagatcagttaaaaagtactccctccatcccaaaatataagcattttggctatgaatctggacaactgtatgtctaaatttatagccaaaagttgttatattttaggacgaaggtagtagaacgcaattatcctcaaagatattagaacagactgaatttaaaactaaaatttattgtctctaaattttaaaggccctgtatggtcagatactctctactgatgttaatacacggcgctggaaggccagggcaccaagccaagcttgagttgcagcccatgtatggtaagccatttctttaatatcttgtcctttacttctattttatttttatgtaaggaaaaagtgcgaattaccccctcgaactatcgcggtcctccaaattaccccataaacccgaaaacctgtcatcgtccaccttgaactttcaataccggacaaattacccacctcgacctaatccagagcggttttatccaacgtggcacacgcgtggcaatctagtcagcattttatttaataaaaaagggtgggacccacctgtcatgctcttcttccgctcttccttctctgtcttctctctctcgcgcagtgcgcacggcgaggacgggcggtgggcgtgggctgtcggcggcgctcgccggcgccaacgagctggtactggtagcgccgtgcccgtggagtacctcgatgacgtggagcttcacggacacggcagcgtgcacgccatgatcatgatgcccatgtactcctgccccgtgcccgtggagtacctcgacgacgtgaagaactatagctgcgtgagcccggcaccgaagttgacgccggcgccggtcatgccggagatgatgccgagcgagcggcgggagacgaaggggatgacgccgaagatggtgccgcaggctgcctgggcgcagaaggagaagaggaccatgcagacgacggaggaggggagagtggaggcgcggccgagcaagaggcagaacggccgtcggcggtatggaggatccagatgttccatgggcgatggactccaaaatcgagttccagctgcagtgggtgacgaagccaccgacggcgcggtgcgacaggatggcgagctgcggcgcccacccgcggaccacgacgccgcgccccgccactcgcgccttcagcgcggacagccattcttgcacctccggcgtggccacctccgactccttcaccacacagatgaa

SEQ ID NO: 11906 - DNA, 25025 bp, Oryza sativa
atcctggcgagttgaagaatcctggctgcgtgtccttggtgacctccacgcgcaccggcatgcccggcacgacgtacctgtcgtcgtcgccctgctgctgcagcccgtgagcggcggcgttgaggtcgcagagggagtagaagcacgacgggccatggaagaacagccgcgggacgccgacgcggctcgccacgccggccgtccacgggttggaccagtcggagatgacgcagctcggcggcaccggcagcgcgcgcaggtacgcctcgagcggcgcggcgaggtggcgcatgacgtcgaagaacgggcggaagtgggcgtagtcggtgatctggtcgacgttctcgacgcccggcggcaggccggcgtcggcggccgacggcgagaacgacacctccactatctcgagcggcagcttggcgcgcgcggcgtggtcggcgacgccgcgtaggtgcgcggcgttcacgggcgtgacgacgaggctggcgcgggcgccgcgctccgcgaggaggcgcgcgaggtcgaccatggggattgtgtggccttgcgccggaaaggggacgatgacaaaatgcggcggtggcagcggcggcggcggtgacgtagcagaaacggagtccggcgtgggcgccatggtgggcacgagagcggtgcgagtggcagccaaaaagctttgatagtgtgggtgatgtgggagattggatacagcatagagagtgatttatagccatcaaagcggtccagctctttttttcttttttgcgccattctagaagcttttgtgattataactatctcgatatctcttctaatcttggagtattattattgctaactacgaaaaacatacctgcctttgtctagctactgtttggctatgtacatccttttggttttgggttgctgtgttataagtaaaagctatacaattaaccaacattatttttctattttcatcagcatatttagtaacattctaacaattgacgcttagttaagttatttatcgaaataaccttcggttgcaccacaattttgatgtacgtttgagtacaaccacatcactatttatggcgtggcatgatattttccacacatgatcgctacatcgaaacgtggcaacgaacactgccaaacatgaacacgagctatagtagcccgagcagattaattggatgaagaaaggtttttagccatcgaggtggtccgctgatgtcttttgtttctctctagaagctttggtgacactattgcatcatctatcttatctatgtattaccgtatctctctaatcttctctcattatcaaaaaaaaaaagctctactcttatattattattattattattattattattattattattattattattattattattattattattattattattattattattattattattattattattattattattattattattattattatatgctaaaagtaggaaaattatcaacatatgtccagctatgatgaggtactaaaaataaaaagtacatgattctatcaacaaatatccccatttatactccttcgcaaagcataggaatgattatattgcacaacacttagctagaggtccccaagatcaatttttccttcccctttcgcagcaagcgtttgatgaatataaggacatgcaagaaaatctccaatcctttacccttcaggaggttgatgattcatggacatttgtttggggatcagggaaattcacttcgcgactctgttacaagctcagttttctggctctcactcccccacctactatcaaatggatatgacagtccaaagtcaatatgaaaattaaggtctttgaatggctcttcttcatggacagggttaatacaagggatctccttgatagaaagcactgcgcgccacccaatacttcagtcctttgtctctcttgctcagctaatgccagagaaactagagatctcctgttcttcctttgtccttttagtgcggcttgttggaattgtctgggatggacatggaaccctaacttggattttcatcaaaggatccaggctcaaaaagtggctgtcttgcattcttgctttatggatctattcttaattgcctcatggaatatctgtaaggagagaaatggacttatcttctaaggcatccagccctcagtgcaaaactggttgatgaacttgaagttagatttgagcttacatttaattaggctcaaagaatgttacaggcccctagttcaatcatggatagatcagctgtaacttagatgttttttttccttcattgtttatctttttccttctttgtacatactactggaaaattaatataccgtgggggcctcccccactacctttggttaaaaaaagtacataaatctatatatccatcattttttgtacatttaataataaaaagacatatttctaaacatgtttaataatattctaacaatagactattaataatgttacttctaaaataacctttcatcacaccactattttggcaggcttttaagtacaaccatgacattgttttcggtacggccgggacgatatgctatagatatgttaaatggggcgagtacaatggctgagggggctgggccggtgagcagtggcaaatacagaactaaacttaaagtgaagaactgttagtgggatccaaaagttgaataaaactatccatcaaaatgaaaactagtttacccttttatctaaaattagatatgaacaagatagtagattgaaaaatgaatttgtaattatgtaaaatagaagtaaaagacaagagattaaagaaatggcttactatgcatgggctgcaactcaggcttggcttggccttccagggccgtgtattagcatctgtagagagtatctgacaatacagggcccttaaaatttagagacaataaattttagtattaaattcagtctgttcaaatatctttgaggatatttgcatcgtactttttaactaatctggctatgaatagggtttacaaaatcatgcgattatcactgttatcacatacggtaatctttttagtttttgaatcactgtaaacctcgtggtaaccgcacagttttcacggtaaccatgttgttatcgtgataattgtctcaccatgggtgatggtaaccccatccaaaacggtttggtgaatcctggctatgagccaggctgaggcttgcttggagagcctcacgttagagaagatacaatagcagactataagccagctataaacatatttcgaggagataaaagacgagagagaagagcaccgggctacatatttatagccagttgtagcacggactctaagatgcacatgtgtatgacatgtgggaccaaacattaattatgtagtatatttttataggtaactattgtatgaattggctattaaattaactatagatgattactattaaacttgctcttagagccacacaatcatcattgctggtcaggggttactcatccgactcacacgtgatgtatgcatgtatgcttcctcgatgaaacaaacacatgaagaacagtggaatgaagacaagtagagccaataagtgatagaattggcccttgccagggtaactactagctaggtgactgtccatatgtgaaagaacgcatgaccacctaacaaattaaacgtgggtagctcggaagaatcggatgaataatttcatgtcattcattcttacagagtactataaattgaatggtttagatgaattaaaacaaagacaagatttgtatggttagcactttaaaattaaggtagaattgttgtgagatagtggagcgaaacaaatcttacaatggacgtagccggtgtgtcgtgttccatatactctcttctttaacactccttacaccatctatcaactgggtattgctctgttattgtttctccatggttggatgcgcatacactttagttgtgcctagttgttaccatcaccgctcatagtatttgttaatcttccatatttaataggagaacattgccataaccaaaaccatataattgatagcgtttgttccataaaaccgatggtaatctccgagttgtattatgatttatgaaattacggtttttattttactatatttttaattgtgatttttatttttttttgttctttgcatcataaatcttttatcttttgttaagatctatgctgcaagggttaatttgttgagttttcctaaaataaaatattaggctctcgcttcattggaacaaatgcaattgatgttaacatgaattctacttatacatataacatttcccctattcctaaaaatgtggttacatgcatattaacttgtaattttcacaatggtctctaggggtagcacaacgaatctaagcgtttgtattattttatctaatgataatgtcggtagatttttttacttatagtataaatcgatgatttagattgttctactaataataagcctagtactagaatactaccagtacctagaatactactaataccggtagagataagggtttatcttaatagcagttaccacatgcagtcgtacttcccaagtaccggccagtcgtacttcccaagtaccggtagagataagggtttatcttaacagcagttaccacaggcagtcgtgcttcctatagcggtttggtagcaaaaacaactattgagtttcatatgatctaaagtttgttgttgttgataataatttataaaataaataaatggttaaattgtgatattcaagatcgattttatgtcttatgatatatcagtcgtaaaataagtgcagttctcgatctaaattttgtcccaaaataagtaaaatcctatagtgctacttgtaacttgaaacaacccagaaatttaagctattttaaaaattaaaaattatgtggcatatatcactaattaattagttaactagcaaaattgttggaaataagaataagccactcaaaatttatgaaattcacatccgtcgaagttaaagaaacaaacaatgggcaatatagagccacaatataatagtaataattggaaatatagtacagcatcatggacaccgtggcgccgaccggcacgccgacgccgagcacgtcgacggcgagccgctcgtttaggaactggtcggagatgtgcggccacgttacgaccggcacgccatgggtgatgtcctccagaatcgagttacagccacaatgggtgacgaagccaccgacggcgcggtgcgacaggatggcgagctgcggcgcccacccgcggaccacgacgccgcgccccgccacgcgcgcctccagcgcggacagccattcttgcacctccggcgtggccacctccgacaccttcaccacccagatgaacggcttgccggagtcctccaggccatggccgacctcgaacaagtacttggggaccttttggatcatgtcgttgaataattttgtttcctgacgttcttcgtatattcttttatccaacctatacatttctccaatgcaaatagttgatcgatatttccatgtgatgtagaattacaaaaaaaatacatctatttatatttcgcgtcgtacatgtgctacttgatcatctgtgtgggaaataactaatgaaggaccgggactgacactatatctgggaacatatatgtgatctccagagaaggaaaacagagagagaggagatggacgatgacgacaaaacaacgaaacactttactccattctaaaaaattaccttagttctaaaataactatagttttatgagtagaaggataaattaacaacgagggaaaatcaactagctgttccctatcaaatgggggtggttgaaagtgtgaagatagttgggggtaaaattagaggaaatttgaatgagttattattaatgggacaatttacaagtaacactataggttttacttattttaggatggatatagaataatatgtaaaatcgatcttgaatatcgtaatttaaccatttagttcttttataaattattatcaacaataacaaactttacatcatatgaaacttactagttgtttttgctaacgaaccgctatgggatgtacggctactgcggtatttactattaagataaaccctgatctctactggtactagaattctagtactagtcttattattagtagaacaatctaaatcatcgatttatactataagtagaaaaatctaccacaattaatttaacatatagtatgaatagacattaccattaaataaaataagacaaatgcttagattcattatgctacctctatagaccattgtgaaaattaccaatgttaatatgcatgtaaccacatttttagggttaggggaaatgttatatgtaccctcagttgcattaatttaatttcttccaataaagcaatagcctaagtattttatttcatgaaaactcaacaaattaacccccgcggcatagatttcaacaaaatatgaaagattaagatgcaaagaaaaaaattaaaattaaaaataaaaatattattaaaataaaagccgtcatttcataaatcataatacaattcggagattacattcggtcttatgaaacaaccgctatcaattttatgttttggttatgacaatgttctcctattaaatatgaggaaggaggtgctagcaacaactgtgcacaatacgaggaaagagatactgccaacaactgtgtaactgtagtggataggcatccaaccatggagcaacgataattcaatagacatgacagaacggaccaatacccaaatgaggactattaaagaagagagcatatgaagcacggcacacaagctgcgtctatagtaagatttgtttcactccattatctcatttcactccattatctcacaacagtcataccataattttaaagtgctaaccatataactcttattttgttttcatctatctataccattcaatttatagcactccgcaagaatggatcatcatgcaattcttccgagccaaccgcgtttaatttgctaggtggtcatgcattcttgcatatatttgctaggtggtcatgcattcttgcatatatggacagtcacctagctagtagttacgtactcggtcaagggccaaggctatcacttaatgattcctacttgtcttttgtttcgctgttcttcacatgtttgtttcatcgaggaagccctgacctgcattggtgattgtgtggctctaacgtgagaagctctcctagcaagcctcagcctggctcatagccggggttcaccaaggcgttttggatgggtgtaccatcacccgatgataagacggttatcgcgataacaacatgttaccgtgaaaaaccatgtggttaacacgggttcatagtggttttaaaaactaagtttaccgtacgtgataactgggataatgcacggttttgtaaaccctactcatagcaagatcgttgaaaataggaagcggatatcctcaaatatattacaaagacaagttttaactccactatcttgttcatatctaattttggataaaggggtaaactagtttttattttgatatatagttttattcaacttttggatcccactaaccgttctttaactttaagtttagttatgtatttgccactgctcgccggcctagcctcagccattctactcgctctatttgagatatctatagtaaatatcgtcccgcacaaaaaacaatggcatgaatgtacttaaaagacaaaatttgctaaatgacatttaaatattatggtctttgctgctagatatgataaaaacaaggttttgcttttggacatcctggaaacattgtagtaatttgttgctatacattgcatcgattattttattatttcttgcctattcggagagagaatcattttgaaaaaaccaaaataccctagtctaggccgagtttagttctaaattttttcttcaaactttcaacttttccatcacatcaaaattttcctatacacataaactttcaagttttctgtcacatcgttttaatttcaaccagactttctattttagcgtgaactaaacgcacccctatttcggtttccccggtgggcggtgggtgactgtcagtcattttttcactcaaaatcagtcaaccagtcaaaatccccaaataaccatccccttctctttcatccttccattccagtgatatgggacaatggcggcgacacaacaactccctcccggcgcggcagctagtgctcaacgcggccgacccgtccggcagaacacgacggtgatgtacccgcacccggacggtgatgttcgtcgccaacaacattgtctcgtcatcaccatcggtgtccgatctccccgacgttcttgcagcagggcacgtgaggcgggagtggaggagaaggcggtggagtcggcgtcggcgtcggcacggtcggagctggagaagcagtagcgtcggcggcggttcttgatgatgaagctcttgtatagtagaggctctctatggcaagcaacactgcaacagcaaggtagtttacggctcttgctatggccagctagctagggagagataaggtacagctcgtcgcgtgtgtgtggtggccgatgctcaccgagaatgtttgacaatttcctggaagagggccgtggagtactgcttgatgctcagtggaagaacagaagaggaacttgaagataatggtacaagaagaaaagggtataaatgacatttcacacaacatgtctctcctctcctggctgtatatattattttgttgctggtaatgtccagtagctaattaccaagtttctgggatactaaaagcaaaatctcgtttttacgatgtctactaacaaataccgtaatctttagatgtcgttgttaacagtgaaattttgtaattggtaaagacgtcatcggcttagaatcattatcggctacagcatctcggaatcagccgatgggagttatcaagtcaccaatagtcggattcctgctatatttggttaaggaaatcaatctactaaaggaagcttatccctaagtgaccgagtttaaaaaggatgtggcatggcagtttatctattaattaggaatagtttgttagtttccttttatctttaggaaagtatgtttagtgtccgataaggactttatatttttcttttatctttaggttagtttctttcttgtccgacaaggacttgtatcaacccatgggtataaatatgtacacccgatgtctatgtaatttatctctacgatcaatacaattcggcacatcgccaccttttttacttctacttttgttttttacgttccggcggaacttggcacccgacgcggggctgcgtcgtcttcgatctccggcgaagggataagtccaatgttccgtcggcccaggcaattgtctcatctacatcggcgtcgttcaaggctgcatcagtacattcgacctcttggattgctctagtttggatgatatatttgcctacctatttatcatatgtctctattaatctagtcctagcatatcaatttagctatatcggctgcttctcgttttagggtttctgccgatatcggctaaatcgcgttgctagattagattagctcagacatctaccaccctaaaactcagtcaacggcttgattgtctagatattatgtttcttttcatacttagtgctgcatcagttaagtttgatctactaagtcgtgcttagaaccataatctctagcctgcttcttgattgacaacaagggtttcatcgaggtttcagccggtgagttatctggacgttgcatcggctcataaggattgcacatacatataagttgcatttcgccgatgacaacaaaggtttcactgtttaatctaatcttgtggatttcatgacaccggacctccagccgatgtgtgctttaaccttcggatcgatgcttatttatcatatcattgctagccgattggtttatactggattatattgttattttattgcatcatcatcagccgattgcctttatatcatccgatgtgtgttcgatttttttttcgtcaacacagatgtgttagcaaccaaatttggtaatattggcatcgggaaagaagattagatcgaagcaaagtcggaggcggagatcgagtttggaaacagagtaggaatcggctggagtccagatcggctacgagtaggatcggctgggtctgagtcgggctaggtaagccgatgcagccgattccgacgatgcaacttgatgtatgatatcgggttgaattgaggcgcttcaaggtgattgccgcacatggatagagtcctgagaaggcaattgtatctagtaattaggatgttttatgtaattaccttagatatatgtttgggcaaaaatctgccgcaaagacttatggtatcttagagtttgttagagatagtagtcgtgtccgttatggatatatcttgtaattctcgggtataaatagacccgagccctatgtaacttttaacacacacgtttaatacaatctcggcgcatcgtgtcacaccctaaaaatcgctaaattataaatcattgtgaaaaaggaattttttagaaattatttaataattaaagaaagtgtgtgaataaaatctatgaaaaatttgaacttaaacatgagctagataaaatttcatcaaatactttgtgtgcccaagtattttcagaatttttcttggatttatttgagcattggaagtatttttaataaatggaacattatttcagcaattatttaaattaaaaagtcaattaaaatcctcttctttgtctcgggccgaatccggcccattcgctttcttcctctctcttccgccggcccaacccgagcctgcatcctctcttcctctctctgccgaagttctatttgcttccctccttcattgggccgaggaaatgaagcccggcaagaagtctgtcttgtctccctctactacagtgtcgcccctaacctccagccggtcgatctcctccctgccgtgcccgtgtacagcgccgcctccccaccaaattcgtcctctccgttgctcctctttccaaattagttgtgggaatggattcctctcgatctcctctatcttatccccaagaaacccccttgagtctcgtggtatatcgtgtggattcgacgcggttttgagttcctattttccggcgaacccaaactaatccgtcgccgattccatccgttcccgagccgatctctccctcttccggctataaatagcatcccctagccgtcctcttccgtttgcctcaagtcccaagccgagccatcgtccgtagcgccgccgccgcgtagccctagccgccgacgtcgccgacgccttccagccgcgccgcgccgcaactgtagccgtcgtcgccgcttcccgtcgccgccgtcgggtgtgcacggaggaggagtacctcggccgccccttagccgccgtcgcaagctgccggagcgccaccgccgccgtcgagccgagccgcgccgttgtcggagctcgttgccggccgctatacgtcgtcgtccgtcattatttcttgcaccggtgagttcgcgtcgtcgtcctcttcgcgtaggtgtcctcggatagtccaaccgagctcccttttgccggtggtcgcgtggagccgtgccatggccggcgatgatgtcagcgatgacgtcataaatctttttttagttttctctgttagctgaaaatcgattaaacttcggaaattcataacaaaatcatcgtaactcggattcgagtggttaaagttgctaaattcatctaaaatcgagatttacatgttaaaagtatccacatgtactgtttatgcttgttttgtactgttttgttgattttgttcatttactttagtttccgacgttctggaggagagcgtttacgttgaggaaggttcagaagcgtttgcggaagctcaaggcaagtcacacagatcccaaacaaccctttgtacatgttgaacccgtttaaagctaatattttatttcaacttatgcattattttcgaatgtcattgggtggtgagcctttcccatttaattctggccgaagatgactttattttcctatgggttataatttgactagcatggaccttatatattggattgattcagttagatgttatttatagttgcttagccgtgcttagaaacattagctcattaatgagataaattatgcttcactattacttatggttatatttaatggtagctcacgatggtcaatcgtgttatgataattaattgataattaaaatatgattaatggtgggttgtgagcacatggttttgagggtcgtgctcatgataattaaggaccggttcgcgagctactgttgtgaaacattaaccatgccaaccacaagccagcgtgggcaacggctttatcttttgtatagcatgattcattacggggtgtcagactatgaagcggcgagaagtccgtgggggtcgctggggagtccattgtctctggttttgagttggagattatgatccaggaatggtgcactgtggtgagttgtgttgtgcaaagggtactgtcacgatttccccctttgcagtgccgtggtggtacttcggggcatggtaacatgtgtggaatcgtgtcttgtgggtacattggtacatctctggccagagtaaaactattcgaatagctgtgcccgcggttataggcgggtctaacaatgtttttcgtgattagttccagactacttattaatgataataatgtgataattaatttgactcctggtttggaggtttgatctgtacgaccggggttggttgttcaggtttggttgggcctgagcagcatgggtgtgctgttcagtgttgattaatattgatgattaattagtgtactgttttactactcttaactctttgctaaatgctgcttttgcaaatgaaccctatattatgccatcctttggtatccatgtgcacttgcatacttgctgtgtggcttgcggagtattccatgtactcaccttgcaataatcatcaaacctcagttgaagaaaaggatccagaaggagaagacctttggtttagatcccagttgagctgcctgtgggagtggagctgaagcttcgctagattttattttccgctgcagttttcttcatggtgaggactaagtgcctcttatgtaagtatttatcattttagttattttgatgaatctgtatattaaattgtcagtttgtgtacctcggctgattcctggacgagggttttaatgcacaaattagttcggaaattacttgtgaatttctgggcgtgacacatcgctaccctttttgctttagttttatttcgacgagttcttgctttcgggttgagctgcatcggtttcgattttcaccaagaggtaaaacttgttatgatgaattatgttctcgggattagtgcttccatctttatgatactctaatcttgtctatgtaattcgtcaagttatcatatatcttacataatcttcgacaatatcgtcatctaacctacaatcggctaacatctgttaacagaaggcagccgatttgtttaaatagcgacgttgacctagattatataagatatctactactctatgaaacttccagcggcttgattgtctagatattgttcttattttcatacttaatgctacatcagttgagtttgatctataaagtcatgcttagaatatcaatttctagcctgccctctggtcgccgattagagtagcgtcggagtttcagccgatcttacctgatttaatcgtatttgctctatatgcttcaatgatacattaaatctgccctttatgtcaagatcttactgcatttaagtatattaggctcttgtttgatatattttacttgttttagtatcctgatatagagtagtatcggagtattagccgatacatgctagatctatctgatcagctatgctattaagatatataaggctgttatcaatatatattttgatctaagtgattcatactgtctcggcatggcgaccgatctatcccagtcacttgatttaagtatatatcggtataggaactatatattgttaatatttacagccgatcgaatagatttagttctttattgcctatttacaaccgccgatcgattcatatatgacatcggctgccagataaatgatgtgtcatcggcacctagccgatcggctatcatttatatatttaactgcggtttctttgcttctatttcttgttgattacaggatcaaatcaactggcacgctcatacattcgaaggcgagctttggacctgcactggagttaagcagatctcctaggcctcgtgttttctgtcaacacgcttttggcatgcccggtgggacctttaagaagtcagccaacaattcttcctcatggccgagaaacaaccactaccaccatccctagctagcccaggctctgttaaggaaaagatgctgaaattagggttgactgacgtcaatgaaggaaacgtcgtgccgatcaatccagaaaaattcacacctaagcagaagaaagagtttgaagcaatgttgcagcaagcacgggatcagttcttgaactcattcatgcaaacccgcaaggggacatttgttcagaagtacaaaataaaagtggttgctgatgatccggggaccagttcttctaaggatggagatgggaaataagctccagacggctcggctcagctgagtaacaaaagtgctaccgatagctctctaggaaatcaaggtgacaattctcaaggagtccatggagtgcaaggtgacggggtgcatggagttcaaggtgatggtgcccaggggttgcaaggaggaaatattaatcagaatagtgatgcggcacaagattttttcagtaatttccaagatcgggttgactacgctgtgcatcatgctttgatcaatcaatctggggtgttagtcaataccttatcaaacatggtgaagtccatagccgatggttcaatagctgagcatcaggctgcagcccggtttatttgcaaggagatgtcttcccaaattatcggtctttgattaccgatgttcaaccatcaacttaggcggttccctccgttgcaccaacatctcagccgacagcactggcgtcaactcccctgcctgttctgtcagcaatggcaccagaccagccagtgaaccctcggttgttaatgagagagcagccacagcatggcgggcaggttgcgaatcggctgacccaagatcaggttgctgccacgtttctgccgcctcaacctattgttgatccaatacagcagcagccgattcagcagacacccccaattcagcaggttgtgcaactaatccagcaacaggtcatgcaaccagttcagcaaacaccaccaatgcagcagcctctccagccgattcagcagacgccgttaagacaacaaatcgttcagccgatccagcaccaaggttcattaggcgcatcggccgggtttgcaacgcctggtggtcagcctgtacaacaatttttaaatcaagttgtcccagaacacttggttcaccatgtacagtcagatggcacagtaatacctcaagttgttcctgagcatttggtacgtaatatccagccgaaccttcataattaccaagggggtaacttgaattatcaatatcagcctccttccccgcaagcccaatatcagccagggggattggctcaacctcagtttgcgcctcaatacggtcagttcgagcccatgcagcaatagtcacaaggggtagctcagcaacgactgtgggccaatgtgattgctgacgtaatgagggaatagtttgggtttaaaccaaaagagactggaagcttgtatcgacagccttaccctgagtggtttgagagagttcctcttcccaatcggttcaaagttccggacttctccaaattttcgggacaagatggtgtgtcaacttatgagcacattagccgattcttagctcagtgtggtgaagcatcggttgtagacgctctgaaggttaggttattccggttatctttgtctggatcggcttttacttggttttcctctttgccgtatgggtcgatcaatagctgggccgatttggagaagcaattccacagctatttctatagtggggttcatgagatgaaattatctgacttgatagcaattaagcagcggcatgatgaacctgtgcacgagtatattcagagattcagggagatgaggaacaaatgctttagcttgagtttaactgatgcccagttagccgatctggcctttcagggtatgattgctccgattagggagaaattctcgtctgaagactttgatagcttgtcacatctgatacagaaagtaaccttgcatgaacataggtccgcggaagttaggaaaaactctaagaaggttaatcatgcttatccgtacatgtatgggtcggatgatgataaggacgattctgaaatagctgcagccgagtgggtgaggagtaaaaaggtcataccgtgccaatgggtaaaaagttctggaaaagaggagaagtatgactttgatattactaaagctgacaagatctttgatttgctactccgagagaagcaaattcaacttcctactggtcatacaatcccatcggctgaggaattaggcaaaaagaggtattgcaaatggcataattctgggttccattctactaacgattgcaaggtttttagacagcagattcaggtggccattgagggaggcaagattaggtttgatgattccaaaaagccgatgaaggtcgatggtaacctttttcctgttaatatggtgcatacagctagccagacagccgatagggcccgtgcaaggggttttcaggtgaattcggctaagattatcaacaaatatcagaagaagtatgacaagcagcaagagaagcatcatgagaaatacgatgatggttttaatccttattggggatgtgagttctttagattctactggaatgaaggtatgaggttgccatctattgaaaactgccctgggtgtagtgacatcgtcgagaactcaagccgatcatataataggggtaatcggctaaggcagacaagagtttctgttcatcaaagattgggtccagtaaatcaagatcatggccaagaggacaatgtaatcaggaagaatcaatggtgtccttctggtattttcaagaagaatcagaagagaagggttcaaagattgagtaacagggagcgccttcaggaggttgaacaagaaataaatcatcggctgaagaaagcaaagccaaggcaggagtggcgtgttaagaatcaggttcctgtagctgatgatgttgcagccgatgaggcaaagaggttggcaaaagggaagagtgttgtgacggcaccggttaacatggtctttaccctgccagcagaattcgggatcgatcacgccgatgtcgacgaggtggaggaggaatcggctaagttggttgtcaccagaataggcagtgttcgagaaacccgaggggacagagaatcggcatcttaaaccattgtatataaacggctacgtgaatgggaagccgatgtctaaaagatggttgatggtggggccgcggtaaatttgatgccctatgctacgttcaggaagttgggtagaaatgccgaggatctcatcaagacaaacatggtgctcaaagattttggtggcaatccatcagaaaccaaaggtgttctaaatgtggagttgacagtcggcagtaagactattcctaccacgttttttatcatcgatgggaaaggttcttacagcttgttgcttggaagggattggattcatgccaattcttgcattccttcaactatgcatcaatgtttgattcagtggcaaggcgacaacatagagatcgtgccagccgacaggtcagttaatgttgccagtgccgatttagctctttgggagatggatggccttgattgtttatctggaaaagtctgggatggagattttctaaaagtgtccgattctgatatacagccaattgaagatggagaacccaagctattattttgagggcgtcgtggagggttcaaatgtctacactaaggacacggtagatgatctcgatgacaagcaaggtcaaggtttcatgtcggccgatgatttggaagaagtagacataggtctaggcgatcggccaaggccgacatttattagtaagaacttatgtccagagtttagaaccaagctgatagagctcttaaaagagtttagagattgcttcacttggaaatattacgagatgcctggactcagctgatcgattgttgaacatcggctacctatcaaactaggggttaggccacatcaacaacctccgaggagatgcaaagccgacatgcttgaaccggtcaaggctgagattaaaagattatatgatgctggttttattcgtccttgccgatatgttgagtgggtttctagtatagttcctgttatcaagaaaaacggcaaggtcagggtatgcattgatttccgaaatttgaataaggccaccccgaaagatgaatacccaatgccagtagccgatcaactagttgatgctgcttcgggacataagattttgagttttatggacggaaacgcaggatacaatcaaatttttatggccgaagaagacattcataagatagcttttaggtgtcctggtgcaatcggcttatttgaatgggttttcatgactttcggcttgaaaagtgctggagctacatatcaaagagccatgaattacatatatcatgatctaatcggctggttggttgaagtctacattgatgatgtggttgttaagtctaaagaaatagaggaccatatagctgatttgaggaaggttttcgagagaaccagaaaatatggactgaagatgaatccaacaaaatgtgcttttggtgtatcggctggccagtttttgggatttcttgttcatgagagggggatcgaggtaactcaaaggagtgttaatgcgatcaagaagattcagtctccggagaataagacagaattacaagagatgatcggcaagataaattttgttagaaggtttatttctaatttgtctggaaggttagaaccttttacactattgttgagattgaaagccgttcagcagtttacttgggggcagagcagcaaaaggctttggataatattaaggaatatcttagctctcctcatgtttttattcctccacagaaaggaataccgtttaggttatatttatcggccggtgagaagtcaatcagctcagtcttgattcaggagttggaagggaaggaatgagttgtattctatctcagtcatcggctcttggatgctgaaactagatattcccctgtggagaagttatgcttgtgtctatatttttcgtgtacaaggttgaggcattatctacagtccaacgagtgtactgttatatgcaaggccgacgttgtcaagtacatgctatcggctccaatattgaaaggaagggttggaaagtggatattttccttaaccaagtttgatcttcagtatgagtcgccgaaggcgattaagggacaggctatagctgattttattgtggaacatcgtgatgattcaatcggctcggttgaaataatgccatggactttattctttgatggatcggtgtgtactcatggttgtggtatcagcctagttataatttcccctaggggggcatgtttcgagtttgcttatactattaaaccgtatgcgactaataatcaagctgagtatgaggcagtgctcaaagggttgcaattactcaaggaagttgaagtcgataccattgaaatcatgggggattctttgctagtaatcagtcaattggtaggagagtatgaatgcaagaatgatacattgatggtttataatgagaagtgccaagaactaatgaaggagtttcggctggttactttaaagcatgtctctcgagaacaaaatattgaagctaatgatttggcccaaggggcatcggggtataagccgatgatcaaagatgttaaggttgaaattgcagcaatgacagccgatgattggaggtatgatgtgcatcagtatttgcataatccatcttaatcggcttctagaaaattgatatataagtatattaaagtatactctgttggatgatgagctttattatcggacgattgatggagtgttacttaaatgtttgagtgccgatcaggctaaagttgcaatcggcgaagttcataaaggaatttgtggtactcatcaatcggctcataagatgaagtggttacttcggtgtgcagggtatttttggccgacaatgctggaggattgtttcacatattatagggagtgtcaagattgtcagaagtttggggcaattcaacgagctccggcatcggctatgaatcctattattaagccatggccattcagaggttggagaattgatatgatcggtatgataaacccaccatcgagtaaaggacataagtttatattggtggcgactgattatttcaccaagtgggtggaggtgattcctttgaagaaagttgattatggggatgcaattcaattcgttcaagaatatataatctaccgatttggtattcctcaaacgattacaactgatcaggggtcaatcttcgtgtctgacgaatttgttcagtttgccgatagcatgggtatcaaattattgaattcttcaccttattatgcacaagataatgggcaagcagaggcgtctaataaaagtttgatcaaattgattaatcggaaaatttctgattatcctcggcaatggcatactcggttggccgaagcgttgtggtcttataggatggcttgtcatggatcgatccaagtccctccttacaaacttgtttatgggcatgaggctgttttgccatgggaggttagaatcggctctcgaagaacagaattacaaaacgatttaatagctgatgagtattacaaccttatggccgatgagagggaggatctggttcagtcacgattgcgagcccttgcaaaggttaccaaggataaggaacgtattgctcggattataataagaaagtggtacctaaagatttttcggaaggagaacatgtatggaaattgattttgccgattggtactcgtgatagtaaattcggcaagtggtcgccgaattgggaaggaccattccaaatttataaggttgtgtctaagggagcatatctgttgcaagggcttgatggtgaagtctatgggcgagcgctcaatggcaagtatttgaagaaatattacccaagtgtttgggttaacgcatgatcggctagtattgccgatgcatgacagccgatgtgtttgcatcgccttgagatggccgatatggttatatcgcccttagttgtttttcatggtgtaatcggttgtggtttgtcgatgtacaatggccgatatggttatatcgcccatagttgtttttcatggtgtaatcggttgtggtttgccgaggtacaatggccgatattgttatatcgcccttaattgttttataattttatcaatgcttttgtcattgtaaaattaggggggcacatatatatcaaaatgcaatgcaaattttttgagcgaatttcaaagtcataattaatcggcacaaaggattatcaagacagtaaagtactagagcatcttagctgattacaaaaaatttctgagtcctattacacaaaagttattgagacaagtatcgctggatagccaaaatagccctttgcctaatttgttctacttcttcaatagtttggacatcttgagcatcagttccagagatgactttcagggacttggttaggtcagcaacattcttgatagccgatttgagccttgctttttgttcttcaattaattttgggagatcggctagctttttgtgttccatatctagctcggcattgcattcttcaagttgcgccaagagctcaatcttgcgagcttcgagccgatcaatattggatttgatcggaccttcagatagctgatcaagtttggttttttcttcatgcacaagctgccgattagcttggattgtggcctcaatctctttgcgctcacggcgttcggctagtcttagcttggctttttccagcttgaactgatgttgctcgagataagcggctggagttaggacatcagccaaatcttcgggaatcagagattgaacttcatgcatctgtgtcctaattgacccacagtcaactaccaaactgtctaaagaagaggcttctagccgatgagagatgtcttcaagtgtttttctcacatcatcggataggggagctagggctttgcttgaagtgtcttcttctgcctcatcaaggtaatctctgatgtcaaaagagaagagatcggctagagcatgcagagacaatttcggaaagaataagagctgggtaaattatagccaatctaattgtggagacaaagggaaacttactgggatagcaggagcagctggttgttcttcctcttcgacgtgatgactccccacagccgatggagtctgatcacttgatgattgctgtacaggaggagaaggaggaggaggctgcgaaatagacaagtgttatatagaatcggttgagattgattaagtaaaagaattaaggacatcttactggtggagccgatttaacaattgttgctgctggttttttcttcacagcagttttcttcttctgcaactacaaagtctatgggtaattagccgaagagggaggtaatttcagaagaagtcagagagaggtacttactcttgtaaaatgaacgggggcagaaggagttggaggcgtttgcttgggtgaagccgatggtgttctttctgtgtcactcatttcggctatagcttggtcaacatcttcaccaatttcctcttcatctaaagcttgttcaatagatggatccaaggcaggtagatcatcagtcggcatatcagttggttgtggttgagttttcttgaatttggtttttttctttggagccaaggctaaggtactcatggttgatgatctggttttccttttcttgcctgcatcggctggttccctagttaggccatgaaggagagttgaagtcttgggggcatggtagccgataaaagggggagatagtccacctccattcggaattagacctgaagcatattcaatgttcttgccactgttactttgatgaggaggggaggactctgttgtctgcaaaacaggagcaagagattagtcaagtaatgaatcggctaactggttatgcaatttagtaatgacaaagtttacctggggtatgacgtcagggaatagatctgtcatatacattgaagtcgattgatgaaatagatgcagcttccattcaccccaccatctgtcaaactttttgcttctaaatcctgccaactcaatattattaatgctgcccaaagggggtcctagtaggttaagtagccgatccatcattagagtggatgtgatttgtcctgggcactgaatcttgtcggcaaagaataagccgattgggagttggcccaatccaagttgtctggccgagctcattaggtgataaaactcgtatgagacttggatgtttctcccttggtgaatgccgacagggaggatgcatgggctgattgcagctataagaatttctctggatttttggaatttttcatgattaatgtcttcaaatctaaagtctgatggaagttcaaggtctgctgagtcttcataaggaaaccagatttgtgcatctttcttaaaaccttcgtagaagctgcagaaccagtccttgagtagctcagccgatagcttcgctccagcatcggttggtgtggatgcatattctccatatgacatgcatctgcgatgggtgcgctcttctccgtcatcttccacaatcggctctggcaatgggaattcagcttctgtcacagagggccgattgacaaccttcatgactatcaggtttaaccaagtttgcagcagccaccatggtccacctgctccaactattgagccaacggctattttagccaatgcattgttcaacatctggtacagatagccgagaaggattttgcccaaaggaaattctttctttgattctaaggcttcggctacaaattgccagttggttgtagggccacaactggatccactgaagaggaacttttccagccatgagcaagaaagctacatgctctcgaggggtaacagacccttggcccatatatgccgccacatagccagaccagccacctatgcttttggtcttgaagtcaaattggttcttggtgttcatactcatagggttagccgatgaagttacatctaatccggtaatcatggtgatgtcgattaaagttggagtcatcggcccttggttgaataagaaagcattgatggtgttggaccaaaagtaggtggcggcagccatcaaaggttcatccttagcagaattggctatggtgagagcaagtgcttggccgattccaatttcatcgcagtgaactttcttactagccgatacgcgttggtaccaggtggtccagctcttatcaggagtaggtttttcgagagatggccaagacttgaaggtattcttccagtgacccaggttagggttggctagtctaaaggggatccggttggtttcaccgatgatgaaatcagtgtggtcgagattgtcgattaggccaagaaaatagtggtttttgtgtgaaaggctaggaatcgcgactaggttggaaaggtgcaacaaatctaaaggaattgggaagcagaaaacatgaggagaaaaggagaaatcaatttcatgcgaggaaaagggatctagctggtgaggacttacctcagcg

SEQ ID NO: 11907 - DNA, 857 bp, Oryza sativa
gagtaggtttttcgagagatggccaagacttgaaggtattcttccagtgacccaggttagggttggctagtctaaaggggatccggttggtttcaccgatgatgaaatcagtgtggtcgagattgtcgattaggccaagaaaatagtggtttttgtgtgaaaggctaggaatcgcgactaggttggaaaggtgcaacaaatctaaaggaattgggaagcagaaaacatgaggagaaaaggagaaatcaatttcatgcgaggaaaagggatctagctggtgaggacttacctcagcgtactcggccgatggcgcagtagaagggctggtggaagacgacatcgccgcgggcggagatctggtcgggaacgaaatcgcctggagatcgccttgtgcgtcggggagatcgccggagagagagagggcaaagttggtttcagtggtgaaaacggaggaggacggtgtgagatttctcgagggtaacggttagtatttaaagcacggcagtaatggtcggaaaacggcaaggtgcgaaacttgctcggagtcgatttacagcaaatccgaaacattatcaaatattccgtacttggggggcatgtgttaacaaccaaatttggtaatatcggcatcgggaaagaagattggatcgaagcaaagtcggaggcggagatcgagttcggaagcggatcaggaatcggctggagtccagatcggctacgagtaggatcggttgggtctgagtcgggctaggtaagccgatgcaaccgattccgacaatgcaactgtatgatatcgggttgaattgaggcgcttcaaggtgattgccgcacatgatagagtcatgagaaggcaattg

SEQ ID NO: 11908 - DNA, 375 bp, Oryza sativa
ctatcaaatggatatgacagtccaaagtcaatatgaaaattaaggtctttgaatggctcttcttcatggacagggttaatacaagggatctccttgatagaaagcactgcgcgccacccaatacttcagtcctttgtctctcttgctcagctaatgccagagaaactagagatctcctgttcttcctttgtccttttagtgcggcttgttggaattgtctgggatggacatggaaccctaacttggattttcatcaaaggatccaggctcaaaaagtggctgtcttgcattcttgctttatggatctattcttaattgcctcatggaatatctgtaaggagagaaatggacttatcttctaaggcatccagccct

SEQ ID NO: 11909 - DNA, 1221 bp, Oryza sativa
aaaaatcgaaataaattttactacagtattaaaaaaaacttgtggttgtacgcacatatagcctagtcataccagccggcagtggctcgtcggcaaaaactccatcaaattttaatattgatgtgtaaattgatggtgaaatttatagagtaaatactatgaatccagttactctgcagtaatgttgagcaacattggtgatgtgaggagaacagtgaacgaatgcattgagcatcagcgctctactgtagctacagtatagtagatgttgctttacagcagaatttactgtagcagatcatccgaaccatcaatcacacaaccaacgatacacagtatccctaatgccatatattgtacctctctgccgtattacatttacatgctactcctataatatattaatatattatagtaacataatatcggatgagacatttcatattataatgtagacaccctcttatctagtatattcgttgtactatgaaatatctcatccgatactagtttattatattatgggagagagagagagtactgtaatagaggatcccaatccaaatacgaagttatattgaaatctattcgggttaaaagaaaatcttaagcgacgggcgccttcgtgactcctcatttgcatccaattttccccctgacccaaccgtgtgcccgcgccgccgaatacaatagaaacacacgcaaattaaaacacacctccaaaaccacgcgacgcgacgcgacccccggttcccctcaaaccaaacggttcgccgcaattcccaccccccccccccccctcccccaaaacactgccgcaccacgcctcgttcccgcggactccgacctctcccgaatccctttctctcctttgcccgcctatttaaacctctccctctattcccaaaccccaacatctccacttgactaatccacagttccactctctgattctcaattttcaatttcttaatagagaagaagcgatcggattaagcgatgagtgatgacgagctgattccggggctaccggaggaagtggcccgggaatgcctgctgcgcgtgggattcgaccagctgccgtcggcgaggagcacgtcccggcggtggaaggcggaggtcgagtcgccgttctaccaccgcctccgcagggcccgcggcatggcgcgcccgctcctcgccctcgcccaggccgagccgccgttcgcccgcgccggcccg

SEQ ID NO: 11910 - DNA, 7214 bp, Oryza sativa
  unsure (1)..(7214): unsure at all n locations
nnnnnnnnnnnnnnnnnnnnnnnnnnnnnnnnnnnnnnnnntacatatgcgcgcgcgcgcgcgcgattgtgtatacgtttttgtgcgcaatttttatagtgtatatgtttgtgttgtacacttaaagctcagcgtttcgtatatacgatgatccgagatggagatgatcagttttgcataagctctgttttgtttgtttacttcacataagcagataagctcattggagtcttccgtgcatccacaaattgaacgctatttttttcttttcaaatatgcaaacagcatcaagcgtgtgtacactgcacggaagaagcttcttttgatataggacgctgacatgtaggcccgtgatatgtaggctaatgaactgtgggactatcaggcattcaaaatcagagagcaggagagtaagggggttagaacatgtttaaagagacaaaagattataataaattcatattcttgctgaaatccttttaaagtgttgtatatatatacttcctctgctctataaaaaaactatttttaacggtgaatctgaacatgtgcatatacatgtttgggttataacacgttctgtagaaaaatcccgcatattactgctaaacttattttttgataaaaaatatggcgccataaatatagctacacccaaagaaaaataccaccacccctaccatatgtcactgattaaatttacaaatcccaaaaatagaataatgatgtcagtaatatccgagacaattgacagagccagctttcggatgatattttggcaatcatctgtgacatttccctcttgaagacacggacaggacaaaccaaaaaaaaccatgagccaaatggattcaaagtggaccctgtagacacatcacacatatccctgcagcggcaagtgacgatgtgtaaaccagaagacgacgaacggcgacgatctgatccgaaaacccgccgccggtaaatggcgcgcgagagcaaccgcccgccgcaggataccttttttttggggcgcccaacggataaccgttgccggcacgaggtcccacggaaggcgaccatgtcgtgtgccgtttgacggcgacgtcctccaatccaacccgggcagctgctgaatccgccagctgaaactggcaagctgatgaggatgtttttcagtcagcgccatcggttactcctcaactcagtagcccccagctcaaatttaaaattgagtaaatttcatcatggactacattttttttaccagtgtttcatattgggctagggctaagtcaagattttcactttacaccatgtttctttgccaattgccaagagttgcactttggggcagggtatgttcacaacttgggcatgtgtgactgacctcgccgtagatattatgattggattgtgatgacactcaattcaaacaacttcttgatgcgcggtgtggcacggttcaggtagagatggctaaacccactcatgacatgacgaaagaacgagatgtgtgctatcgtttcatgcgtgcagaacttccttcgcatatctaggtgttgtcacattgcaataatctctattacaagcttgccgacgtccacaatccaatcatctccatcacaagcttgccggcgtcctctcttatctcctgatctactgacatgtgagagcatccagtccaaagtgaaagcttttggtaaaagaaactggcccaaagtgaaaactttgtctttaggattgtccatgttgaaacttaggtaaaaatacctagaccaatgtgcaatttactctttaaaatttaaaagttattttaaaaattgatcttgattttttttatcatactttatttcagaatttatattaaaagttaattttatagttgattttgattttttttaatcgtaccattgaattttaagtcgtccaaaatacatataaaaaagtttttcatatgaacaaccttctctatctcatattataaaaaagtcaaacgacttataatacgaaacaaagggaatattttttaaccgctaacaaaagctacagcttgtaatagctgtaggcgaaacgacggtttctagtgaatggatactgccacagtggatgggaagaaagggctgcaggtttcgattccaacgagaggcaaaaatgcctttttggaacgccgacaaaaaagcgaagaaatttctttaaggactcctcttgaaaaagagggaggtgaatcaaactaaaaactttaagaattgagataccttggctgcgtactctttgttcatgagcttcagagtcaccgtgctgccaattcttaaagctgacttaagaaagagccaactctgtcaacgccagaaagttcaccagcttgtatctgaagcaaagatcatttctggctgcttcgtgatgaagtgcccaaatctttctttcctctgctttgcacctggttattgactgcatacggcaaagcataatttaaggtcaattcttggtgcaaatccaactccaggcacttctacttcataataactgcggagaacaaagccacaaaaaatgtccggcacatgcagaatactaactattttttttttgcgaggaatctgacctaaaaattggcagcatgttctgactataggctaagacagaaaatggatgttcccaagccaatatccacctgataagctggaccattggtaaagttgacatcaacaaatatatccagaagtcaagccgttggcaccgatgaaacctgagtttactgagtacgatttctgcatgctgatgacacaattgccattcactaaatctccaatgttgatcacataagggcagcatatcttaccagatatggtggatatattcatgagaagtgcgttcagcaatctaaaccaaacagaccaagtagaacaaatgagcccggtgctcattctgaactctgaacttggtgatggaagcagtctatctatcgacaggctgttggttttctctttcttctttgcaccagcaagctttgcactcctagcagcatcctccattttgcagcatgctttgcagccccatccacctctgccggacttctttttggctgaagctatcttcttcatcttctccttcatatacacagctgtgatttcctcttcagatttgtatccgccacctctccatggtccttgctggaatccatttcattgggctgctctttagaatccttgattgatttgtcttctttgatttcttcttccttgaagtcttgctctctgaaggtacaggagcaccattcttatcaccaccattctgcttatctggctttctttcagctgtaaatttgggaaaaatcaaaatacttgcttgtttattaaaatatatcatatgatcaataaacaatagttaatgaatactccctccgtccctaatataagggattttgatattttgtttccactgtttgaccactcattttattcaaaaaatttatgcaaatataaaaaacgaaaagttgtgcttaaaatactttggataatgaagtaagtcacaaataaaataaataataattcttttttttaaataagacgtatggtcaaacagtgcaagtaaaatgttaaaatcccttatattagaggacggagggagtatgaaatagtgaagatgttcttaatttggtacaagtcacaccatgagtaagttctatacatttactaattgcatcaagctgggtaccatgtccagaaatccccagctcagccagcacagtatctagttctgcaagctctttcttcttccattccttcttcgaaagctgcctttctgtctctttagattgtgcaggtattagaccagaattcttaacctcaagctcagatggtacatcacctataccaacatcaaggtcatcatcttcactccccgattcctagagagcaaacgtacaagtaattaattaaaccagagtgagttggaggaaaaataattaggacacatacatcttaagggtggacagctggacacatgagccacataccaatttacatacctaagataaagagcagaatttattttatgcctaattagtctctgaatcagagaaaatcttgttcatgctgtccctcatagaatcgtgcaggagaaataaattagaagaatataaagcttaaataaacatttccccctttctgttctgtttagttaacactttcatatacacaagaaaaacatgtatcgttcatctttgctttcagcagtgttcgctaggggattcccacaagcacaaatttatgtttataatgagttcaaaattttctttattgcgaaatgatctatcagactatctggtatggtgtggtatcgcagaatgttgtgagcatagatactggcatagtctttagagaatactttagcaaatattggtactaaaatatatttaaaagttctgataaaattgaatataataaaaatatgcttgagataaatttgcacgcttgatatttatgcgttcaatccaaatatttaacaatgttgacatttttaaaagtaatttttgattaaatctctaacatgatataattaaaaatatatatgtagagtttctaagtagaggaatgaattttcttttttttctcttttttttggtaacacacgaacattatggtacttcaataaaacaagagaatctcccctcaaagaaaaaaaagaaaagaaaagaatctaccacttaataggatggggaaaaaccaaagcattgccatagatgggaaggtccagaaatggtagcgcactgtactaccgcatgcattgtcccaacatcaacatcattcatgatacgaaaaaggtgagaccacaaattcttctggcaagtcaatagtcgctttgcaatttccactagtgcaccgaatgccacctgacaatttgacaatttaaaccaagcagattctgctttgcattacattattatcgtttaatcaattattcgaagtgtctacgaacagattggttcgaagagaggagctattgttcgaaacgaagatttaaaatttcttttcctacgattatgaatacaacccacaactatctctagtttatccagattacatcccctgtacgggtgtacacgactgactcatgcttacattgaatcgctgaactaaaagagagaaagagagaagccaccctacaacggacgctcgcaggttgtaaaaccagcataaatttcaaggttttacaggttctatctcggtctccatgccattccacccacactcccagaaccatagctttgcgcgctgttattactgttgggtatcacaccatactgcgactgctgcaccatgctcgccggcgcagcggcggcggcggcgccgccctgcgccggccaccaagcattggtctgctgccaggcttgcgctggctgaagctgctgctgcatcagaggaagttgctgcaatggttgctgggttcggaggtaagcctgggggatagagttgctgggtatctgaggttgcaatgcattttggtggtggtaaagctgctgctgctgctgctgctgatgctggtagggatgatgcaattgctgaagcgaggccggtggtggtggtggagccaagcggttgctgtggtgtgggtggaactgggagctgccttgttggctgttgttgggtgacaagctggttggggttccattctggtatatcatcgtcgtcatcatcatcccaaggacgagcctgaacagatgatcttttaccatacttttgaaccagttccctcatttgctctaccgggcgagcagaggtaaggggtacatgctgccggcccttgtaggcctgggtggttgttacattagcagcaggattggacgagttaacaaaattaaattcaggaagatcgtcttcatccctagcaacaccagggccaaagcccggagggacatcatcagttacatcttcctcgtggcggtgacgctgaactggaaaacccggcggcgcgccgtgcgagctcataggcagggagggcctagggcctggagtagaaccagtaacctgcggtttctttaaaatcgacggcctccgggaaccatcatgcctagggtgtgccggcatcctgggaacgttgggcctccgccagacgatgaccccgatgatggaggatgctgacacagcaagactctccaaatgctcctttggcaggtgccgagagagaatctccacagttttcccttgagaagggcacaggtacagctctattccatctgcaggttcagctaaccctactctttcatctgaaatatacgagtcaattgtctgcagaagaatagacaaatttaatgatcaaatccacaaacattcattaagctagctcctgaaggaaggtctttctctgaaagaaaaagggctacgatagaaaaacctgcaagagatgttggcgaccactctcatgagaaccttccttccaacacaactcagttacctatgaacaaagttggacatattcaattactatcctatcaacaccagcatgaaccataatctgtgatgacaaaagcgcactaactatagtttgaggcatttagttaaataaaggatagatcgagtaacaactcccaaacagagtgatacttctagatgctaagcatacaatcataagaagcatttcaaaagttaagacttaaaatacatgcaagagatcatgtcaagagttgttttttttgtctgtaacaattgttttcttttctggctgacacatgctccaattcatagctttttgttttcttggcaaatttagcatataagtaccaacatttttcaaacatcctgacccagacctcagacatttaaacatattagttagttttcaacaggaaaaatgcaagattaccattatagcacggctcctagatttgggaagctgttcaacaaactcttgaaaggcactaagtttgactctccccttgatttcaacaaagctccgccattcttttactggtggcttttcaccactgcaaagtgaaattttaatacatgtcatcacaaatacaaaaataaaatacagaataaacacatatcaacactatctttcaggtagagtggatcatgtgtacttggacagtagcagggcattctgggccacaacaatgaagaaccagttgtaaattgttatcaacattaattaaatcagcaaactttgcaaaagggatgatttagatcagtattaactaacaagacataaatcgaacaaatacacaagtatac

SEQ ID NO: 11911 - DNA, 19672 bp, Oryza sativa
  unsure (1)..(19672): unsure at all n locations
ccccacttggacagtagcagggcattctgggccacaacaatgaagaaccagttgtaaatgttatcaacattaattaaatcagcaaactttgcaaaagggatgatttagatcagtattaactaacaagacataaatcgaacaaatacacaagtatacaagttcccatcagaaagaggtgaagtagccaagctggaccctcaatgacatacacctacttaatgcactctctgcggaatcaagagaagtacactgaagcatgtcacatttggcagtgcttgctaattataaattattactcttagcagttctcacatgaagatatatttatatacttgcatgccatgagctatcagtttttacttattacttaatttgatgctagatgtctagcttctaaacctaaagtaatttaggtagagcaagaccttgagcctcttgagaaaccaatagaaacaaggaatcaaacaacagcagctagcttcaccagatgaggaagaaagacttccataactcacttgcctgaggcgcgaaagaactgagatcttcaacgaaagccccccaatttcattgacccttacttaatgaccagtgatggcgatttatgcttttattgcctcccaaacttatcattcttactcaagcttaagaccaggacagaatagttggagtataaataaataaagttatcatacgagtcttggacatatgcaagttgtgtgtgtgttttgccaaggagtgcatatgccatatagttcaacaagtatctttctgaaggaacagacaatcaatttccaaaatacgaccaagcgaatacaatgtagaagatgaaattgcagaatacagttcagtaaaagctttgtgcaaaagaagatgtacgtgttctgtaaagcactaatctgcttttaataaattaaaactaagacaaaggcatcgaagagaatgtgtcaaatcatcatggtatgctaacagaaacgattgtatattggtaattcaaaggaaaaggctgcagatgaaacaaaccttttgaagatggcaacgacatttgtgagcgaagacatggtaagttgaattgcaccctcccatatactttcacgtatcataggaagagtagttgccatattatgcacagtagagtcacgattcagcacattttcagtagttgtttgtttgacttcaacactatctggggaggattttatcagctttccttcacgctgctcaacagggcccaaatttgaacccacctcatctttgggtgactctaacttggactcagatttatcctgcgaagatggcaggtcagcttcagatacaatcttctctgctgcagaaactttaacttcttcctcaggaagttccgcagattctgcagtagtgtcagcttcgtctcgatcatctgaatcttcttctggcgtcccagctgagagattttcaaaaggtggttcagaatctaaaccttgcatgaattcatctagtgaagggatcggtggaaggttttcagtgtctttcaagtcatccaccataagttcttgcataaggtcacttttctcattatcaacatattctaaatcatcttgtggatcgttcttgcctgccccattatcttcatcttgtgaagtcccatcaggtgcatgcctgcagatcgactctagaggatccctgttttatcatctgtactttctttatcgtctgatttggtctgatcttcaggggcttttgatggaacttgagtaagaagattacctccaagctcaacctccactgagataccatctgtttcttctacttcaacttgaaattctcctttgtgtgttttcctaaccaaacgtctaacatcaacctcggtactaggaaggacaaccatttgtgctagttcttcagctttagctaaccgccactccgatagctccttggaagcaagttcctccgcagtcattgaacagaggcgatcaggtgtaatatctccagacaataccctctctcttaactcaggattacttttatcttttagattaaatagaagagatctacctttctccttatacttcttattaactccaccaaatagtttgaacagctcctcttcaaccctaactgctaaatcatctgccttctgaataatgctatccttatctatcgcttcctcatcattggcagacttcattcttttggactcagattctgagagagtgtctgcaacaacagggtcaatgtcagaagccctggacctttttaaattaggttgtgtggcaggttcaggaaccccagcatcaaagtcagaaacccaacaaagtccatgaccttgcaagagttcatcagcaacaactgtatattgtcccaacatttcatcttgtaaagaagcattctctggttgttgctggatgtccgcgtttaatggtgtggctatgttcgaaactaaatcactgtttaacttctcatcttcagcacgcctctcagcaccaacacttgtcaatacttccgacttggctgcactcatgccttgggatgtggtggccacttgatctgcatctacatccatctctttcttttggtctgcagacccatcaggctgcacatcagaagattgattcttactctgatcagaatctgttctcagagcagcagaaagtgactccctgaactttgatctcacagattccaattgctgagtttgaacctttgatggtgtctccttctgtgcagaacgtttgttcgatgactgtgactgtgtagatttcagtatttgaacctttggagaagcaattgtcggttgcagtttcttgccagcaggagagtgttgtgatccaaccattgttggcaaagatgttcgaatacttagcacttgctggggtggcctcaatgatactctgcttagagaatgtgcccctgaagaacgcggagtctctggcctagaagcaccaatttggaccgattgttgactcataggaacaataaaatacgaactaattggaacagaagctcccatagaaaacattggctgtgcaccccagtcagcaggcaaagatggataaaacatagacggatactcagcctgattaggttgaatatttgaagaaggcaatggttgagaacccatgttagttgacatgggtgtctgcccttgatttgacaactccattatgcaactatttcaaaaactcccaagatccttgacgagaaatagttgtgttgcttagaacagttaatacatatatctgaaatagatatgaagcaatggaggtcttagaaccgtaaacgggaaaggagtaaatacaaactgtggaggacatcaaaatagatgctccctgggccagtatacatagatttaagaattaaaaaaaatattgaattagaatttcgtaaaaaagcaatccctatgtaaaaatgatacatcccacatgagtatgaatattattatggtggaaaattgaatttattagaaaagtacgcacacagattccattcatgataagtattctgaagaggtgtccgcattaatcagttctagattaacacaacaatagtctaacagtaaaaagaaaaacaatccagaatacaatcgtgatacaacaaaatgccaacatggctgttcatacgcatacagtaaaacataatcctccacagcgcattgacctagagtgaagaaatgaattaacgtttgattagcaattgctaggaaatgcaccaggcggtgatagcagtgaaaataggaggcatgtgaatgaagtaacactaacagatctcaatacagcttaacaaagcaaaccctagagctataacattcgtctacatcgaaccaatatcaaggaacacccaaccatcatcatcaaatctaaaagggcacaacgcccagagaagggacgataacctcgctccgtagacgaatcccccccggcagcgcagacccaacccaaccaaaccctaaacgtctccctccacgtatccgacgatcccaatcactcaaacccaacgaacaaatccctcgctcacaccgagccgcggcaatcacgaagcaaacacgccgacaaaaaaaaaaaagaactacacgcatcgatcgcacgaatcatctggagctcagaagcgcccggcggaagagggatccacttttacctaggcgccgggcggcgacggcgacggcggcgagagggaagggggggggggggttggggagatttgcggggaaggtgggggattcgatttgggggtttagggttagctatgggcaggggcagaggtcccggattgtgcgcttcgggtttccatttggttcgtctcgtctcgtccccgcgcgaggtggtgaggtgaacggctgctgcgtggtggatggatggatgaggtgggtgatgactgggtgagtggggtgagaccgccaccaacgtcgcaagtcgcgactcatctcccgtcatcagtctccttcctacccacgtcgcgttcggtgcgggtgcgggtgtttctcgtgttggcccgtgtctacattggggccttttgtggaacaaagtctattgttgactccgtttctctagctccaaatcnaatgtcttccccccccccccccacaccgtaaaactgagtataactatgacatctctcccatcaacggaaatcggtataaatcgactcctttaacggtacgagaactgacgcctggagaaagagagatgggggaggggagaggtgatggtgatgagatgaggatgacatgtgggtcccgctacttactcggtgaatcaacctcgatcaacgtaccatgtcagcagaaaccactttgcaaaccgttgaaggagttgattttcaccggtttttcaagatggaggatgtgttatatccagtttagcagttgccggttaagggaggcgatttaatcaggagcaagacatgagagaggcacaatagacttatttccgctttatcatgtgttcgatgggacgtgattttgtggtttgggcctcttgttgtggtttgtggtttgtggctgtgccctgaacctttggcacaatagtaaaggtccatttgataggacactggctctcagatcctctctggtggagttggagcctatagatctttacttttacaaattaaagtgaaggattcaccccacaaagtacatactaggaggggtgaaaccactttcctagcttcatatagctctaccaaataggcctgtagtagcaaatttggtaggatagaatcttaggggtgcaagcggaccgatccgtgagtttaaataaataataatttatggtttttcgcgtcgcggtccggcttgccgcatttaaatatacaagtggatcgatctataaaccaatttataagtcaaattcatagttaacccgctagtcaaaccggcgggttacgcactatttttgcctataagtggtttcgcgggtaaacccacttacacccctagaatagatgcttttagaaagaagcaaatcttcatattgtagggggaaaaaatggcaccatccaaaccagcgcttagtctaatcactgcttcctctctaacgcatgatatttacaagatctagacactccttggaagaaacaaattttatagtattttcaagggtgttgaattgattcacatgaaaaatcctgtaaaatttatatgttccagcccccataaaatcatcttaggattttcggagcccacggatcatccaaaaatccgcccatacaatggatctccttttctatgttggacatgcaatcctaacaaattattttctctctccatgtgctcataaaaatatatatcttgtgtttgttctgttgttagattttaggaatcatactgttgaaacatctctgtattatagttccaagagtaattttacggtccttaaggaggtaccatgaagtaccgttttttctattgtaaatttggtacctcatggtacctaggtactgcgaggtatcatgaggtaccaaaatttaagtgtaaattttgatacctcatgatacctcctcaaggacagtagaattgctctagttccaaattgtgtcctgcaaactatttccaggcatcatcactgtgtagaaggataagaatacactggcccaatgtagtagctgttcctggtaaggcctcctctccaccaatcaactccagaatccatccaaacttactacatactgttaagtagctcaattgtctctccaaatcaatcagcttggatgatgagcttcaaaaggacaggacagggacacttggaattctgttccctgatcacctgataccctgatatccaaagatgctaatctatacattaggtttccaaccatggctgtgctgtttaactctgtttatgctttcctgatcaaaagcttgacagtagaattcatgtttgtaacttgtaaaaaataactggtgtttacaaaaccactaactctctaaaaaaaagaaatttatatttagaattatctgcttaaatcatgtagttcaggaattcggtaagacgatttcaagtatttgcaagaacagcttgatgggagttgcttaatgcttttgtatgggatgatgcaattcctatgaaaatcttgtagaaaacttccaaggaaagacttagctactattgccagttcaacgtactctgacaaaaaaaatagtaatataaagataatctgcaatcaaatattctcagttggcgaacgcctgaacgggatatgctgatgcaaaagatatatattctccgaactcagatcatcttatggaaaaaaagaactgatttgccatatgattggttgcttcaaacctctaattgtgtgacacattgccccatagtgcttgatgtgccattgagatgatgtttacatccaatatatggattattggatgctggggcataaacaatgagtcactgaaaacaacatcttctgaaaatgtcaaaataatatttacaatcggtatgtaaattcaacttcaattgagctattctatctctaactttgaatcatgcacgcctggtttaaagagattaattgaactgtggttcattttgcttggatatgataccaatgagctatcactaattcggtggcaggtcaccttaatgaatattaaccatggattgtgattgatgaattattagaagtttagaacagtctaactaatctaaaatctgcacctgaatggatcaatggaaggataagggctagccacttttatggtctgaaattgatatgttttcgcactaactgcagatatatattagcctgcatctttacattcccataaaccatatattattatattttggagtcagtatgaatgcaaaatctgtgatatgatataggagtatatatacttttttcaaaagtagtttttctacctctgcacatcttcttacacattaatcttcagaagctgaatcttaagcctgtaaaatatttgactacaattactacttttttttactgttaaatatttgatacaccaaactgaagcactacagttactatctaagggcctattcggtttggaggatttacgcgagaattttggaggaattgaactgtcctgtgaaaattctgtaaaattcctacattccgaagatggctaggttccttgtggtggaaccagtccacctgggttcaaatcctagatttgacacgggtgctcgcatttacggttaattattcttttagtaatagaccatgtacctatcaacagcgatgcgtctgtggtaactttgttaatctcaagatacgttgacttagtcttccggaggtgctcatatggatagggtgtgtgtgcgtttatagggatgagtgtgcgcacgttatgggcacctacattcatactatgtttctaaaaagaagttgatggagaaaaaaaatggtgcactgaatgcggtcgtattggctttgtattttggtgttgagtcccttccatacaagaactaatggacacttcttttgcagtttcaaaccaatgttgcattgttcaacatacactgttttagtcccatctgttgcaagaaccaatgcagatcactgctgcagcaactgaagcatccgaaggggttagccatatccatcaaaccatcagcatcactatcacagtaacagttcagagcatcttcagaggcatctcctaatcctagctatatatgctccttttctagctgaaaattggtggggaacacgatgaccacgacgcgatcgtattagtacacaaatcaaaagagaaataattaaacaatggtgcactatcagtagctgttaactgaaacagtctgctctgaattctgaagattgcaaggggttaggtagagctctaggcctctagcctagccagcctttctcttcccttctccttatataccacactagaacacaggagcaagaacaagccacaccattgctcatcacctctccatctttagtttgaagtatctcagttttgcgattctcctcgctgttcaccgcgaataatcaagcatcgattgacgacgacgatggacgaaccatcgcagggcggtgaccagaagctgtcggccatggagcatgtcaagaaacgccatgaagagaagggcttcctctatgcctggtttgtacagaaacacaacactctgcatctgcatgcatgatcatactgcaagttcttgctgcatgcagtagcttcagttcagtaccagtgctttagctctgaactctgaacttctgaatgcatctcagcatgtgaactctgtatcagactgcatctgcaacgatgtggcactgcaagaacaatcacacatgcatacatgatgattaattggttgccgttaatttgggtgtcggatttattttttttttccttttttgcagcttgttcatgctgtgctgctgcttctgctgctacgaaacctgcgagcactgcctcgagtgcttctgctgctgctgcaagaaggacaactgatagagatcaagatcgatttcctggatttgttagcgaattgttcgtcgaaataataaaaggctagcttggtgtgattcttctcggttttaatttgtgtgttaactatgcgttaaccgtggtgagctagctaatagttatgtactccatgctgtgactatgagtgagcgagtgaattgcaggtggattgtggttgtaagtttgtaagctggatttctgatttttcatgtcagttcattgttgtagtacaaattcttgtgtaaacataagtgtaggtgattcatgttgcagttatccagttatttcttctgcttgcataaactgatacacagaagttcagattagacgggaagatatgcagaactaaataactgtagagttcagtggatcatgaaggcatcttgtttgtgatgaattatttttgcctttcttttctttctccctatcttcagttttgcattgcgagaatagaaagcaaaggagaaaatgaaaaaaaatgttcaaatgttataaaaaaaattctccaattcaaatttggaaaaagctctaaaatttgaaacaaattttcagcaggttattgcaacgatttactttattgtacagataaattttaaaaatagcttaaaacaattggtataaacaaaagattatttttttgggtgaaatgtattttgagagatgtgaaacaattaatccatcataggataatcgatggatgtgtaaagaaatggacaagagcaaaaagctcttatgctaagttggggtcggggagactggggagcttctcgttgttatagcttctctcagaattagaagctcccctatacagtttagtttttggtccacattatgagaagccgtagttgtataatctagaaagtgaactagaagtcagaagttgaaaaacccatctttttcatattctcagaaactggctgccaaccagttgtttctcaaaatcttaaactccccaaacaggcctgagagtgatcccacgcctatttcttatccaacggtggttagatcattaaagatatttttttttgtcagaaaggggaaaattgaaaagtttatatgtactcaattttgtctgttatactaaaattctatctgtcacactatgagtccagctatatttttttataattttatctaattaaattaaactttttttatacatgccacactatattttttttttataattttctctaattaaattaaactatgagtacttaaaagccctgaaatctgaacccaacccaggcgcgaaatccgaggtgccccgcgaccgcgctgaccggcggcgatgccgatccggcggccggcccacgggcggatcgtggccgccgccgcccgcgttactccggcgcttggtcggcgtggctctgggtaacgatcctgtaaccctacttctcctcagagtcagatccatcccgcgcctaatcttcctgcgggtgtatgttgccatcgcgaattaccagtctatagttgctgtatgaatgtgggaggcgatcttgttgatctgtacttccatcgattgtttagtgctgggtagttggatgatcccctgcaaaatgtgcctgtttctgtacctgagctagtgcggctggaggggaattgtttggggatttctgagttgcgctgaatttggtggtgcgattgctgtttatcaccatttccacttgtgcttttgttgtggaacactttggcaattttgacaaaatcttccgaggattaccaagagtccaatgtcaattttggaggattacattgtttcgtgaaaacaacgactaatctaaatcaacaatttatttctcacagtcagttaaccatcgatattgctgcaaaaaaaaaagttgactatcgattctatggatctgttttcgacttattgttagttaacaatgccatacttttgtatagagaagtcccccctcccccggtttttaagcaactaggccatgttgtttttttgcctaagagaaactatcacatgttgaaatgtgcaatatagttgttgaacagtcatctttctttcccttggttgggccaaattgattgacagacaaaggccgctcaataaatggcacaagttattttgtgaatatgactgcaataatccctgatgcagtccatgctctgtacattcttgtaaaccagaggtttgctggatgtctgttcaaaagtttgtgtcgaagtatagttgcttttggaatgttatttttatatgacaatctggcctgtccttgctggatgtctgtttaaaactttgtctcaaagtatagtttgcttttggaatgttattttcatatgacaatcagtcttgactataaaattcgtttcttatgcaaaattgcaaacctttatcgatattctttaagcctcccaaattatccaatagttaaatatatggcacaccttagaagcttcaatagttggatatctgaatttgtctttggttgtcaatacttttgctgtcctgctgtctagaaatgtgagtcacgtctcatttaaaattcgcatcaaggttatttttaatccaaatggtaatatgttatcacaataatcgtaaattattaattatatgctgaacacacaacatcatcagcaatcttgaattattgattatatcagttcctaatgctagtgtttgtagtagatttctaaagtttctactgttttcagcattatatagcagtgccatcttttttttttcacattaatgtttcatttgctgctttttgaaggcagtgagattcaattgaacaaatacttgacaatattatggaaaaaattacatcatggaactattgcatatttttacagtttacatacatgcctcttatctgtttgataaatgccaaactgaacagatagagatgtcaattgcctacgaatgaaacaaatactgaatacattctctcctcatttacagtgctgtgtgccagtactcaacagcaaacttatccaaacttgaatcaagatgagatggtgctcttatcttctttggaaattgaagactttgatggagaaggcaaagacgaacgcgaagagagcagcaaacccaacaacggcagttgctacataacctaagtagtcatgcctaaacccaaagtatcgtctgatgtaatcttgcaccacttccccgtcctccagtgtagagtttgtgatatcaccatattgtgaggcaacaagtccgtacagtgtccatgccactgggcatgcccaggaataccacctccaccatattggtatcctctgcaaaccagccatgtatatttcagcatcaacagtatagaaaaaagacttaaaggttggtatggacaatgaatgaatatcagatacttactggtcgggggattaggaagccggcaaagatattccatatgcaatagaatgcagtagagactatggcagcaatgtcgctgtttggtgtcatggcgactgccatcatcccatagaatgtgaagtacatgaaggtgaagaacatgaagaacatgtaccagaagaatttttcaactgtccagtcaaagccaatcaggctgtagacgatcagaccatacacgacagtctggaggaagatgtgtggtatctcaataagaacctgttgaaaggataaattgttagatttttttccgtataataaaggaagcacactgcaattgttttttgtttaaatatgcagctatgaccatttacctgcgcaaatgcatatggtagagcggagtacattccagcggccttttctcggtagaacactgttcgctcaacgtctacaattggttggacagtctggccgttttgaattccaatgaaaaggactgctgcatacatggatcccaaagagttgaacagatccaatctcttgtttctgtaggcaagataagcacaggtaagtttctttctcacaacatgccaacatagatcaagttaattgggtttgttagcaaagatacttacattttcttccctaggttcaagaatatagtgccgaaaatgagggctataactgttgtgaagaagattctagttgctgtatacgacggatttctccagtatgatttgtgctgcttccacaggcaagccatgcattgtgtgaagaagggctgtgaaaattgagttgggaagtgtaggtccgttgatccaggtggaggtgtgcttaattcacttatcaatgttttattcctcctgcaatggtgcaattgaatcagtgatataacacagaaaaagcagaaaaagaacattttggggggcttttgtcatgaaacatactggtatagatcagaattcctgtatacttcagcaaagttgatgccaaggatatcttcttgggctagggtggtaacctccaacatccatgttgcaggattgtaaccatccttgattttcctcactccttgtataccctaaatttggagcagcgagcaaggttaccatgcatgtcttaagttggaaatttggtgttcacttcagtatttaagtatcgaggctcacctcaaagtaattgatgagatggcatgagttgtgtcccagggggcccacatatatttcttcacctcctcgtttcatcagaaacagctgcagaagttcaagaatagcctgttagtgttcgtatgagaagggcatccaagaattgtgcaattttggcccttgcttcaacttacctcatcaaaagcttcaaatatgtcaatgctgggctggtgaattgtgcagacaacagttcttcctgtgtctactgtgtttctaactgttctcatcacaattgcagctgcccttgcatctagtcctgaagttggttcatccatgaatatgatggatgggttggcaacaagctcaacggcaatagtgagcctcttcctctgttcggtggataaaccattcactcctggcagtcccaccagtgctcccctcagtgatgtcagctcaacaagttccatgacttcttccacaaacatctgcatccgtgaagtgagtcagcatcacaatgcaaaatgtgtaatgagctagcagagtaaaggctgtttgactaacctttcttgcttctgagtctacttcagagggtaaccggagccatgctgagtacagaagggactcgtaaacagtgacatgtggagagtggatatcattttgctcacagtaaccagcaatccgagcaaaggtctcttgcttctttgggtatccagagatggagatgtctccttcaatgtaaccgcctgttttccttcccgccagcacatccattagagttgttttaccagctccgctaacacccatcagtgctgtaaggactcctggcctgaaagctccgcttacacctttcagcagcagtagccgatcttcagtaacacctttatctttcatttcctgtcaaaaattgtgcatcgggattagcataatagcatttggtggtatatttgttacacacagggaggcttccaatgcttgcttacctgaggcatatccacagagtatctgatattgtcgaaggtgatcgacagaggagtaaatggaagtaccattcctctcttcctggtgtcagctcctgtaatctctcctcttcctgcatttgctatacttgttaaaaggacacaacaaaatggcatatcttgttcaatgccataatacagaggaatgtactaaaaagactgaccatcagaaggtgaattctgggaatctgttccaagagtcagcagctcaacattttctccggtacggtttacatgtttttccctcaattcctcttcagaaacaacagcctgaccttttccaagtgctgcagtcataatatggtgtcaatgccaaataaatgatgtttgaatatgctaatctatgtgtttcagagctgagatgatactcacggtcaagccattcaaggaacagaatgaagaggatgttgaagagcatgatgtatccaagtaatgcgccaacgccaatccagtaccagtttgcatcgacaaatatgccacgtaccttaaggacttggacaccaagcgtgtcgttgctttgtgtcggatcaacaacctgcgcaaagattaggttgcttctgagttatctaaatccaaacttagattgtcaggtttgagttggtgcaggagacactgcattaccttgttccagctgtggccaaggaactcattaactgctatggcattctgtgcatacatcagaggagaggaccagtagccccaaatccaccatttcttgatgttttctgcaaaaggagaactcagtacaatgctcttgttactactggaacaatatatgagttacttggcatacctctagatatcaagaaaccaccgagaaccagaagaataagctgagcaaatgacccaaacgtgtctgcaacaaccatctctcttcctagtgcagcgagaagccggaagagaccggacgccatctggctgatcagtaccagcagcacataatggcggaagaatctctctatgtttggatcgaagcccatgacatagtatgtcatgcaaatccacacagcacattctaagaatgatattgggattttgagcacccatgtaggtaatgcatacgcccatgatggatagaaaagcaggtccctctgcttatagaatatcggcagctttgcaatgctcatggcgagctccgcaaatccattgaacaaatgtgtgactaatccaaggaacatagcacccaggaagatcgcaccatcttctacactgcgtcgatgcatctttgtacgcaggaagaccgtcattccgatgcttccaaggattatgagctggtacagatgtacctttcgtcagattttatttatggtcccgaagtagagagaaaaaattcaagatgcgagatacatacctggagaattttgaagatgtaaacaaatgaattcctcttcatcagcagccactccctcgagaagcatgccttggtaagctccatcttgctgatgccatacctggaagttgtgagagcagcaggatggttcctggttcggtcaaagggcaccctgagctctgagcccagattacgcccaacatggaattccttgaaggcctccgaaaagtcgttcaccgagatgtaccggtatggttcatctctgcggcaccagtactgatgctgatccttcctcgatgtaacctgtgcattcagaatgaacactgtcaaatttgagttcctagtccaacatgcagggaagattactctgctggatcactcacttcttgcaagaagtctgcaacacctttcctctccggacatttgaagcccattgcctcaaagaactcgaggatgttttctcgaggtccctggtatacgatttggccctcggagaggagaacaatgtcatcaaagaggtcatacgtctcaggtgcaggctgaagcaacgcgatgagcgcggttcctcctaagatgtggacagattgcctgagggagttgacgatctggtatgttgtggagctgtccaaaccggtggagatctcatccatgaacagagcctttgctggaccgacaagcatctcacctacgtaaattcagtggattgagaggtcagatttttttcactatgatcgaagaacactgtcatgcctagttctttgttgactgcagattgcacataccagttgtgacacgtttcttttgtcctcctgagatacctctgatcatagcgtctccaaccattgtatcagcgcagatttccagacccagaatctgcaatagcaacttaannnnnnnnnnnnnnnnnnnnnnnnnnnnnnnnnnnnnnnnnnnnnnnnnnnnnnnnnnnnactcactttgagaatgtaatctgtgaccacgctttcctgaccttccacggagatggcctgtttgcacaagggaacaacaatttgagcacttcttgtatacttttccaaaaaaaaaaagaaaaaaaaggaaggcttgtgctttgaataaactagcattttaccttcatgtaaacatcaatatcaggatctggtttaatgctggcttctttctcccttcttgacagttcagtaagcatgtctgcgtgataacaaaaccaccataagaataacttcaccaaaagcgaaacaaattgctctgcactttcagtgcagcatgctgcgtaccgtaacgagttccaactccttgacatcttgcagagaaggccagtgtctccctcacagtcatctcgccgatgtgaagatcatgctgcccgatgtaagccgatgtcctctgagggacaaattcgtccatgtcatgcccattgtaagtcactcttcctgatacctgagcatttcaaaattcaaattcagccatgttacaacttttgcgactaatctttcccatgtgataatttttgtccgaaaacacgggaatactcggaaattaacaagaaacatgtgaagatgtggttaccttcagtgttgagtccagtttccctgccagagctaggagcaggctggttttcccagaaccaggagggccaagcaacagagacatcctgaacaaatttcacattattaagctccaacctttcatcaaaatatgataatccgacacatgaacagttcttgattttcctcacctgccgggtctgatgattccactgatgtcatgaaggatggagataggcctcttcccgctcgaaacgatccgcatcgcgctcagcacatcctgatgatccaaacagttcaacaagaatcagaagctgcaggacgagcttaacaacatctgaacttggaaactctttcagctcctccatgatgatcatggatgatccaaatgcgtaccatgattttgttggagaagaagttggtgaacgttgggattccccggttgccgacgtatgcctccgcgtcgatgctaaggttctcaaacctcacttcaatcgtcgggttgtcaatcccaactctgcaaatcaaatcatcacaagttcaaatttcaaaaccacccagaattaactctcaaaaacaaagacaaacaaagaaggaaaagaagccatgactgatcacttttcccccactatctttcagttgctactgatgatgaacaccttttgtgtctgaaatttgaatttgatcgagaagaagaggaagtgaatggaattgagcctcaccgctccatccggtcgcggagcttgaggaggaagcgctcgttgtcctcctcggcggtgcggacgaggcgctcgatgaggttcctcctctcctgcagcccgagccccccgatgtccacctcctccacgccgccggcggtgaggatgcccttccgcatccggtcgtacgtcgggagcttctcgatcgccgcccacttgagcgcctcctcgtcgtcctcctccctcaccgacctcccgaacgcgtcgctcctccccgacgtccccctccacgacgacgccgtccgccgcacgctcccgccgccgctcgccacgctccccatcctcactatatccatcttctccgatcacctcctctcaactccgatcacctcctctcaactccgatctctccttcgatcgatccgcccttgcttgcagctgcagctttttgctgctgctcgagtggagaagatgacgagaaagaagcgagggtttgtgttggttggaggagacggtgatgggggtggtatatatacctcgccacccacgcgcgcctcttaattacatattaatcggagattagcgaggtgattgatgattagtatagctaattactagatttagtcgaaatggcgggctcgctggtcatgacgcagccgcttgtttcgaattttttttaatttttttaatgcggtctcgagcgtggatagtttgaccggccggtcggttcgcgccgaaacgtcttgaccggttcggggtcaggtccgcctcgtctgacccgggcactagggggcatcggggtcatcgtggccgttggtgggaggatctgcgggtgggattgttccacgtgtcgccgggattcgcggtgttggggtacctcccgcgtacggcaagggggtgcgtttagtattagtggtgcgagtgaagtcagctatgcaggtaaacgtcaattagtggctgcatgctgtagtgtttattactactagcttggtatgtagattatcacgtccatgaacagcgacaatgttgccagatatcgtgatgatcaaaacaaaaggaaaaagtgtgggcctgagaactacagcatgcaatttggatgtgttggaattaatactcttatgtgccgaatggttgaatggatgaatagttgaataatttttagcaattattcgagagtacaaataaatgaaataaattaacaatggatttaatatgtttcttggaaatttatatataggaaaattcatgcatgtttcttgcgaagcgtgcacatctctcctatcatttcattaagtacaaaagaatacgcaggttacaaatctcagcatctatatttggagggggttcattgatttttattaaatagaaaaaagagaactgtacatggcgaaaagaaagagaaaaggtacaggctaaggacccttggtccaagctaactaagggtgtgtttagttccacgccaaaattgaaagtttgattaaaattgaaaattcgaagaaaaaagttgaatgtttatatgtgtagaaaagttttaatgtgatgaaaaagttgaaagtttgaaggaaaagttggaaactaaacaagggctaatgtgtaagccggcgaactgatttttcactctcttgtactctcccctagctgctgttcctgctagcgaacacctgtgatcaaaaggcaaactgaacaccaaaataactgatcggcgatcggtt

SEQ ID NO: 11912 - DNA, 3293 bp, Oryza sativa
aggatccccttggaattaatactcttatgtgccgaatggttgaatggatgaatagttgaataatttttagcaattattcgagagtacaaataaatgaaataaattaacaatggatttaatatgtttcttggaaatttatatataggaaaattcatgcatgtttcttgcgaagcgtgcacatctctcctatcatttcattaagtacaaaagaatacgcaggttacaaatctcagcatctatatttggagggggttcattgatttttattaaatagaaaaaagagaactgtacatggcgaaaagaaagagaaaaggtacaggctaaggacccttggtccaagctaactaagggtgtgtttagttccacgccaaaattgaaagtttgattaaaattgaaaattcgaagaaaaaagttgaatgtttatatgtgtagaaaagttttaatgtgatgaaaaagttgaaagtttgaaggaaaagttggaaactaaacaagggctaatgtgtaagccggcgaactgatttttcactctcttgtactctcccctagctgctgttcctgctagcgaacacctgtgatcaaaaggcaaactgaacaccaaaataactgatcggcgatcggtttgtacggcaaaaacaaaaggagaaacagggtagaccatctacgaagggggagtagacagtagactacttcatctgcaggcaacaagaaatcaacggcggcgtgcgcgaggtctggtcagtcgccaccccagatcggacggccacggttcgtcttctagacgaccagctgtatgacatagccgatcttcaagccttcgttgaaaaggataacgtttcttatatttaatttcttaacgattccgttaataatactatatcgcttgccaaagttaacaaagtcagaatccagtggcaatcgagagcatcacgaactctggactctgaagtctgaaccagtcagcagtggcttgcggccagttaataataacaacacttttcctcgcaaacaaaatataatgataataatgctaatcctttctgtctggtcaggtcaggtcaaagatggccagctcttgcgttgtactcgaccattgttttttcaaggatttgtgggagaatttctctggagaaaacaatgtgatagtagtagctttagatgagatttaactgttttggtcgtggaagtcgtgcttcgacggggacggtgacggacggccacgggattcacgggcggccggcgagccgccgccgttcgttcgttcgcactgccggcctcttaattcgcttccattagtttctggtcgccgaaccggtgtcgtgcacgttgcaccaacattgcgaagtctgcttccagctgcattggagattcggagtcgtcttccaaaatagttttcatcacgataggagcatacggttttagcttttgctgatgtagttttgcttggagaaaacatagtacaagaactgtgctgctcctagaaacgtgaaaagggaatagcactacggcacacattcgtggacgtgcaatagttgaaaaatatgtgttggtgtactagcccagttgaactatgcagggagctagtggcacacagactgttcaagtggttcacaacattattcttaagaaaaaaaagagagctttagaccgcacgtgatgatacgaaacccattccaaaaccagtggcctatgcagagacacctctagaaaacaaagaggttctggacaaatttcaaagtcagataactgctcgagttggcatggtacggacagcatacacattatcacttgtcaaagtcaggcaagaattcctcgggctaataatctacaccgacaaaagttcacactaaacaatctgcagactaatacatggtttcctagccttcacttacatgaatcacttgttacagttcttcatggtatattgtacttctaggaaagttagcaccatgataaactaataataccggttttgtgatgtgcagattttcatgctacgccattctcatacattgaaccatctttggttgtggcttcttcaccaatgtcaacctcacccattgcatcgtcaataagagactgtaatacagaaagagacagcagttcaattatatagcaggtcaaacaactcccaagaaatacaaactaagctaacgcattacttcatgaaatcatgagtatctccacagactctgggcacgactacaagagcatgcaggtactgcacccaggattactgaaattcaataaagggtactctagggaatcaaaagaaatcatatgttgagcaaataacctggagctccttttcagacatcttcaccctgtcattgtagtcttgaagttgcagaaaacatttgtacagctgcatttaatattttcaaagtacagaatgtgatttgtcttggttatccgttgcttattttcataaagcagcagctagcatgtgagcaaaataccacatgtacctttgtaacaaccaattgtcgttctgaagaaactttccgtgcagcagacaattcatcctctaacttctgtatttttgtatttaaaaatagtttgtcagaaaaaaataaacccgagtattggacaaggataagcacttgcaaatttaaaaaataacagtgcgaaagatgctaaaaaggattccagtatcaggatacacagatcacctgggatctcttttgcaaatctgcaatgtgttgttcctttgctgcaactttatctttgatctgactaacctgtaataggacagcgttcaaactattttttcataatatgagaagcaaacagaacaaagaacactatataacaattgtaaatgctaaagttagtagccagataaatatgtggtctaatgcactagcaccatgagtagtgacaaaatcctagcatgctcctagttgactatctgttggtgttcaagcaatttaggcatgttgcatcaaatgtatcttatgagacaatgttagctttgctgactcagattttatgaactagctttgattatccaaataatgactaataaaatagagcatagctgaaaaagaaaaagagtacctcattttcaaggtcctcgcgcatttgaattgctttgttcaactgtcgttttgcctgataaatgcatgaaaagaaagaaaggagaaatgagaaacccaacaaaaattagaagcaatagaataaatggttagaaaagctcatagacaaatttccatttgaagtaacagaacaaagagagatgtatttacatcactgtgaagatcatcactggaaactgatagatccctgctatcatg

SEQ ID NO: 11913 - DNA, 8026 bp, Oryza sativa
  unsure (1)..(8026): unsure at all n locations
nnnnnnnnnnnnnnnnnnnnnnnnnnnnnnncaagcaatttaggcatgtgcatcaaatgtatcttatgagacaatgttagctttgctgactcagattttatgaactagctttgattatccaaataatgactaataaaatagagcatagctgaaaaagaaaaagagtacctcattttcaaggtcctcgcgcatttgaattgctttgttcaactgtcgttttgcctgataaatgcatgaaaagaaagaaaggagaaatgagaaacccaacaaaaattagaagcaatagaataaatggttagaaaagctcatagacaaatttccatttgaagtaacagaacaaagagagatgtatttacatcactgtgaagatcatcactggaaactgatagatccctgctatcatgatcttttggacggctgtacagaagaagtcaggaaagtaaagagatgactcaatcctaacttctctactacttggtagcaagcaaaaatattaatcatatacaaattttgtttcaaagcagacacagcagaaggtaatagactgtagacattacatgaagactcgaaactcaccagtgctctttgtaaattttgcaccagccaacataagtacataacagatgtcataccagtaaatgagatttggctggcaaatttcaagtatgacatacgaaagtacactctattttattgcgcagataacagaaagacaaccctggatccaggctcgctatttatggtttcatatctcagttcagatccagcagaacacttgtttaaagtgctaatcacggcgacaaggcacatacgataatttcagttttaaatcctcagcatactcaatatgtgaaacccattcagttggtatgtgtgctgttagtcttgatcactgtggggtaaacttaattgcaatgtgccaatgtctatccccatcaccccctaggagatagcaaaggtgtcaacccaatttaatctacaatcagccacttgcagttgaaatcaagactgacagatgacatatgcaggtaaaagcaacttacaagactcaatatatctgcaagtcactactcactacaaaggtgcattcagcatttcagctgcacaaattctaacaaatttggacaagactgaccatcaactttaaattcagggagtagtcaattagtaaattaacaattgcaaatttacattattgataaaaatgaatatacagtataaattattgggtaagttggcaaaataataataataattagaagaagaagaatagaacaattggttttcgtgggtgaaactttactaaggacaccaggatcctatccagatttatcaaaaaatatgccacatcaatagtcctaaaaactaaataacaccactaaagaaattacaaccttctgacacaattacatgcatcaaccagaaatatattttttgtggaaattcaactcagatgccttgcaacttcaattaagcttcatgccttcatcacaatacaaatatcttccctagaatatatatatacatgatctatttccacccaagtgcatgattagcaatattaacagagctaaaatacaatgagaagataatacctgaacctttttcttgatcgctgctccttttctttctctctttcactatcatagtctttagagttttctttttctctgtcattatccgaatcaacattatgcatttctgctgcacggtcgtagtctctacgcctttcatccccatgatcttgatccatgggatagtcaatttcttgatcaaagcctctaggttcgtaaaatctgtctctatcacggtcacgagatctatcactatccctgtcatggtagggatctctgtcacggtcatagctcctttctctatcccttctgtcccaataagcatcccttgcgcttccaggttctcgccgaaaaccttcacgcccgaattctcgggcacctctagtacgcacttcattcactctaacaacacgtctatttattctctgttgcaaacaaaaatgtaattaatacaagagataataaaaggtgttaagttccagataggagcataccttgccgtccatgcctgagatagcatgctgtgcagcatcagcatgagtgaaagtaacaaaaccgtaacacttgcctctgactctctgatcatttatcacctgcaaaggtcagaaagagattcctctgtactctcacataatttgaatcttatctgacaggtaactactttaagagggaaaaaatagtgcattgactgcttcaaagcaaaaatccttttctgttattgtatcggcaaactcgggaactaaaactttaaacccatctttggcattgcagtaatgccatgcctcctccacttgaaccagaaacaatataaccacatctatcacttgcattattgaacctctcattctactaggtattaaatcaagtaccaataacacaaaaaaaggaacgcatccaaactaatatccaaagggaaccctgaatccttctagtgtaaatttaccctaaaaactaatttgaaatatgagctacttgcctccctattcatcttagcagcaaaataagtgactgtgtgactgaaccaagtagcatgtcactacatattcaccttcatttcccccctcccgctttagataatacaactatctccccaccaaatcccgagccctcactccagagtcccaattacccagccactccatgtctcgcattaggacgtagatccaaataaaaaccctaaaacaaacaacgcccttgttgaacccagctatctcgaccaccaaaacgagtctcgcgacatctcgcgtgcttttacatcacagcgggcagcagcaaaacaaaccctagaaaaaaaaataaacaagccgattgacctcggagctcggaccaaacaaccgtcaacagctaaaactcctcaacgccgcaaacccctgcgacgggagagcgggacgggatagcggtggggggcgcgcggcgtgggaagtagggaagggaaccttgacggagacgatggtgccgaatcggccgaaggcgtcgcggagcatgtcctcgttggcctcgtacggcaggccgccgacgtagaccgaggtctcctcgttcaccgccgccgacatctcgccgccggcgacgacgacgacgacgacgcgggctagggttttgggtttacctccgctccctcccctctctctctttctctctctcgcggagacgaggagtcgacgagcgagcggaatgggtggggaggctgtcggatctaacgccgcgcgtggtgatggtggtggtgggctggcggcatccacaatccagatccgtgtgtcccctcgtgaccaatccccgtcgtccccgttccgatcgtgggttttttctacgtgggccggatcaaagatcaggcccatctcgtttggaaggatcgcggctttcaatacaggttggagtaggtctattttccatacttcaactattgccccttagttgaatcacattactctaccacaaaaccgggtacatcacatactacaactaccaaaactgaatccctcagcggtttggccgatggttttctcctacatgatgccaaataattaataaaaaacttaatgagacccacatgtcaatcagataaaagttagtaaacgcatagtgggcccacatgtaagtattctctccctttacccctccatcttcatctctcatattttccacgccggtgccaagagtgacgacgtccttgatctcgaccccagaaccagcgcgggtcgccgtcgatgagtcccgccgagctggcatgcctatccaccatcatccccgatgagcccctctgagacagcacaccatcccctttcctgaattgttgtctccttaagctgcgcaacacttagtggcaccttggctaccagggttcgcagcaatggaggtgaaggcagagctcattggaaggaggcaccaacaaaccttggtggcgagaatagaagcttggaaaggccacgtcagcggcactccagcttcatctatgtgcttagtgacgaggggtggccgcagatgcccaaacctagcccaagctcctctacttcgttggccacgcccaaacttccacgtctctctatcgctatccgacgtcctcttcctaagatgctcaatgcggccgatggcccgtgcttcctctgcctcttcctcgacttttgcactccgccaccagcccaccgaccgccgctaacatgcactgcctgccatgtcattgggcgcctcgtgcgtccttgctctcgtgaagagataaggggtgagaagaagtgatgagagatagagagaatgacacgtgggtcttaatgggtctttttttacattttttcaagagcgatttacttgtgggcccttttttttattttgggttgactgtgatgctatttaaacgccgtatagacgtcacgccagataaagaccagtttaacatgccatgtaatcgccacatcatccaaaaccaccttgcaaaccaccaaagtagttaatttacaccggttttaaatagttgaggtagactttatacccggttgtgtggttgagggatgccatttgaaggagaacgatagtccaaggagactttattccatactagcttgactcatgtgcgggccatctaaattgggctcgagaacgggatcgcagctttcgtgcgggcccatattagttggactggaatggaacttcggctcacgtttggcccatgctgtttgggccagaacgggatcggatctgacgtgaggccgtaacggaactgtcgctaacgaatgtacgggcccaaatgagaggcatatcatgcggttgtgggacgacggcggccgacggcaggggagcgagcgccggcgacggcgtcgaccgagaggtggaaccgccggtgaccattggactgcgctgacctcaccggctccggcagttcttcgctggctggcagcccgagtcttctgaagttctgataccaacactttgtcttgtagtaaacatcagcatagatgtcacaactctagtatagctaaatttaaaggttgcaaggccggaaaaaaaacatggatagctactattgtaaagattcaaaaacttctccaacgtttacttccagatcagacaacgtcctagtctggaaaatccgacgaaaagttttggtcctttcctgaaggttgcaggttgcagcacgaaataaacatttgcaaattgcaagcatcggccactagtagatgcaaaatgagttgaggaaccggaatttccacaaaattgtaattaccaaaaaggcagtttcatatctatgggatggaacaacagacagctacagatattctcaagcaaagaactaaagacaattctcaaggtgaagtcaaaatatacatgctacaacaacacaaaaaaaatggcctgcttatttttcttaccactctgctgctttcctcagcaacaacccagggcaggccaaactaagcagcttttgattccacggaagacttatactaactaaatttgcaaggcaaagaacttattgagattgttgaccagacttctccgaggtcgtactctcaggttcctgagacactttgatggccgaaccattcgcagagttctcactggctagagtttcttggagagaaccatttcctgacccaacaacttgagcagttgtttcgaccgtctttgctttcagcattttctccttctcaagctcttgctttgccagtggggagaactgtgagtcaagggaccttacagcacccaaccaggcaagaacaattaccaatagaattcctcccaggtagggtgtagaatttgcgagagatccaaatgataagatcatgaactgctggatcaaggcgcctccagacttccccaatgggttgcagaccacatcaattgctgccttacctttgacctgaaatcatgaatagaaggcacacatgagaagaaaatttcagaaccgcgtgaaaattttgaatcttatatcagccttaaaatttgacaggccatacgttcttaatggtgagataatgtgtgaataatattggactgcaactatagtggatttgtacatcacaaatgttacggttagcacttaaaaaaaaaaagcacaataaatttgatagacaaatgcattccagtcacaatcaacaaattaatcagattattgtagaactagcaattttgatatgtatgcattctactatcagcctatcaggtgtcagggactatcctcatagtaacccaacccatcttgtaatagcaagtgcatcaaccatctggtgaggtactatcaaacatgcctagcacagttttctgaattccaacagaactagtgggtagcagggtttatctgtttaatactaccatatgttttctgacattagagcaactggcctgattaattatatcaagataggaattttggagactaaccttcatgtcctcgtccaaaggaatgtatgccatttccttacaagggtcaaacaaactgtacttcgcactcttactgaaaatgttctgcattgccccaacatagaccgcagcaagcaaaggtgtcattccaagtgtggccataagaggagtcaatggctcaccgaataaaatcagtgagaagaatccaactccagtgagaagcaacactgcaggggtgattgtagctgcgactccccacccaaacttcctaagaattactctccctaacaacatcattgtaaatgtggctatgccagtagcagtcgagaaatcccccatgaatgaagaatattcattagggcttgggtactgcaacagaaaatagagttaataaccactcatattatcaccaaacaattgcacatctggcaatgtggatgaacttacttgtgccttcagttttgacttccatgtcacctccacaaggttaatgcttataccataagcaacgaccagggtggcaagatccctcacataccgagatgacacaagcaccttcaaactctctcccatactcagctttggcttatcctgcagggtcatgtttgaagcaccataaatgaaagctcaataaacagaagttgcaaaccatagaacccataagaaaaccgaccttcttcttccgctcgacgactggcgcagctgatttatcaattacaaacttgtttactccccagtagatgccggcaatcacaaggcccagcaaaaccactatgctcatcatgcccctcaatgaaatcgcccatccgtccacccctggacccaaattctgcctcatgtttgagaagtatttcactgtgcgacccgagaagatgagtgccacattggccccaagcccgaacagtgggtaaaactctttggcctcttcaaccgtagtaatctgcaatcgttaaatgcactgagaatttgtgtacgtagccaattgttttgaagtgagaatctacacaaatttaaacatgacccgttcagctattcacaaatgtttagaacaacaatgtcctacaaccaactgacaattttgtaatttcgtagaccaacatcactgtcagttattgccgatatttcaggagaatagtttgcaaacttcaattgctgctactaaatccgagaggaaagatttgattgtacctgattggcgaatccccagaagagcacggagatgacgacgctgccccagagctcggccatgacatagaagaggcagaagctccagacgcggaggatggcgacggggcccaggaagctgggccccagcgcggcgaggaggcggtcggcgagcgcggtggggtggatggcgtcgcgcatggggtagagcaggtagccgaaggcgccgaagaaggcgatgaaggggaagatgacggtgtagaagagggcctccttggagagcacgtcggcgagcttggtgtagagcagcatgaacccgatggccatggggaggttgacccacgtcttgaggaacgggatgatctccgcgctgctgcccttggcggtgacgacgagcacgtccttggtgtcccgcaggatggtgtagttaagaggatgca

SEQ ID NO: 11914 - DNA, 5814 bp, Oryza sativa
ggtggcttgcgacgaggccggactccatggcggcggcggcggcggaggtggggaaatatcttggaggtggtggggggaaaggagataaggtcggggcgctcggcaaagcgggggtttggggaaggggaggggtgtgtcttatactactactccggtgagattaggaggtggggaggaagacgacagcagtggggagagtgggaggggccgtgtggctggcttagtgctgagattagcctaacgaccttcttcgctaatctgaggaggggagacgcggacttgggagtgtatattcagtgtactgaattttttttcctctagaaaagttatactaccaggctgtagtaaaaagacaaccaatttattttagaaaaaaacgaaactgatttgaattctagtagaatttaattttagttgtttatttaaggcccagtattgggtgcttaagattctaaaaatctgctggtcggtatccagcttatgagaatatggaaaagctgggttttcttgcttctgggttgtagtttattttttggattttataactacagattctcagaatctgggtgataatctggactgtttgagagaactggagattctggtaaaatctgcaacaactagaaaatcccctcaaacaggcgcttagccgtttctgtttaagctctcttctcatcatggttaagaaaacaaataaaataattttttttgtaaaactacagatagtttagtaaaattattatgagactatagatagatttattaatttatagtatcacaaaactaaatgaacaaatttattagaaagctataaatttaagcaattgtatatagaaactatatattcagtgtcatttttttcctcgcaacacggagcatcgattttctcggagaattacacattttaaaattttactatgttaataggtatagggatagcacatctaaaatttattgttttatgaagataatactaaatgtatgctttcgagtaacaatagttttatgttaccatggtttaaatatgttgttttatgataattttgttaaagtatatgtagtttttgaaaattattttaaaacatatgtttaaattatccctaaaaatatatgagggtttgtactatgtatttcacaaaatattcttaaaaaccaaaatttttaaattcaagtcaaaatgatgctgatcaatatcttaaagcaaagcgtaataaacgcaacacacaatatacaggtatcacataatttactgggtgtggttgttgaatcacgcttggccttattgtaagtagaatgatgcatagaaacaacagttgacacgacaatgatctccagtaaactccacgttgattatgaacaacacttgaaaaacaaataaaataacggtttcgtatgatcgggatattaatttgagttacattcggactaaagagagattcagccatataaaaagataaatataattcctcatttggattaccataataaatataatggatgcactcaatatgattagggatgttgagggtagatggtttttctataataaaaaaaagatgaatctagagaaattggatgtattagttaattgtatacatgcatgtctttttattatgaaaaaaaagatggttacatcctatattttgaagtaaagaaagtaatagattgttatattttaggacaaaataagtatttttttaaaaagaaaagggcgaataaaaaatatcagtaaagtaaaatggcctcctgaggtagatactacaagtcttgacaagaggttaattggtactactactacttgctacagtaggggccagtagcagtggatcattttgcatgatttgctacagcctacaggatgagtagcagtagtagtagtacgttccatgccaaaccgatcgatccgtgcgtgcctacaccccagaagggtctgaggagagtgagaggacgggaaacgcatgggaatgggatgcgcccgccccgcccccggtccctggtcgcaggcgatcaacgttccatcctcacgtcgcgacgagcgagcagcacactgtacacacactgatactgatacaaaacgctccgatgctcgcacctgcaggatcgaaaagtttgttgggcgccaccaccgctgtcgcgtgaccctccctccgctccgattgacggccaggaaatgcccggcgcgacgcgatgccccctttgctctcgtctcgtccgccaccgcgacgtcgtcgtgtccgtccttcccacgtgactccgcccccgcccggtggcccctcgcctcctcacggccgtccattcgctcgcagcgccctcgtgctagctgccggggggccttggacaaatactgggacggagtacgggaaaacgcactgattctgccgtcgaatcgcgtgcgtatctgcatctgcatatatcgggccgctctttctgggactgggtgattaatctcgtgtcgtgtcagcttaactagtggcctggtctagtgcatgggatgatgataattccgaggtacgccctgtttagttctaatttttttttcaaactttcaacttttcattacatcaaacctttcatatacatataacttttttaccacatcatatcaatttcaatcaaacttttaaattttagtgtgaactaaacataaacatagtcgtagatggcgtgtggggtggggtttattagtgataaaaaccccttttggctttacgcgcgtgagtgccacgggactctcgggctcggctcgtgtaagctgtacgtagcgtgcaaaatatctctctccctctctcgatcgatcgcctcgtgtcattttcagtttgctccctttttccggggacgcacgcacacgcttctcatttcgtacggggaaagctcggggcttatagctattttgcatgcactggccggttgctggcacagtggcgctccacacgtatccgaagttctaaaccaactagaaaggtagcccgcgcacatgcgtgggcaccttctcgtataatatgagtaaaattttattatgaatatttatatgtaggtggctttttattaaaatatcttgtattatattctaaactaaaattaaatttattttgtgtgctttgaaaagctttttatatttttataattatccttgcaacatataaattctaaaataaaattacttgaaatcatgtggttttgaattgatgagaaactattgtgtcgaaacaatggaggtggttcctatgataaaatttagggtattttaactcgccaaaaggatagtttacaacctcaaaacaaattcaataatatcatttttttgtttgattgtattttaaaattatatatatatatatatatatatatatatatatattcattctaaccgtccttgtaaaatgtttcaatttttctatcaagtattggttttaaatccagcaacatttgttcaattttcaatttatttcatgcctatttttattttttttcttttggatagtttcattctatgaatcatccttgaaatgatttgatctttgcaatttgggacgaaaatataagaacacataacctagtatggggtaaaggtatacgttctaaattttctctcctgaaatatcaaagtaatggtcataatgtatttagtgaatcatcactaaagtgtattgtcttataaaaaaaggaactgacttgatttattgctaaagccactgcaaggttgttccatagttaaaatccttagatacaacctacatgcttatcgatatgatgttcaaccaaccacacctttattttcaccctattgtctatattgctagatgaatacctgctatgattagtgacttcgtagatcatatgtgtaattcgaacgctatgatcatctttcttaaaaatatttatctatgtactaaaaactttattttgaaagtaccaaggtcaatttgtataggcatgtcaagagaaattaattaagttggcagaaagtctttagatgcctaacatgatataagtaataaatggaggtccatttgtaattttttcccatatagataattttaattttaattatcaaggagataaaaaatagagagaagaatggcgcacgctgtacatgggcaggaagggagggaggtttgggatgtttttctaaatgattaatctaacagactaaaataatgtgtcagatgtttatgtcgaaaccgatggtcggatgttttgttttcttgtcagaattttattaggattttctttgatttaagagaataacataatatcttaagagcatttataagatgtgtaatcgacttttaacaccgtatgccgcaaaggagggagggaagaaggtttagggtgttctttttttttaaaaaaaaatagatctaatgacctaatataatgtgtcaattaatccattgaaaaaatgtgtccatcgatttatgtcatatctaatggttggggttttttttcccaaaatttctaagatttttctctaatttaagaatgccatatagcagcttagaggcattaataatatatttaatggattttaacaccgcacggggatggggagggaggcaggaagagaggtttgggttttttcttattaaaaacctaacaaatcgatagccaaatgttttgttgtttttttaatattttctagtattttatttaatttaatagcaccacgtggcattttagaggcatttgtaggatatttagagtcacagagcgagagctgctagacctaataggtggaggtctctttgtgatttttttaatgtaaaaataattttgattataatttctcatgaacatagctcgttggtacgtacgtgacgggaggttcggaatgtgtgctttttttttaaaaaaaaatctaaccttctaatataaaaataatagatcaccgatttaaataaaaatcgatggttggattagagtgcacttgacgatctaggagcatttgtaagataccacttggcgaattaaaagtatttgtaagatgtttaatgaaattttattatataattgtctttttttttgaaatttaagattttattttatttaagtatgtgatatagtagcttagaggtgtttacaaaatgtttaatggattttaacactgcacaggggtggggagggagggacagaggtttgggatttttttattaaaaaatctaacaacttaaatccatcaatttaagtagaaatcgatggtccgtcgctttgtattttttaagattttttaatactttctctaatttaatagtaccacgtagcgatttagaaatagggagagctgctagtcctattagttggtctatttatgtttttttacctgtaaaagtatttttgtttttattttctcattaagtagaaaataacacatgaatgaaaatatggaaagacaacagggaagtacgtacagtacatacgcacgtacgttcggcattacgtacgttggttccgtatatgatgttccggatgttcttttttctttataaaatagatctaactaaatccaaccattcaaaataatgggtccaccaacataagtaaaaatagatggtcagatttttcttatttattatggtgccacttggcgatttgagagtgtttatagggtgccacttggcggtttgagagtgtttataggaaaatataaatattggcaccatccggcctaactgcctaacgacctaggagcgtttaatggacttttagtatataatagatagatagataaatattggcaccatccggcctaactgcctaaacaagtgcgaacttgtctaactgtcatgaccacgggctttaatacttcgtttgggg

SEQ ID NO: 11915 - DNA, 788 bp, Oryza sativa
taaaatttacataggttatacgcagatttgcctatgggtgctggtgtcagcgtagcagttgtatggctaccttatacttcctacctcccatattaagttcattgttagccatctctatttgtccctaaataaattcgtttttagagtaatcatatcattacatcagaacttgtgaaagtggggaatactccctctagagtaattatattgaggctgatcggttgcagctgcggcagctccaagctgctgccactggcagctattttcaatggccacagccatagccgctaggacagccagcacaagcgaacagcctcattaggagtagataaagtgatgaatagttgcattgagatttgataaagtagatgtattatagtatttttgcttttgtattggtatgtgtgtgatgaatgaaaaataaacttattttgggacggaggtagtagtggctacgatggtacactcaatacatacaagtcctatacgtgcaaagtatacatgaaaatgatttcattcttattgaatgatagaaatagtccctattcaacgtgcgtgcatatagatgtctaattggctacttggcatggtccgcctcgggcacaaccaagacacgacctaagatcagttgggttggcacaccccgactgacacaccgtgcccacccacgggctgtatctacggcgtaggcacgacctagtaagactcgagctatgccgtatcggcccgaagacacgactagttcaccatactcgtccttagaataagtctattttcctccctcgtct

SEQ ID NO: 11916 - DNA, 680 bp, Oryza sativa
cagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagaggagcaatcttgcagaccacaagttgaaggtgacgagcctcccatacctcttggtgcattacatgatgacccaccaacaatgagaaggaggtcagggtcggccatcagaaatttcactcagtggattgagaatgagcctaaggagaagttgtctctattgttcgacaccgatggatctcggtatggcataatgacaaccaatttggcagaggtgtacaactgggtaatgcgaggagttcgggtacttccattggttgctattgttgaattcatccttcacggcacgcaagcgtacaagaaaattggtccgtccatggccgataacaacatagtgtttggcaacgtagtgacaaagtacatggaagataaaatcaaaaaggcacggagacatagagttgttgctcaaggcacacaagtgcatcggtattaaataatgtgtgttgataggagcaagcgtggtttctatcgcaagccagccgtgcaggaatgtgtcttgaag

SEQ ID NO: 11917 - DNA, 1352 bp, Oryza sativa
caagctttgggattgggataagggttggatgtgcactcaaatcttcgaggggcattctcactatgttatgcaagtcacatttaacccgaaagataccaatacttttgctagtgcttcacttgatcgcacagtaaaggtttgcgattttgttccttacatttgcttggcatagtttttgcatttctaacatttcttggtctggatttgaatgtggtgcccttatttaatttcaggtatggagtcttggttcccctgatcctaatttcacattagatggccattcaaaaggtgtcaattgtgttgattactttactggtggtgatcgcccatacttaattacaggctctgatgatcagaccgcgaaggtatgccatctgcagtgaattatcttgtgagtatattggacattgttacgagacacttcgttgaatcaggtttgggactatcaaacgaagagctgtgttcaaacgcttgaaggacatgcacataatgtctctgctgtttgtttccatccggagttacctataatacttactggctctgaggatgggacagttcgcttgtggcactctactacctacaggttctctcgctctctccccctatgatacaactcataggatacttcatgcatagtttgaattttgagataaattcatgtactcgttactctcgtgggtgtgttgttctattgatggcaataaaaactctgttcggtggcataaaatctggttcttaaataatcattggtgtgtcatatctattgatgaccttacaagcatagtttctggtcttcatgtccttgtttctttacgaattagtttgtgcatttagtaatttattatttagccatgtaattttgattgatgcagcattacattctttaatctaaatataaatttttgagtgaaagtgttacatttactcctatagcataagtttgtattacaactcagtcctattttagtaacaatatagagcaatttatagcttgaagtacgactagctaagaggaatattttctattaaacctgtcctgattggcatcagagctggtagtgatggttagggtcaaactaagagaaatatgcaactataccacttcctaacaattggtgacctctgaagtgaagcactgtgtccagagaatttgaagctaccattttcctgtggtgttgaaaataaggagattctcttgccatattttgaaactagcattctacaccaggatatagataaacaattttggggggtgcgaccaggatgcacatcacgcccatgccacaaacattcacttacgcgtagctactatgcttgttagttacatgaattacactgtcttcaataagtat

SEQ ID NO: 11918 - DNA, 9905 bp, Oryza sativa
tactaacctgttccatttttcagattgcagatggtgagcgcttacccttggttgtgaaggagttgggaacctgtgatctttatccacaagtaagttcatatttgctatttaaacgaatgcatcattcgcatattgatgttttccaatagaaccaacttgatgcttgcaaatgagtcccaagtttctttttcctattcattacacgagtcacatgtatacaccatttgaccatgcatgttgaaatattttaatatgttagtttatttgacatttgcactggtgagttgttttatttaaacacaccatggagattctgttgttatagtaaaattaaattaatatcaaatctagtatagtgtaattatggagttggagtgccggttttgaaattgtacttgtcgggttaaataaatgtgatgaacttttctacgttctggtttatgtttgcatgttattaataatagtgtattcatttcagagtttaaggcacaatccaaatggaagatttgttgttgtatgtggagatggagaatacataatctacaccgcattggcatggagaaatagatcattcgggtctgcacttgaatttgtttggtcacttgatggagaatacgctgtcagagaaagcacctcgaggataaagatatacagtaaaaatttccaggtttgtactgcccactgccccttcttttaattatcgttgtacatcagagtaggggtccttcaatgcaatgtgtggggctagaaaaatttagtaggtgtgcacatttcatggacaagctggagtactgtgcacattccaatataaataaaattgccaaaaaaaaattgcaagtagttcaaaaaaaatatagcatgaatagaataccacaaattatataataaaaaaatgaatatctcatgaaacatttataaatcaccaccgtcgatcttcaaataacatatccattgtttcaaatcgtttttcacatttggctaatcacaattagaaaatccattaaaaatcatctacaatttattaatatcactgaaggtttcataatataaagttagttttattcttgtttttctttagaatataaaaaatcagtaaatgaccaactccttctggatagggatatgggagtgagcaatattgcctatagtagttggggtagactgatcaatactaaaatgtgacttgagtaaggggcattatgaatcatttattcttctactgtgtcagggtcaacttgttacttatatttattaggcagctgccaagcttatcacaacaatctcctttactgtggtttctgaaacatagtatgatgataaaacctatctatttcaggagagaaagagtataagaccaccattttctgcagagcgtatatttggtggagtattgctggctatgtgtacaaatgattttatttgcttccatgactgggcagagggcaggatgatacgcagaattgatgtcaatgtgaaagtgagtaattttgttcctggatttaaatttttttttgcgtgtcatttggaatattatgatgctaaataggatctgctttcttatttgtagaatctctattgggccgatagtggtgatttagtgacaattgcaagtgacacctcattctacattttgaagtacaatgtaagtttttctgcattttgttggctctgtagttcaatgatgtaacatctacttgatgtaactataacacaacaattataccttccagagggatgtagtttcttctcatttggatggagggggttcagttggcgaggaaggtgtggaagatgcctttgaactacttcatgagatcaatgaacgcatccgaactggcctatgggttggcgattgttttatctacaacaattcttcgtcacgacttaattactgtgtaggaggagaggtaagtattttcattatatcaaaaatgcattcacatatgatttggttagactgttaattttcagaggtagtataactattcgatgtattacaggtcacaaccttatttcacttggatcggcaaatgtatttactgggatatcttgctaaccaaagccgtgtctaccttattgacaagcaatttaagtgagtcttggttgtctggtatcgtatcatattcggaagccacaatgaacttctgaggttaacttgttttcttactgcagtgttgtggggtatactttactccttactatgattgagtataaaacacttgtaatgcgtggagacttcgatcgtgcaaacgctcttttaccatctataccaaaagaacaacatgacaggtgccccctgttctgctaattattgtactctgcaactcaggcctcagaatctgaagataacccttttatttgcagtgtggcacgtttcttggaatcacggggcatgttggaagaagcccttgagatagcaacagactctaattacagatttgacttggccgtgcagcttggtcggcttgaagttgcaaaggcacagatgattaatttatttatcacatttccaagaatgtttttgtctttgttcaaatgttgttaactatttgcttttcaggcaattgccattgaggcacaaagtgagtccaagtggaggcagttaggagagttagctatgtcaaccggaaaggtacagctgttggatgtattagttactactccctctgtttcatattataagactttctagcattgcccacattcatatagatgttaatgaatctagacacacacacacacacacacatatatatatatagatttattaacatatatattaatttgagcaatgctagaaagtcttataatatgaaacggaggaagtatcttctatgagtggtcaatatatatattgtgctaattaagtgggactgttctgccatggcattttagtttcttgattattagtaccagtataccgtgtaacttaataattatgagcgcacagaaataaatccctcctcccaacaatataagcaagcatttgaattttgttcatgaatataagcatttctacaatgcatatgtaaaatcaatcacctcatttaaatttcttcccatcttacgcccaactactcttcaaccccaaccttctcattaaatgagggcactaaagtactttctcctcaactttaatctttgctcaacagtctagaaatgtttatattgttggacagaagaagtatataatttaacaaaggcatttgtgaagagataatattgcagttttgatgggaagtagctttgattgttgctatgatgcttgaattagaacctaagaagttcttgtgcctttgcttttgctctgtccatcttttgtactacctccatttcattttataagtcgttttgacttttttctaagtcagacttctttagctttgacgaaatctatagaaaaatatagcaatatttttaacacaaaagaaaaaaactattcaaatatattcaatgttagatgtaatgaaaccaacttggtgctataagtgttgctatattttttctataaacttggttaaacattcaagaagtttgatttttttaaagaaagtcaaaacgacttattatatgaaacggaaggagtagttgtttttaaaagtagaattatgcgtgcaaaacaatagttttgcctgatggcagagttctgtgtgtaaaaaaataacttaccatcttagttttaagtagaattcttgcaatttaataactttgccatgttatgtttcagcaccttgccagatacaaaactggctaaaagagtgcactcatattctaacatgtcaagtgtcaattctgcagcttgatatggcagaggagtgtcttctacatgctatggatctcagtggtttattacttctgtattcatcccttggtgatgctgaagggctaacaaaattaacatctatggctaaagaacaagggaagaacaatgttgctttcctttgtttcttcatgcttggaaaactggaagaatgtcttcaattgttaatcgaaaggtattgccatttgccaagactatcctatttaatagtacaatgcttattcagaaaatgtattttttattttatggtgatcacgttatattctctatacagtaatcgtataccagaaagcagcattgatgtcgagatcttatcttccgagcaaagtccctgagattgtaacattatggaaaaaggatctccaaaaggtaccatctgtctcttttttccccctccaaaaggtacccagtttctggtgttaatactgatgatttttagtgatgtttccatcctaacaggcagaatgcccaatctatattttgtgtacctgataaatcatgggcattcaagggcattttgtctattatctgagctagcatgcaaaactaaccaaaagacaatcaatcttgtgctagagtattgttcttattttcagacttgcgctacgcgacactgtttaatttgtaggagatatgtgttttattatcttaccatgccttttttttcattctcgtgccattttctttataggtaaaccccaaagcggcagaatcattggcagatcccaacgagtacccaaacttgtttgaagactggcaaattgctctcaatgtagaagctaatgttgcgcccaaaaggtctgtttgtaaaagtaaaaactatgttcttttgtgaaagttttacctgttctctcttccacacatgggacaagccgtcatggtttgctttcctcttctctttaattgaaagcatctgatgaagtaagaatgatgccctctaccatgtatgggatgctggtttggaatatcacatttagcttcagttgagcacatatagtgaaataaatagaagtaatgtcagtgctcatttgtactttttctttattgtaatatgaaatcctatttgtataggggtatttatgcaccagctaaggagtacattatccatgctgagaggcctaacgagactctggtggaagctttcaaaaatatgcgtatacatcaagaggaggtgctgccagatgaaaatggagatgacactcacgaggtatcactcttacagaaagagttgtaaaaaaatattgttaaatagtgggtagctatttgaagatgttaaattacttctactaaactgatctcttttttttttggcatgcgatgtcctatatttatcaccaatcttttaaagtgatcattatttcaataaaatcacattttttgctattcattatattttcttttctccttgctttaagttgtaatatagtaatatcaatctggtccaccaggctatcgaggaaaatggagtagaagagagccaagaagatgctgttgaggttgatgttgaagctgatggttcgactgacggtactgtccttgtgaacggaaatgataccgaggaacagtggggtacgaacaatgaagaatcattagcataaaagctgtagttgagcaagtgtacagtcctaaaacctttttttcgtcctagtttctcctcccagggcaccaatgatcatagtgaaaacttgctgctggtgtcctcaaaaagaaaagaaagaaagaaagaaaacctacctgcttctggatacaagtgtttattctgggctatatcctttagtttaatctgccgggataatttaattttggtattcgagttaatctgttggtctgaccagttttcttagacagtttgaacataggagcaaattttgtgcttgctatacattagttgttgatgttttctaactactgtcttgccttttgcagtattgactcctgaccaatagtgaatcagcgggacagcaacctgatacactgattcagcttgtaaaggtgaagtgtttttccatctatacaattagcgacagttgttaacaactattcatttattatagctaattattttttgacaggttgctgactcctactgaaactatgtgaaggccgttttcctccacttgtataatcattgggcgtgctttaagatcggcatatccgacgataaaacccacagaaattagtcatcgctttgtccttgtttgagatagaaaattttgtacctttttacacacataggtccttactgtggattctcagggggatgttcccttctcgttgaggttgaatttgattagctaaagaggatccatattttacacaagagtacatagggtaaaagtatgcttgctggatccagaatgtttctttgatgcaatctgcaagacaacactttgtgcgagctatgtatcatttcatttgtgctattccttgcgagcgttattagtgaataataaaagtttagatacaagagtgattcttttatattgatataaacgtcatagccttgtaaaatttcagctcttcttgttgggcctatcatgaatcatcttgataaccaaagggaaagtctacttgtgaacgtactcaacaaaaattgtttcgacactagtatggcatgaacagactgaaattctgctttaaaagaacttatttgccattctgcttgccgccatctttagcacctgacacgcactgatcacataccatgcttgtttacgtcacttgccgtggagtaattttatcatcattaaggtataagaaatcatagtgtaaaatttgatatcttctcgaggtactaaaatttttaattttaaaaaattttctcgaggacccaaaaatttgagaaagcacaagaatcttcaggtacatacaatatggtgaaaacaacttagaagtttcgttttgtcctgagtatcatacaacattccaaaaatggaccttacacaattatacatatcaaccataatccggtattaccatccacataaattttaatagccaactgcactgggggtaaataaacaacctgggccaataagaatacatgatttgcacatggtccatggagaatccgaaaagaaagtcaaaaaaccattcgaggccccgaggcctcatccttcccaaatatacatgttgcaaccgcatcaaacacaaatatacaaacactattggaatgcgcatcaagaactccgaagggtggagcttatgctcagacgcagttacgctcgaccattgtccttgtggaaacgagttgtacaaccaactacagcggataaatacacaaccagtagtatgaattaacaaattctctcgagggctagtatggttcctgatcccgctgggcactgcaaaccctttgtccgatgatgcacaagaactccaaaagagcagataatatcgcacgtcgattgtataatgaccttacccaaaaggatttcccccaacagagccataggaaggtggggtgcttggctgggggtacctgggagcagcttgttgatcaaagcccatgttgagggaacccaaacctccttgttgcctgtaatgccacaacttggacataagcgtcgaaacaacaaaaaattgcacaatggaaccaacaccttggaagtattttaggacggaaatacgtcttgtaggaactaaaacttaaaatgaaagaatgatataacacaacggaaccaacgcaaaggctggtgcctttggttgcagtaccagattttaatgacacaaacaatgggcatgccactagaaggtggatgctattgtttatagtagagcaaaggtgagataattctgaaagctacgggtttcagtggttgatgtcaaccatccaatctggtcgaatggactcattaataattagtctctattttaaggttgcatgctacttcctactcctacatcccaaaagatacaacaaaaatggcagaaaaaaaaaatcaacacgagcaaaaagtatctttaaaaaaatgctaaaaagttcttcactacactttcaacttaggagatacactaaatacagcagtcaactcacattggaagcatggtattaggtaactgctcagacatgtttggaacttgctgcatcatgtaatgatctgaagttgaaccacaaattagcacacagataagaaatactaataaagagcacaatttcagagattatgctgagatatggaaatacttggaggtgcaggtgactggtacagctgctgaggttgctgtggaaggactccaaaactcgaggtaccaagtaaacctgggggagtcatgccagcagatgctcccagtggtccaggtaggggctgctgctgctcaaggacacaaagattaaccatgttaatggagcaaacaaagatggtgagtcataccagctgatccaggtcgggattgctcaagggtacaaacaatatggtcgcactatcgtagtgcatcatcaagtataaaactaatgcacttgacagttttttagaggaagaggaccaacatttacacgaatatcacaatgttaatgaaacaatcaggcataattaatagacaagatacctcaagatttacaagaatagtaagtgaaacgatcttagtttgagatattttgtaaaagaggtatttcattctcttcattcataccgtgtgagcttgaactggagctggctcattcccaagatcaaaaggatttgatgctttcgcaggttgggggtatgcatgttgctgttgcggatatacaggttgttgatatgcaggttgagcaaatgccatctgaggatatgcttgcattccctaaaattggtaaataatttatctagttaggaaaaacatcaacatcagatacacaataaatcgctaatatgagaatgatagataccattgcagtctgatatggcatggcatatcccattccaaattggggtgttctctgccaaccccctattgtttgaggtcctggtggatataacgaagtaaagatatcctgcaaaaaaatgatctaagggtcaactatgctgacacaatgattttatggagcatattagtggccccaccaggtttttttttcttctctaatatgaccatttttcacagaaaaggaaaaggatcgcacagttgtcctcaattcaaagttagtttaaacgatcttgcaagtgaaataggggtacaacgaaaagacaaatgaactgagaagcattgttggtcacaaccagcatgaatgggcgactcagatcactacttattacttactggaagtatagactcaaaccaatagctatatattttttttctttttttcctttttttgcataatgatgacctgaatgcctgtttagctttttcactcgataacctgatttatttccatgtatctggttagtcaacccagatatcacattcaaatgcaccaacaattattaacaccattattcaactcttgccctaccataccatgcattgttttacatgcatatattatcatctctcaataaaaaaaagttaataaccatgtaacccccattaaaatgcaatttaatatgtaaacaatcaacaaatctcacctagttttaaaccaacataactgatcgcataggaaatgatatatcctaccaacgtattaacagttagctaatgcttgctaaacagaaataccacctctgacagatcaaaagatcatcatttaaccttgggccaccacaccttacattatttgacaagatttcaaggaaatactagccatagaaaaactgtaagtgtcagtctcttagcagttttgagctctataccttttatcatgtactcctgttctttttttatctgacactttttaactccataaaatttcagcacgacactgcaaataacttttgtaactttatgtaaattattaaaggcacctgaatatctagggacacatctataatccaatacatgtatatgctcaacaagaattttggagcttgggtatgaaatgtaccccatatgcatatggtaagtgaaatccgaactaagaactcatattgactagtactcaatttagttggactgcagtgattatatgtcatgaaattagttcatgggaggataaccatatcat

SEQ ID NO: 11919 - DNA, 7993 bp, Oryza sativa
aacggttgtgctactaatctggtaagtagttggttctatgccctgtccacaaatttggtaatttcagctttatgattcacaaaatatggttacaataagtttagaaaatggcatcgcatattgcacaagctatactgtagaacatacaaattaacggattacatatctaaatgaagccaatgaagcaaaggggtggggaagatgaaacaagtcagtagtgcagggactagaaaatgctgcaatgctagatgttcaattctctacaagcagttaatcacataccgctggaagttctttccggccaatggatctactgtcagtattaggtgctgcttcttgaatgccactagttgctcgggaattcgcagagacctggaacggaagtccagctgccggagcagctagaccagtttgttgaactgaagatccatggatagacattcctgttgaggcctaagaaaagtatcaagtgaaaacctatttcaaggcaaaaaaagaaatggaaggtacacagatcgacttctgatattcctctgcaaacggaagtacctggtgacctgagactccagggggtgcaccaaaaaatgaagaatgtgactgccccatcatggatgaccctccatcatttggaactgaagtgggcatgaccgaagctggaaaagctgatgaattgggtgcagagggtgtttcagaaaatgatagttgagcaagtgcagactcaaggggatctacactattgccagtttgtggtgtttgttgctggccgaaagaatcaaacgatgcccagtcaccaccaccactgctcactgatgacacatttttcccttgttccacagcaggctgttgtgctggtgcattaacaggttgcactggctgtgcactagcaggctgctgttgtgatgtaggtgtagattgtggaggtggcacagatgcagaaggctcaggatcagcactgaaatcaattaaacttatcgtacttgccacttttatctgttcggaggtcccctctgaagaaccaatactgctggcagttgatgtcctctacaattatgaagtatgtattgtaagctaatgaattgaacctactgataaaattatcagcttaacgtggaaatggagacaagaacatggtgatatttctaaaagcaatgtctgcaaaaaaaaaaaggaaacatcagaggaaaataataacctgcatctgtggtggaggttcgatggttctggttccatttggtcttggaggatcaattggccttccccgatcaatcggtcttggaggatcaatcggtcttggaggatcgattggtctcggaggatcaatcgttctcgctacatttggcttaggaggctcaccaacccgtagttgaggtgcattatcacccagtatatccctcactggccgtacaacagggctagatccatcggtttccttctggtaatttggagacccattatctggcctctgtggttcagaaggcctgcggtcctcaaaccgttgaactggagttgtttttccagatctatcctcacgatttctatcatcaacttcaaagtagcgggggcttttcttataatcattatgttcatagccaggacttcgttctccataggaatatctggaatttctgtcatcgctccttccactataactgcgacgatcagaatagctttcattgtatggcggacttcttgaaccaccccaatttccatcagatctcctgttttcactatactcatccttatcatcctagaagatacaaagaaataaggaaataacgaatttaggatagtataatagcaatttccaacaagcaatggcaactgcaaaaaaacaaggatagttataattagccaacatatcacctttcccctcggtggccgatctgcacttctttctccctgtgtatctccgttccacataaacatgcttaataaagttcctcaatttatccgcattactgagaccaaaagaaacaggtcagaattccaagataaaggaaacaagttgtaatctaaatatggtatggctaaacagaaaggtaacctgctgtcagggaaagaattgcggtgagcatcccattccttgaagaatatttctctagcacgctacaggttatgcaaaacacatgtcaaattagaaaggcctaaaatggtagaaaacatgaaaaagaaaagagaggacaagtcacctcatttcctccttcttgaagggcactaacttcctgtgcagtaaatttagccatagaaactgacttcgctcgatgcgtgaactctcggctagaagcaaaacaaattttgtcatcaataaaattaggatcactgacttcactaaaatgcatctaatttgaccaaagggacagtgaagctagagaggttcgacatattacaagtgtaacaaaacagaactgaataagaatcttactgtgctccactgcaattggtacaaatgaaggtccagaaatttgtacagacatattgtggtccctgttaatatcaatatatgtgattcagtaatatacaaaaaaaattaggaaacaaagtaatgcacatcagtattacacaaatacccactaattaagtctactttcccaacaaaaacatgtgtggagcacctaagcaaggagtactctgctgaagcaaaatatgggcataaatataagcttgaactatcttagagtccacctaattgcaagagtggagtgcaatcctccataatcttgacatgacattattaggcaaacctagctgcttctactgccgattccctccagtacacatattgcaaaactcttcaagttccaaatgatagattttgacattattttgggtgcaccatagaattagaaagcataatactccctccgtcccaaaatatagcaacttttagctatgaatctagacatttacttgtccggattcatagctgaaagttactatattttggaatggagggagtaatttattctacttgtggtagagaaaattaggcaaggctcgctgtgatgactagttggagatttccaaataacctcattgcgctgtagatcgagtaataaacgaactaccaaaaaaggcttatgtagtgaaaatgtcatgtggactgcagatgattcatgcttttccaacagtagaaaacatttgcaacaactgatggcatctaattatataggaccccactgttgcaatagcagtttaagaaaaaaaatcatttattttgcataataatagaagcaatcactaattggcatactctaaaagagtaaaaaaggtgaagtcaactgccagaacaatagacatccaaatgggccatgataatatagtttccttattgatagctgtggtaaattattaatgcccaaaacaactagcagatcagtcaagtcaagaatgctatttgccttaaatagcagatactatgctagcagaaaaagaaaaggaaaaaatcaagcttaaagaaatgcatagagcctaaagtgcagcgtgcaaatgtgcatgtattagcacgacagagtttagggcataaacagaagggaaaaaatattaaacatccatgaacgcaaggtcaactaagctattcaggtggttgaaacaacacgtgaatttttagacatcatctggagagttaacaatcttggtatatagtagaatattactccctccttcccaaaatgatcatcatatatgtttatgcaccaagaccaaggataatttaaatcacatcaatcaagacaccatgcacgcattctcccacaatgcatgcatcgatcaaaacaccatgccaattacaccttagcatgcacacattctcccatgctgcattaattgtattatgatgaaatccgtgtccatgcggttatatgatgatcaatttgagaaattttgaattccattacatgatgatcaatttgggaaggagggagtagcatgtactgccttgcaagtgccagaatgtcacaaaatacacgttttggtccaagacgaccatagtggtttctaattttttttgcttatgatcttcaattcttcatcaactataatagcaaagagtatatgtcaaagctgtttttcgactagggatttattaaaattccacatgttgtaattcaattataaagaggtgttctttttattttattttctgcttgtgctgctttttgaagggctgctttgttttgtcacaccacagacaatgtaagcaagtgtgacattcaccattgactttgactgcaaagatatgaacatgataactttgagacgctcataatccgtttttccgcaaagataagaatactttagcagctcataagcgccattactttcttgatacttgtatcttaggtacctcttggccattgttctagtcctaagtcgtaacgcgtgatgtatatctggcagaaagtagcaacatttgtcgtctacataattaattacatgaaaaagaatatgctgtgtgattacagggcatggcattacatccagcaatagctccacgcattactctccgtcccaatttactgaattgtgatccagtatcaaccagcctaataaaataccgctatccgatcggaaacctacctatccagccagccaatgagatctcctagtatgccgcaaacattcgcgggtagctctaaaaccctcgccattactagcaacgctgaagtataaagccaagcgagctcaaaaaccacttcccctagatcctagccaaccccgccgaaatcctaccacatttagcaagcgaacagtagaaagccagcgggaactcaccaaattgttgcagttgatgcacctcttgttggcgggcagcttgagcagcccgcgtatgatccgctcgttcctctcgtcctccttgagcctgctcgccatcgccgcccggatccccggccgccgctgccgccgccacaaaccctaaaaccccaccgccgcaaaaaaaaaaatcaaacaaaaatatcccccaccgaaatggctcgagatccgaccaacccagccagatccgcccacaattagagcaaagccaccgccaaaatcggcgagcactcacctgccgacgcgcctcctcctccgatggcggcgctcgcgcgagatctcgcagcggaagacgaggtggcggcgagcggcgacgcgaaggcttcgcctctttcgttcgctggctgcttcgctgcgcgtgtaagtaagtaataataataaaactgaaaaaaaaaacttttaattaaacctttttttctctcttccctttctcgtggggggtttgggagaagaaggcgaaggttaggcagccggtcaaccgagagagcggtgaccggcggcagccggtgggttggtggggcctggggtgtgtggggcccacatggcagtggcggttgggtcggttgtgggtgcgtgtgtgagctggacgtgggctgttccttcaccggcgtttctggtctggtcttggtttgtttttgggttttcgctgagtcgctgactaatgatgattcctgtctccgcgctgtctcaccgacaggtggggcctaacagaaagaaggtattttttttttattttggggggaagggaagatgatggttctagaacctttgtggttgagttggtggcatgtagtgatagatgaattcatctttgtttttgttctctttggatgcatgagagggtaatgaaggttttgaatcagttgtttgattagatgttttgaggtttactgtgttttattaagttattactaggtgatatcccgcactttgctgcgagatttatagatatatattaaatattatcgaaatgataaaagttgaaatgttaaaaaaataatgttaggaagattatttgacatatacttgttgatctctataatataatattgtagatataatataatattgtagataatatgttatgcttgcatgggatttaaaataggctagaatagtaatcgctagtgagtgaagatgtggtatacttgcatgggattttaaataggctagaatagtaattgccagtcggtgatgatgttgcatgcttgcatattgaactttagcttctatcaattgttagtgggtactaattatataattatatagaaagtatagattagtatgtgcctgattactatttggaagcatgttaagggaaaattgggtctcctgttcggagaacatgctttacggtggtctttttcaccccaggctataatgttgacgaaatgaaaactgaaactatgacgatgtccacatcttctaataatctaaaagctagctcttttgctagctttcgattggtgcatgtggcgccttttactttgaagaaaaaacataagtttatactagagaaaaaaaaacacctaacaatcatatgtgaggaaaaatctagagaaaaatataattccagaggcttccaaaactatcttctctttccaatcacacagaattctacttatttgcctcctataaatataacacgcctactcgataccgctccggtaactctagaatatatagtaaacctaaaaatattaagcaaaaaaacatatctaaaacaacaaatttacactcattttctttctttaaatatactaatcatactcggtactattagcttgcgcttttgttagctttcgattgatccacgtggcgcctcttactttgaagaaaaattataaatttatactagggaaaaaacacctaacaatcatatgttatgataaaaatatcacatatggattccagaggattccaaaactatcttctatttacaatcacatgtaattctactcctttgcctcctataaatataccacgtctactcggtactactcatataactctagaattatagtgtaaaacaaaaattattaagaaaaaacaaatctgaaacaatgaatttatatttattttccctcttttaaatatactacgcatattcggtactacccatataactctagtctagaatatatagtgaacaaataaatcatttatatataaatccataaaatgtttctttaatatcatatatgtccatttgtcaaaactaaaataatggttcataattttatttctaaaatattttatgaaaactttaaaatttcaaataagaatgtcacagtaattatccagcatgtcacagtaaatcttcccaacactctggtttaaagtagaaactcgtttatcacccccaccatttgtgttcattgtcttctccagcgcattgttcttcatcttcgccaaatgggtgttcattgtcttctacagtgtttgttgttcatcttcttctctagcaagaagatacgacttatataggtcatcgctctcttctgctagctgccaattatataatataaattatcaaccttgtcagtgtttaaataaataaacaaaaataaaaagagtgaaagtattgagcatcaggtatttaggtcaggtgtaagtatttgttgctactgtcggttttcgtagtaacatgtactactctgaatttctcttttaaaccacttatgtgataagcattaatgttcatccatacctcgctagaatgaggcttcgaccgtgctgatatcaacaccaactggttcatccgagtgaattctactacttatgtgatagcactaatgttcatccatacctcgctagaaggaggattcgaccgtgctgatatcaacaccaacgggtgaattctactgtgattacaaggcaaaaacgaaaacatcaaaaatactacaccgtaataataattacttacttgaaaacatcaaaaggaggtctaaattatgttagttcttaaagcgtcatgataatcatggcacatggcacatgtcaatgctacttgagcacttcatatctcgcattatgtctgttttgagttaccaattgtggtcatatctttggattgctcgttcgactatgatagcgcttatgaaacagagctgtaatgaaattattttacatctcatcctctgttgtgaggcacacatgcagtcaataaagttattaacaaaag

SEQ ID NO: 11920 - DNA, 1682 bp, Oryza sativa
atgtttgctagtcaccctatataaatttatcataaaaaaatagtaaatgataaaattgatgtgctcactaatttgtcgtcactacaaagtggaaagccaacctaaatatgaaaggtttgccgtggaaataagtgcaagctgaggtaaatgagttgaagaggcgaaaggtgatgttgctggcttcatgcaaggctagcgagaaagagttgaatcttcgatgaatcaaatccttgagctacagcacagcctctacagcacccacctcttcttgaaagacacccggtccagtttgattcgagagcagaatttaagagacaaaagttggaggaaaagaagatcattaggaaggaaagaagaagggaagaaaggatggcattgaaagaagataaatctgatagggaaaggtcatcaactaagaaaaaaaaggagagaggggcagtctgagagtgaaaggaacatgccatcagagaatacaagaaatgggaggtgaagtctcagatatcttctgagaagaagaagtcatatgagagctccaaggctgaggatcataagggaaagggttatgagaagtccaacacggagaagaaggggaaaggcaaggagaacaagagttctgagaaggggaaggggaagacaattgacggtagaaagaaatgacgaggaaggttagaagaaattgtttcagccactaggacaactaaatgccaagtatgaaatgcgactaggagagtaattaaggaacgatccctccagataaaagaaaacttgttgagtttttaagtcctatttctctgcaagtactttttttcatgaaataaagaccatgcacttatgcttcttatgcatttctctcagatccatcatccttattagtatgtgcctgatttctacttggatacatgttaaggggaaattgggtttatgttcggagaacatgttttactatggtctttttcatcccaggccataatgctgaccaaatgaaaaccaaaactagaagatgtctagatccatgtatataactggagcaactatctgcaaccttgttttgaagtaccatttaaatcatttttttcattgatttaggtgtctcactctgttttttaatcccttttgactgtgtgcgcgcttcataacagaggatggagatgtaaaataatttcattacagctctatttcatgagcgctaccgctggtgatcacaagtaaaccaagatatgaacacaattggtagctcaaggcagacctgatgcgagatattaagtactcaagtaacattggcatgtgccatgcgacatgattagctaacaagaactaacataatttagaccttctctagaacacaaatttgactggttttcatacaaactagttctaattccgtgaaaaaaatgccctatttctcccttcacaaataaggcatttgatacacaagacccagacggtgagctctttgatagctaaatagcaatttgacaatatactttaccttcgtttaaaactctttttttgttaagtataatattgtactccctccgtttcaggttataagacgttttgactttggtcaaagtcaaactactctaagcttgactaattttgtaaaaaaaagtaataatatttttaacccaaggctagtagttttatcaaaaattattaaattattgattaatgaaactatg

SEQ ID NO: 11921 - DNA, 5345 bp, Oryza sativa
  unsure (1)..(5345): unsure at all n locations
ccaaagtcaaaatatcttataacctaaaacaaagagagtagataactattttgaatcaaagtaaacaaagtgaatccaattttatggataacatgttactacctattttgataggtcacacacgtaccgagtctgagtcagcgtccgagcggctttggctaggagtccggatcagaattcgaatccgaatccgaaatagaatgagcgccccgcactataaatatatcaaccggcgatcgtataaggaatttggcatcgttgaatagcctcatcaccgtcgcagaccacccatcgcctgatctgcgcctgctgctacccatctgcttgctagccggggccgatcgatcgagaggcccaatcagtgatcagcttgcgagcatggcgacggacatggaggtggacgagatgcgccggtgccggcgatcgtcgggaggaagaggtgcgcggcggaggaccggaggatggagtcggatttgcggcaggaggcggagctccgtgcgaaggcgctcaaggacaacacgtggggggagatggtggcctgcgacgacccctggctgaaggagatcttgcggaggaggtgcgtgaacgcaatgcggacgagggccctccacgcccagatcaccaggctcatcgacgacatggatcgccgccatcgcaagttcttcctcacggggaacgaacaggtgctctggccgccctcccatgtgtactagtatcatggatgcatctcttctgtgcaattgttcatggttgaatcctttgttcctctgttccagattatccaataattctatgtgtaatcaagtaggtaattattattacggtgtagtagcaaacttttcaaggttttttttggccttagaatcataatagaatttactcagatgaagctgttggtgttgagatcggcaactgctaatacggccgaatcatcattctagcaagtcaagagagatttagaggcatggatgaacattactaatagtgctatcacataagtggtttaaagagaaattcagagtagtacatcactacatctcactataaaaaccaaccgtagcaatagctacttacacctgacctaaatgagagctcctagcgcgggattaagtgacgcacgcgggattaacgctagcacgtcatggaaaaaaaaaggggctgctagcacgcacgcacggcagccgctttcctttttctctctgatctcctattttggtgctttttggattttttttaaatctctttcttttttttctccacacgcgcgcataattttttttcaatattttacaaattcaatctttcacctttaatatcagtcgagagttttaaatttgagttgaatgtttattaaatttaagttgaatgttttaaattttgagatggaagttttcaaatttaagtcgaaggtgaaagtttttaaatttgagttaaaagttttcaaatcttgacttgattttttaaatttgagttaaaagttttcgaatccgagttgaaagttttcaagtctgaatagaaagttttcaagttcgagttgaaagtttcaaatcagagttgaaagttttcaagtctgaattgaaagttttcaaatccgagttgaaagtttttaaatctttaattgaaagttttcaaatctgagttgaaaaattcaaaaaatcttaagttgaaagttttaatcttgactcctatacatgtgcggtagtcaaaggcgaaaaaagaaaaaaaaacgtgacaacgccatatagtccatgggaaaaaaaagaaaaaaaggaataaaaaaacgtcacaacgccaataaaaaaaaagaaaaaagaaacatcgcgtctacacgggcctccgtttggcggcgtcgtaggcgcgtatgcgctagatagcttttccggacatgaatacctacctgaagctcaatcctctcactctttttttttcttttttgcttattcatctaaatactaacaagttgaataaactagatatcatgaccatccaaatgtgaaatgatattacaattaggcaaaaatcaacgacctcttccattcttcaatcaagaaaaaagaactgaatttcattctgccacaaaaatattgcattactgaactacaggcccaatactgaatgttggtgatatgggcctgggggtatcatgtttagagtgccccccaaggccacgtggccctcccccgaggggagtgaggccagaggtggggcggcggccactccttcccaaagactagtcagaggaggctgccccccaaggccacgtggccctcccacgaggggagtgaggcccgaggtggggcggcggctactccttcccaaagactagttagaggaagctgccccccaatgccacgtggctctcccccgaggggagtcaggcccgaggtggggtggcggccactcctacatagactagtcgaaggaggctgccccccaatgccacgcggccctcccccgaggggagtaggcccgaggtggggtggcggccactccctcccagagattggacggaggaggctgccccccaatgccacgtggccctcccccgagggggatcgggcctgaggtagggtggcggccactccctggccgagactagagggagaaggctgccccaggcgccacgtggccctccctcgaggggagatcgggcccgaggtcgggcggcgaccgccccctcccgtgactaggggtcggactcccccgaccccctctctaggtcaccacgtacggtgggttaggtgtccgcctccaggtgcccacctaccagcattaacggcgacccgagcggtcgcgccacgccgcatttaatgcggtgtgcagtgcactcaaccggtctgtgaccggtcgaatgactgatgggacccaggatgtcatgcgcaccatcgcgtgtgtcaggcgacgtgcagcccgacatatcccatcaaataatgatggtgagaggttctcatcctcttatcccagccggagtcggtcctcccattttggtcaaagcaaggctcccgtttcccggtgtaataggagcccagaagtcttcacccattaaatggtgactgacaggggcaccccccgtgtcaggcggcaagatttgataggccccatcatcaagacgacgtgcgcatggcttcccaagccaagagacaagacatgcatttaatgcaaagattataatacttctccaccggagctaggttaggttgttgggcccatgtggtaaccccttgaggtataaaaggaggtccaggcctagtggtggggggggacttccgagcgaactggcgcttgagtctcgcaaccccaggcacttgtgttctacacttgaccataatcccaaacacaggagtaggcccgaacctgtataaaccccttttgtctcatcgtctttggggattgaaccccctcaagatcacacagcttcgctcaccgaatccttgaatctcacccgctgccctcggccgaactcacaaaggggggcctcacggttccctggtggaggagttcattctccgacactgaaattcttatcgtcatcatgcgacggcccattactggcgagtaaataaaccagatatcatgaccatccaaatgtgaaatgatattacaattaggcgaaaatcaacgacctcttccattcttcaatcaagaaaaaagaactgaatcttattctgccacaaaaatattgcattactgaactacaggcccaatactgaaattcttatcgccgtcatgcgacggcacattactggcgagtaaatacgacggagagatctcccttttttatttctttctccggtcagtctcacgaataaataacaacaacgttgcgcttggacacacgagccagccatcatcgatccaaacctgataaagaacttgatcttgccgtcttggccatcttgctgtccctgtaaaatttgtcaattatgtgtgtgatgaagtgtgaacagcgcgttacattcgactgatcctgaaaataatcccccaaattaatatctgagctagtagctagctgcaatcgatcctgcaagctacaccagcggccaaaaaacgagccggattaaagccggtgcaattgcattgatgctcccaacgcccaatctgatcgacaatttgcactgcacgatcggctcaaatcagctcgtcagtcacactcgatgcgtaacagtgacagtgacatgtcactcctgtgtctgtgactctgtgtggctctctgtaaaaacgggatcgagagcgcgcgtgcgagcatgtgctcgtcgacggcggcggcgtcgcgaacgagtggatagggcggtgcgccgacgatctgatcgatccgcggctccgaccgcgacggacgtcgatttgggaggaaatgggttaatggaatggatgcacttgcagttacagttaagttaaccagagctttgctttatttgctctgctctgttttgtctgttcggtcactccgctggtccactaaatatcaccctttatcctgatcgattagttggatgggcacgaggaataactggtatgcttaaaaggtaccggtatttttttattgaccggtaaacagaatcaactctgtactcttcccatcaaaataaaggaattaacttcttactataaatttaaacatagaaagaaaatactagcaccgttataaaaaaagctatctactactccctccgccctaaaatataagtgtttttaattagatgagacacattctactatgtggatagattatcatacaaaacataaggcagcaagatcatttgaaccaagggactagggtagtacatagagaggaacggatcatgaagttaaccaagccataacaactttgtcacacataaatcgacgtatacattcaagacttcgggttggccatagcttcgttgaaacaaaagtagaaataacctaagtgagcaatagtttaactgattaggtttcttgtgatagaatttccctctgaatttctaaatgtttaaatttatagctgattattttttttattgctaggcaatgtaattgttgacaatgagatgtccgtgttgatttcatcaatattaagatataccaatccaatcttttaatatggtgtgcatatgtgtatttatagaagtgagtatatgaacgtttacgtttgtactgtgttctaaaaaatcgaaataaattttactacagtattaaaaaaaacttgtggttgtacgcacatatagcctagtcataccagccggcagtggctcgtcggcaaaaactccatcaaattttaatattgatgtgtaaattgatggtgaaatttatagagtaaatactatgaatccagttannnnnnnnnnnnnnnnnnnnnnnnnnnnnnn

SEQ ID NO: 11922 - DNA, 1925 bp, Oryza sativa
attttttttctcctttatttttcgttgacgaaagccagcagaaatgaaaaatgggtgagcagtgagctcatttattgtacaaaggaaaggaaaaaaaggggttgctttcctctaattttaaatttgatttatcatatttgcaatagcgtccaaggaccaagaccataaaacattcccttccttttttaaatgaggataacctaaaaaaaatgtcattgacaagcgtccaaatacaaaaaaatatcatcgataagtgtgagttctaaaaaataccattgtacaaacaattttatcaaaaatgtcatcgtcattatgattcctttcattccgctatgttaagtgtaataggacgaacaatgtatttaacagcgtagaatagacggaattttaacggtgatggtatttttaggataaaatcgtttgttcgatggtatttttttaaaacccacacgttgatggtatttcttagatttaaacgttcgtcaatggcattttttaattatctcttaattaaacctcatcaatcaaagtgttgtgttaagcatacatgtggatatgcaacgatgtccacatgcacgatcaaacagacatgtaactacagcatttactcctacacacatggataaatagacatgcaactattgcatttacttctgcataaataaacaaatagacaggttagatgatgatcaatttgaaaagatctcttaagagtgtggtcagaaggaggggttgggtacgtattattgcacaattaattaaatattagctattttttaaaaaaatagattaatatgattttttaaaacaactttcgtatagaatttttttaaaaaaacacaccatttagcagtttaaaaaacgtacacgcggaaaacaagataggtgagttaggaaaactgagataagaactctgtgcaaaggattaaaatgggatggagtactgctgtgcgcagtttcggtttccaattatggccaaacagagattatgacgagtgggaccctggataaggtgtcgcaggcgtggtggttggtggggccaggtccaatattttgttttttttttgcgaatattgggcctcattgggaccgttgcatgagtagaccatcttcttattctacatgggccaccgcataacccactaactaagtttcctgcaaagtgagctgtagccccgtgcactgtgccggcccatctcgtgtcagatggggccgtcagtcacgtgtacatccgaaagcgaattttttttatttttaatttttttattaaaagttttacaaaaataatttttcattttgaaaattgacagaagtggtcgcctaccgccctctgggagggcgatttttaaaaatcgccatcccagagggcggcgaaagtgacgtggcagacggccgttcgctctcgggcgacggccgtcaacgaaatttgcaggcggcccccttgccgccctccgctagggcgattttgtactgtgcggggggccgcctgcaaatgggcggcgagggggcctggaattttgcaggcggcccccttgccgccctgggggagggcgattttatactgtgctttatattttttataaatatcaatagttatcaaaattttttatattgaaaactatataagattaaaatctccaagactggtaaaatacaattttattattttttagggcctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttcaatcgaaatcaaacacaagtactattcaaattaccaaaatattggtagggcatgttttt

SEQ ID NO: 11923 - DNA, 1736 bp, Oryza sativa
gtcggtcagaatgcattgcattctcgtggtccttcaatcgttgatactctacttgtgtttctgactctgttatcttctggccatgatatgatggagtgacattgtcgatccatcgagtaaatccacccatccttggattgccatgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacctgccagcgatctctgcacccacactttggacgctcggaccatttatgtaaccctaatggattgttcctccagtctaagcttgcaatttccacccgacgttcgtactccatccaagcatgaatgaactgtatggtcggttcaggttgcattatcggcccgccacttgaagtaactctgactgtgtcaatccattgtacgaaagtgtgttgtcgtgagcataagttgttctagcaccatatgaatgaaaagaactatgtagaggagacaaacacaagtagtactgcagtagtaatagcaaaagtagtactgctttacaagtttataagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtaccgaagatcccggctgcaaatcctgctggacaaggaccatcagtttcatacatgtatttaatagtattaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgcagttaaaacatggtgacatattcgtgcaaaagctgaaacaaaaatgaactaatctctgggctgaactgtaccgtgcgaaaccggtgctgtaggtcgcactgctccgaagctaggggcgctcgaaggcaaacgaggtcctgtgaggatggaacatcaagttacgacggggtgatgttttcgtacaaaaacataaacaaaacttaagaaacctctgggctgagcagtaccgtgcgaaacaggtgccgtaggtcgaggtcctgctccgacggtaggcgcgtgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaactaatacaaattcgacgta

SEQ ID NO: 11924 - DNA, 771 bp, Oryza sativa
tcttctgtgtacggctcccagatgacgtcgctcggctggagacggtcaaactcgaacacgaagtccgggtaacctcgtctcacctggacgtgagcgtaacgacgctgcaataaacatgatcggaattagacatgttatgtgaagaaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctcaagcaacatagggcagccagcgataatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcttacaattaaaaatgaaatgttagtacaaaacactctgttgatcgcaaataagcatgtctgataataacaacttatttacttacagtgaactggagcaaccaagccttgctaggcccgactgtagagtacggaggaagggtgttggccggtcggggatcctctag

SEQ ID NO: 11925 - DNA, 756 bp, Oryza sativa
ccgaatccttgatctcacccgctgcccccagccgaactcacaaaggggggcctcacagttccctggtggaggagttcattctccgacatctggcgcgccaggtagggtgtgtgttcgtgatttttgaggttctttcgagcgccggcgcgacgagcgtcacaccgccgatgcgggggaaggcgcagcctcctcgggagagccgcgccaccctaggcagggggctaggcctcccacttcctcaccggaaaaggctagcggccaggcctttgtggcgagtcttcggaatgtccgatggcccctaaagttccgacccagcctcaccgagaagtacgacggcggcgtcaacccctccgagtccctccagatctgcacgacgatcatagaggcggcggggggtgatgaccagatcatggggagcttcttccccatgaccctcaggggccaagcgcggggttggctcatgaacctgctgcctgcctcggtctactcttgggaggactcttgcagttgagctccgggtgccgtcgaagcccgggaccccctgtgctggttcttccgtagcggctagctttggtcccgccggctggctatggtgcccggcccggctcaactaatcgtcctttcaaccttcaagtattttcaatttttcaattcatcagcttaatacagcttgaagtcttatatttcttttcccccattcttttctcatggccctgtgacgctcgggggatcctaaagagtcgacctgcaggcatg

SEQ ID NO: 11926 - DNA, 270 bp, Oryza sativa
  unsure (1)..(270): unsure at all n locations
nnnnnnnnnnnnnnnnnnnnnnnnnnnnnncaactcctgaatcaagactgagctgattgacttctcaccggccgataaatataacctaaacggtattcctttctgtggaggaataaaaacatgaggagagctaagatattccttaatattatccaaagccttttgctgctctgcccccaagtaaactgctgaacggctttcaatctcaacaatagtgtaaaaggttctaaccttccagacaaattagaaataaaccttctaacaaaattt

SEQ ID NO: 11927 - DNA, 685 bp, Oryza sativa
gggagagagtcggtataattgttgatgaaatgagagggaagattcggataatgagaaagcggacgacgacgcatcatccgatgaggaaggtgatgtaatggccactgattgggcaaatgaggacttctctggacttgttatatcagagggtgatcatgtaccctgggagtataaggagaacgaggtaatttgagggtgcaaggtatgctcataaggaatgagatgaaggaggcggtgaagcattgggcagttttccttgcagagagagtttagggtggtcaagtcaacaaattatgtgtatgaagtgaggtgcatgaaggaagattgtccgtggcggtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagattattgagatgaggtatggcacatttgaagcttcttatgataatttgcctcgtttgttagccaccattgcccagaggaataataatacttactatgacctaca

SEQ ID NO: 11928 - DNA, 217 bp, Oryza sativa
cccaacaatgaacagatggggaaaaaaattcacagccccttctcgaaatcgagcagaatccgatccaccaccggagacgggttgggggaagttacctgcggcgcggccgggccggtctctgcgtccattgcgctcccccccccccacccaccgtgacgacgggctgcaccgggaagcaagcagccccagatcaaatcagatcaaatcaaaaccaaat

SEQ ID NO: 11929 - DNA, 265 bp, Oryza sativa
tatcccctctgcgagatgatcttggtcaactgacacaaaaagttgtgcctacatctaagaaatgggaaacaaatgcaaacacaggaaatgggcaagaaagatatgaaggggttgcggcttaaagggggaaatctgatgctaaaaaaaagaaagcttgtgataccaagaggccaaaaagcagaaatgatgtcagcgcagctttgaaaaatgagattgatatagaaacacctgctgagcaaaagatcggattggaagctctcaacat

SEQ ID NO: 11930 - DNA, 1529 bp, Oryza sativa
ccgccctccgctagggcaattttgtactgtgcggggggccgcctgcaaatgggcggggagggggcatggaattttggaggcggcccccttgccgccctgggggagggcgatttttgcctcccccctataaagcccagtcccccctctctgaaatttcattatattcactaaaaatccaaaaaaaacgaaagagagagaggagagggcagcagaaggggagcggcgaagccctgctggttcgctcacttcatcacaggtttgctcccatacatcttttgcatttgtactaatatgttatgtttgagtatatatgttgcgttttagttttagttccatatattttagcatatctgtagtacacagcacatatgtgtagatccagagcatagaatataatagtatgaattgagacatagacagtagtgttaattgtaagatatagtttagtttgatctggagaatgtaacctacttttagaattttggagaacaatattgtagagaatgtaacttagggcgtagtacagaaatgcgaggttaacgcagttattgttttcatcaggcacaatgtcaaataaggtcacatttcagatagttcacggtgaaggaaatattagatttggtccagatggtgttgatctgtcagattttgtaatgacatctaagggtatcgataggcctgcggagaaaacatttcagtcaatttatagttggttgttgagaggatttagaatagaccaagaagtctacacaatgtcagtatcagttgtagtgagtcgtgcaacagaaggttatttttgggaactaatgccgatggacagcactgctgcttggagacggtatgtggaaatggcttttgaacggtcatggcccctcgttatatttgtgtcggtacaagagaaagatataaatgtttcaatgcaaaccgaagatgtagagggtcctatcaatgcaagggatgttgttggaccatcgatgcaaaatgaggaaaatcaaccaagggaggagcaggccatgggcatggcggatgagggggagagagtcggtataattgttgatgaaatggagagggaagattcggataatgaggaagcggacgacgacgcatcatccgatgaggaaggtgatgtaatggccactgattgggcaaatgaggacttctctggacttgttatatcagagggtgatcatgtaccctgggagtataaggagaacgaggtaattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacatggggatcctc

SEQ ID NO: 11931 - DNA, 368 bp, Oryza sativa
catgtaggtgtatttggtgggcttgtctagccaagtgtgatgagctttctcaagtcctaaaccaagagagaagtgggcatgtccaataggagtgagtgacatcttgtgggtatgtccggggatgtcctttggagtgtgagccctttatccttgacttaagttgtgtttcttggatggtttttttcatgggttggatggccctttgaataatctttccatagagtccaagaacgccaaattccgagacccgagtcaagagatatcaccgttttactaacggtcggttaagctgaaaagtgacctgcggtctgaccatgggccttaggccggtctgaccgggcctgttagccggtctgaccggcatgata

SEQ ID NO: 11932 - DNA, 339 bp, Oryza sativa
caagtgcatttcccttgcatgcccagcgctctttgagcggagaaagattcaaagggagttgaggggtgtttcagaatcagcaatagaagctgggtattatcccttctgttgccagaactcttctgaatttgcttttttttttgttcatatccctgtatatgctgtaaatttgtaacatgtacaatcaagtgtatttattttgttgtaacattgtacaattgtataacatgtgttgagcaaagaaatttaatgtataataatgcaaatcctcgagggaatttggacagagtccttcgctgtttgtaggtgcttcagtctggaccatccccccccccctat

SEQ ID NO: 11933 - DNA, 563 bp, Oryza sativa
aatatgctttcagatttacttacattaggatatttcgatccagaaaggtcggtagctcaattccatctatgtgataatgtaaaataccttgtccatttggtacaagaccaaataaaaatattgttcttataatcggtatggatggaaggtgagttaaattatgataatattttctcaactttttctttcttagtttagatgaaaaaaaatctgacctctaatgtttgtgcagtttttaccggtgtcagtttgatccagtaaacggtggagaaatgaaacagcttgagtacacgaattttttaaatatgtagggatgatgatctgttcaaaatcagaatatgtattgatattatcatagttgacagagaagttatcatttttttcacttgtcttatttcgatttggagtttaaaagatatttttgccttcatagatttgatttatttgggtatatagtgtcatcggattattctctttatagtgtagtgacacgataatatacaataatacttagcacactttgaatcaaacttaaatctcctaaactgattgatttaatttta

SEQ ID NO: 11934 - DNA, 478 bp, Oryza sativa
ctcacaaaaaagtgaaatcaagaaaaatgacaacagcaacgccttcagctccctaataccagagaagttaaagaatcatagggatttcaactttttcttcttcgatgctttttgggacttggaatctttagcagcctgcatcccggaatcgttcatcagtattttccaccaagcaaaaatatgtaaaactaaaaatattcaaactattttccacggtatagctatgtgtggctgtgctattatgaacggagtatgtccatctggtaagccaagaaggcagtacttagaccctgatttttaccaagtagactatgcaatgacagtaacccagaagcttagtctcctgattctcctctttcttgtgaaggaaaactagtaaaagggtattacagtattattacctttagatttttctttttatttttcttctttttcttgctctgttctcctccgttttgaaaactcttatccttctgag

SEQ ID NO: 11935 - DNA, 591 bp, Oryza sativa
tatatcctatgtatgtcacaaatcgaaatcaaacaagaatttcaggcataatgtgactttcaggagctaaaggcatgcgcacataccgatctggggatcaccagtgttggcatcaatattccccagcagaccattaattcttgcagtctcaagctcatggtggcagctgcaaattttccatggagatatgacactgcctctgtaagctaccttgaatgacgttagggaagcaagaaactaacctatgtccagatagagtagcgtggttgcattcaacatttatcttgaattctcctgtatatggtgaaaaagaatgtactttagattatttcacaatacacggttaactccagacagacagcagtaaataaaattgttcaaaacactaatggtgttaatacatgaattcctgaaatccaaataacagttcaactttcgaaatcactgtaacccaataacaaactacatatgtacctgttagaccatatttctgtaggaaagagaatgtggttgcaacatcccaatcgtacctgggagaggacaaacaagggttaggattgtttaatcctgtgacattttgttaatgtaaac

SEQ ID NO: 11936 - DNA, 274 bp, Oryza sativa
cagcctcccagaaaatgcacttttgtagacgtacaggggtgatgtactcaagtctccatagaccacaccaaagctctgaaatgctagcagagagatagttctgcaataacttttccattggtcctgcaaaagcacaatcatcagtacgccgaccctgtgattgtgaatagtaactattactgagaacgatcagtacagtccagtagtaaaacaagagagaaagcagatattggtagctgggcatgtattaaacagattattaatttgatattgg

SEQ ID NO: 11937 - DNA, 214 bp, Oryza sativa
  unsure (1)..(214): unsure at all n locations
caaaactctaatcaaacgtggagttaaagagggacacacggtagttgttggtgaggtatatattcctatgtcataaacaaaacattggacagtcatcacacaaataaaattatcagatttctaagttaataatttctgcagatggaaatggtttggacannnnnnnnnnnnnnnnnnnnnnnnnnnnnnnnnnnnnnnnnnnnnnnnnnnnnnn

SEQ ID NO: 11938 - DNA, 928 bp, Oryza sativa
  unsure (1)..(928): unsure at all n locations
nnnnnnnnnnnnnnnnnnnnnnnnnnnnnnnnnnnnnnnnnnagatcatcaaccatgagtaccgtagccttggctccaaagaaaaaaaccaaattaagaaaactcaaccacaaccaactgatatgccgactgatgatctacctgccttggatccatctattgaacaagctttagatgaagaggaaattggtgaagatgttgaccaagctatagccgaaatgagtgacacagaaagaacaccatcggcttcacccaagcaaacgcctccaactccttctgcccccgttcattttacaagagtaagtacctctctctgacttcttctgaaattacctccctcttcggctaattacccatagactttgtagttgcagaagaagaaaactgctgtgaagaaaaaaccagcagcaacaattgttaaatcggctccaccagtaagatgtccttaattcttttacttaatcaatctcaaccgattctatataacacttgtctatttcgcagcctcctcctccttctcctcctgtacagcaatcatcaagtgatcagactccatcggctgtggggagtcatcacgtcgaagaggaagaacaaccagctgctcctgctatcccagtaagtttccctttgtctccacaattagattggctataatttacccagctcttattctttccgaaattgtctctgcatgctctagccgatctcttctcttttgacatcagagattaccttgatgaggcagaagaagacacttcaagcaaagccctagctcccctatccgatgatgtgagaaaaacacttgaagacatctctcatcggctagaagcctcttctttagacagtttggtagttgactgtgggtcaattaggacacagatgcatgaagttcaatctctgattcccgaagatttggctgatgtcctaa

SEQ ID NO: 11939 - DNA, 1210 bp, Oryza sativa
cagcacaattcaacacctccggtgagtaaaatgtctattgtaaaccaaagctcttcttccaaagaaacctgcaaggatcagaacttaaaggaaacaagtcaaagttaacaaagtctgaagaaccgtttgccatgacagattcaaaatcaataaaagttgcacattctaatcaaacttcacgcaatctaaataatgagctatttgaggacagcacaccttttgctgttaaaagtggtatgtctgaaccacctgaaaatcgatcttctgaacaagctttggatttggctgaacctgcctccagtgatttggcctactttcagactacagctgtaacttcaagctcctcaaaggcttccggctctcagagaaggaaacaaaacttccacgttgcaaaaacttcaccaattgagtctgtctcttcatcaccacctagaatctctaacaatgacaaggtctcccatgacaaaatactgggaaaggaggatctacatgtgctaatacaaacaacatgcagagcttggtaaagaatactgaagttatagtagataatgtcggcaggccaggaagtcacatgagagcatgcttgctagtgaacctgttatgaatggtttttcacaagggaactctgataaagataatgaattgcctcagttaactcaaggccatgcttccaatgggattattcggggaaggagtttggatgatgatctgcagcatgcatctgggaggaaagattcttctttgaaaagctccaatgcagctagaagtcatacccacttgcattatgttaataaaaataacttgcttactgatggctcttcaatccaacataggatggcagtcttggatactaaaggtgattccatggtacatgaaaacaagagaagtgttacttctctccaagacagaaatggatcaactcattacccaccagatggaaatccccaatcagaggtgtcattcggaaaagaaaagtcacatcccaagagcaacaagcatgatatgcagaattccaaagcccaaatgctccctcacctctgaaagaaagtaaagtggaatcccactccgctccattaagatctaatgcatcaaaattgacagcacagttaaagcggggcaatgttgaaaatggagggcaacatggcattacaaaacaagcaatttctaatcctgcagacacttccagtccagttaggaaggataataactc

SEQ ID NO: 11940 - DNA, 602 bp, Oryza sativa
cttcttcaaggctaacaacatcaaacactttgaatgtaaatggacatgttgaacaaagtaggaaaaggaagaaatactctgagtgacggaaatgtttcctttgatgtttctcagcaaatgcaaggttcggtttatccactgagcaaccaacatgctcctattagaagtaaaagtgctgctgatagtatccagtttcctgttgaaagagattctaaatcagttgaccatttcgttgagaagaaaaggtccaagagcaagaatcatggtagctcttctgatggggggttctgtctactgtttttccttcaattctcctagtttggtttcccgtatgaattcactctagttgcatcatttggttatgtttcttttctgaaactttcttttattcaaatacaggccatctcgtgaaaagatccaagaagcattcaaaagtaaaaagcaagagagagatggatcatgatgaatacagaacttctaggaaaattaagaaagaggagcggcgccagcgccagtctggcatagattctaaccctggatatgatttagctagtggagacgttcctgatgaggccaaagctttgccttcaaaatcgatggcc

SEQ ID NO: 11941 - DNA, 621 bp, Oryza sativa
atgtgctattgaagtttcccacacccaaaatgaatcacagtataaagatttgattagtttagcgtatatgttctctgctccatagttctctccaatgtagctataaactttttcgttgtctgctaaacagtcttattccacaatttgctcttcacagaaacccttttcttttcatgttttcattaacttcttccttttcaagttaatttagtgatacgggaaaaaacttgacttgtgcagggttgtgatcggatatgatgaagggacaataatgataaaaattggccgtgaagttcctgttgctagcatggacagcagtggaaaaatcatatgggcaaaacataatgaaatccaaactgttaatatcaagaactattggtgcagaaccaatgagggtttttcttgttcaccatgctaatatgttgaaaacttgaataactttcttatacgtcttggttactaacctgttccattttttcagattgcagatgggtggaagcgcttacccttggtctggaaaggaagttgggaaaccctgtgatcttttatccacaaagtaagttcatatttgctattcaaacgaatgcatcattcgcataattgatgttttccaatagaacc

SEQ ID NO: 11942 - DNA, 583 bp, Oryza sativa
ttatatacaatggtttaagatgccgattctctgtcccctcgggtttctcgaacactgcctattctggtgacaaccaacttagccgattcctcctccacctcgtcgacatcggcgtgatcgatcccgaattctgctggcagggtaaagaccatgttaaccggtgccgtcacaacactcttcccttttgccaacctctttgcctcatcggctgcaacatcatcagctacaggaacctgattcttaacacgccactcctgccttggctttgctttcttcagccgatgatttatttcttgttcaacctcctgaaggcgctccctgttactcaatctttgaacccttctcttctgattcttcttgaaaataccagaaggacaccattgattcttcctgattacattgtcctcttggccatgatcttgatttactggacccaatctttgatgaacagaaactcttgtctgccttagccgattacccctattatatgatcggcttgagttctcgacgatgtcactacacccagggcagttttcaatagatggcaacctcataccttcattccagtagaatctaaagaact

SEQ ID NO: 11943 - DNA, 709 bp, Oryza sativa
catgcctgcaggtcgactctgagaggatccccgatttacgcgagaattttggaggaattgaactgtcctgtgaaaattctgtaaaattcctacattccgaagatggctaggttccttgtggtggaaccagtccacctgggttcaaatcctagatttgacacgggtgctcgcatttacggttaattattcttttagtaatagaccatgtacctatcaacagcgatgcgtctgtggtaactttgttaatctcaagatacgttgacttagtcttccggaggtgctcatatggatagggtgtgtgtgcgtttatagggatgagtgtgcgcacgttatgggcacctacattcatactatgtttctaaaaagaagttgatggagaaaaaaaatggtgcactgaatgcggtcgtattggctttgtattttggtgttgagtcccttccatacaagaactaatggacacttcttttgcagtttcaaaccaatgttgcattgttcaacatacactgttttagtcccatctgttgcaagaaccaatgcagatcactgctgcagcaactgaagcatccgaaggggttagccatatccatcaaaccatcagcatcactatcacagtaacagttcagagcatcttcagaggcatctcctaatcctagctatatatgctccttttctagctgaaaattggtggggaacacgatgaccacgacgc

SEQ ID NO: 11944 - DNA, 360 bp, Oryza sativa
agatgctgtagccgataatgattctaagccgatgacgtctttaccaattacaaaatttcactgttaacaacgacatctaaagattacggtatttgttagtagacatcgtaaaaacgagattttgcttttagtatcccagaaacttggtaattagctactggacattaccagcaacaaaataatatatacagccaggagaggagagacatgttgtgtgaaatgtcatttatacccttttcttcttgtaccattatcttcaagttcctcttctgttcttccactgagcatcaagcagtactccacggccctcttccaggaaattgtcaaacattctcggtgagcatcggccaccacacacac

SEQ ID NO: 11945 - DNA, 709 bp, Oryza sativa
  unsure (1)..(709): unsure at all n locations
ctatagggcgaattcgagctcggtacccatgatgacgataagaatttcagtgtcggagaatgaactcctccaccagggaaccgtgaggcccccctttgtgagttcggccgagggcagcgggtgagattcaaggattcggtgagcgaagctgtgtgatcttgagggggttcaatccccaaagacgatgagacaaaaggggtttatacaggttcgggcctactcctgtgtttgggattatggtcaagtgtagaacacaagtgcctggggttgcgagactcaagcgccagttcgctcggaagtccccccccaccactaggcctggacctccttttatacctcaaggggttaccacatgggcccaacaacctaacctagctccggtggagaagtattataatctttgcattaaatgcatgtcttgtctcttggcttgggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11946 - DNA, 1497 bp, Oryza sativa
acttaaattttttaaataagacgaatggtcaaacacatactaaaaagtcaacagtgtcaaacattttgaaacggagggagtatataggtatagcaggacaatcgagcagctagctagcatacagatatcagtagtatttttcctcttgcatccttttctttttctgaagaagaatagatatcatcatcgacttgtttgtctttttttttttgaaacttcatcgacttgtttgtcaatggaatgcacagcaacatgcatcgatcgtcaaatccgtagtttcgtaaccaatcatcaaattaatcaaatcatgcatcgatgtgcaattgtgtatagttactccatttacgaggtagtactccaattaggactagtagtgcttttaactgtttttatcttcgttatgagtcatgaccgtggataagttcaattcacattttaaatcgatggattttcatcggtctctcctcgaggtgacaaattatgagcaaattgcagacgagagaagctagggtcttttgacagagagtgaaaaacggcaaccctggaattctcattttctcctcgtatttgtcaacctcccggtttttctacctcgtatggtatcacctatccaaacctccttaattttttactcagtagtagatagatagatgatcttagtaactgaagtggatttactgacttaactctagtgtttactcttgttcgtctgaaactaggaatatcatacagccgccgcagtacaaaactgagttaaaaaacgcacgcctacgtagaacaaaactgcactggtaaagtgggccacttgaatagataaagaaatggcccagctagtcctaatgactgaacgggaaagtccatttgacgtccctcaactatggtttgtctaggttagtccactattacagcccacaatgccttctttgaactgggctggtctttacattctccaaacacaaaaaactagtgaaagtttcgaagttgggggtatgtttttttagataatagttagggatatgttttagctgaatgaatggtgattgatactccaaaattgtatgtgctgtggtcatgacttggacaaattcgaggttgcttaaaaaaagacagggaaaatcagtgtttggcagaaatagtgtgaattcaagactcaggccttgtttagttcgcgaaaaaaaaaattttgggtgttacatcggacgtttgaccggatgtcggaaggggttttcagatacgaatgaaaaaaactaatttcataactcgcctggaaaccaagagacgaatttattaaacctaattaatctgttattagcatatgtgggttactgtagcatttatgggtaatcatggactaattaggctcaaaagattcatctcgcgattttcatgcaaactgtgcaattagtttttcattttatctatatttaatgctccatgcatgtgtccgaagattcgatgtgatgtttttcggaaaaaaattttgggaactaaacaagg

SEQ ID NO: 11947 - DNA, 207 bp, Oryza sativa
  unsure (1)..(207): unsure at all n locations
gctggctttgcatggtcatgggggccattgacattcttggtcccaactgagatatgtccacttgagatcagatcagcagggcagagtattgttgttgcagtggtcttcctgatgacatttgtgattggacagacattccttgcagttctatgccgcatcaagtcannnnnnnnnnnnnnnnnnnnnnnnnnnnnnnnnnnnnnnnnn

SEQ ID NO: 11948 - DNA, 1226 bp, Oryza sativa
  unsure (1)..(1226): unsure at all n locations
ctgccagggtggttttatagcatgcaggtattctattctaaggcatgtccatattatctggcaaggaagaactgctcatagtgcatattaaactgtggaaatgaatcatagatgccttgaaataaaggacttcataaaatacctgagacaaaacctacttgataatatgtaaacagtagcggcatgctcatcacggccaacaggaaatgttagaacaaatgcttggatgacttcaaacattttccatatctgttgctgtcctgagtaacttatgggcatcggcgattatagtttaggaattacgctaagtgcttaacttttgatgttaatagatgctctggacaccacataatattatttatcagggtcttggttatgaaatttgcacttcagagcctcatgcttataaactcaataaatagaagttctcttgaattagcctctcttgataatacttcatgccataatctctgcattttggatgcatgccataatctgtctttacaatttccaatcttatgacgaataataatttgaaatttgtttgcagtacccgatggaagaggctgattcaatcgcgaggtcgttccttcatattttcaactgctttaccagtgccagtagttgcttctgtgtatggtaatactctacacattgtgttctaataatttaaaatattgatatgggaatctggtattgattgctacatatacctgtttgtgttacactgttttcacgaggaagggcatagaaaaccttctctatcacattaatccatagaaggacgaatttaaataaaacattaactaacgtaaaaattatctcattgtcaaagtaaatatcaggaattcttctaaacagaatcaattaatttcagctgccctctatgtatcaagggaggagagatggcggagatcagtgatctggaggcatgtgcagtattttgcctctttgacaaaactcaacataacaagtcccataatttccattgtagttggaagtgaaaaagcagcacttagagctggaaggttctcacttcctcccatttttgtttcttgataatatcagtagttgtgtgttctaatcttttcattttgaaactgcagggatatgctaagatctggatttcatgtcacgccaatccgaccacccacagtaccgcccaactcatgnnnnnnnnnnnnnnnnnnnnnnnnnnnnnnnnnnnnnnnnnnnnnnnnnnnnnn

SEQ ID NO: 11949 - DNA, 499 bp, Oryza sativa
cttcgagctctgcatcagcctcggcattctcttcgcaaatgttcttaactattgcgttgtgaaaatcacagctggatggggctggaggatatccctatccatggctgcagttcctgctgcattcctaaccatcggtgcggtcttcctcccagagacaccgagcttcataatcgaacgcgatggcgacactgacaaggcaaggatcctactccagagacttcgtggcaccacttcagtccagaaagagcttgatgacttagttgctgctagcaacctctccaggacagttcagtatccgttcaggaatatattcaagaggaaatacaggccacagcttgtcatagcactcctggtccctttcttcaaccagcttactggaatcaatgtgatgaacttctatgcaccggttatgttcaggacgattggtctgaaggagagcgcgtctctcctatcctcagtggtcaatcgactctgcgcaactttcgccaatatcatggcg

SEQ ID NO: 11950 - DNA, 756 bp, Oryza sativa
ccattgcagatatacttccatttattcaacatgtgcacatgaactttaagcaattgctattgtatacagcttgctagtacataattaattttcgttttacataatttactatacattatcttaaaaaaatcaagcatacaatttttctcttaatatatgtgaatgatgagggtataagtgtcatttatcaaaagagttattggttcaaggataaatttgaactaaaatgaaaacttgaaggactaatatggatagattgaaacatcaaggactaaactgaggcttagatgaaacttggaggactacttgagctattcaccctaaaaaaaatagtggtaaccatatttgcacccaacacctcccacggagagctaacgagattgaaataatattgaagaaaatccttaccttcagacaatttgttagcattggagttatcaggatccatggagtcctccaatggaatcctagacttgtctgtttcgtttatgtgaaggaatattaattaatgtatgtctggatttctagttagagaagcaaattgtttggcaatgctacagcaacctacagaagatgatttaaagatgcttctgtctaaccagaaatcaaagatagcaagtagataatatttcatatgctctatcttagcctgaatatagggctggaagaggctcccttcttttctgaacagaatgcacaattattctactcttcgtgaaacaaaaaccaaacattattatcagaatctttggagag

SEQ ID NO: 11951 - DNA, 710 bp, Oryza sativa
tgattcataaaaatttaaaacttaaaacgtttatatttatagataaagagagtagcacatgctgtatatgtggtgcgcgtgcagtgtgtccacatgcatgcatgagcatgacggcaacacggcatgcatgcaacgcatacaggcaggcagcttaattggtcgacggatggtcaatggatggatcgatggaaccatccagcacaagtgccctcgcgtccaagttactccaatttgtcattactagtatcacgtacacggtccaatcgattgattcttgtcaactcgatcgatcgatcgatctcatgggccaagctatctatctattctagtattagtcttccaaaacataatgaatcattgattgattgattgattggtcgatgcctccatggatcatactagtatacttctttcttaaaaaaaaaaactagacctattacttttatcgtcaagattaaaaagaaattaacttattttatacgtgacaaaaattaaagagtatatatatcaagatgactcatcgagttctggtctcaaatatttgatttgtcctttcatttaaatcttatatgcatagagactctaaatcttgtggaggaagctaagtatgggagaagatggtggaattgctaatattgatgacatgaaattgcacgtacactacgtgcatccgttcgtgcagcgggccacgtacgcgccgacgtggcgag

SEQ ID NO: 11952 - DNA, 609 bp, Oryza sativa
caaaaggactaaaattttcgtccttttttgctgttaaaataatttaattttttattattattcttttcaaatacatatgcattttataagaaaaataaaccccctctataaataaacagagaagaggagtgggagcagtagtctcctccaaaccgtcgagagcccaacaataataatccccccttttcatcgcggcgacgatacccgccattttcatctcattctcaccaccaaaagcgaccacgcagcgaccggccaccgatcgagatggagcagcatgaggaggcagcggagaggaagccttcgccgccggtgatattccggctgttcggcgtcgaggtccgcggcggcggcggcggagttgacgaggaggagtacgaggaggaggaggtggagggtggattgttcatcaagaagagctccagtatgcccaacctcacctccatcgacccgctgccggtgccggccgacggcggcaaacggcgcgcctccgacgactccgagctcgcctccggccagcagaagcgccgccgccgcaaggtgcaggagaggaagaaaggtgagcaaccaccctttttgtctgttcttgtatctactgttcattacttg

SEQ ID NO: 11953 - DNA, 824 bp, Oryza sativa
ctgtggcctgtatttcctcttgaatatattcctgaacggatactgaactgtcctggagaggttgctagcagcaactaagtcatcaagctctttctggactgaagtggtgccacgaagtctctggagtaggatccttgccttgtcagtgtcgccatcgcgttcgattatgaagctcggtgtctctgggaggaagaccgcaccgatggttaggaatgcagcaggaactgcagccatggatagggatatcctccagccccatccagctgtgattttcacaacgcaatagttaagaacatttgcgaagagaatgccgaggctgatgcagagctcgaagccgttattgatcgccccacggtatcgtggaggcgccatttctgacaggtacagtgggattgactgcaaaatatagtttcatagcaaaggcgtcagtacagttaccactgtcctttgggaaggaggaaactattgttaagaaagaacaaatgcaaaaattagagtctaggattaggagtatgcatcagaaggaaaattatgtgcataatgaagtttagttacaaagtggaatcccttttctatgttatctgaaaatcttgattgcaagattgggctttatctccggatctcccttgtcttgcacagtgtgagattggatcagtgaacagtcactgtttttctcataagccattctaattcctatctaggcagtaaatcgccaagtttttagaccacgacatagtttgttgctttccctctgcgttgtatctccacacaatatttcaacactgtccctctccaaaacagagattcaacaggctgtaaaaact

SEQ ID NO: 11954 - DNA, 5643 bp, Oryza sativa
  unsure (1)..(5643): unsure at all n locations
nnnnnnnnnnnnnnnnnnnnnnnnnnnnnnnnnnnnnnnnnnnnnnnnnnnnnnnnnnnnnnnnnnnnnnnnnntaaacctgacttggccgagctgaaagtgtgttcatcgttcacttcaatttagtttacttccaagtgcaatctgcctatctatctagctactactcctagattgttagaccagtgatcaagtagtcgatcaaactgttgatctgtttgaaatcctcatacttaaactggcaacttgtgcttgattttgctttccatgcatggacctagtcatgcatcactgatcgctaagtcaaaagatcaaaatctcgataccaagttaggaatattcttggagattgtacatatagaaaaatggagaagatatgaacaggtactgaatagtgatttctttgatcaatgtgcctggcaattaggaaggaaaaaggagtcaggctaacatgtcaaatggccatacatatattcagctcacaattaattaatttattacaagatactttactctgatttttccatgcatggacttcattggccgacctttttttaaggagtcctaatttttgttggggtccaagctaagaggcaacaagaggtcctgattttccctaaagtgtcacatgagtgttgagcactgtcatatggtgaagcatctaatgatggcaagtaaaagccattgcatcagcatctgttgcattcatatgatgagctttctttctttccaacactccacacaaatgttgcattcatatgcctgatctactctattacttaccttgttgcagagatttatgcatcaagtttaagacacaattgcactaattaattgaggccatgttggctgctttattccttacttgttgccacagcacagtgctagctaggcagcagtccttgctctagactttttccttttcttttttttccccttgatgaaagcaaccaagctagctagtcaattaccaaaaggaaaaatatgcacccttttgtttgttgcctagtcattgttaacacactttgagttgagcacggttgcttctttttaatttttttctagaggcctacatttttttgctaaatagttcgcctattttcttatagaaaaatttcagcatcgtcagatcgattgagattcatacgtttctaaactaccttgacggaattgagtcaagctaattggctacatttctagatgagaattaatagttagtagttgaatatattgtagtcactagctagctgctaatatatatgacttgtacatataccacaaataatatttctttccttataaacaagacatgtcatgcatatttttcatcccttcagtatatttgctttgcaaattgaagtgtcacttatgcatttgttatcttttttcccccatgttaaatatgcatcatattgcatcccggtcattgcattgcattgcaccctactactagtaataagtaggccatgatgagcttgtgatcacaactttgcaaccaacacacacattcatagattttccttttcttttctttgccttttttttccctttgcattcatgagtagtgctttctagctaggacctctactgtacatgtattttcctaattaataattcatgtatgcagattgccgtcgcttccgtgcgatatctcacagaaaaggatcgcaaagtgccaaagcaggtcagcgtctaactagatgacaagccacaaaatgcactacttgcaccatatgggctaatttacaagataattttgtaccatgaaatctgttaatcttgccataatcaagccctagttggcagattaattagggggctcacccaatgaaagatatgattaatttagtctcagtaaccaactaattaattgtcgttagctgagacaggagacaaactaacaaacactgatcgcgtcctgattaagacaacccatttttgaagctcattccttactccaatttctcgagacaatagacaagtaggcatgtaagtgactctaattgcatgcagttcttcaacttatttagaacgtgggggaatttgcatgaattgtttttccatgtagagctgtcttactattggcacacagagatcggacctaccggccggccaacgactagctagctagcgagtgtttcacctgttttcagctggaaaaatggacgtgatgtgcgtatcaattcaaaggagatgctctctccggtcatgcaaacaaattgtcttaaggtatagtatggtctttgatatatagtcaataatttatgatatagcatatttgttaaaccaaataaaacttactactagagtatgctaatttcaagacagttttaacaatgtgattttcatgtatccaattaaaatattttaagaagatgtgaaatgaccgtagcttaactagttaggctccttatgattgaatctgtttacccggatttaatttttgggcttggcatcggtgctcgtgctcgcgtttatgattaatcacttttttattggtacatgacacccattgacaacggtttttggacgtgttcataggatagtgtaagaatatatttaagaagatatttacgcatgcttgagatttataaatgttctattatagaagtgcgccctaagccacaagctatcggaaatcaaaatcatgcatagccggatcttcagcagagtcgtgtcacctgttttgatcgttcgaatggtctaaaatattggacggctaacaaccttctttgcttaatcttgcccccatggtcttaattaatctttgcccagaacgattaggtcctggaaactaggattaacaaaactttaattgcagtgaggatcaagaaaaaaaaaaatctccctgtataattttcggttttgagaggtattccgtaccaatcaacgtcgataagatcaaaaatcgaaagaaaagcgaaattaaatatggcacacgagggtgacagccgtgcactgtccaggcgcgtacacgtcgctcgcgtacgtactttgtgtgcagtagcagttggtactcctgcacagtgtacgcgcgcgcgacatctgtacactacgtacacgtttacgtatacgtgtatatgcttgtcgtccacgtaggcaacctccgctactcggtctctaagagcttacaatagcagtctataaaccagctataaacatattttaaagagataaaaagaagagagaaaagcagcgggctataaatctgtagccagctgtaacacggactccaagacgtaatatgtgtatgacatgtgagatcaggcattaatagtattgtaagcaactattgtatgaattggctattatattggctatagatgatttgaagctaacagttggctatactattaaacttgctctaacgcagagctgatcaccgatcagagtgtagtacagcgaaataagcgtcgccagactttaccctaaattcaggactatatgtttctgttttctcgcgcacgcttaacaaactgctaaacaataatttttaaaaaaattataagaaagttgttttaggaaaatgtattaatccatttttcaatttttttataactaatagttaagtatgcattaatctctgttttatgtgtgaagggagcggttccccaactgctccagaagaagaacatagcttaattaaatttcctacggtgaaatcagtctatacagatttaagttctaaaattgatacaaatattaatatttactactaattgttttttcagtattagacaacgagatgtctatggagacatcatagtagtatccagcagcctatgtggcgttgcattgggaagcctagcgcggtgagtcaccctccaccgtggcatggccccacctgtcagtttgtaactgccaaccaagtcactgaaaaattagatggacgattttgtctccgtaaaacagagtgaaattaggaggaccactggatccgctatgccagggatgtactcatgatctgggccatccacgtgtctgattaaatacttgaccctgacatgacatacacgcatacttaatgcattagcttaattagctagcaacaattggtttgggatcatggcaatgcaaagcttctactactagctagctaggcatgatcatgcaagaggcagcctgatgactctgatgtatgttaacaactgcaagcaagaggggttatttcactagtcttgtcttcacatgttaactgcatgagtagctgcttagtttggagaggcagtgtcctaatccagcaaagggcagggcagggtcagaccagaaatgctgcctcatggtaagtgggaacattagctttctcactggaatatgatgccattgcttgaaacaactgtgctcactgtagtgtaacaaaatcttgttcctgctatctttgataatggtacccgtgtttatcggaaaaatgcttactgtaccagcctaatgaagacgaagttgaagaagaagatgatgaacaagaagaggaaaagatctttccaaagcagccagcaaaaaaaggatttataaaaaagaaaagaaaagaaaagaaaggtagccaaaggagaaagcaggggagaagagaagaagatgagatgagctgagatgctgcagccacatgaggaatgctaccttttgtctccacttgatcatggaggagaccaagaccagccaaccaaatcaccaattagttaactgcatttgctactaattgctagtgctaaacaaaggtttggttaaacggtagccaccagtaaacaaatcagtatgcaaaagaggaatggggttttaatattaccaaagtcagcaggagcgagccagtaacatcctagctggaccagcttcctgggaatttttatttcagctcaattctcgatttctcattgcattacacactgattaacctttttttttcattgggaactcagtacagaacatggagtacacagtatacatcacctaaattctagcaaggtcaactagtagcagaattcacacataactatgtagcaataactataattaagttactgcagatagtactacatatatagccttttttttcctcagtagtatttgtatatatatatatatatattagatattatattaccccttattaagtaaatagaaaagggaaaaggaggaaagaaatactgcttttccaaaggtaataaactacagaagaaaaggaaaaaaaagataagagagagaaaaaaagaagaaataaaaagtggtaattaatcctagtggtgtattgcaatttagtccttgggattaagcatctgttactcccaagtcccaaagcaatggctcctcaagccggagctccgcattgacctcgtcgacgtcggcgagcggcgcccacatcgccgggaacccgaacggcccgtcctggatgtcgaacagcaagtccggcaggtcgaacagctgctgctcatccgccgccgccgccgccgccgccgccgccaccggcgcggtggttgagccgtcgtcgtcgtcgttcttggcggcagcggcaggctgctcgtcggcgtcggcgtggacgacgcatggcgcgacgtcgtcggccgacaaggaggaggagggcgacgaggacggggacgtggtgaacgcggcggccaatgcggcggcggcctggacgtccttgggcgaggcgga

SEQ ID NO: 11955 - DNA, 1622 bp, Oryza sativa
gcctcctcctcttcctcctctcctgcgccgccgcctgcagcctcatcagcctctcctaccacctccttcttcctcttccccccggccacagcattgggtctggccggcgacgaccacgcgtccgtgacggcggaggagcaggaggacgtggaggcagccgaggaggacgaagacgaggaggtttcttggagctccttcgccatggccatggcgagctaccaagcttagcagctgcagagtgtgagcacgaggtcgaacaggttgcgtgcgggcggagtggcgcctgcgtctgaatgcgtagtgaggagagaggggggtttttattgcgagttccaaatgcaaacgagagttttaacttggagattataaacaactgatgatggggcctcaaacccgtcctatatatgcttcgtgtccccccgttgttgtccccacggtgtcgccgtgtttatttcaggctcgctcgttcatcatatgatttttttaaaaaaaaattccttagttgctggtataagttagaaaaaaaaactgtgtgagataaaaagcagttttatttgttgtatgtatgatgagctttagttggtccagttttagtagttgaggctaggacatcaaattggtactagtttctccaaaatttgtttatttgtcctatgaaacggggtggacgaaactttcttaaatcatgcaacctccatcgtgtagctattggtttccgtgaccaacgtttgatcgtccatcttattttaaaaaaatgattaatatttttattgttattagataataaagcatgaatagtactttatgtgtgactattttttaaaaaaaatttcatatttttttcaaatatgacgaacagtcaaacgttggtcacggaaacctataactgcaattatattggacggaggtagtacgtggtaggttaattagtaacatcgtgtgatctacatcatcttaatctatagcgagtttcttgtttaaggccttgtttagttgcgaaaattttttgggtttggttatcacatcagatataagaacatacatttgaagtattaaacatagtctaataataaaataattacagattccgccagaaaactgcgtggcgaatttattaagtctaattaatccatcattagcaaatatttactgtagcaccacattgtcaaatcatggcgcaattatgcttaaaagatttgtctcgcaatttacacgcaatctgtataattggttttttttcctgtatttaatactgtatgtatgtgtccgaacattcgatgtgagcgtgaaaattttgttttggaaactaaacagggtctaattctcggtatgtaataagttcttatgaaccagaacacaccacatgttgtaattaaggagaaaattccgaggggttttttaggaaagggggaaaaacgcgtgtaacacctgtgttccactttgatctacaagtaacatgggacatatatcagcatccacatccatttcacctcatatcaatgtaaaaggtgatgggacgggcccatgcaaaaggaggaagaggaggactgttcagtcactgacagcttgccccttagggatgactaatattatggaaggcagccaagacaccatgaagggct

SEQ ID NO: 11956 - DNA, 4084 bp, Oryza sativa
cattgtcaaatcatggcgcaattatgcttaaaagatttgtctcgcaatttacacgcaatctgtataattggttttttttcctgtatttaatactgtatgtatgtgtccgaacattcgatgtgagcgtgaaaattttgttttggaaactaaacagggtctaattctcggtatgtaataagttcttatgaaccagaacacaccacatgttgtaattaaggagaaaattccgaggggttttttaggaaaggggaaaaaacgcgtgtaacacctgtgttccactttgatctacaagtaacatgggacatatatcagcatccacatccatttcacctcatatcaatgtagaaagtgatgggacgggcccatgcaaaaggaggaagaggaggactgttcagtcactgacagcttggccctcaagggatgactaatattcatggaaggcagccaaggacaccatgaggggctcctcaatgtattgttcctttcaagtgctcaagaaaccctggtgtcttgctggtgacacacccccaattaaaggcatgtcacaccagcccacaacccccccccccccccttcatgtgtgctgcatcaccccccattttacaactcatctggcttttccatgctgctgcccacattagctactggtggcttggctctttatcttatctcatcctgcaagggatcacaccaccaaagagattctctatatcaacagctgttggtgtgatacaagccactgacatgtgagaccgcacctatctgtcagtgatcactactgcagaggatgtgaaaaatgcaatgcgaacagctgaccattgcaggttctggaacaggttaggatgtgaaaatggcagcccatgcaagtggaaatcaaggcaaggggcatatcagcatatggcagtggtattggccagtgggcagtagtagtatggcattgggattggagcacatggatttggccaggggatgtgtggctgcacccaaggtctggcttttggaaggccctgctgtctcttggaagcaaaaaaaatttgtgcttgccttgcatgcagccatgctgggcttgctcccttggatgtatgtggcaagtgaaccccatctacgcataattgcattggattttcccttcattggattccagatgcatgttgttattgtttttgttggtattctcttttgtgagcaaccattcactgtttcgcttttagttccttttctccttctagagtgtacttaccactactagtttattactccctccaaagtttgtcgttaggataaaaaaattgtaggtaaaatgtatggttaatttggttgtccaaaatgtatagcatgtataatgactagagatgacaactactccgtccgtcctaaaatatataagaatttttagacggaaggactatatcctaaattcgtagtattaaaatatattttatccgtaaaaaaattattatattttagaatggatggagtaattactgccacactaactacgagctccatcgcttcacctgccactgattataaactgtaacacttaatactgactaaaaaataaaaaataatatgtgaatagatcttttatatatattcttagcgacttagaaacaatgaaaaaaaactacgataaaaaatatcaaaaataactttaaaattaagttttagaatttaaattttagtcacgactagtaagctgaagagcaaatgaaaaagctaacggtgtttccatgtcagagttgtgcgtacatccaaaagagttcaaattctgatatccacgaatcagcgttcccgccctcacgcgccggcccacacgaacttgtgtaggtagaaagcatgtgtcttcgtatcgtaagagtggatacctatacgtacactcaacccgtcaacggccttcgttttccacgggggagatcgatcaatgcatgcatattgtcgatcgatcgatcgaagcgccgccgcgcggcgcgcgtcgtcccattgcctggccctgatgcggtgaacgcgcacgcgctccggacatcggcccgcgacgcgccctccgtgttctgatgcgtcctccaccgcgcatgtgcctgccgccatgtgcgcgcgcatgcttcgtgtccgctgcacagagcgtggccgcgtcgcggcgacgatggtttgcacggtccaatgcccgggcgacagccatggcgcgagcgcgacccccggcttgctgggagggcggcaataatccatttcaactattggatccaagcgttcggttccagctgccgggacacgtagtgcactctcctcgttatctcctggtgtgtcttcttcccctcctcatcactgtggccatactacatgctactactcaattgtgtatgtagccaatcggttggagtacagactacgacagagaacggtgctctgcttcccattattttctttcaagagctaggacagtacaaaggagtacagtaggagtatgcaccccccatactactctacattcgaattcgagatggcgaccacaaccttgttttggttgcaaaaatcattcggggatgcatgcttatattagtgttgccacgtttttctccactgaaatgaaaggctcaatagatccgtgcttcaacggataaaaaatcgatcttcatatctacaagtagatatacacgatcaaaatatatacttcatttgttttcaaatagctaacactgggcacaaattttaaaactgacaactcagtctttttgttacaaaaggaattacaaatacttaaaggaataacagatcatagtatattgtatgtcttaaatataagcattatggagttagtactatcactgtgacttcagagttttttttttttttatagaactgacttcagagttgacatgagaaaaacctgacatcgtccggcgacgatggcatcaggcaatatcggcacacggcaggtttgattcgctcatcagatttcggtgcgtaccaatctgtaccatgcatacgcgttagctaggtttgcggcgtttttactcatcatcgcggtagctagctgcatatgatgcatctttggccatatctgaggtgaacagtggggatgaagctgtaccaaagcaccatgatctggctgcataaaacacatttgaatctctacactgtagtcttccgtgaggcaattaattaggtgctggagaataacgcataattaatcaaggaatgaaaaatggtgagaaaaatggcacatgtattgctggtacatcgttggcacttggcagttaggcttaagactgagttcttttcatcaacttcaaacgataacttctttgtttttcgttagcatgttttcgaacctattaaacgcataattaataaaggactgaaaaatggtgagaaacaatgttattgttactggtactagtacatcgtttgcagtggcctgtcgagtcaatttcttttgaggcaaccaagacgaaagcatcagctaaccgagtgaaaaataggcccaagacgagcacgctgaggcctatctcaaagttggtccggccgagcaagcccactgcaactctagaaatacgggccacataactaacttgcaaattttgggctgaatactgggcttccaagaggcggaatcctatttgggccggatatctgcgaacgctaaatgggccgccaaaagagccctctactattcaatgggcgggcccacgaagaaaaggttgggcccactacggaacggaagcctagggccagccggcagccgtcggatcaagatggacggcttctgtgcctcgaccagccctctcgccctcgtcgccggctgcctccgccgccgcacgccgccgccgccacctcatcgctggcccgcgccgcgccgccgcctgatgggattccgcgcgtctatatcccacgtccctcttgctgcttctcttccactcgcctccgtcgcggtgagcgagcgagcgcgagcggcgatggaggagacgaggaggaggggtggtcgaatgtgagaggcgaatccacgtcttgccgctgagaaggcggcgggagggagcaacgtcgtgagacccaccacgcggtcgctgacgggtgggcccaaccaccc

SEQ ID NO: 11957 - DNA, 6648 bp, Oryza sativa
gctcctttcttgcacccatggctattgtttggtgcggaatttttttgacactctaggatttgcaccatgtttcattgaggggcaaatcctagactggcgcatgatcgatttttccttgtttgatctatggagtggactgaatcaatgcttcggtggttaactttgccaacattctggtgtatctactaggcagctgaagagtacggcatgggccctagaggatctgcgttgatttgtggatatactacctatcacaaaatggtggaggaatcgttggcagagctgaagaaaaaggaggtactgttgcgttcaaaatttaagcaaccacatgtgcccggtatacaaaataaaataaaaaacttgcagccttactagagtccttctacaggattgccttctttgtcccactggattttctgccaatatggctgtaatgacggctctgggaaacatcagctctctgttggctgctgggagaaaacctgcggaggacgaaagaatagcaattttctcagatgctctgaaccatgcttcgatcattgatgggattcgccttgttgagcgacagcaagaagtggtatcatttgtgtacaagcactgtgacatgtcccatcttgaacttttgctgtatgtttttcactttccagtcataactcataacatacaaaatgctaagcactaatttacttagttataaaccatgtttgtgattacacatgcagatccagttgctcaatggaaaagaaagttgttgtcacagataggcaagttatacatccaagtaaatttcatcatttaagaagcatttattctctgtattagtgagtagtgtaccgaactcagaagctcttttgattggtaaaatgcagcctgttcagcatggatggtgattttgctccattgcctgagcttgtcaagttgcgcagaaagtatgggtttttgttggtgatcgacgatgttagtatattatcttccctgaaatacagtatttttctggcctaatattaatcaagttatgttgcaaatttccttttcaaggcacatggaacacttgtttgtggtgagaatggtggtggtgcacctgagctgtttgaatgtgagaatgagattgacataagtgttggcaccttaagcaaggctgctggctgccagggtggttttatagcatgcaggtattctattctaaggcatgtccatattatctggcaaggaagaactgctcatagtgcatattaaactgtggaaatgaatcatagatgccttgaaataaaggacttcataaaatacctgagacaaaacctacttgataatatgtaaacagtagcggcatgctcatcacggccaacaggaaatgttagaacaaatgcttggatgacttcaaacattttccatatctgttgctgtcctgagtaacttatgggcatcggcgattatagtttaggaattacgctaagtgcttaacttttgatgttaatagatgctctggacaccacataatattatttatcagggtcttggttatgaaatttgcacttcagagcctcatgcttataaactcaataaatagaagttctcttgaattagcctctcttgataatacttcatgccataatctctgcattttggatgcatgccataatctgtctttacaatttccaatcttatgacgaataataatttgaaatttgtttgcagtacccgatggaagaggctgattcaatcgcgaggtcgttccttcatattttcaactgctttaccagtgccagtagttgcttctgtgtatggtaatactctacacattgtgttctaataatttaaaatattgatatgggaatctggtattgattgctacatatacctgtttgtgttacactgttttcacgaggaagggcatagaaaaccttctctatcacattaatccatagaaggacgaatttaaataaaacattaactaacgtaaaaattatctcattgtcaaagtaaatatcaggaattcttctaaacagaatcaattaatttcagctgccctctatgtatcaagggaggagagatggcggagatcagtgatctggaggcatgtgcagtattttgcctctttgacaaaactcaacataacaagtcccataatttccattgtagttggaagtgaaaaagcagcacttagagctggaaggttctcacttcctcccatttttgtttcttgataatatcagtagttgtgtgttctaatcttttcattttgaaactgcagggatatgctaagatctggatttcatgtcacgccaatccgaccacccacagtaccgcccaactcatgcaggttgaaaattttctgttcctagcattttccatcctaatctctattcatagacttcagcaacctaaagcatcagtgttcctagggaccatagactgtaattggattaggaaccagggtatatatgcatttttattaatgtgttttcttggtctttgctactgctctccaaagatggaatccctgctagactttttttttgaactgcttgctataatttgttgtccagatattagatggtcctagtgttcatcgacataaggtcgggcctgtttcaaccaagattaactgttttatttctttccatgaattctttgcaggttgcgaataactctcagtgcttctcattcttcggatgacatcaaaaggctggtggatgcgctgacgccgtggctccctcacaaacatgatattcagatatatgctgtggcatcaaagctctaaacaatgattcatccgagtgttcagctcatcaagcttcaagaagtaacattagctgagatcccaccggatgatatgggagaaaaggggataagttagtgctggttgacgcgattaatactgggatatctttgtattacagcacaatcaatatgaatatgaaacataactgatgaaacagtactacatcttttgccctctctaatttgactttacttaaacataaagcatcacataattagctaggtaacaacatgaatgcatagcatccactctttactgcaaatacagaaacgtatgcacaaactacaaatatcgacaaattgagagagaggggccacgctttatgcaaggaacaacatttatacaaactctaagtgatcagcagattaagagcaaacaaataaagctaaattattatggtgtattggaacaagcgtgctaaaaataatatgttatactatatatataactctctcttaatatgatgtaaacacaattagaggtgcagtaaaaatggcagcatctgctcccctgtgttattgaatattcggcttaactagttgatggatcaactcgtgcatgaaatgtctttgcaacaaatgcagcttaatctgattctccatcattccacatgcagcttactgtacaagtatttttacagtcattaagaagataacgggatgtaccatattttttaagttgatacttatctgttggtacctctcaaagacactaaaatttctattaaccaaagaagtgcaagctatgcagaaagcagaggaggtaagaataagatagtgaaacactcatccttgcatttctttctgatgcaatatgaatcttcagaaatatatatagtactccttctactagctagctagtatagttatcttgtcaccgacaccatagaatatgaatcatcagaattatatatagtgaaagccaaggagtaagttcggagaattagagactacaacttttcactaatatcaatacagtatacaggcaactacagaatgtagggcctgttcactttaatgctatttttaaccataccattttttttgataaagttacccaaaaaatatccacgtttagtttgttgccaaatttagtcaatacataaaaaatcctgccaaaattttagcaatattgtcatcttgtcaaaattttagtattgacaaaacttggtaaggtttattttagctacaatctgttcatattctacggaacactcaaaatagcatagtagatgatttactaatgggcaaaaggcgatttgaaatagcatatatacaaatgaaaacaacagcgtttaggaagggtatacagtagtacttaagaagttgagagttcatgatctcaacagaattgaagaaataaataatcacgaaatagatgtgtatttatgtgtgaagagagaaaaaccgatcaatatacaacctgatgtatgcttaattgactagagggatatgactaattagttctacactagtaatatcgtgcgcgtgcaatatacattcttcacaaatatatataatgaaaattaaacatacatttccagctcgaccgaagtgtcctgcaataaaaatacggatttgctataaatgtgccatcatgtttttcatgaaaaaatagttagcatgtatttacattgtaagtccctaaattacatatgtaagtccctaaattacatatataattacattagatttgtaatataattgcatttgacatatttttacctatgtcgtcatatttttagattgaccctaaaaatataactaatatccacattttacatgatttggattagtcatttagtatgacaattgataaaacctatccttattcaaaatataatctaaaaggttcaacatatgaagttgaagctgatatattggtggtaaaaactagtagaacctatccttgtgaaagaaggcacctgaaaacttactggatatataaaaaaaaaggtgaatagctaattaagtccctcaagtttcactgaaggctcaatttgatccttcacgttttattttgttcacatagctcctctaaatatttgttttggtttgacatcatccttgggccaacttaatatgccatatggctatttttagtcaatatttctattagaaaatgtcccttttgcccttaatttatatacaactatatactaaaagggagaaaatcaagatgaataaacaacattgcagatatacttccaattatttcaacatgtgcacatgaaacttaagcaattactattgtatacagcttgctagtacataatttattttcgttttacataatttactatacattatcttaaaaaaatcaagcatacaatttttctcttatatatgtgaatgatgagggtataagtgtcatttatcaagagagttattggttcaaggataaatttgaactaaaatgaaaacttgaaggactaatatggatagattgaaacatcaaggactaaactgaggcttagatgaaacttggaggactacttgagctattcaccctaaaaaaaatagtggtaaccatatttgcacccaacacctcccacggagagctaacgagattgaaataatattgaagaaaatccttaccttcagacaatttgttagcattggagttatcaggatccatggagtcctccaatggaatcctagacttgtctgtttcgtttatgtgaaggaatattaattaatgtatgtctggatttctagttagagaagcaaattgtttggcaatgctacagcaacctacagaagatgatttaaagatgcttctgtctaaccagaaatcaaagatagcaagtagataatatttcatatgctctatcttagcctgaatatagggctggaagaggctcccttcttttctgaacagaatgcacaattattctactcttcgtgaaacaaaaaccaaacattattatcagaatctttggagaggaatagatgtcaaccctaaaaatttagtcaattttcagactattttgtatattaaatctccgtccaagaatcaagccagtatacatagaatgacaattaattaatatgtaaattcaaacaaaaataaaacgtaaatacttacagaagaggcaccacatagaataacacagtagcagaaggtcaatcctagcgtgactttagctccactgcacaaacaaacttaattgggatataagccttggcttcttcactctaactcaactctgtaatttgactttcctgattgccaaccagaacaaacaataaagtagcagtgcagcacataattaactaggtaacaacatgcatgtatatagcatccactgttcattgcaaaattaccaaaaacgtatgcacaagctacaaacatcgatagactgatgatgaaagacacacatttattccatgagagacaagctagcaaaacatgcaattaagctctgtccaaagctctagatagggtagtatgcttggacatgcatgcctaacacacaaacatcaacagatcatacatggatcaacacttgtctctctctgagctagtatagctaaacacatacttaattaattcatgtgattatatatgataatatagctctggctgcagcttgatgatactatatcagcgtaagtgtatagcattcatgcatatgtagtagtagtattcagttcagttcagttcagttcagttgggcttggagcttggcacgtagatcctggcccagaggtgcctccccttgatcatgtacttcgccgtctgctgtccgtcgagcaccaccgggatcatcgacgggcaccggagcaccacccgtccgtacaccggcagctgccccgccgccgccttctccaccatcaccgactccacgcacggcccgtacaacc

SEQ ID NO: 11958 - DNA, 1353 bp, Oryza sativa
cagcacgacgggggccggcagcacggcgacgcggcggacgaagtcgtggtggccgacggactcgagccacagccacagcgcgatcacccacctcatcggccccggctgctgcccgtgctcgccgaccagccgccagaacagctcccgctccatcgtgtggaacatcatcagcgcaaccgccccgctgctcgccattgccgccgcccacctcgatctcgatctcgatcgaaacgctcgctgcagctggcgatcgatcgatcgatggcgctgttaaatagctggccggattggcagctggtggctcgccggggaagcatgaggccaaggcggttgttgctgcagctacgagacaaatcaaatcaacggggagtggacacacgtcactgcacctagccgtgctcccgctccggcgagctcacgtgggaagcacgcatgcatgcatgcatggccaaaccgccaaagcacacaaaagctagttcttccacctctgcacacaaagctctgaacatcgatcatcatgcgtgatcgttcgagcttagcttaagctatcttttcaacagcatgatttggagatacatgagttaggtagaaaaagttttagaaaaacttacgaacttggataatcaatatgagctggctcgagatggaagaggctcctctaacgtaaagtcagagggacataagtcgtctctgacacgtgaggctcaccccaatagacccacacgtcagagagatatatgtccctatggtgtacgtgagaggagcttcgttggctcgagatatatctggcgtggcaacgggattacggattgttgatcatgtgtagctctgctccaaaacttttgatccaagtgattcaccagttagtaaatgttgtttgctactacccttggggatgtgtaaagctaggtggatcaatccaaacatgacataataaggacatggttatatgaatttaagttcaaaagttatgggcagctagcataacaaacctttaaaaagatcttagaaagactttttttttacgattacacgaaagacacacacgcacactacaatcaccacccgtaagtgcgtcccctaacacacgctatctaaagagacaatttgattacaccaggaagctaacagatccttgtcaaaaatgctaggagttgggaatattctatctccatatcattaagttgattattgtggtgatcattaagctatatctacttggatatctggcgtggcaacgagatggatcatgtgtgcttgctcatgggtttcaatccaaatgattcagttcgttaatgctgtctgctaccacctttggggatgtgtaagggagattatatcaattcaaacatg

SEQ ID NO: 11959 - DNA, 7676 bp, Oryza sativa
gattcaccagttagtaaatgttgtttgctactacccttggggatgtgtaaagctaggtggatcaatccaaacatgacataataaggacatggttatatgaatttaagttcaaaagttatgggcagctagcataacaaacctttaaaaagatcttagaaagactttttttttacgattacacgaaagacacacacgcacactacaatcaccacccgtaagtgcgtcccctaacacacgctatctaaagagacaatttgattacaccaggaagctaacagatccttgtcaaaaatgctaggagttgggaatattctatctccatatcattaagttgattattgtggtgatcattaagctatatctacttgtatatctggcgtggcaacgagatggatcatgtgtgcttgctccatggctttcaatccaagtgattcagttcgttaatgctgtctgctaccacctttggggatgtgtaaaggtagattatatcaatccaaacatgacttaacaagaccatggttcataatagtttcagttctgaagttatgacttatcagcagctagcacgagaaacctttgaaaaaggatcctagctagaaagacactttgattacacatttacacctgggagttaactgatccttttgtcgataatatatgatctggctctgcctcgaaattaacttgattgtggtgattagatagagtaaaggtgaactcactcaaatgatgatggcgaatctcctgacagaagtactgaactagtcaaccaggccagcatggatggattgttggtgaccagttgtctccaatgcatttgagagtgaggaacatgtttctgacaagggaaggggaaaaaacagtgatgagaataatcccatattgggaattgctacaacattaccaaataaagaattgaaagaaaataaactttaaaagatctaataattgccttcgcccccaaatgatagaaaaaaaaataggccgttggatggagatccgatgatccagatacatttaatcttgtaacaaccctaattactagtccacctcaattgttttttgttgccaccaccatcgatcccctacctcgccgccgccagcagcaacaagtccgttcttccccgggcacctccctctcttactatcgaacaccttcttctacttctctctgaacatcctctccaacaacgttgttttaccttttctcttgttgtattgcctttagatcaaccgctgtcgtagcatcaatcacctcgtaatcacaaagacttcctccgcctcctccctgtttctcccctcactcacccacaacctcatcttgtagagccttactctagccaacttcgccacctccaccaccgtatagcgagaaagccatgataatttgggttccgtggtgtatatatggcggagaggctgcctaaaattcacaaatgaggataagagcaatggacgaaagcaggaaaggcagccagccttttgcccttttataagcaatgacggtttgtaccgacctaatcgtatttctaaatgggcctaaacatatatttgggtctaaaatagtcgctcccgtctatcacattaaggctttatttggatgggtcgacatttctatggaccacatttatgggctgaagttttattgaatttgtcgccctgtacacaacacaatagaaaaaacttgggtttactcatattgtagccacctttcctttaaaaatgttctttatgaattttcaaaagtatttcgttttctatttattctgatgaaatttataccaaatataaagttacaacccactaaatctaaaactcgacatgcaatcatgccacaatcaattattacatatcaaagctcatgtaagcatgaacatcatctacaatctactgaattctacaaattaacaagcaagcatatcttatcatcaccactcatatcatttccacaatatttcaaagtatctatttatcatttttataatacttaaaacatatatctatcaatatattcagcatcaaagcacaatatcatttgtttgtttcatgattagtatcgtaaactctgacgtttcattattttttgcattctgcttcttgcaatacaaatcttgatcaacaatctaatattttatctattgaatttatttctctccaaatatatattagtaaaccagtttaatttgttgttaataactaatatcctttttactcctaactcgattgttgaaaaaatatattgaagattgcttcgtaattcccacagcaaagcgcgtgtggaaacacataattaaacaaaaagttgtatccacttgagccgtaggctacaacagacagatagtaaagtctctacatcaaagagcgtctaaaggtatgcatggtccatactcattttatttcaaattgtttatcattctagtaaattttatagcaaataaagagctatggcaaattacattattccccttatttatcagagtacattccaatcatttttcaaagtagtcattaactctgattactaattgtggctgcatatatagggtagggagggaagatcacatttaaagccttgggacatgagagtgactattttagttaaaaaaaatgaattgctaataatatgaaatggagggagtaattgaatatgccttttgggctgccatctgcccattgggctgtgaccatccggtttgagcccattttactgacctgtctccctgggctttgttgcgcgagcacgagccatggccgacgtgggtgggagagctcgagctccgaagatggcaacaatggcggccggcgtcgcactgcacctgcacctacaaggtgacgcggccggccgccggataagcggcgaagctgcccaagttcttctccttgggctgcttctgcttctactggtgagttcagagttcagactccaacttgggtcagatctcgtttccatgactcccatgtacccatgtattctgaatttctgatcctagctcaaaattgtttttttctctttttgtcatttcctgttttgatgaaacatgcgcatcattcaagtattataaatttataattggtgccagccgcaaatttgcggaggttggtacgaataggattgtttttttgtcctcatgtatttgtacttttgtagtcctgttgaatccactagagactgctgcttattgctgaactgccacatattgctgctaggaactcacaaattttcaggagttctactcgataaacttatcagcacattgcacatccagctttgcctctgagtgcttccagggatgaaggtgaaggcaattagagtccacaagattggtggtccagaggtaagtgtgtgttctataccaagaagaaaactccatctaatttccttttccttataattcatctcctgcaaatctaatccatttgggagtaagcagttcttcttctgatgtccaaaggtgctaacttgggaagaggtggagattggggagcccagcgagggggagatccggatcaagaacaaggctatcggtgtcaactatgtcgatatttattaccgtactgggttgcatcaagaacctctcccgtttgttcctggtacggattttagtattttaccatcatcaatgacagtgatgtgctgaatgttttcagatctggtgtatggggattctgataacaaaattccaacttactttgttaaatctaatgtcagttcatggcccggagaaaattcttggttgccatctgagcttatagagtatactggtaggctaaggaaaaattataggacatgttcatattgtagccaaaataaaccttaccaaaccaaaattttggcaatttggcaatattgtcaagttttggcaggatttcttatttatttaccagagtttggtaagaaactaaatggatgcgcatatttgacaactttaccaaaaaaaatagtatggtttaaaatggcatcaatctgaacaagcccttactctagcacttttcagtcttctatcactgttcactaactaggcaagtgagcagtgatataggacttttgaaccttgtaatttctatgtaggatttctcaaatcactacagccaatcaccatttgcatacgaagaatcagactcagtgttatgcttgaagagtcttcccctgaataaagttctttggtgttttttgtactagccaagcaccgaattatcacaagaagtgcagtttgtgacttctagaaaaattgaaaacacacaaaagaaactgtttaactaatgagtattcaatcgaatttatcagaaattatttaatggtatgccgaaaaggcaagatcgcactatccatttgcaaatgaacagtcaaacttgtcgaaaatgtgaatgatcttattcttggagcattgactttgtgttcatccaggcaaggaagcagtaggagtagtgtctgctgttggacctggggtaacaggtatcgaagttggcgatgtagtcggctatgctgatactccaatgggcacttacactgaagaacagattataccggcaacactggccattcctattccaccttcagtggaccacattactgcagcatctgttttactcaagggaatgactacatatgtccttgtgaaacaagcctttaaggtgattgttttgtgctaagctgattcagtagttcagtaccaacttccatgatttcagagacacaaaacaaaagaaaacaaaacagaaactgattttgatttcagaatgcaacttagaaacacctccatgttggtctcttgtgcagattcaggcaggccatactgtcctagtccatgctgctgcaggaggagttggctctctcctttgtcagtgggcgaatgcccttggtgccaccgttatcgggaccgtttcgacacaagagaaagcaatccaagcagccgaagacgggtgccatcatgtgatcatctacaccgaggaggatttcgtagcccaagttgctgaaatcacatcgaggaagggtgttcatgttgtttatgatgctgtcggtaaagacaccttcaaggtagcaaaaccatcctactctcattttgcaacaccttacaatcactttcaccttctttgatcttgacaaaaagcattgccatgaaaattggaattaaatgttgaatcataggcttgacatgaggtaaatcagctgcctgaaactgaatatttttttgtctgaaactctgaatgtgaagggatcaatggagtgtctgatgccgcgtggatgcatgatctcttatgggcaatgttcagggaggcctgaccctgtaccagtgagtgatctggcgtccaagtccctgatcttgggcaggccagggatgaggcactacaccgccacccgcgacgagctgctgcacgccgccggcgaggtcttcgccggcgtggcggctggcgttctgcgcgtccgcgtcaaccatgtctacccgctgcatgaggcggctcgcgcgcacgcggatctcgaggcacggagaacctctggatctgtggtgttgttgcctgccatgccagcagctgacagctgatgagagtatcctgtggcattgatgttgttagaataggtgtcgaatatactagttctatttggttacagttggacttggaattgtaataggtgttagggggtggagttagagtcaaactctgtaacccggcatctctcttaaatagagcggggggcaccacaatgtaaccatggcgactacaatgtagcgtagacacgcagggagatgatggcggcgtggccatggactcgtagcggctaggagctatattggttggggaggagcgcccataatcagagccccggggatgtaggtttcggctgaacctcgttaacaaatatcgtgtgttcctgtgtcgtcatctggcatgtcttgggtgatcaatgattgaagcgatcgggaaggttagttatcgttccgctatatcggctaacttttataacaagtggtatcagagcccaaggtttggaacctggaacaatttccatgggtcacatggtggagaggccaggtaacaagtcttcggggtcacatgggttggtgtgacgggggagattgttaggcctgaggccaggtaacaagtctttggggtcacatgggttgatgtgatgggggagattgttgggcccgatgtgtgatggaggagattgttgggtttagtcctacatcggtaattgatggtgggggagcacgacttaaaaggtgggggcggtcctcacccatcagactagtcttttgggttgtgtaggcctaggacctaaaagttgtggctccggttggacctgtggtggagcaggcccaatgtgacctgggtggcctacggttggtgggccgggctgcgcactccaacaagtggtagactaacctttataacaagtggtgagaacaatttccatgggtcacatggtaacaaagtggtatcagagcccaaggtttggatcccggaacaatttccatgggtcacatggtggacaggccaggtaacaagtattcggggtcacatgggttgatgtgatgggggagattgttgggcctgaggccaggtaacaagtcttcggggtcacatgggttgatgtgacgggggagattgtgacttaaaaggtgggggcggtcctcacccatcagactagtcttttgggttgtgtaggcccaggacctaaaatttgtggctccggtgagcctgtggtggagcagacccaatatgacctgggtggcccatggttggtgggccgggctgcgcactctaacagatgttcttgtgtaaactttgtcaaaagaaaaaagagaacacttttgttcagtgatgctaaatgtgatctagagtaaaaaattcatggatcatccagcctcatcgtttggtcgatggctgaagcttcataagctgtagaaaaatgaacggagaaatgaaatataatttataaataaaaacttatatatttgtgttttagtgaattaaaagtcaatgctagaaaataaaatactgtgatagaacatcaaaatcaactttaaaattaagtttttaaaatctaaatgttagttgcgactaataagtacaggcaaacgagatggaggtgatcatcattctgataaacctcatgctggcatgtcatttcaagcggtgaacttgaaagatttaacagtttagccaaggctgatggtactgtcagtccgacaacaagagcaatatatagcttcgctgcctttgtttaaacatgatccacaatttgcgtctgcatctgcttcactgctcagtgaagtgattggacatgatctcaatttctcccaaacaaagacatggatttgcaaaccacaaacaggaagtttggcgaatagatcaaagtgagctatttgattcgagcaattcttctacaggctatcactgtcatcagggcaaaaactgtgaggatgaaggatacattacataccaaaaaataaataaatgtatccaaacttacaaaactgaatgattaaggcacacgttatacctttctactcaaataaaaaaaacaaaaaaaacgtgggctttcagcattatatactcatgcagtcatgcatgcactggggatggaagatctcaaggattcagcttctgttgtgtaacggctctcatattgctatctacagtcgacgagtcaagtaacggtggttagttttttc

SEQ ID NO: 11960 - DNA, 2182 bp, Oryza sativa
  unsure (1)..(2182): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataggaccactaccctgggttttcttcatttccaacgcaacagcctttaacttctccttgagtgcagaaaatgtagctttccagtgatttttgaattgcccatctaacagccttagctgtgcgcaaagaaatggctccttgatctttttcctagcgaactccttccctgtagcaatgatctcaggggcaaaagggaggaactcaaccttctcaagtatagtctgtagccgacgatcctttggcgattcgtggatatcaaaatatgactctgatcccttgtatggtcctgagaaaagtgtcccaaatgccaacaaggaagcatcctcagcttcagaaccaggccccaaagccttgtacatatctttgcgcctcctaacgtatgatatctttttcctctttttcaagtcttcatctggttgaaatgaatcaagcgccccatcattattctcttgatatgtccagactgttgttcggcaatcgtcctggacaggatacacacagccattttcgctgccccctaaaccggacagcatcgatcggcatctatcgtaatcacctggcagcgatccaccaccagagacagcacagcacaagccagagaagcaagtcttgcgcatgtctacgccgcaccacaatgagacaaacaccctgaaatcaatcgttctaaccgtagcctttatcggcgatagatcaattatgtcacccatggatacatacctgcaagttaaacagatgaaaatagcaataaatatttggctttgtgtcgaatttaccaaatgaacatggtaatctatggtggaaaccgtgaaatttggaaattgcattactgtaacattaacaagcaaagagagtaatctaggattaaccaaccccactttgggggagtgagatttttacctccgctcccggaggagctgcatggagtggtcccagacggcggcgcggaggtcggaagcgtcggcgaccctgaacttggggcagctcccgaggacgacggcgtggtggtcgagcaccgggggcacgacgagggtgcggttgagcagcgcggcggcgacggcggcattccggagctcgcccacctggttgctgaacccgctgtgcggcgcgtaccaaagaaacctctccccttccagctccggcgaccgcccacatcttctgccccctcctccgccaccgcctccgaagccggagaaggggaggatggagcggagcagcgaggagtaggccgaggagaggaggagggaggccgggatgaggagcacgaggacggccacgaggaggggcgcgtgcgaccgggcgctccgcttccgccaccgcccgcggctcgccggcaaatccatctcgccgccgccgccgccgacgccggcgaatcggatcggatcggtaagcaaagccgctcctccccatggcccacctgccagatatcacgcacactcccacgtgggcccaatatgtcagcccgctagttcaggatgggccacattaagctggcacccacctgtctgtccagagtcaacagcatgggccatgttaacttgggctttatcacgtgcagcagcaacacaaaggacaaaaaaagaagaagcccataacctacggagccaccgacatgtggggcccacttaaaacaagatattatcgcgctctcatgtgggcctaacctgtcagtcagcatgggccaccccgcccatctagacttacgtactctaagttgggcttgttaggcatgtgcagcccagaacgtaccccggggggtgggtcgctgacaggtggggcccggagaactgccgaaggcgtcagggtccagaagctcgtgacgcgtgcggcggcttgcccatgtcggcatccgccaacccctcctcgccttcttcttctccagtaataaatccacgcaaaagcctcgccgcgcaccaccacccagctctcttcactccactctcgcgttcttgtggagtcgtgctccactccgggaaagaaggagtgggtgggtaggtgagtggagttggtc

SEQ ID NO: 11961 - DNA, 18742 bp, Oryza sativa
aacttgggctttatcacgtgcagcagcaacacaaaggacaaaaaaagaagaagcccataacctacggagccaccgacatgtggggcccacttaaaacaagatattatcgcgctctcatgtgggcctaacctgtcagtcagcatgggccaccccgcccatctagacttacgtactctaagttgggcttgttaggcatgtgcagcccagaacgtaccccggggggtgggtcgctgacaggtggggcccggagaactgccgaaggcgtcagggtccagaagctcgtgacgcgtgcggcggcttgcccatgtcggcatccgccaacccctcctcgccttcttcttctccagtaataaatccacgcaaaagcctcgccgcgcaccaccacccagctctctccactccactctcgcgttcttgtggagtcgtgctccactccgggaaggaaggagtgggtgggtaggtgagtggagttggtcgatggcgattggggcgttcgtggagagcggcggcggcggcggcgggggagggggaggagggtacggcgggcgggtgacggcgtacgtggtgctgacctgcgtcgtcgccggcagcggcgggatcctcttcggctacgacctcggcatctccggttcgtgccgccgccgccgcctcgcgcggttgattacttcctcgctgtagtaaatctatctcatctgttcatctcgtctactgcttgtgagttgtgactgtgtcgtgtgctggctcgtggttgggcctgtctgcatctgcatgggccggtgttaatggctggctcgggcccagtctacgtacaagaaaaggtttgcaagcttttttgtcatgaggaattaagaagctgcatttccagctcaaaagatctcatcttccagcagtaatgcagcttctcatcaatgttgccaacactttactctttgtattccttttttttttttgtgtgtgtgtgtgtgtgtgtgtgagatggaagacgaggcttcttgttttgtgtggagagtatagataaagataagtaatgtagtttggatgatcacgcaaacattgttcaagttctcctgcttaatctgtccactgatgttgtgacttaactaccactagtacggaggaaagatcatgctgaaagctcatgtactcgatcgtgtatgaattgtggcaggtggtgtgacctcaatggactcgtttctgaagagattcttcccggatgtgtaccagaagaagcaggacaccagagtgagccactactgcgcgttcgacagcgagctcctcaccgtgttcacctcgtcactctacatcgccggcctcgtcgcgaccctcttcgcgtcgtccgtcacaaggaggtatggccgccggacgtccatgctgatcggcggcaccgtcttcatcgccggctcggtgttcggcggcgccgccgtcaatgtgttcatgctgctcatcaaccggatcctactgggaataggtctcgggttcactaatcaggtataattctcagcacatttgatttcaggtcagtaatctctgaatgaatgtgaatctagttcaagagatagtgcagagatatctgtcacacatttttagagtgcctgttatattaaagaaaataaggaactctgttaaactattgcacaattcagataaaaaaaaaacttgtactccgtatgtggcatggtactccttatgttgttttagaagtcactagtacatcaagttcatgccatcatgcacatcgtgatgctatctagagttctagacaatgtatcaaaatcataaatcttgcatgctgaacctaacaccacacacttgaaaacgaaatgcaggccatgcgtgtcgtgtgcacaaaagtcaagtcttcattgacttgggtttagagggtatagacagcgggtttatgtggatgtactttgttccaagttgataacactcgacaagaagtggagcactgacaaactacatggttgtctttataatattaaggtcttgtttgtgtatagatcattgcattgacttgacaagtcatattttcgtttttgtggccataacgagtgagtgggtcattaaaaagttaagaagtttttacagcctgttgaatctctgttttggagagggacagtgttgaaatattgtgtggagatacaacgcagagggaaagcaacaaactatgtcgtggtctaaaaacttggcgatttactgcctagataggaattagaatggcttatgagaaaaacagtgactgttcactgatccaatctcacactgtgcaagacaagggagatccggagataaagcccaatcttgcaatcaagattttcagataacatagaaaagggattccactttgtaactaaacttcattatgcacataattttccttctgatgcatactcctaatcctagactctaatttttgcatttgttctttcttaacaatagtttcctccttcccaaaggacagtggtaactgtactgacgcctttgctatgaaactatattttgcagtcaatcccactgtacctgtcagaaatggcgcctccacgataccgtggggcgatcaataacggcttcgagctctgcatcagcctcggcattctcttcgcaaatgttcttaactattgcgttgtgaaaatcacagctggatggggctggaggatatccctatccatggctgcagttcctgctgcattcctaaccatcggtgcggtcttcctcccagagacaccgagcttcataatcgaacgcgatggcgacactgacaaggcaaggatcctactccagagacttcgtggcaccacttcagtccagaaagagcttgatgacttagttgctgctagcaacctctccaggacagttcagtatccgttcaggaatatattcaagaggaaatacaggccacagcttgtcatagcactcctggtccctttcttcaaccagcttactggaatcaatgtgatgaacttctatgcaccggttatgttcaggacgattggtctgaaggagagcgcgtctctcctatcctcagtggtcaatcgactctgcgcaactttcgccaatatcatggcgatgatcgttgtcgacaggtttgggcgtagaaagctcttccttgtaggtggtattcagatgatcctttcccagcttgctgtgggtgcaatcctggctgcagagttcaaggactatggatccatggacagagagtatgcttaccttgtgttgatcaccatgtgtgtgtttgttgctggctttgcatggtcatgggggccattgacattcttggtcccaactgagatatgtccacttgagatcagatcagcagggcagagtattgttgttgcagtggtcttcctgatgacatttgtgattggacagacattccttgcagttctatgccgcatcaagtcagggacattcttcttctttgcaggatggatctgcttgatgacagtgtttgtttatttcttcctgccggagacaaagaagctgcccatggagcagatggagcaggtctggaggaagcattggttctggaagaagattgtaggggaggaggaggaaaaacaagcagagaaaacagctctccctagcatgtaaagccctatgaattggaatgtatttgaccatacaaaaaccatacaaagtgtagggttctaattagcaaatgtaagtttgtaattcttctgtctaaatgtagtgtgttgaggtggtcagttgccgtgactggctctttcagatggtaattacaaagaaatgtaacattaatgttgtaacaagggtgccattttgtttctgattccagatgaaaaggaaaaactattccatattctgcaggattaaacgtttctgctgttcacaacaggtaaagtcactccacttcagggaaagacagcaaaatcatttcttttacacagactttagataacccttttttttggggttcttggtatatgccaacttttgtagcctgcaccagaaacaaaaatgaagacttttgctaaagatgtaaaagtggcatgatgtcctggatgaccaaataattcatgacaaatggattaaaagagcccaatatctgaaagagactggccagcagccactaatgtcaccaaccacatatgtaacacttggtgcataattcaagagggagcatctcctccagaatcaggattgaaaggtacaacctcatagtaaatcctcggaatatagcatgtgcagcataagaatatatcagtgttgtgctgggtaagaaaccacatgaaccaattaggaataaataatcatgctgaaattatagcaatgcttgcaatttgcaaacgataaagctagacgcgggttgctggaataacaatccatctccaacaaaatagtacagaatataactgaatggccagctcagaccctaacagaattgaaaagctggattcatcagcactccattgagcaatctagatcaggaaagagcatagatgcataatgaactgagatcccttcaaaatgactaactaatatttttttttcttataaaagagtttacaacagtacaaccacgaagatcagcactaccattactgattttgttaacatagagtgatttatcatgtgtgccagacaaacaacagatacattcatacatagcataacttacagcacatgatacagactacggagaacggttaatcttaaaataaaaacaaaaaaacaaggaggcaaagcttattttgcctgggattcatctaaatgcagttgtgtgcagaaggagatcatgcctgtgcccttgttggtggatttgcatggaaagctgattgtctattttgacctcctaccagatttaatgaaagagaagtagacactgtctcttgattggactctcctatgctgagcttcgacatgccaacaagctcatcaacgttgattgggctctttgaatgaactggaacaggcttgacaatctcatgtgtttcttgcacaggaccatcttcatctttctgattttgccagaaaggaaccgagaattgcaaaaagggcgagaaataagctggaacaatcactggataggtcgactgcaaattatctggcatgatagcagaagcggaagagctctctgcaacggcagaagtatctgactccatagaatctacctcctcctcctccctcggtggaggtagtgctggttgatttaatacttgggtctctggttcttgacctccaggaagtggtggaaggtccatagactgtaaaaccaccaaaacacagttcagttcccccattagagtacagagaaaacagtacaacctttctaattcgaacaaggataaaagtgttctcaagtcttcatgcaatacataaataaactacacaatttgttcaaaaagataagttttagcaatatgatatctatcaccacacaaatgagcaatctcctcgtctcaatataagaatagacccaggcaggcttattatgctacatgccaatatcagcacaataatcgaaataagatcaagcaagctacctcatctggcaccatgtcaaaaaggctagaccttcttttccttctggtcatattggattggcgtataaaatatttctgagcatgactggctacttgagtaggtgttcttgagaccacgaaattacgagagattcctcgccaatcacctttgccaagcttttgcaatccaagcaaaaacctccggtgttcttcttcagtccaaggaacacctgtcaaagtcatcttaatcagaaacatggcacacagaatgtggcctgcaggcacgcaggtagcgagtaatgactggagtacaagaagctggagaactgtaatagttaagctcccatcatatactgacaaaaataccaacaaacttgggactactacacaaaataacagtactgcctatcaccaaaggaaaattatccagcccaaaaaagagcccgttcctaagaaacagggcgcacagagagaggactccaatcttaaaaagtaaaaggattctatgagattccaagagaaatgccagaacataaaagggaaagagacaaattttatgtcttttgccaccttaacaagttatgcagaaggttaacaagattaaaacattgtcaatctggcataatcctcttaacagaataaatgtcaaaagaatagcaaattgtacatttcaaggcgatttcttttatccaatttagtgcctttcattacaaattgataaaggacaaacatatacttttgacttttccaatacatttaagtcagtaggcatataagtctaaaactgcactccaagcatcaaatttggatggaagtacaagttaatgaggcaatgacaacgcagtctaccaatggcatgacctctagtaaggccgttacagtaggaactactgccacagtaaagatcaaacaatcacgtgctgctttgaagctttcacacattaacataggcatgccattaggaaggttcttgggttttgaaagctgacagcttggaagacttttcttggaccaacaccgcgaatataactacgcagtaaactagaaatcattctgaatcagaacagagctaacaacaccgtacgcaatcataggttccaatctccgatgatcgggtgtctaaacatgagaacactgagcctagttaccagccactcacaaaatccctaattcgacactgttatcctctcagaacacgtggccccatgcatccttgcagaggcaaaggatcaaattaaaaagttccacaggatcagccatcattactcgttggaacgatctggtctgattctaaattcttacttatcctagacaaatatggagctgagcatgagtttgacaaaacgtccttgtgatctcatcaaacagttggaggcatctatacgccgtccttgtaccgagagtaattaattgaagtggagtggcgtatgcatgagctaagtagtaccaaatcactcatccatgaccatcagtacaatctgcccattaaatgctttctctagcgtctgtcctacttggaagaaacaactagcagtgactgctagtagcagtactccatcaaatctcccaaatctacacgccgaagcagcaaaggaagaagaacatactagtaggaataataataaaaaaagaagcccaagaagaagaaaaacctgaggttggagaggatctagtaagtcgcatcaggccagaatggtttttgggatgattaaatcattgaaattaaggggttgggaaagaaaaagaagggggggggctgacccttcttgcggtcgcgggtggcggaggaggagccctggacgaagtcgtcggaggcgtagccgtcggcggcggtgggggcggcgtcggggccgtcggcgggggaggcgccgccgctggtggatccggcggcggaggagaggagggagaggttccccatgctggcgctcttgcggatggagccatcggtgaggcgcaccccgaagatcttgaccccgcggttggggcacgtccgcgagttgtgcccgttgtggctgcagtgcgagcaccgcctcgtcatccccccctccgtccctccaccttccaaagcttcccttcccccacctatggagatcgatcgatcgatcgagtggagacggagatggtggtggtggagacgacgaggagagggaggggggagaagaggaaggggaggagaggggttaactgctgtgtggtgattggttaaggtggtcggagagaggcgagggccgtccacgtggcggatattcgggggaaggggatatacgtgagacgagggaggcaagtagcggcggcttgtgggtcacgccttctttctatccgtccacgcggttgggcttccttccttcggctgctctcctcagcctcagcctctgcttcgatcgtttcgtgtggtgactggtgaacgatccacagcaaacggcccccaacaaactctctctcgctgctagctcgtcaaactgtcgtggtctttctttcttttcttgttttttttcttttgagcgatgtcatggtctggtttaactcttctactcgtaactaaacagacgttaactaaagatgaaaaatgcacggattattctacgccaaaaagtttatggattctaaatgtgttgcttcttggtgtaccatgtaaccctaatgtgccacgggtgaacgtaaatcctgaatagttgaggattagaggtttgtctcactataactatcaataccaggttttggttgattttatcagctaaatgccagctagataaggaagataaatcacacgtatctgattcctaaagacggagagttagttttgtgaacagtagaactaattcctaaccaaattggagataaccctcgagccccaccagcgcctatataaagagatgaaaggcaaaggagaagggatgtcgtactctttgcctaaaccctaaaacttgcactagaaaggattcgtgaggtgatctcgggaagccctcggtgatgaaaaaagaagagaagaaaagaaaccgaagaagaagagaaggaagaaacaaaaggagaaaattaacaccaatggcatctcaagcaggtcggtgagattacaattctacataggtgattttgtataggctaaagcattgagattgtaaatttgaactccaacacgaggatgtcaaatatttttgtagaacgctcactttgtttcacattagaagacaataatgctaatgacatttttacctatcgatcctattggagagacaatattaatatgatggtggagtccatccacgaggtccataaatatgcgtctttatagtagatgttgagtctaaagattatacaacctttatcaagttagtgtcatgtggtatgctatgattcgtttatatatgcatcaacctatactctatataaggaattatgcttcctatagagtaagggaaaggaattattgatgctatttgaatgtgtattacgaggacacgctgatagctatgtacgtgtatgtatttcatgggacctaaaatgtgcactcactctttctgcaagcataaatcgaggcttgttcagtttgctatcattttcaaccttatcaagttttggcaaagttacttaaaaaagtagctacatttagtttgttgccaaattttagtaagtacatataaaatcttgtcaaaatttgacaaccttgctaaaattttgataaccttaccaaaatttgataatgccaaaacttaataaggttaaaaataatagcaaagtgagcaggccctagatttatactccgtatatattttccatgtgggctgcaggcacacaactggtgaaacacatggtggcattggaggtttgggaaccagggcgagcatggtatcacttgagcgtgacccgtacgagcacggcagggatgacgatatcatcgatcggacccgtggcgcgcgcgtgcggaccaaaaatccaaaaatccggacgacaacgagacagccacacaaacgcgatgaggccgcaacttgcacacacaagcatgtaacgcacctgcctcgtccaacgcgaataacattcgtgcagctcaaggtgtggccgaccgtgcgcgtacctgtagtagagaaacgtacatggatttattttctggctagcttcacaagtggttagctaattgatctggattcaaagactcatctattctatttatttaatattaaatttttctctactattcgcgtttttttcgtacctgtatgtatacggagtacttatatataagggtagtctggtacacgaattcgtagacgttgcacaccagcttccacgacaaataaataatcctgcgagctgcagctgctcatcatcagctcatcctatcctacggactgcaacaaccaacacaaacacaagtcagtccatgccgaaagaagccaaagaaaaatgcatggaaaatgtatacaccacatcatcttgaaccaaatcaccagattaatcaaagccaacgaacgtacggcaaggtgatcatgataactatagcaaggatgtaaaaacaggagtattatattttcaagaacacgagcaatcaacggatctgaacctgaagtaattaacctgcaagtcaaaagggatccaccgcgagaggtggattattgtcggtctaccactcgtaaaaccgggggacaatgttgtcggtctactactgcattctgtattatcatattgctacaagcacgaaacagtgacagcttatctaagccaacaatatgctttctgctcgcaactaattaaaattgcatccatggggttgaacggaccaaagaggataagttaagaaaaagcgtggctaaacactcaaaaagtcggcaatcgatcagcatgcacctttatcccttatgcacggtaatcctaagccatgactatcacggaacgcgtcaaagaaaaatgacagtcacggatcaatcaagggcgcagttaataaaaatagcaaaaacttgaaggtgttaggataattttgacagtgacttgcttgttacagagatattaccttttttttatattctgtactaaagagtatttacctatttgaagtagaaaggcatcataatctaaagtaaaacagagtatgtaagcaactgagtgagcaatggcctatattattttcgtgtggagatattctcatctaatgtcatcaagattcaagacggaggttgcacttgcaccgatctagagagaggatgtgcttaccaacatccaaatcttgatgcctaattttgttgatgcagttggacaaaatatcccttgcaagatactagcatatatcttcaaattatcgaataaaatataagttaggatccatcagcagtgactggaccatatctttttttatatataaaaaaactgacactggagtacaggaccatatcaacaggtggatatatattgtttacgtgagtgataatctaaagaaagaacagaacttgatgaattaaaagttgtgaaaaagatagcatacctgcaggcaagggtagccattccatattggcatattccgaatgtgccgttgcaacagtttccatcatcagattcatatgcttcactggtattgaattgataaacaaatccatttcaataaaacaaagagataagatgtatggaaataaaagataaacttaaaaaagttgctcggctggatcaacaatgataaagaaacacagtcagttcattaaaaagaataagaagattcatgatttgttttctgtttatatctcattctctagtttaaaaacaactcagttgaacattgcacaaaacaacggtactccagagcccagaagcctacacgccttatatttatgttacctaatagatttaattttctcaatcatacgcacccagtatatggcagcaatataattaatctgaaacattagtaagaagattttgctgagatgctagtctgaacactgaaccaaccatatttatgttacctaatagatttaattttctcaatcatacgcacccagtatatggcagcaatataattaatctgaaacattagtaagaagattttgccgagctgctagtctgaacactgaaccaaccattttggaccttatggtttcttactaaactaaaaatgttctggcatgaagagttttagtatcatataaacactgtaatgcacagatatttagtaccaactaacaaatacacttgaaatggtgcacttatgactgcactgcattattgaccgaatagtgctgatcagcagtaacgtgcaccattgttctgaaagaattcagaatcaggtcccaaacttgaagggaaatataagcaacaacagtggagtaaacagttctctgaaacaagatatgaatgtgcaatgagcaagagtgatagaaagtgggttgtgaacttgtgatacagttctagaatgctgtagttgtttgcacaataccaaatcaaaaatgcctatggcagatttgcacagtacagtttcattgacgcctttcaagatggaaagtgttctaaagataatttggccggacaaatatagaaatattcttttgtccttttaagaagcaaagcttggaaaggacatcaaatcaactgaatgatgaacgtccaagtaaaaatgaacggttacatttgacaaatttatcagttgttgagaaatggcgaagcagacaagtaccttcagaaagcaattggtacacatcatcactcaaatccatcttccagaggcccaaatcagaaataccgcttgatgcatcctacacagacaatcaccaatcacaactgaaccactcaactgcatcgtagcaaccatcccaaaaaagtaaaatattcgaaaatatgatttttgtctcgaactacaggcagtatgaggatatgacaaaaggctctccaactacatctggctgacagagtcgcgcgtaacctgaacaaattaagcaataatcgaagcacacgccacggttgtcgacgatcccctcacactccaagctatccccagttcaccacgagcccaagaggcaagcactgaaaaatccttacccctctttccccgagggccgcaccgccatcttcccctccggcgaaagctcgaagaactagtcgccatccccgaacgaacacaccctagtacataccataaccctacccagcaaaaacgcatacaaaatcaaattaaacggggacttcgcgagctggaacgcgagggaagaggagcaggatacttatctacctgcctccggtcggattccgctgcggcgcggagccggctgccggagggcgcctccccggcgtccccgccatctccggcttcgccgccgcccgacggcgacgcgcgcctctttttttcttcttttttgagcccgcgcgtctcttgctctatttcggtgtttcaaatgggccgagataggtgggccttaatgggcctgaatcaaatgcgaactatactgtaatattgtcgatttgggccgaaaattatccatccagtacagtcacctgacaagtaggccctacgcgccgcacttgtctcgcgctgctgtttttttccccctcctcggcggcgattccactgcctcgccgtcgccggagttggagaagaaggcggcggcggcggcggcgcaaaaaggtgaggcctctcgaccgaatccctttccccttcccgtcttccgccccgcgcagtcagcagcaacagacgaaggaatgcggtgcgaatgcttgcgagtagagaaatcgatttctggctgccgttcatctgcgcgttttgttgcgcgcgcgcgcgcgcgagggagggagggagatccagtaaatggcgccttgtcccgttgcttgctcgatcctcctgccggccgtgggggtttttgcccccgattggttccgataatttgtcccgtgttgtagatggtgaatcggtgatgaccaagggttaccttagatgataggaaatgattaggagtagcgtatttcctcgtgattactggagctgatacaatgcaggatatttttagcgctgatttgtaacatggcaggattaatataccattgttgtgctgttgatcacaccatatttcccttatgcagggtattttgtattagggatataggcaatgcaaaactgcaagctgcaaagccatggccatccaagataaagttgagaacaacgacccaactgtgactgttgggttggccgtgagtagttccaaatccagtaagtacgccgtgcagtgggctgtgaaaaacttctgcaccaatgggatggttaggttcgtgcttatccatgtactgcagaggatcaccacggttccaacaccgagtgagtgcatatttgatgtgtttcctactgtgtagatgtatactttcgtttgtaaatcatgttgtcacttaaatatatctatttttcttgcttcttttgtagtgggcaactatatcccgattgataaagtacgggctgacattgccagcgcatatgtgaaagaagtcgaatgtaaggcccgaacgatgctccttttctacaagaacatgtgtgatgagaaggtatgacgttgccacttcaggccatcctttttttcttttccgttccaaaatgaacattcctaagggcacactggagccaaatataatgaaatacaactgaataagcacaattcacaacagtatttattcaggacatttcataatgttaattttgttcagaattgtactttcgtatagagtcagaaattatgagaacaggttagaactcagcaatgatactcatagttttaaacatcctgctgaacatgtgtatacattttctgatcttgttcaggctaaagctgaagtactggttgtcaaaggtgaagatgtggcagaaaccatttccaatgttgtttcaatgtacgaaatccacaagcttgttgtcggtgactcttctcagggcaactttattaggtacttaacatgttctgtaataaataatggtgaactgcatgcatcaaaatgctgattaatttggtggaaatgtcttaggaaatccaagggtactaggacatcttctcaaatttgcagaagtgttccaagcttttgtgcagtttatgttgtctcaaaaggtggtttatccgcagtttattctcctggatttgaaggtcacaagagttctgagctattcctgtccagtgatagctccaaaactgaaatccattcagatgataagccctcattatcaggtgaagttatctgtccgtaaaactggcactggaaattttcactgtgtactgtatagacgataacataatgactgcttccaactttgaaccttttcgtccttggtactctttgaagctgatatagaatggatctttgctagtctttgagaagtttgtagcacctagcttccttttcaaatgtttgcttggttctttgcattcaataagaatttggaatcgaggtcgtttggttttgaaattcagcaaaaaagaaaagaaaaaaaaacagtgcaagaaatttatcccttttgtccaatgcagatgccacaccttcgagaagctttagatcaaacttgacatgggagaatctggaaagtttatcatccgcagaccatgatagaccgcgctccttacatgagtatcttactgaaagcacttcagcatctgttggtgataataacagtaattctccatgtgctagcggtcaaacccctcgaccaagtaacgtgcttatctcagataaagctccaatgacaagcagtcccctgcaggaattgatgctttcagaggacatggtgagccatttgattttttcacagtaaaactgtaataaattttttcacagtagtataattttgcaaatgatacatctttgatgaattgaggatgagccttcactgtttaaacttcttagataagaatagttccttttttttctgaatatacagtaacttaattttctcaatgcaggatgatgtaaatagcgagcttgaaaagctgaggcttgaacttaggcatattaaaggagtgtgcaaacttgttcaggatgagtccatcaatgcttctcagcatgtaagtttgggagtactgtgtttcaacataattagttggttactttatctccaatagtcagcaacttaattgtcatcttgacaatcatatgttaggtgactgacttagctgcaaaacgtgctgaagaggaagcccggctcagcgaggtctactccaggatcaacagagtcaatgagcaagcacatcaagagaaggaacaactgaacgctttggaggctcagtgcaggcatgtgagggatcctgctagagtcgacttgcagaagcagattttgcagctgaggacttcgaaggaggctgataagatgcaaaggctggaaaaacttcttgaattagatgggatgtcatactcaacatttacatgggaagacattgaatctgctacatcatcgttttcagaggcacttaaaattggatcaggatctaacggaacagtgtacaagggcaatctacgtcagacatctgttgccataaaagtcctcacttctgacgacagccacaggatcaaacatttcaaacaagaggtattccttgaaccattaaaggttgagcagtcaagtcctaatatcatcatgatctccggatcttcagatatattcataggctaagaagtaaattgcgataactttgctatgttcaaatatgcagtgctactcttcttgcatatataatgcaagatgccatcattgttatctctaggaaattcttataagatgcccctgttctgcagcttgaggttttgggtaagatccgtcacccacatctgctgctgctcataggtgcctgtctggacagaccatgcttggtgtacgagtacatggagaatggcagccttgaggatcgcttgcaactcaaaggaggcacggccccactcccatggtaccaacgtcttcgcattgcttgggaaatagccctggcccttgtctacctccacagctcgaagccgaagccaatcatccatcgtgacctcaagcctgcaaacatactccttgatagcaatttcaccagcaagattggcgatgtgggcctttcaacattgcttccgctgggggatgccttgtcgacaacgcgcacaattttcaaggacacagatctagttggcacactgttttacatggacccagagtaccaaaggacaggccaagtgtcaacaaaatctgacacatacgccttgggcatggttttattgcagctgctcactggaaagccacctgtggggctagcggaccttgtggagcaagcagtagaaaatggtcaccttgttgacatcttggacaagagtgctgggaagtggcctgcacaagaagcacatgagctagcgcagcttggcctaagctgtttggaaatgcgaagcaagcatagaccagatctgaagtgtaaggttcttgtggagctggaacggctgaaaaaaattgccagtgctgtctctgaccctgtacggccagtgatatctggaccaccaagccattttatctgcccaatactcaaggtattttttggcttattgcaatacatcagctttaagtgaattacatcacaactacctgtagctcattgtcttgtaagaatgtttctgtttcagaatttgaactatattacacttcaaggtggtctgtaattcaactttttactcttaccttgttgtatccatttttttcgaagggtctgaggtgaaacttcattttgctttttttcctccctgtagaggataatgcaggacccatgcattgcatctgacgggtactcgtacgaccgggtcgctattgagatgtggttgtgcgagaatgacaagtcaccgattacaaaatcgcggcttcctaacaaggatttggttcccaaccatgctctgttatgtgcaattacaagttggaaggcagaagcaagggactgattgagtgattgtgctaggtaacttctctaacttcacatggatacggcactcgaaggctgatgatgtacatgtttttgccttggtgatggcctccttaatctctaatactgtagatactgcggtaatgttcttgtaaagcagcagttttgcagcattttcatagaccatctctgagataaattttgaagggtttagagtaggagtatcaagaaggtcattttgtaggttggaccagcagaaagtacagtagtacacttctacagtattgctttgtgatagtttatacatatacatcgaaaggataggaaattcctcttactttcttatcttagtattgtgatgactactctataaatttaagagttgagacaaatttccggcatagactccatgttaccgttgtgactatgatggctataaacttagtatttcttccgtcccaaaatatagcaagttttaattatgaatttagataaacacttattcagatttataattaaaagctgttaatgtatattttgggatggaggtgataatatttaaactacctctgagagtaaagggttagcaggtggtcgtcgtatcccatagtgttttgctagtactattattattgttacgaaccatatttatagagtaaggtatttgctgtacttagcatgttctgttagtattagcaaacttggacatgtggtcttcagctgtacatccatgtagccttgttcaactcgatcagctccaggtgatgagatgatcatatctgaccaataatttggacacatcaggtttaactaaaccacttaggaaaaaaaaacatagcttgagctgcgtgtaagtggatgatgccagcagctgttcaaactactccaagtactactccagtaagaaaagaaaaatgattaaggagagatgagttagcagcagtggcatgacgagctaggaggccggattgtcggggctttggggttacgtgctagtgacgtgtgggccccaagcacggatgacgtggacactttcacgtgtatatgcagctagctagcttagcactactagataagtataagtgtggcacacttgtgatagtgtgaaggttaagagtaggaggaggagtactaattataatcatcatggtgtcatcatcaggcaaggtagagtcccccgacagcatgccggtttggtgtcaccaccgccacgagtccatgagtgacatttattagggccaatgcattgcacgcacgcatgattgctcacattctgttgcactaacagataaatttagtactgtatgacaaaatgacaaaattagtccatgagtagtaccaatgcatgcacgcacgcatgattgatcacatattgttcccctcttg

SEQ ID NO: 11962 - DNA, 16584 bp, Oryza sativa
  unsure (1)..(16584): unsure at all n locations
ccatccagattcacagtagtatgacatgtttcatctaagaactaaatttcttatatttttatatgaagggaatatcaagtttatgtatgttttaaaaaattcagacaagtatattttttcttttttccaactttctttctttttttttctttctttttgggtggagacaaaccaaatatgtactggaatttactttatggatcgggagagaatgtcaaactgaaaaaaagctatgaataaaccgcgagcgtcgacgacgatgccaccagagagagagagatgaaaaaaaaaagtgaataaagaaaaagacccaaggagaggaaaagaaagaaatgggtgatgagtggctccaatgattggaagccaaaagcaggtgtgcgttgtcggggaaagtcaagccaagggaaggcccacgtgaaagcctgccgcgtccgacgtggcccctcccgcccacgtgagtaggtgggccctcccaccccggtttcccctcctgctttcccgcctcggcccacgtgacccctgggcccactagcccactactaccggctgctgctcccggctcggctcggcttaaaatcgagcttggcttgtcgagttccaaaaaaaaatcaacttaaaaggaaatgtgtcctctcctaagtttatgtatgtggatatatgaggtgtccatgtacattgatctaggaggggtcacatcatcccctcttaggccgagtttagatccaaagtttttctttaaacttctaacttttctatcacatcaaaactttttgacacataaattttcaacttttccgtcacatcgttccaattttaactaaacttctaattttagcgcgaactaaatacaccattgattctttttgggagtggaggatgtaatcggattggcgtgggggcaatgcagtgatgggcatgattggggtgatgatggcggcggcggcagggagaggggaggagatgatggttgggtggaaggggacagcgtggccgcacgcctcgcgtcggcgaccggcagcacgcaccatggtccatgggccacgtacgacccaactgtagtgcatcgccgccgcgccggattgtgccacgtcgtcgatcttgctctcgttcatcagcgactagttcatgtcttttgttgaaatgcgtaaatttcactataagaaatataaaaagtggctgctgagaatggtttctgatccaggtttatgtttttaatggaaaccatgttcaatctgggtgcccaccgtaactgccgtggcggatttatgccacgccttgctcgtagaatctaggcataccacatactattgatactaaggtcgtgttatttccccttttttttcccgttcgtaccttttcaaacggctaaacagtggagtatgacttttgcaaaagttttttatatacaaaagttactttaaaaaattatattaatccatttatcaagtctttaagctaatacttaattagtcacgtattaatgggtaacaccggaaaccacggggaactccaccttccaaactcagcctaagtttagacgcaaacgcttgtataaacacacttatactcactcctgtaaacaaatgcatgcgtgtacatctatctctatgagtatctctcaagatagaatctgcatgttataagagttatgaagtcacaacagatttataccgacattgttaaaaggataattagctgtaaatacgagcatccatataactgatctcatgatttcgttggaacacatgtttttgtacgtacccctccgtcaaaaaaatttaatcctagctatgaacctggacatatacgtatccaggttcgtagccagtttttggacatagtagtaagcaataggaatcggtttaatcgataatggacttgatcgatacaattagctctattgtcgtatatatggctggctgctgcaatacacggttgttgccgacactctcgactattaattaccaggtttgttatcgcattcgaggatgtgcacatgttgtgttattagtgatggattgcttcaatgtggcttacttatttcactctcatcttttcttaggaatatgcggaagatttgtaagccttttttttttttgaggttgcaaccaattgtccatactttcggtacggactacggagactattccactgataggagtacatctgttatctttctctttttctctttttctttgtggcatctgtgtcacatcttgggctatatcttcataaaagaaaataggcaccccaaaagtcaacagcttaagatggagcaatgtactactgcttatactacctccgtcccaaaataagtgcagtcgtagatatccgtgcccaacgtttgatcatccgtcttatttgaaaaatttgtgaaaaatttaaaaatatttagtcacacataaagtactattcataatttatcatctaatagcaataaaaatactaatcataaaaaattttcaaataagacgaacgatcaaacgttgaacatgaataatgcaaaactacacttattttgggatggagggagtaccattttaagctgtctagttgcttcgtccgtccttaaagagatataggtcctgcttggggagctaagggtgtggttggttgcctggctcgtccctggctcgcatctcggatgcaacttgtagactgtttggttgactgcacgtgtcccacagccaggccgaatagatgcaaaaagtctctcgcagccaggctgagcacgaacgaccgaatcgagcttcgctgctcatcctggctccacgcatgcagcggcgccgcacccgcgcatgcaagcgctgcacccgcgcgtgcagggagagccggagaaacgatggggtccccgacaccaccctaccttcttcctcatttcttctatcttctcttctcttcgctatcgccggtcatggccactagcggcgaccatctccatcttcgccggccagatcaggctagctgcaagtcctgctcctccctctcttcttcagcaagggctcaccaagagctctccgccggcggatccggagggcatgagctcgccactgccagatctacctgcacggagatgtcgaagtatgagcttggcttaagctcgtcgtcgtcgccagcggcaccactttcctcgccggcttgagctcgtcgctgcgcggacaccctcgccgccacggacagctacctcaaatccatctcctactcacctttttttttcgccagattcagaggttagaagctcgggcctgccagatccgagtaaccacaacaccctcccggccgctggacccgctgcaccgacggcggcgaacatgcctagctgggtggcacgagcggctaggtaccggtggcggcaagttcctctgcgagctctgttctcctttttttttctttcttttttccaccgaatgtcattaaccactgataaatatggtttatgtactgctgtgcaactgtatatgctcatccgatactgttttcaattattgttgtcaggagctccgaaatcaatgctttgtatattttgcatgtactattaaatctgatatatataccataaataaatacgctttttatttcgtagatggtaagaattttcaatattaattctaagtgaggtaatctctccttcaaagaaagaaaatacttatacctactatccatacaaccaaccaaacaaagtctctttcaagccgtatctttggtgcaagcagccaagcagaatctcacgctaacctggctaaaccaatacaaccaaccaaacggttgcatatgtatctacctagccaggccaaactcagccttgatggaagagatgggccaagctaaaacaatgcaagcaaccaaacacaccctgattctgagaagccaacttctgagaatctgaaaaagatatgttttccagtttttgacttctagtttacaactacagctttagaatctagaaaaaacttagactgtttggggagcttctgatttctaagagaagctgcaacagttagaaactcccctaaactggtccatagttttcagtggtcaaaagtgagattatacatgaggttaaacaaataatatactattcattaatacttggagagaacaaggagaggagaaaactaggggaatgagagagtattattagttcgatggttaaaaaaataaataaaaagatgaaatagtaaatagtattaaggaagaaaaatattttttgtgagctaaaattttaaactataattagattttcttttggacaaggagattagagattaatgtttgggaaagactctgctggtatctctcatttacggaggaattgagggtgattggataagataaaaagaaagataatcaaatagacaaataatactactctctatttaagatataatagtacatagaaaaatagggttaggggagtataaaaaaatcttaacatttgtgaataaacataacacacactaggaaaaatgttttactatattagtagacaaagtggataagcctcaggagatatacttgatagtccagtgataaaaagactgtggtttcaaccttaagaatcctcaacacgattataatttctttttaaaaaatatttgaaggggcgtttctctctatatattttttttattttttagcgtaaagccgtaaaacctcaggctgcgagctatgggcaggctcaactgaaggcatggccaggaaccagggtcaaaggagcaacaagtcatgtccggtgggccccacccggccccaaccccgggggacaagtcaatgagtgcccccgctccctccgaacaggaaaagctgctcatcatttgcgctgcgacgctgacgcgtgcgcccattccacgcaaaagaatactcgcagcccatgcatgcacaatactactactactagtattttctttgacttttcctgcaccccacaaaatatcgcttttgatctaatctcctccttaattaccccctctaatcaagctcccctgtctcccccacgctttaaaagcttcctcctcctcctcgccaaccaccaccctcagtccctcacctccatttccatcaagcccaagaacgaactcaccacgctagtgttgagaagtggagagagttgagaggaatcaatggagatgatggttcatgggaggagagacgagcagtatggcgggctcaggctcgggcttgggcttgggctcagcctcggcgtcgccggtggtgcagccgacgacgagcagccgccgccgcgccgtggtgccgccccgccgccgcagcagcagctgtgcggctggaacggcggcggtctcttctcctcgtcttcctccggtgagtatagatggacggacttacgtcgaagtcgtgcgtgcatgcatggatgcatggatcgatcttacgaaggttagtttgcgtgcagatcatcgggggaggtcggcgatgatggcgtgccacgacgtcatcgagatgccgttcctgcgggggatcgacgtgaaccgtgcgccggcggcagagacgaccacgacgacggcgagggggcccagctgcagcgaggaagacgaggagcccggcgcgtcctcccccaacagcacgctctccagcctcagcggcaagcgcggcgcaccatctgccgccaccgccgccgccgccgccgccagcgacgacgaggactccggcggcggatcccgcaagaagctccgcctctccaaggaccaagccgccgtcctcgaggacaccttcaaagagcacaacaccctcaatcccgtaagcaaaacaatcaatcaatcaaactaattaccaatccaccatgaaatcgatcaagaacaatccgattgacttgttcttgctggattgatcagaagcagaaggcggcgctggcgaggcagctgaatctgaagccgcggcaggtggaggtgtggttccagaacaggagggcgaggacgaagctgaagcagacggaggtggactgcgagctgctcaagcgctgctgcgagacgctcaccgacgagaaccgccgcctccaccgcgagctccaggagctccgcgccctcaagctcgccaccgccgccgccgcgccgcaccacctttacggcgcccgcgtcccgccgcccaccaccctcaccatgtgcccctcctgcgagcgcgtcgcctccgcagccaccaccacccgcaacaactccggcgccgcccccgcgcggccggtgcccacccgcccgtggccgccggcggcggcgcagaggtcgtcggcgtagagaccccactactgattaattagttaattagagatgagtagtggctttttcttaattagcagggtattaattaattacttaattagggttggacccctgtagttttcttgtttatactacgtgtataatttagctctggttttgaactttttaattagtttcataatctttttttttcctatctctcacttcaccctgtttgttgtttactcagcaaagaatatggtgtctttgtataaagtgatgcatgaaatggatcataaaagttttcaatattaattccttcatatctgtagtgttcttggactactaattactgccaaaagaatgatatgattactactgtattgatgcttactatcgactcttgtggatcccccttgagatctcaggataacgatggctgattttccttgctttgttttgttaatctcctcatatgtataagaccagagtaattaattaattaattaacaggggtcgaactgtcaacggtgcaattattaacatctccgagtgcaggcatcagtgaggatgaattccaaagaggaaatcttctccttttctttccattccctgtgatcttatctttgaagcattctaagcttcctgacaggaacatctagctaagctatagctaacttcagagatgcaaaacttgcaagaaacaaaaggggaccagatcaagaaactgaagctgaatctgaagcaacaataacaacagtctctgcaaatcaattaatcagtctctgaacatgtgtgtcgctgttaaacaggcagtcaattaatcagtcagaaggtttagtggtagctgccgtctgaaccgggcaagaaaagatgagcagaatttgacctcttccaacacacaatctgcagcaacttttggctcatatgttctctggccatcttggcgaagctactactagtagtacggtgattgcaggggaaatatctcatcaaatctggatgaaagctactgaagatgagatcattggaacaagacgaagtttcctggaccttactgaacttgcgccagacagatcataccaatccagtatcactggaataaggccctatatattctaaacatgtttttgcacggattattgagacggattttgtttactttgatgataaatcaatattttgagaaataaacttcagtgatttataaatagcttaaaacaagtgatctaaataatgcagtagaagatcttttttatgagaaattgtatagacaaaagataagctgaaaatagcatgccctaatacttgggattaacatagaaaagcaagcaatggcttaattagtagtactcgtagattatgtgtgagttgtcgctactattagttaagtaatccatagcttaattagtagtaggtgcaggtgtgcacgcatgatttggtctggtgatgcaatgcaatcttggttagatttgcgcctaacataatcaggatcattagcctccccagccagcatgccatgtgcaggatgccactaaactactaaaaatcatttggcatcatcatcatccaacagaggcataatgcgtgcgaggtgatgcatcattgtttaaccaaagtgattaattatctcattaggtgtactactcttgtgtgcagggcttagatgtggagggatcacgaagcaaacaggtcccacgcggagcccctcagcttaaatccgggagcaaaagctgcagagatgagaagaaaatttgctaattcatgggacacctttgctccctgcttttgctaacacctagtacagtatactatacccctcttttgctgaaccttgctttgcttgatgaagttttcaaagctggtaatcaatgatgatgcctgtcagtttacaatactttaattgtacactaattgtgttttgtgcagttgtggacttgtggtgtgcaaatgcaaagttgcttggtgatcaatgattgtgctagtattgcctgcacaaagtccctgattagaaaggctgaaatgttgtgcttactaagtagtgttcattactggggccaatgctactgtcttttcaattcttttttctctctcttttctttttcacatgctttcctggagcagagtgtagttagtcagagcagagaaagcgaggttaatacgagtttattagcaggattagtactcaggaactgcacttttactgttgctgcgactgttcagtccaatacatattcagaagggttaggtaggacatccagattccagttgtgaatttcttttctgttcctgagccagcaggtcagctcctgcgcgtgcacgtagcatctgatctgatacggtgaagcattgttcgcttctgcctctgaattctgatccttccttggcgtagaatggaagcaattcagaagaccaactcgcgttgctcaactgattcatcagcaattcgcatgtagatccttctgtctgaatatgtgatcaagccaatggaaatacactaagctacatcgagctccggccatggtcaggtccaagggttgaacttctgacctcatagatgacgctaaggacctgtttagttcgtgaaaagaaaatttttgggtgtcacattggatgtttgaccggatgttggaaggggtttttggacacgaatgaaaaaactaatttcataactcgcctggaaaccgcgagaagaatcttttgagcctaattaatccgtcattagcatatgtaggttactgtagcacttatgactaatcatggactaattaggctcaaaagattcgtctcacgacttctccccaactgcgcaattagtttttttaatatatatttaatgctccatacatatgtccaagaattcgatgtgatgtttttggggaaaaaaatttagaaactaaaacaggcctaacacaaacaaacaaacaagagtaaatcacaaaaccccaggttttgagacacatacaacataaaacctcgggtattatgacttgtttcgagtaacactagattttgaggcaaaatgtttcaaaaagccatatgtttacatcaaatactcatagttttattattgtatatgttcacattagtaaactcaaaatacatataccactcgtgtactttatcttcttcctcacttttgtattacaccatttaaaaagtgcaacacaagtacacaaccccttaataatgacacattaaccagttacttatatacataaacagccatactaccaataaccgatgctcgttaaaataagtccaaacacgtatatcatggaaaatactttcataatatataattagtcaaaaacaatgatattagcttaaacatggggtttcttgaaacattttgccccaaaacctagggttattcgaaacaaatcttaatacctaggggttttgcgttacgggtgcctcaaaacctgggttttgtgaaatttactcaacaaacaaagatgcattactctctccgtttcataatattcgcactatgttaaactatgtgattattactctctctgtttcatattataatcacatagttttatacgaaatcaaacacttttactttttaccattaatttttaaaaacatgtataattcaacatgataatttaccattaatttttaaaaacttgtatagtttaacagcgtgggaataattatatagtttaacatctatatttttagaataatcatgagaaatactttcataatatataattattcgcacgctgttaaactatgtgattttttaggaattaatggtcaaagataagaattttttttatttacaacaaatctaatttaatacggagggaggacatcatatgcatagaggccattgacctgaacaagatgcagttcagtaatccgtatgcatgtgtggttgacagcacgatgcatgcagaagcagttcagaagacgaaaatttgttggtttggttggtctcgtctctgtactgaacttcacacagatgatggctttatgtcactgacttatttgtgctttctgaaaaccaacacacactacagaaatgtcaaacgaggagaaaaaaaggatgttcagatcgaagaaaactcatccatggtgcccattttgacccggaaatcaactgacgatgatgtgtgctgctgaattctcatcaccatgtaccatttcaggaggcatgaccggttggttgatcaatgcagcgatcaaccattgcacgtgtgcatctgaattctcttcctgcattgcagcctgatctctccttcattgagaaatctgaagcagtagcacaggccaaacttgcgtttgtgatgtactgaactttctcagaagcgatagctacttggtcagacaaatctgttaggatctttagtggttatttctgcacgtttgttgaggatcgagttcgcatgaataaacaggacaaatgattgatccagttagaaggaattaacaggtcaagatattatgtttttcttttccaacacatggaatggcttgtctgaacatctggaagaaactgtacttctgaagaacagaacaggaaactgtcgattaagttaaatttcaattagaagaagcatgtttagtgcatcaaatccataaccagtgatgttgctgtatttaatacatgcaaataaagcatatggagactggagctaaatacaatcacatttcagcaacctcagtacaaacttacatgagcagtaaatacaggtagaacagaacccactggtagtttcttggcaaaacttctagacaaatttgtcaggatcttcttgggtgaatatcttcaagttttgtgaagattcgagttcgcataaatcgacaggaaaaatgatgaatccagttagaattataagtcaagatattctgttattttccaacacatggaatggcttgtctgaagctctgaaactctagatgaaacaacattaaaaattctgaagaacaggacaggaagaagtcgatcaagttactttcatgcacaatgcaaatccagataactaaatcggctgaagaatatttggtgcaattgtatgcctcttctcaaaatgaataaagaaggcataaattcattcttggacagagaaaattcagaaaaagcatccagtaaaacatgtggagtgaaaatgccaaactgccagcttaacttgaaagcaagcacaaataatgacaaaatacattattcctctgatataaaaacaaataaaatggcaacttggacagcacatttgtctacaggcatcatgctgaaaaataacgttgtcagtcaaagtcaataaaaaagtagttagtggttagtatatttactagtagttgatagttccccttcttttttcagttgggtttgcaactttgcatagctactgctggttcctgaacgttcacactgcaaagcaaaatggataaaagcacgtcattatttttttaaaaaaagaattcagctatcaacaatagaacacagttcagtcggcactttattcacaagtaagaaagggttaatttaatctatgccattacaaatatgacatattagaaaaatataacattacaattcgtgttatcggctcggtgccactgagaatttttaaaatcggaaccatgccaatcccgtcactatttccgtcctcctctctcacgccgacaacctcaccgtcatagcccacccaccccacccccccaacttcagagaattttcttcagtctaattttctgatttatgctctgaagaatttgtcagtctttgttccgaagaagttttaaccgcagttctcatggtgaaacgcagagagattcagacggacgtgcggtggcgagacggatctaagtgggccgacacggcccaggatgacgtgggtgacatgtgggccgcatttggcccatcatgtccgcgtcagatatgcaagcagattgaggagtccgttccgttcactcgtcgccgtcgccgagatgagcagcaaccgcaaacgcgagctcgagcgcctccgaggcgcggcgcggtggctccttctgcaacgacgccgacgccgtcgtttccctctcattaattacagatcggtagagcggatacctcatacattgttccatcgtcaccgtcctgaagttgtcgtccatcggggtggacactggacagcagaggatatcctccagacaaataggatggaatgtggaaactccaagacaggaaactatgaaatagtatgggcaaatcaattctattagctcgttcaaacaaaaaaaaacatggaaaattaagcttgggtgttgctatgcaatgaaaaaagtgccacgacttagatttcaccgttttgttatataagactttatttgaattatttcactgtttgtattgcacttctgataaattaggcttgaattgtgttatgtgcttgaggtttttggattgtctttacccttttgaactagatgggcacacccatgataaaaatcctgggtctgtcactggtcgacggccgccgggatcgcgtccatgtccgacgatgccagccggagtcgctcgccggtggtcttgcagcagcttgaggtgttgatacgatcgatgtattgccgctaaactgcactgtaccagactcctctggtatttgctcatttctagtaacagaaatggtggcttcatgccctagttcaaaaaaaaaaaaagatcatgtattgccggtttctgatactatccatagatgttcacagaatcacagttagctccgtttgtaacgttgtctcacgtttggatccaatcatcccattcaagggggtttcggagactaaaactccgaccttttttgcgacggcccatgaagaactgtacgttccgtgcgttccccgtgtgtgtaacaacgaagatacatgggttggcttggtttgtagcctaaatagagcttaccaaaattttgtcaatgccaaattttggcaaattttgatatgactaattttgataaggcaaagttgtgtttgaattgaagccaaaatagacaaaattcactattgaaataacccattttcttaggcatgctaaaatttggcttcaaatcaaatattgttaagcctattttatatctcaaaccaaaccagccctatatgactatatacggtagaaactacaaagatgtccttgatgctgttaatccattcattatacagtgggcatgaattcatggagtttcttcctattagacgagagccaacacttccatgtcttcatcggagaaacttttagctactaatcacattcaatattctcttcgagcaatgcacagcagttgcgtggaagttaagaggaaaaatatatgatagtttccaccgaataatcaagtgggctagttgggacacatggtcagcgatttgagataccttgtcatttacctctgtacatgtagaagtcaacttattacagatatgtacatacccaagcaactgcactctttgcttgctgaggagactggagttaaggacttcacattgcatttgcatgttcttggctttaatatatacggatgacatgccagacaaaaagttaaaagaaaggtcgcggcgaatgcaagtcgaacgatcatggattaaccatgacaccttgaagcaaacatgggtgaggtttggcgagttgctctgcctcaagggagcagctctcgctccccacgctattgttactctcagggacagggagtgcctccttgttcttacggggggcacggcatcgtacccacaggtatgagaaccctgcaaaggccgcctggctcgcaaactgcacgcggtatactaggcttatctcccacaagccactgcccacgttaacggccaaggtatccgcatcatacccttcgaggtccgatttggaaaccatgacgaatgtcttctcgtcaaatgcaatgaggttgcgagtggcaaggaacagcggtggtttcattattgggctgtccaggcaaatggatttcccagatttcttcaccctaagctggtagaattgctcaacagcctacaaaatatggcatgcgacacatcagcgttaatgaagtctgactgttgaatatgaacaaaggagacaaaaacataaaggtgttccttgcatactgtaaagtatctccaaacatctaaatctaaaagattgagttgaaccggttcacaaaacaaaaggtaggggcagcttgatagccacagtgtctattactatcatgaatagtggacaaaaccttatctcttttctggaactagcaaaaatgtaaggagctccttgaccactaaaaatcatttcaaatatccaataataagttgcatatattagtgtctaacaattttttttcaagatggaagtcatataaatgggtccagttgatattgaaagcagtcctatttaattctgaatgcataatattttttttcacaataagagcattctgaatttaagagaaacacagccatgaaatcattctgcccacaagcacagaattttttttgtggcagcttacctgccgctgtgcagaagctaatagcacccttggcctgcgcaagcgaacatgttcataagcttcagccggagtcatttgtttgtattgcacctaagtacagagttaatggtcagtatcaaatttcgattatataattaagtcgtatctgcatggccaaataacctaacataccaagtagcaaagaacaactgttgtgctccgtccacgtccagctttgcagtgaacatatgtcaacttcccacacaaagcatttccttccaagattaaaacaacataaataaatacacgagacaaacctagttaaaaatcacaattgcaacagcacaataggatctctacgaaattaatgaacttaaatttttgtctacctccccattagaggaagtgaatatcacaacatgcacgaaaagtaaaaatgtagaagagcaagcagagcaaaaaaggcagtaaataaaaggtcttaaattttttgtatccacaacgtagcagcatattcagtcaagtttcaagaggaaactgcagtagcatactgcaaaaccaaatggcgacggccattatattggtagagttaagtacaatgcacaaattatttattacagggtgttgggaccaacaaacataaaaaacatctcttactacaaacaaaccaaaccaaacataaggtatcaaatcacaagttctgatatctactcatgcaatgaacagtacagtcaaaaacaaactagaatatacatagtgattccgtcgtattataggatatgcaatttgagtagattcttactgtggatgaagtcagcagcccggcaaaggttctcaaatgatggtgcataaagataatctctagttggtaacaccaggttttcaattccatgagcctaaaaaacaaaaagaccatttcagttgtgtgacctagaactgctagttatttgaacattcgctcatgaccagcaggcagaaacagatatatgtaaaatttagggaagttagcatggacatggcacatcagttgtaaattacaaaaaaacagcgccagcgtgattagattacatgtaaagattgcaccaaatgtacagtttaacgtagaagaaagcagaatgttaaaaaaggagcatgttgcatgaacatttcaatgcctaattagatttcttttttctgaactaacacaatgtttgctataaccttgtcatttaggttgaccatgagtagtttacatatcactgacctaggatcttcaatctaccttaactaccacagtcaggtaataacaatatagtacctaacaaacagcgatttgtggtcccatcagctaaacaaaagggcgcttctagtatttttctcaaacccttgatctgatgggtgggcatctagatggcaaacacagaaatctccagtaattgctctcttcacattgcagtattgcaccactgagaccactggaacctgattatgctatatgccagtgtggtttacaacaaggccgtgcacctcctcgttatcagagtaacaacaaataatatgcaggagccatactcgcaggaaggaattaacaaacagaagcagcaaaacttacagaactacatattattcagcacatttgatcagtcatttagtggaatgatttggccgtgtgactacctcatacaggcacctgggaaccagcctctcgtaggattcattcagtgtcacaacaccgcaaactccaagctccttcagccgtagaacatcgctggggaaaggaacagcaccgagcagaacatgctgatcgaagcaaaagaaaagtacacaattagagcagagtaaactataactctaaacagatcgagaaatcaatactgcagnnnnnnnnnnnnnnnnnnnnnnnnnnnnnnnnnnnnnnnnnnnnnnnnnnnnnnnnnnnnnnnnnnnnn

SEQ ID NO: 11963 - DNA, 1641 bp, Oryza sativa
cgggtagaacagcatccgcgcgccgacgcccaccgccgcgcgcttcgcgtcgaaagccacacgcatcaccaccccaccctcctcctccaccgccgccgccgccgccgccgccccacgacgcagctgcagcagcgccccgccgccaccaccaccaccaccatccccacctcctccgccggaatcacccggaagctcctcgatccgcatctcccccttccctccacctcctccaccccgcccaaatcgacccgatctggaccgatccgatcgggaaaaaaaacacacacaccagaaaaaaatcccccccaaaaaacaacgaatcaatcgatcagcgggtggaaaaagggaagctccgcagcgcgaatcggagcagctgggcggcgcgaggtggtggtggtggagcggaatcgaattgaattcgcgattccgcaaccgcgcggaagaaatcgagaaaccccctccccttccctcgcgctcacgcctccccaccctattctttccaaaaagtcgaaactgcccaaaccgagcagcaacccccgcgcatccgattagtagtacacccgggcgcgcgcgacccctttgtttgacatgtggggcccacttccaccgacagatggggcagggtaaccgggcgggggccggggcgggggcgggggcgtgggtcccctagaggtgacatggcggccgttgatttgtggatgggcttggatccgagcactgactcgaggacgcggacgccacgtggatttgcagaggtggggttaaggagatcgtgtggggggttaaaccgctaatccggtaaagtggatagttccatgcttgtataggacgttaatcgcttaatccattgcttcatctcgcagtgccttctgtgtgtttatgtcattatctttcttttttgtttgtttgtttcgttttggaacaaatgcacgtatagctatagatttcttcacgaaaataaaagtagagatgtctaatgtaatggacatgagttatggtgtgatgtagtcactcaaagtataaggcgaattagttgttacgtgcctaaaaagaaacattcttcttaagaaatttttcttgtgccgtattgcttatggggtgttaagattcagggtgtaaagtttttgcacgtcacatcatgtattatatagggtgtcgcatagggtgtttgggcactaataaaaaactaattacagaatccgtaagtaaaccgcgagacgaatttattaagcttgattaatccatcattagcaaatgtttattgtagcaccatattgtcaaatcatgaagcaattaagcttaaaagattcgtctcgcaaattagtcgcaatctgtgcaattagttatttttctaatctatatttaatacttcatacatgtgttcaaacgttcgatgtgagagggtgtaaagtttctttttccaaaaaaattgttaatttaccaaaatattcattttatatctacaaccgtgtagataatgcatcacagacgctcggttaataatctatgtcaagttatgcctatttcaatcttgttcaaattgagcctatttcaatctattactaattggaaatccaaataactcgtgagtttcaaaagtagcattttgtaaagttgaaaccaattaacatgatgatgacc

SEQ ID NO: 11964 - DNA, 6116 bp, Oryza sativa
  unsure (1)..(6116): unsure at all n locations
nnnnnnnnnnnnnnnnnnnnnnnnnnnnnnnnnnnnnntgtttgtttgtttcgttttggaacaaatgcattttttgctatagatttcttcacgaaaataaaagtagagatgtctaatgtaatggacatgagttatggtgtgatgtaatcactcaaagtataaggcgaattagttgttacgtgcctaaaaagaaacattcttcttaagaaatttttcttgtgccgtattgcttatggggtgttaagattcagggtgtaaagtttttgcacgtcacatcatgtattatatagggtgtcgcataggtgtttgggcactaataaaaaactaattacagaatccgtaagtaaaccgcgagacgaatttattaagcttgattaatccatcattagcaaatgtttattgtagcaccatattgtcaaatcatgaagcaattcgacttaaaagatccgtctcgcaaattagtcgcaatctgtgcaattagttatttttctaatctatatttaatacttcatacatgtgttcaaacgttcgatgtgagagggtgtaaagtttctttttccaaaaaaattgttaatttaccaaaatattcattttatatctacaaccgtgtagataatgcatcacagacgctcggttaataatctatgtcaagttatgcctatttcaatctgtttcaaattgagcctatttcaatctattactaattggaaatccaaataactcgtgagtttcaaaagtagcatttgtaaagttgaaaacaattaacatgatgatgacctgttgatattcctcctaactttttgcctacctgttctttccagcgtaacacctcactccttcactcatgtctacacattcttggaagcacaacaacccatggacattgggcattcctttcgatgccttgatatggtgtattgtttgtttgttttcagagcaaaacttatccccaaatcaatttcagcatgatgccaggatgataactgacaaaacaaccgacaacgatgcgtcagcaacgcaccaagattagcctagcgtgcttccaacaaccaaccgatctaatctagttctcaacaagctgacatagtatacagtagagagaaaagtacagagaaatgcagtactgaatgcagcttggtcaccacaggaaagaaactctcaagttaattaattacaggcttaattacagctactggtgcaactgggtaaatttggaccactcatccaaccaaggattggaatcaaaccagcaagctaaagtctaaagggtagcctctgatcaggatcagattcttcaccagctaactgaagctgaatgctgaatgcttagattgcttgctgctgtaaagggaactgaactgaactgaatgaattacaggctgaaacctgaagttgtttcagttaagttcagaagaagatacagtagaagtaacagattactgctatgttttactagcagattagctcatggcaagatttttagataatggaacagatatccagtttgattgccagatgcaacagtcgatctccttgcccagaaattgagcatgaacatgcactcactctcattcatcatctacatgaatgtaatttgtttacaggtggttcttgataactactaattagctatcacaaatacaaatagtaccgtactatctatctctgctcaaaacgagaacaaaaaaaaaagtaaaaaagtggcgccggtgatcgccggcggcgggcggcgggcgagctacttgccgtgcttgacaccacgcggccccgcggatttctttatcgactcgattctctgcagcctgatctgctccctgaacctggcgatgaactcctccgccttcttgtccacctcgttctcgtccacctccggcgacgactccctcctcggcgagttccccctcgtcgagagctcgccgtcgccgtcgacgtcgctgtcgtcgtcgtcgctgctctccgaggacaccgtcacgttgcccaggatggggtcgctgctgcctctctcgtactggaacctgggaatggattggtacgccctgtagccaccgtacggatcgtctgaatccgatccgtgaagaagagccggcgcgtcgccggcgacggcgacgtcgggttgttcttggctctggctctggagtgattctcttcctcctctgattgttctcaccgatttggcaactgggtagtacgacgaggaggaggaggagctatctatggagattcttggcttcgccgacgaggagttgctgctgctacggctgaattcggaggtagtgaagctgtgggaggtttgctcctgcagctcctccttgaagctcttcgccgccgtgcggcgttcggccgccggcggatggtagccgtggacgaggaacggaggtggcggcggaggcggcgccggtggggatgacttgtacgggctcctccgcctggaggagtagtcctcactggccttggctagtgtctccttggacagggacgacgccggggagagcctcttcggcgacggcgaaggggggctcggcgccgacgcgtcgaacctccccgaccgtgaccgccacgggatcggcgaagggagcacggtttcatggccgccgccgcctccgccgggcgtgtcctgtgagatcctgcgcggccgcgccgcccacggctcgccgccgtcgccgtagcccgcgctggaggacgactcgccctgcggcttcagtgttcttacgggcagcgacagcggcggcgcctgctgcgccgcctccacggcgtggctccggccgcctctgcgccgccggtcgccaccaccaccacaggctcgtcggggtggtgcatcgcgctccacgaccgcaccctgttgccacccgggctgtcgagcgccacgtcgccgccaccgtcgtcgaacaccagcgagtcgtggatcatctgcgacacgtacccggcggagtccgccttcgcctgcgccgcggcatccttctcgtcgccccgcctcccggcgttgttccggcggctgaacagcccgtacgacacggcgatcccgacgacgagcaggtggagcagctcccacaccttggcaagaaacgcctccccacggccgccgccgccgccaccatctccccccgccgccggcgcctgcggcgacggcacgagggggagcagcagtacgcacgccgcgaacaccgccgccctgaacgggaagctctgcagcagcgacgcctgcgccaccgccattggaggaagaagaagaagacgaagagggggaagcgggaggcagcgtgacgacgctgtttttaagctgcttttgctaagtttttctcttcttcttctctctctttgatagcttttcgcgcgcaaaataaaagttgtatcaaattctctcaccctttggcttgggctttatggccaaccatgcgttggagatgcatcgagattactagagatggtatctcttctcatctcatctattatctctttttattttgtgtttttcttcccctctactctcctaggcaagtgtgtgtagtttgagatggtgagggaggcttgaggaaaatggtataacttagctagtaagggaggaattttgtgtgagaaaaaggaatatatgcacttctctcttggtcttcttttgtttttcacgtttatcagtctcggcctctgtatcatgtgatgcaagtaacacaccgtttaatacgcgtgagtcaaaaacataaagaacatatgaaagaatatgcatttttttcgagaacggcgaaataagatgtttgtcctaacaatgatattttatttttacaatacatatgtattatgattggcagattcctaacaaaattcctattatccaaatgcacatgcgctgcatatatgagagttgttctttttgaataaaagaaaaaaaaagagctctaaacacgcgagttggaacacgcaaaaatatgaaggaatatgcatttttgtgagaacgacaaaagaaacgaactgaaacaaaaaaaagatgttgtacaaactatggtcctttatttttgcagcacatgcattatgattatcagattttataacaaaatccacaatatccaaatgcacatgccctgcatatatatatgagacttgtttctttttttttataggaaaaaagtgagcaagtactcaaaatcataaaatatgttatatcagataaacatagcatttacactacaagtacgcctttgattcgctcgtggatgttacgcgaatattgtgctgcttcaacgtgatcgagctctttgtcttctctcactgacgcgtctctgacgaaatgctgatcgagcatgcatatgcattaaccaccctgcagctgttaatctcttttcaggacaggacagtaaatccaggtaaaactgcaaaggtttttttttaatcgaactgcatttcattttattaagaagtaaattcaggtaaaactgcaaatatttttttttaaaaaaaatgcagaagagcttcatttcatttcagtgagaagtcagtttaggtaaaactgcaaatatcataactactgcgagattacaatgttagtttccatgaaatgggaattaacataacatatacttcagtcatcaagcagctgcttactctgcacactagtcatcagtgaagtcagctgcagaacgtacgtatccaccagctggacagtgtacctgatcgtcagttgagcactaaagttactcttgtacatatccaaactaaaggttcatgaaaaaaatacatctttgtggattaagacgaatataagctcgttcaacactttgcagtaaactacacctaatcctgcataagctaggagtagtaatttaaagacacatcataaagtagagccaattaaccagcacacagtatggattggtgattagatgagttcgatacttcgatggtgattggaacaacaaagatttttcacacaactgaaactctgtaccaactagaacatcggatatgcagacagagagagagcaatgcaatgcaaggtgatctggagacctgaaaaaaagaagaagaaagaacatgaacatttgcgtggttaaaaaccaaagattcctcactcttttgggtggcgtacgcaactactgcttctgctgctgatagcttttctgcaagcttaggtgggtttctgaatgctgatggtagtgtggcgttcatgcatgcatgtggtgggattagttgcgttgatcttgtttttgagggcagcatgagatgctcctactcatctcggttcccttttggctttgagcatcttttctccttttctttttcaaatggtttgggaattcagctgctctttactgactcatcaccgcacgccaactttgattttttttttcgtactacatcagtcaaatttttgtaagcgagtgtcacacttcagttgatgcgtgaatcgacagaatctgttgctcttggtattgtgaagcaggcaagcagccatggcacatggcagtgactaaagttcagtcttgacttccagtgctcgaactgctctagcaactttcagaaaacctctcaaactgaaaaaaatgtacatcctcttggctcttctccttagtattttttccgcgaacatgcaaaagacttgcatatctctgtacgctctttagtaatagaaaatagaacgttcacaagatacaaatgatgaaattattcaagatcctttaggccttgttcggttaatctccatgagggagggattggagggaatttatcaattttgctatatatttgtcgacaaattttaccccaaaaatttgacagatgtaattacagtacaatcgtagtgtaattacattgtaacttgcatgtaattacactgtaactatagtgtaacttgtatgtaactttcaaaaatctctccgtaacatgttatttcgataaaatggaggttgtgggaataaattctttcgcatatgtgtgtgctatgatttgttttcttcatcaccaaaataaatcttgtaatagatctaacgattcaaaattatgtgaaacttacatataagttacactgtagttacatgcaagttacagtgtaatcacataagttacagtgtaatnnnnnnnnnnnnnnnnnnnnnnnnnnnnnnnnnnnnnnnnnnnnnnnnnnnnnnnnn

SEQ ID NO: 11965 - DNA, 5650 bp, Oryza sativa
  unsure (1)..(5650): unsure at all n locations
nnnnnnnnnnnnnnnnnnnnnnnnnnnnnnnnnnnnnnnnnnnnnnnnnnnnnnnnnnnnnnntgacatttcatagtacaataaatctagacaccatcctatctatccagattcgttgtactatgaaatatccaattggtactaggttgttatattatgggacggagggagtaatatttttgacccaagataaatttattataaaaatatatttaattattaatttctataaacttagtcaaatttaaagcagtttgactttgaccaaagtaaaaatatcttataacctgaaacggagagggtacttttcagtgattcagtccatccaagatgagagggcaagacctacaattagttgcatctttatgtttctgaatctggtttgcttcaaaattttctcactgtcggactaacacatatgtatgttcagaaatttcagattcagtgctgcagcgccgcagactgaattttcacggctcattttgactgaaactagggtgaaatgaaacaaagtcaacacctgggcacttcaagcaaagataagtcttgttccttcccatgaattcaattgaaatagctacaagtaaagcaccctgtgctgtgataatttcctatgaaatttcactagtagaatggagtgtagtacagataaactactcatgactcatcctttctgcatccattctactagtgtttgtagtttatctgtactacactccattcctatgaaatttcactctgtagtgttcgtaattcttcactcttcccaagcttctcggtaagtaacttgttgactgaaaacaaaaaaaaaatgctagagaatcagtcgatgagcaggcaagagcttgggaattaggaggaaatgctgccatgctttcgttggccgtagcaatttcttgactagattcttgtactaggaagctgctcgctagcgtaatcacaaagacacgacttgacctcgtacttaaggaatactactactaaacctacttcaagtaccaatcttccaatacattaactcaagatatcatcagaatctttggtactcaactcgtgcaagtggctggattttgaccagatggtcggttgctgtttgccaatttccttggctcttcttgctgatgcgcaagttaggccaaactaggatctatctatctgtctgtctacttatttatggctaattcttttttcctgatcagaaacgatccacctcgagatcttgtcaataatttgcagccgcaatatctccaacgaggttagcaccaacaaaataacaatatcatctcctatgctagtgacattattccattgatttgccacctcgagaaacaaaaagttgtgacaaccctgaaaagaagaaaacaactgcagaaaaggatctccactccaccttatctctgaagatcatatttcccaatcctatgatccatttctttattcctgcatctctctctttccttccttttgtcgacgacaggttgccgtcgactctgcaccagcaacggtgggggcatgcaggcaccgcaccgacgacggcgatcgaagaggccaagaggcaaagttttgcagtgattttggtgagtttcaagcatgcaaaccaagcagcagcagagagattcagttgggagccacctaggcatgccatgcatctttctttgcaaaggttgagacccagcagcagtgcagcgtgcttgacatctccttgtgtttttctcctcatcatggaccacttatcctatcgagatccacatatcctggcctagattcgaccacatcccatccatctcccttttcccttcctatgcagctccagagacctgcagtagacagactctgcgtagcatatggcatgatttctgcatatccattatcttgctaggcctagagatcttaacagttgggccattattgatgcaaagaaagctggtgctttgcttctttgtggagtagctgtagttcactgttgtgtttgagttcttagcatgcaaagcaagcataagtgaccagcatgtcctgacagtaaaaaaaaaaagaagaaagaaactgaattctgcatgattcttcactggctttcattctctgctgttagaagcaagcataagtctggaatgaatgcatgatgacaagagagattgttgtgttttttacgagagtggcatgaatggattggctgggaccaatggtcacaaggacatgaaggggaagggtccaattattgaagcactggaagaagctcagagccacacaagaagatgtcccagctgcctcctgtgacaggaacaggaaacaaactagacttatgaacaagatggagacccttcatgatctctgcatcaatatactccaattttgcaaccgtacaatacagacaggctactatctggttttcttttcaccaacttataccaaccaaccaaggcttaattaaacatgtctcggaaggtactgacattctcactgtattatataagactgctgaaagaaacgccacatgacccaaatacaaagttagcatgacaactacaacaacaacaacaacaaacaacccccgcaaaaaaaaaaaaaaaacaacaacaacaaacaacaacagcggcgacgaagaacagtagctgaagccgatccagattccttcggtggagaattgcgtctggatcacagcaccttgatggccgcctcgatcgcgcaatgaggaggcgcgatactgagctctagactgctgatggatgatgatgccatttccagtccagagatcatggagagcgacatgtcctcggcggcctttaatctcttcacatattcagttagttcatcaacctgacagaaggatcagtttgtgttagttttggtcagactgttgctgggttccatgaagatgttctcagatgctgattttacctgcacgctatcgcctctaaagcctctagcaactggatagcttagtatctgcagcaatattaaagattcagtcttcagataggattgtttgtctcaagttacaaccagtaatcatctaagggtaattacaactcagcttgtggctacaaagaagaaaaaatggaagcaaagtagaaaattaccgggacatcgccgcgatctgtatgaattatatcctgggtaggaggcttagttccaacactctgaggacttggaagctgcaacagaaggtttcagacaagagcattagctgcaagatcccaacatgcgtggatctgatcaaagaagtgcactgtcactgacctgatcatcactgcactcagcaacaacatcaaagaggctggcccggcgcttctttttgccagggttggtctgccggaggaagtacttctgggcgtggctggccacctgagtcgccgtcctgctggtcacaaagttcttggagatgcctctccagtcccctttccccagctgcctcagcccttccaggaatttcttgtgctcctcctcagtccatggtaccccttcacagattaatcaatcaaaggcaattaagtgtcacatgatcttcacaggaagcaacaaacagggaataattaattactcctaactagtaaaaagtttttcaggtctgagaacctgcttgtggattgttatcgatgtgttgttgaccaattgactgacacacaaaaggttaatcatttttctctctcttttggaagaggggattttcaaccaattttgttggttgctcaatcaaagatattttttttgttttttttttgctttcacggatcatcaaattgcgtcaagaattaacagtgagttggaagtttcagagtaaaaaaaaaggaatcaggtgatggaacaagtaatgaacagtagatacaagaacagacaaaaagggtggttgctcacctttcttcctctcctgcaccttgcggcggcggcgcttctgctggccggaggcgagctcggagtcgtcggaggcgcgccgtttgccgccgtcggccggcaccggcagcgggtcgatggaggtgaggttgggcatactggagctcttcttgatgaacaatccaccctccacctcctcctcctcgtactcctcctcgtcaactccgccgccgccgccgcggacctcgacgccgaacagccggaatatcaccggcggcgaaggcttcctctccgctgcctcctcatgctgctccatctcgatcggtggccggtcgctgcgtggtcgcttttggtggtgagaatgagatgaaaatggcgggtatcgtcgccgcgatgaaaaggggggattattattgttgggctctcgacggtttggaggagactactgctcccactcctcttctctgtttatttatagagggggtttatttttcttataaaatgcatatgtatttgaaaagaataataataaaaaattaaattattttaacagcaaaaaaggacgaaaattttagtccttttgttggtactccctcagttttgacttattttactagtcaaatttcttttaactttatcaattttatagaaaagtttagcaatttctacaacacaaaattagtttcattaaaactaacatttattatgcagtaaaatatatggagggtcatttaacttgtttatgtgtgtcgtgtatatcattctactttcaaaatacacatttagattactaatatgagttaagtaaatcatttgattatcaaactatccacgtgagcgcatcttgtacatatggtatgtcacctacgattgaaaaaaacacttttggaaatatgaaaaaaaaaacgtgtgtgtatttttccctttctcacagcactaacatttagaaatacacaaaattagaggaacacaatcatttcacttctacctgttattatgtttgttttgtgttgaaaaatattactaaatttttatataaattagttaaatttaaagtagtcaaaataactagcactataaaacggagggagtattaaattgttaattgacgaatcagatggtttccctgcaactacaggactcgttgacctcatctctggcatgcccaaggctaaagggaagagatgccatccctctcatttccctgtcttccagtgacgtcggtacttacgtctaaaatcttcttgaaatgctcagagaaaaaaagatctccttggttgtgcctgtggtagcatatcgaactaaatctaattgttggcaggagttttcgcgtcaatttcttggcaacgatcagagactgaacctggctacgtgtacatgtatagtgtcagtaactcagaatcttctcttctttttttttttcagggcatcattgtgtcattgcctgggtagccacactggacagaaagaacattgcaattgcgacaaaaaaagaaagaaataactgtttgccagttgggttgcaatttgcctgcagcttcgaatattccacgtgttgatcgatgaacaacagattcagatattcagatcgtacattcgtacgtacgcaggtacgttcattcgtttctgttcagcattactatatatctcgtcgatcgatgaatgaattattagctcatggttgcatatatatgtgggcataaatatctctcatcacattggaaatatcttgcattgctagctagcccttgaatgtatcgatcgatgatggcataggcataacgtatggtcgagaatactccctccgtttcaaaatgtttga

SEQ ID NO: 11966 - DNA, 2006 bp, Oryza sativa
ggggtatgtttttttagataatagttaggaatatgttttagctgaatgaatggtgattgatactccaaaattgtatgtgctgtggtcatgacttggacaaattcgaggttgcttaaaaaaagacagggaaaatcagtgtttggcagaaatagtgtgaattcaagactcaggccttgtttagttcgcgaaaaaaaaaattttgggtgttacatcggacgtttgaccggatgtcggaaggggttttcagatacgaatgaaaaaaactaatttcataactcgcctggaaaccaagagacgaatttattaaacctaattaatctgttattagcatatgtgggttactgtagcatttatgggtaatcatggactaattaggctcaaaagattcatctcgcgattttcatgcaaactgtgcaattagtttttcattttatctatatttaatgctccatgcatgtgtccgaagattcgatgtgatgtttttcggaaaaaaattttgggaactaaacaaggcctcaatagatacttatggaggatcttttgagtggcttgcgtttctgcaatgttgttggacggtcgaccttctgctaaagtgtggtatcgacagtcactcgacattgcctcctctgcacccaataacagaagacggcgaaccacatccatcttaactatgttttttcttgccaagtatggtaccatgttctgtctcctcctggttggcccgacctcgctcttttctgtggttgttctctctaggtttggtgaccgtctgctagggctcgtttacctgagtatcttcgcaagggcttcgactctttggtcctcctggtctcctgacaactgtggaatgagcagaactttagagtattcgatcgctcactctcttcggttttcaatggtgctagagtctatcctccaggaaggccgtatgtggtcatctgctggaactgctgcttttgaggacttttgctaggagtttagtgggactccgccctctaggagtttttcatcttttttaagttgtctataagttgtcttttcttttcggttttttatttctcgtcccccgacaataacactttagttgtttgtgttatgtaattaaaacgttgttttcttctaatatattgtcgtgtaacttttttctatgttggggaaaatacttacataggatgatggtgtaatagtatgtttcctgtttcacgatttaggtcggcatgcgatgcgatgcgactcagtgactaaactttacttcgacttgacttgacttagtttacgaccttgtatttcccagtcttggacggtgatctccattgcttttgtgattttgcttaatcattttttaagttggcttttcaaaagggctccaataagtgaggtaaattagtcagacttaatgacacaaatttccgtagcctgacaaagtacacacatacacagtacacgctcgtatgcacacatgatgcacatgtcgcgcgcgctgcctcgccacgccacgccgcgccgcgcggcttataagccagacaccggcgcgcgcgccctcgccactcgcgagcttctactgctgtctctgagatactgtcagtgcactgtctgtgcgttcccggccatgtccgccgccgcggtcaccgccacgccgcgccacgcccggccgtctcctctcaacccgaacgccagggccgcggcggcggcgaccgccgcggcgccgccgaacgccgtgtccaccaccaggacgcacctcgccaacctcgaccgcctcctcgtccggccgccgccgctccccctgccgctccagaacaagggggcgccgccggccgatgacctcggcgacggcggcggcgccgccaccaccgacgaccggagcggtcgctgcgggctgctcaacgcgctcaacctgtgcacgttcctgcccttcgtccgcaagccggccgtcgacgagatgttgacgcgcagcctcgcgcacctgcagcgccttctcacgctgtcgccgaagtcctcgccgaaag

SEQ ID NO: 11967 - DNA, 3421 bp, Oryza sativa
aggtatcccagctagggcggctgggacggactgctcgacccgctcgaccaaaacctccgccgcgaggtcctccgctacggcgacttcgtgcaggccgcgtacacggcgttccactccatgccgtcgtcgtcgtcggcggcggcgtcgcagcacagccagcaccggacgctcgtgctccccgaccggtcgtaccggccgacgcgcagcctgttcgccacgtcgtcgctgtccatcccggcgtgggcgcggcggcggtcggcgcccgggtggctcacgcagcgctccagcttcgtcggctacgtcgccgtctgcgacaacgagggcgaggtccagcgcatgggccgccgggacatcgccatcgtcctgcgcggcacggcgacgtgccccgagtgggcggagaacctccgcgccggcctcgtgccggtcgacgacgacgacgacgacgacgtcggctcgccgcagaacgcgccgaaggtggcgaaggggttcttgagcctgtacaagacggccggcgaccacgtccccagcctctccgacgccatagtcgacgaggtgaggcgcctcgtcgaggtcttcgagggggaggagctgagcatcacggtggtgggacacagcctcggcgcgtcgctcgccgtcctcgccgccgacgagctcagcgcttgcctgtccgcgaacgtggctgaacatcgccggcggccaccgccgatcgccgtggtgtccttcggcggcccgaagaccgggaaccgcgcgttcgccgaccgcctccagaacggccccggcgtgaacgtgctccgcgtggtgaacgccggcgacgtggtgacgcgggtgccggcgccggcgatggcgcgggaggggaaggggcacgtgcacgccggcgcgaagctgaggctggacagccgcgactcgccgtgcctccgcccggacgccgggccggcgtgctgccacgacctggaggcgtacctccacctgctcgacggcttcgccggctccggccggccgttccgcgccgacgcgagccgcagcgtggcgcggctgctgacctaccagcgtcccaacgtgaggggcgcctacgtcgagcgcgccagggtgctcggcttcgagccggcgacgccgcggaccgccaccgccaacggcgccggcggcggagccgaggggcattacggctacttggctagcccaacatgatcgttgcgtactactaccactgtagcatgcatgcattgtcgtgtaccaccttaattgttataggagtaaattgtatcgatagtacaagaacttgttatgtgggtgcaatctaatgtatggacttgtaaaatgcttgttttgatacgtgaacttttcttgctcatatgaattaaagtcaaaaggacattatataactaatttgttgatttagatgctgattaggatactacgtagagacatacacttgttcaataaaaagatagaatgatatatagtgatcgtagagaaagatataaaataccgagcaatgattcatgggttagaaacatatgaaattcaagataaagtagagaacaaatttataaatataacatattttatgcatactcactattcgtatggacgccacatcctaatcaacatcagctaggtaaaattaaccttgctaagccattttagacctagatcacacgtattagataagttcgtgtaaaaaaagaacattttacaagttcatatactaaattgcacacacctaacaagtttatataccaccaatgtaatttactcgggaatggtatttaactcgtaattgagatgtatctgcacgtgtttcttgatgtgcattaattctactgcatatatgatcaagaggtgatgcggttgagtcaacttaacggtgaactttttttgagaactaacgatgaacttgttggtgtagtcgtacgttatgcgtatgctttttggtggcaaattaggtggtcgttatcaaatgactggtttctggacattacgaaatctgtcaaccatcagtggcaaagctatatagtgtttggggtacacatgaaccccccaattcctaatttctcacttaaaaagactaaaatatatagtgttgtattaaaattttctatattctcaatggtagtgcaccctcttattttgatgctagcttcgcccctgtcaaccactcatgatcgtgcatcattgggtgcatatgtgcatcatcaggcacaagcatatgtgacatacagtaccgatttgatgcttgaactactgaagttcgtacctcaaataccattattattatttagacaagagctccaggactatttgttactccctctataaataaaaaacgaattccctgtcaggggcggatcccatgtgattcatgggtattcacctgaatacccatagaatttttaaaaaaataactatatataggtatgttatgcatatatacatgagaaattagaaggaagtacagcatgtatagcccaaatgaaaagaagcccatttattcgcagcagaccatacattcctccccatcttggcccaacgaataggcccactggcccaaaaacgaacaaaaccctagtccctatcccccggtcagctagtccccacgccttctgtcgtcccagccccaatccgccgcgcctccactcatccccaccgacgggcgacggggcatcgagagctcgacgctcggcggcgccggccgccggctcggcgcgtcgccagaatcgccaccagcctcatctccctggaccctggtccctgggcctgctgctgcggaggcggcgtggcctgcgacgacgccgccgcctcctcggggacgggcgacgctgagcagctgaggttcgcacggacggcggcggcgctgcggcgcacggcggcagccggttgcggcgacgcacccccgcgtcggcgcgtccccttggtccctagacagctggacagtggactggcactggtaaaataaatcctcttgtcaaattccccaagcgattggccattgcttaattgctattgcttagaagttaaattagtcagaaatttgaactgtaggtcttgaaatttgaaaaatgaagaagaagaagacaatagatttgaagtctttgtgggaaaggtcaaccaagtctcagaaagtagcttccacctctgatccaaaaccattaaccattgagagtgaagttcagatcccagaaaatgccccttctagtcctattcagctactacttgaagcacccaatgcctatgatagtgatatgtccccaagtgtgcagttggagatagacatcttgactattgtgctactgtttgtacctttaaggctttaaacatgtcattaccactcctgtatgattttcccagtccaattttttgagttctgtatgatttttttttcagctttgaataccctttgctcaaatcctggatccgccactgt

SEQ ID NO: 11968 - DNA, 1785 bp, Oryza sativa
aacatgtcattaccactcctgtatgatttttccagtccaattttttgagttctgtatgatttttttttcagctttgaataccctttgctcaaatcctggatccgccactgttccctgtgtccagatttatattcatgagctattcttttactacgatgaagagagtgccaaagaggttaagcaagcaatgtgcaaactttcgttcaaatgcttgagccgctgaaatccatgttggattcaccccccattcgtacaagataggtcatatattcacatgagtttcgtaacttcgttcagaggcttgtttttgaaaatccgtagaaagaaaatctactccatatatataatatgcatcactctttgaggaaaacaatacattccatccgtccaaaaacataactatttttggaatttagttttttttttccaaaatttaaaatatttcatcacctatttcatctcaactaatcataattttctcctatttaatgtcccgctacgttttcttatcaaccaataacaatctttcatcattttatttgacctactttttagatttatataaagtctctataaatacattttaagatatgataagtggatgtttctttctttttatatgtgtgtggggggtggctgaatgtaatatgggcaacaaggacagtgacaggagtggcaacatgcagggacaaaccggcctctctctaccacgttcacagcgagaatgcaagtggatctgtggatgcatgcctcggtggcgtgcgtgtcaacagtggtcagtgtagtggatgacacattctttctccccttgcactgtcggagacgatatatatgattccatcagttaacttctctcaaatcaaaattttcgtttaaatattttaacttttattcaagttataacaaaagctgtacagttgtagattaaaaaaactataagtgatcatttccacatctattttatattctcactagctatttctccgaatccaaaactctccaaacaaatctagtttttctcaaacgtgtaattggaatgcacgtcaatatattaaaagaaaagaatatttgttacgcaatgcaatcagcccaaacaaaccttgtcgcacactatgctgctggatggatcacgcaaatgcaccttagtggtagtggagtagataagcagccaactatcaaaccgcaacgtgctcaatgctaacgacgtgctagcctatggcttattttaccttttagctctaataaaaataaaaaaatatatctaactgcttcagcagacacacctgcttgttgtcctgctgtggcttgcgttagatttgtaataatatagtttattatatggttgattgattaattaaattattagcagtcccttaaaaaataatgtagcagtacttgtgtagtacggactatgtatatattttgatgtcagtgtatgcatgtatgggagttgaaagaagcttagatttttaaaatgaagtcgtcatactgtgtaaatcatgttgtattaccgtaaccacttgccgttgcctcgggatataagtttactttagatccctcaatttatcattgaatctgaaatccgtcctgaaccgtactaccagatatgacgtgtccatcaactttcaaaaccaatacaaataagattccaaagcggtttcaacggtagtttcggctgacgtagtgctaaaccgggtccccttctccgccaaccttgtggctcctcggcatggagaaggatggcggtccatgggtggctgttggatgccgggaaggagaagaagc

SEQ ID NO: 11969 - DNA, 2927 bp, Oryza sativa
  unsure (1)..(2927): unsure at all n locations
ctactgggccaagatacccagtctgaccaaaaggcccatttacaggtcggcctgccttgtctcgctgcgttgcaattgaatacggcccaacatggaggccattactggcaggcctgctcgcggttcagcaaaacggcccattaaatactcggcccaattaatcttggtgagttcgaggctatcccattccggcccaaactgctggtgaattgctcctgggaatacggcccaaattgttcggccgcgcttagggccgtcggatcaagacggatggcctgcgatgctccacgtagtcgaccagccatcctccgccctcgtcgccgtttccgccaccgttcccggcgagctccgccgcctccttcgccgacgatctggtcttccatggccagcaagggaaattctgtagatctcaggatctctcaaccccccctcgaattcgtccaacccgagtggaaccgctcgctgagaggagagatcaagaggttggtggtggtgctctgctcggcggcgatggtatcctcctcctccccaacctgcttggtccacgccgcctccgatcgattccgcggagatatctatgggctttcctctcgcctccccgcgccgccacggcagcgcacactaggtcatcaacgggcggatcgctgggcgggatcagccgcccccatcgatctcgccatggcggcgaggcgagtcgtcagcaccctcactacgctgcgctgcgccacccacttctcgtctgacgaatctgccgtcatcggttgggattgggatttggtagtgcgattgttggtgttcgtttatgttcagggtgtgccatttcttcagtccttcgatacatggaagttcatgtgtgccaatgaatgtactgttaacagttttgctgcaggtccaatacatgttctctaccacgatgccgcaattcgtgtggatggtgattaagggcaatgctgaattgctgatgcatttcttgtttgaatttcagaaggcgattggagccggtgatcatttgcttggggttttacgtgaataagatgggccaatgtgctttggataacgcccttcagactcagactcttcagtggtaaggacattggttcaaacctatctaatgttttgtaattgatagaactgtccggtttgacaatagatttcaagcattagctcaaatatttatatttctgtagatttctgtagattacattgatctagctggctaatgatttgctcttgcatttcttgtccttgtttgcaacttgcatcctgattattaatttgtccttggtgaagtcttaagtgatgatcgtactgttaaaagtcaaaaactatatgctcatggatcttcccgactgtgccaccactccacggtagtggcacaaaaacacgagttatcatcaatcaaaacacctagtgcaactgagttagtctgcaaagccatgcgcatacatgtgttcctttggtttgatgaagtaatggagtaatcgaagtgttgaatgtgatgaacatctctctgtttaggtctcttgtcagaatgaagatctgttttttccccagcaaaccaacacctaaatggtgctgtgtgccaactgccgtaaggctcatccagtgctcgtcttttttgttacacacactatttcatggtcaacaaaaaccacaacaacaaccagctctcttgcagacgttgttcccagagaagattattttggctcttcttctacataggagtagtacgttgcaggcttgcagctgatgtctcttcttctttgatggttacaggtcaaaagctatttgtcatttctctggcttattcacagaaagcattcttccaactactgctgcaatgctgctgctactccactacaaacaaaactagggaaaaaagaagcaaggatgcatcatcagattgtgtgccatgatccaagccgaagctccatcgatccctacacgaagcagcagcaacaaacttgtagcacaccactaaactaaactctgatgactgacaaagtgaaatcggcgcatcaaagaacgagacacacaggtaagcaccacataccccctttgaccgatcttgcctcagctacaaaagacatgctcgcttggatcaaatctacaaaaaaaaatgcaacttcaatctctcttggatcaaatcatcaaaagacatgctcgcttctttcaagaaagaaagggaaaggaatctggtgatggtctcctttccccttttttttcacccttttctagaataaagggaatgttggttttgaacaagatgatccctaggaaggacagtttaggaggtaaagaatatgctactcatagcaatgacattgagtaagatagaatgctcaatgtatagaaactgaaacacaacgcaaagttctataggttaggtgcagagtaagtaagccacagcatcatgccattaaaatgtgccaatacataaggttaccgctccatccaaacaatgagtagatgagtactagagtagtactattgtatagtaataccttcgtgttgtacaatattaatagtagttggtttgaacaaattagaagatgtcctgaaaattcaggattagtccccattgagtgctcaaagactttgtcatgactatataatctcgagtactcgtagaaaatagagtttgtagactaaagtaaagtggtttagtcatctaatttgggtccacaatataaacaataatattagttcactcacatattcaactccaggaatttttgaagcaagagatatatctagctaaaaaaaacttgaagttggagttgccagtccatagagagaacaaatttgtgaatcactgcctcttatatatagttaaggtctcctttgaagagaatgattttcgaaggaatttcataggaactgaannnnnnnnnnnnnnnnnnnnnnnnnnnnnnnnnnnnnnnnnn

SEQ ID NO: 11970 - DNA, 870 bp, Oryza sativa
  unsure (1)..(870): unsure at all n locations
tcactcacatatcaactccagaatttttgaagcaagagatatatctagctaaaaaaacctgaagttgnagttgccagtccatagagagaacaaatttgtgatcactgcctcttatatatagttaaggtctcctttggagcgtatgattttcgaaggaatttcataggaactgaactgttttctaccaagaacccataaaaatcttgctttttaaaggattcccaaacctgtttggaacatgagaactgaaccatttcaagcgaaacccgctccaaaaccggtatagcatacccattccttaggcccacgacactgacagccgcagcttatcaaccaaaccctctagtactactgtacctgttcttcactaacggtaatataagcattgcaatcaaacagcaacatctaagcagccgaagcagaggaagaagacagcagcaacagcagcagcagcagttcttcggttcttcctctgttcctctgcagctcactcggattctctctctctcctctgcaaagcctgcaacgcctgctgctgctgctgcagtttggtttctctctccatctgcatcctgcagcttctgtcctttctccccaacctcttttgtccgttgcatttcacctccattaatccaagcacagagagaggagatgcatccgtcacgctcactgcacgccaagccgccaagaagccacggtcaccacgcgcgctcgcgctcccagctgcccaccgccatttctgcgcccaaccaagatttccagttccagttccagcttctccccaaggtgttccagttccacatggacgtcggcgnnnnnnnnnnnnnnnnnnnnnnnnnnnnnnnnnnnnnnnnnnnnnnnnnnnnnnnn

SEQ ID NO: 11971 - DNA, 487 bp, Oryza sativa
tctaggaaattcttataagatgcccctgttctgcagcttgaggttttgggtaagatccgtcacccacatctgctgctgctcataggtgcctgtctggacagaccatgcttggtgtacgagtacatggagaatggcagccttgaggatcgcttgcaactcaaaggaggcacggccccactcccatggtaccaacgtcttcgcattgcttgggaaatagccctggcccttgtctacctccacagctcgaagccgaagccaatcatccatcgtgacctcaagcctgcaaacatactccttgatagcaatttcaccagcaagattggcgatgtgggcctttcaacattgcttccgctgggggatgccttgtcgacaacgcgcacaattttcaaggacacagatctagttggcacactgttttacatggacccagagtaccaaaggacaggccaagtgtcaacaaaatctgacacatacgccttgggcatgg

SEQ ID NO: 11972 - DNA, 659 bp, Oryza sativa
cggaagaaatactaagtttatagccatcatagtcacaacggtaacatggagtctatgccggaaatttgtctcaactcttaaatttatagagtagtcatcacaatactaagataagaaagtaagaggaatttcctatcctttcgatgtatatgtataaactatcacaaagcaatactgtagaagtgtactactgtactttctgctggtccaacctacaaaatgaccttcttgatactcctactctaaacccttcaaaatttatctcagagatggtctatgaaaatgctgcaaaactgctgctttacaagaacattaccgcagtatctacagtattagagattaaggaggccatcaccaaggcaaaaacatgtacatcatcagccttcgagtgccgtatccatgtgaagttagagaagttacctagcacaatcactcaatcagtcccttgcttctgccttccaacttgtaattgcacataacagagcatggttgggaaccaaatccttgttaggaagccgcgattttgtaatcggtgacttgtcattctcgcacaaccacatctcaatagcgacccggtcgtacgagtacccgtcagatgcaatgcatgggtcctgcattatcctctacagggaggaaaaaaagcaaaatgaagtttcacc

SEQ ID NO: 11973 - DNA, 704 bp, Oryza sativa
ccttttttctctctcttttctttttcacatgctttcctggagcagagtgtagttagtcagagcagagaaagcgaggttaatacgagtttattagcaggattagtactcaggaactgcacttttactgttgctgcgactgttcagtccaatacatattcagaagggttaggtaggacatccagattccagttgtgaatttcttttctgttcctgagccagcaggtcagctcctgcgcgtgcacgtagcatctgatctgatacggtgaagcattgttcgcttctgcctctgaattctgatccttccttggcgtagaatggaagcaattcagaagaccaactcgcgttgctcaactgattcatcagcaattcgcatgtagatccttctgtctgaatatgtgatcaagccaatggaaatacactaagctacatcgagctccggccatggtcaggtccaagggttgaacttctgacctcatagatgacgctaaggacctgtttagttcgtgaaaagaaaatttttgggtgtcacattggatgtttgaccggatgttggaaggggtttttggacacgaatgaaaaaactaatttcataactcgcctggaaaccgcgagaagaatcttttgagcctaattaatccgtcattagcatatgtaggttactgtagcacttatgactaatcatggactaattaaggtcaaaagat

SEQ ID NO: 11974 - DNA, 570 bp, Oryza sativa
accctttttttatctctgctttgcttccatgcatatcaaattttcatttttttattattatttcttccatgtaataactgcctttgagataagcctaaacaacatgttctagtttctttcaatatcatttttaatgggaaaggtgttatcaacaattctagttgttatcaatatagtttcgttttgcagaaactctaccaacttctcatgtatcgttttacttgattaggtggtgaggggagtggccaagaagagaaagtggacgagaaactgattcttttctccgggaatgattacatgggcctcagctcgcatcctgcaattcgccatgccgcagtgaaggtgctcctttcttgcacccatggctattgtttggtgcggaatttttttgacactttaggatttgcaccatgtttcattgaggggcaaatcctagactggcgcatgatcgatttttccttgtttgatctatggagtggactgaatcaatgcttccgtggttaactttgccaacattctggtgtatctactagacagctgaagagtacggcatgggccctagaggatctg

SEQ ID NO: 11975 - DNA, 1068 bp, Oryza sativa
caaattttaccccaaaaatttgacagatgtaattacagtacaatcgtagtgtaattacattgtaacttgcatgtaattacactgtaactatagtgtaacttgtatgtaactttcaaaaatctctccgtaacatgttatttcgataaaatggaggttgtgggaataaattctttcgcatatgtgtgtgctatgatttgttttcttcatcaccaaaataaatcttgtaatagatctaacgattcaaaattatgtgaaacttacatataagttacactgtagttacatgcaagttacagtgtaattacatataagttacagtgtaattacactacgattgtactataattacatctgtcaaatttttaggagaaaatttatcgacaaatgtataggtggtcccgaatttattccacacctaatatggtgtggaattatttcccttcaatcctctccaatctccttcgatccctccaaaccaaacaaggacttattgatatttttcagcgaggtatatgtgctggattaggcatgggccaagagtattgttgggcttctgaatgggttttgtggcccacgttcagtccctatgtgtgctagaaactatatgggcccgcgtaacagtgacatacgagtgtgggcagctgttgggcccacgttcaggtccatagtatccaacggccacatgaaatctggcccataaaatggccatattgatcgagctagtggataggaggccaattgggcgtcccagcccaacacggcacgggcccgctaagacacggcaactgtagcgggccgtgccttgctggtccgtcggtgccagcccatgggctaaacctctgccgccggctcttgccccttaccgggcttctgttgcatcgctgggttgggacgcggatctgcttgttcatctcatagatgagacgagatgagatgagccttcaccgattgatggttttgagagaagtccttgagagcgtttctgaataatggatggaatttctgagcaccaaacgggttttgactggcgtcctgcgatatcaaatgctaagatttctggagaagcta

SEQ ID NO: 11976 - DNA, 1938 bp, Oryza sativa
ggattctctctctctcctctgcaaagcctgcaacgcctgctgctgctgctgcagtttggtttctctctccatctgcatcctgcagcttctgtcctttctccccaacctcttttgtccgttgcatttcacctccattaatccaagcacagagagaggagatgcatccgtcacgctcactgcacgccaagccgccaagaagccacggtcaccacgcgcgctcgcgctcccagctgcccaccgccatttctgcgcccaaccaagatttccagttccagttccagcttctccccaaggtgttccagttccacatggacgtcggcggcggcggcggcggtggtggtgaagggaagtcgtcggagaagaaggttcttgctcagctggagcaggtgaggctcagcattgcgtcgagcgaggacgaggaggacggggacgcgccgcccaggagctccttctccggggcgagccacccgccggagccggtggatgagatggatacggtgttcgttgccgtgaatggccgggacaaggcggccaagccggtgatcatgtgggacgcgtcgccgccgcagagcggcgcggcgagcccgcacagcagcatcgacagctccggcgcggcggccacggtgacgagcatcgcgcccagctgcaccgtcaccagcctcagcgccaagaccagcgtcagcagcagcgcggccagcgacggcagcgggtggagcaacagcacggccggcgccggcagcgccgccggcggaggcttcggcgggaagccgcacaaggggggcgacccgaggtggaaggcgatcctcgcggcgcgagcccgggacgggccgctcgccatgggcaacttccgcctcctccggcgcctcgggtgcggcgacatcgggacggtgtacctgtccgagctcagcaacgtcgccgtcggcggcggcggcggcgcggcgagggcgtggttcgccatgaaggtgatggacaaggcgtcgctggagagccggcggaagctgagccgggcgcagacggagcgggagatcctccagctgctcgaccaccccttcctgcccaccctgtacgcgcacttcgagaccgacaggttcgcctgcctcgtcatggagttctgccccggcggcgacctccatgctctccggcagcgccagcccggcaagcacttccccgagcacgcggcgaggtaattttcactccactttaattccatctcttgctctaggctcctaatcttgataggattagcattcagcaagaaaccatactctgtttaaagtgacaagatcaggtatggcagttcagagctgtcactggagaaatctttcagtattgcagaaattttcttctctaaaaaattaatcttgccaagcctgaagctggaactgatgcatgattgacacattaacaaaatggcttagttttttttttcagcatttcaattgacattagtgtattaatagtatagtgaatggattatgctccgacttctcgagtggggcattttgcctgtctgctgctttttctatgttgtggaacaggatatctaaaattaacaaatctagcagaccacaaagcatgtgtcagttgtcatgctaaaggttgatagtagcattttccccactaacccattttgtgttcgaattaggtatctcaaacatagacatcttttccgatctgtccctgaattaacaaacatgattatcctacttgtttttcccaatatttctgatgtatcatgtaatcttcttcatgacgtttgtttgatccgccatattcttctctttatcagctcatcttaaactgaagcatacgatttattcttttcttttccggggctttgcaagttctacgccgcggaggtgctccttgcgctggagtatcttcacatgctcggagtggtgtaccgagaactcaagccggagaacgttctggtgaggg

SEQ ID NO: 11977 - DNA, 2049 bp, Oryza sativa
attgacattagtgtattaatagtatagtgaatggattatgctccgacttctcgagtggggcattttgcctgtctgctgctttttctatgttgtggaacaggatatctaaaattaacaaatctagcagaccacaaagcatgtgtcagttgtcatgctaaaggttgatagtagcattttccccactaacccattttgtgttcgaattaggtatctcaaacatagacatcttttccgatctgtccctgaattaacaaacatgattatcctacttgtttttcccaatatttctgatgtatcatgtaatcttcttcatgacgtttgtttgatccgccatattcttctcttcatcagctcatcttaaactgaagcatacgatttattcttttcttttccggggctttgcaggttctacgccgcggaggtgctcctcgcgctggagtatctccacatgctcggagtggtgtaccgagacctcaagccggagaacgtcctggtgagggacgacggccacatcatgctctccgacttcgacctctcgctccgctgcgccgtctcgccgacgctggtgatgtcgtcatccctgggctccgatcccaagaggggcaacaatgcgcagtcgtgcgccgcccagccagccgcctgcatccagccgacgtgcttcatgcccaagctgttcggcaagaaacccaagagcagccagccgaggcagaggtatcatcatcagcagcagcagcagctggccgccgcggcgttgccggaggtggtggtggagccgacgggggcgcggtcgatgtcgttcgtggggacgcacgagtacctggcgccggagatcatcaagggggaagggcacggcagcgcggtggactggtggacgttcggggtgttcctgcacgagctcatgtacggcaggacgccgttcaaggggcagacgaaccgggccacgctgttcaacgtcgtcggccagcagctccggttcccggaccacccgccgacgagcaacgccggcagggacctcatcagggggctgctcggcaaggacccgcaggggcggcttcgcgtgaagcgcggcgcggcgaagatcaagcagcaccccttcttcgacggcgtcaactgggcgctcatccggtgcagcaccccgccgggcgtgccaagggctgtaaagcctgtcgctgtcaccgcggcggtgccggcaacggtaatgtccaagccgccgccggtggacaccgtcgagatggcaatccacagcaattgcaacagcaccaacagcagcaaaagaatggcagggcctccagaggtagagtctggaggcaagtacctagactttgagttcttctagcaaggtgaatgcaaagatctgccaaatattgcatcaggcagctgagaaaatatgaagtttttaaccatatacttgttttagtttgagttgtaactgtagtcactagtcagtgagtcccatactttcaacatttgggcaaaaggcattatctgaatctgaccaaccagttgtactactgtgttttcccctctgctgttgcaattctatcacagatgaactagttagcacttagcacctataaatactccaatagtaggcttaatggagtagcaaaaagtttccatgtacagcatgttagtgacatgcataatcacacattagttcttgccatgattatatacaaaaatgttactatcttttacaagagcaagcatagatgttcttttacaagagcaagcatagatgtgggaagcattgcgtatcaaaatgtgaatgcccagagacacataagggcaatagattgtgaagaacaagagaaggaattatggagacacttcacaagtcatcacagcattagtagtacatcattagttagtaagcattagtaactctagattagtgggttacaggacgaggttatgggaggcggcggcggcggcggcggcgaggccgacgccggcgggagggttgcggtggcgggagagggtgcgcagctgcgcgcgctggcactcgaggttggagacgagatccaccctctcctcccgcggcagccg

SEQ ID NO: 11978 - DNA, 6850 bp, Oryza sativa
  unsure (1)..(6850): unsure at all n locations
agcttcatctggacgcgctcctcccgccagagctcggcgacgcgcagcatccggcgctcgtcgtcgacctcctccagcgcgcgctccacctccgcgcgcatctcgcccacctccccgcgcatcctcctgcactccgcctccgccgccccgcgccgccgcctctcctcctccagctccacggcgagcacctcgctcaccgcctccgccttccgccgcatccgccgctccacctccagctccaccctcagctccctcacctccaccttcaccgccgtcgccgccccgccgccaccgcagcgataccactccaccatgtcatcctccacctccacctccatgccgatcataggatgccgagacgaagcgctcgaggaggcgtggcggcgcggcaacaagtagggagggcttgtgatcgacaaagctagtggtagtgcgccatgattggggcgcggagggggaagattcctggggcttgtttccgccaccgccaccaccaccaccaccaccactttgatttctcacctacgccatggagctttttggcgaggtcgggatggaatattttagtcggcatgagtggctccagcctccaccgcgtggccggcatggtcgccggctttgtgagctgtaaaagcgacgagctagctagccctaagccctagcccggcggcggccggacgaggagggagatggagatggtcaagtcgtcgatcacatgcgcggatcccgattccgatgccgccatgatggcgggctcatgctccatctctcctgtcctgctattgcaacgccgccatgaatgattcttgaaactttgccaaattgcaatgcattgaacgatcgttaattaggccgtgtttagttgttttggccaaaatttttttttactcacagggacacatatttaagagaaaatcccctatatatccatgaaagttcacctaatctcttctatacccctgaattttgcttaatcccttacatacccctgaattttagtttggatcccttccatatcctttccgctagttgaccgttaaattcttttgaaaaagtccattttgacctttgctataaagaaacataatgaattaatgaagtatattgttggaatgtaaaaatttattggataagactattatatttatgaatatgtgatgcactatattattggtaacaaatttacttttacatatgatataaaaagtaaaagttcttttatgtagcatatgtgttttcatagtaatacaacagatttgtttattactccagaacacatatgataaaaaaaatcttttaataactaataaattaatattaattttttatgtcatatctaaaagtatatttatcgcaaataatatggtgcataactatctcataaacataatagtctcatataacaaatttatatgctccaacaatatactatgttaatttatatgcttctttataccaaagggcaaaatggactttttcataagaatttaacggtcaactaacggaaagggcatggaagggatacaaactaaaattcaggggtatgtaaggaattgagcaaaattcacaggtacagaagggattaggtgaactttcaatgatacacaggggattttctccatatttaaaggattaaacttagactaataacaaaacatattccgcatgtaaactgcgagatgaatctattaatcctaattaatccgtcattatcaaatgtttattatatcatcacattgttaaataatggtgtaattagactcaaaagattcgtctcgtaatttatagtcggactgtgcaattggtttttttcgtccacatttgatgctccatatatgtgtctaaatatttaatgtgacggaaaagttagaaattcgaagaaaaaaagttggaatctaaacatgacctaattaattaattcggaattgattttctgctgcaattgtgcaggcaattactccatgaattgatttttgtgtgttgctgctcgatggatggatcgatctgttctttcgtgcgtggatcgatgtgatttgtcaggattgcgtggtacgcgaggtcgtagtaaatggctttcactgacgctttcgtaacgggcactggatgaatcgccatgaatcagcaacatccgtgatctgatgccaatcaatgctgctgcctgtacgagttgctggcttgctgcagtgcagtgaaatgcaaaacccggtggactttttgacaggccaaactgggccggaagaaaggcccattataatgagctacggatttgggccatttggtccggcccattaatactaggcctgtatagatacatacactgcccatcaatactttcgttggagcgtgttttattttgggccttttatatcatttttggttgtggttccaaaacttgaaattaaagagggcagcgaccgccgaaccaatgctttcatggcgccgccggtgccagcgaggcctccgccgcttccctcgtcggcgacgaccggcctcgtgcactcgttggtacgtcaccgcttgctctctcgatcatacttgcatactggtccatggcacgcatggcgcgtcgctttctatctctacctagagatactggtacttggatcctatatttataatttcaccgcattatgtttgttgtaaaccaatgcgcctattagtggatcatcggatccgttccccgtcccttgtacagcagtagagacatgagaagatgtagaacacttgtggcgcttttctttatcattaagaacattacagaagtagacaatgtacacatgtgtgggatgaagtcctctattcatcatagatctaatctcaaatacaagcccgtcatagatgtctcatactgcccctctatatacaagggtcttaggagggatatattttatctctactccgatttggattggtcaaaaaaaacttatctcctagaaatttgtttcacaatagtgttcactttcttgtatttggatcctacttagttccacactgcatgccatacctcgaggcaggcgggtttctttaacaatgcagaacactgatatcctttttatatatttcgataagatgttgtatggaaatcatatgcatagatttgcctaaaaatttactattatggactcatgatattatgaatttctttcttttttctaatgttttgcaaccagaattagcaatcaaagcctcattttgaagaccttattgctcacagaaatgatcgagtgagcatgcatcatcattggttttgtcatgcacatggccatagcccataggcgtagagcccatcacaagccacaccacatcattagctctgttccatatagaacatcatcatacaatgcatgaccagagtaaaaaaaaaggaaaaaaaaaactgtgatcttgcctgccactatcatgtctcttccaagttcttatcctctctcgtgtaacaatagaagcacccacttataggtgccatggtattgtctggtccaaaacacccaattaacacctacacttgcaaaaggttcagctacatacaaaaccagacacacttctttatcaccagattctctatccagcatgagagtgtgttttttggacccttgccctagcccacaaatcatctcacaacttgggcatgaaacagcagtggggacccaaccagagttcacaaaattgatcggttttcatgaaatcgtcagcggtcattttgtggaaaccgatcggttttagttgtttttttctagcattaactgaaagtcatcggtttttttatcagttttcgtaaaccaagtttttttatcggttttttcataaaccagtgaggagcagtttttgtttgcaaaaaagaaaaggtggcacatgttgataccatatgccccaagaattctctccatgcttccagccatcaaatcaagcaatgtggtactagtatcatgcatatgccatggagatgaatgccacaaccactttttcatgccctttcacaagaaagaaagggaggagagtagttgccctttgcaaaccaacagccttgtcatgcatgatgcagctgtgtccaacaaccagcataggtccaaattgccagccttgctgctattcatctcccagccagccaagccaccatgttgttgaagaggggggcaactagttatcactgatcagatattcagatatattcagatatgccatgcaatgcaagctatggcagacaagaggggcatgcatgagtagtgacacagcatttgactaatcccttcgcggctaagttacagcaactttaaaaggcaggtcctttttacagttgttgcagacttgctggcttgatgcaggtaggaaaggaagaacagacgaaactttagaacgaaatgcatgtgcaaaagcagatatgattatgtgtcgtttcagacaaacaacaaaaagaggctgtggtgagttgtgagcatcagagcattggccaaaactccagaagtctacaatgacgttgctagatcatgttttagttaatcttggacaatgcagcacgacattaattacatgggggccaaaatgggacatcaaagattcaagacgaatgtcctccatccagacagtcagacagcacaaagatgcagggacagctccaagtctccaaccactggaaacatagctaattcagttcagaattctgacatttttttcccagaagaacaaatggttagttactatcttccatgggagaagtgcaagcataactcgccgttagatttgctaggtgaagtgaccacagcatctgtacaatgtaatcttcccttgcacttcacaggacaagcaaaagaacatcaacaatcctgagtaaaatcatttatctacaaccaaaatgaccaactcccaacaaggcaaaacatcaagggagccttctcccccatattctcatcactaattttagctatatatattgcattttccctatataaattactgaaccacccaaaaagacttaacgaacggtttcttggaaagtctggcagcgcaagcttctaccgcaccgatccagctcgcctgcagacaacgtcaagggcttcaacaactgttcctgagaaaccagctatggcttggaacattcctggcaggcctgtttggatgttgttcagtgtcattgatctagttacctccactgccttagcatgccttgtcatttcgtcctccaccttccgccgacattgggcaatctcggttttcttctctgcaagaggatcgcgggcatcgaacgaatggctttcaatgccatcgcgcccactgccaggaaggccaaggccaaccattgaataggattggtagtacttcttctcaatggctcgaagtgagttggtcttcttttccagctcctttgaatatgtctctgtccgcttttttattttcatctcctctgcctgcttagtgtagatgacatggacaacattcacgaagctcttgatagcctccgaagccgaagcatctggaagccggtccagtgcttgcttccactcatcacagaaggtggtgagttcacgagagatcagcgaggtgtaagcctcttgtgggatattactgtccacttggaagagtgtgagcttcagccagccatagagggcacgtatataatcacgttgatacttgatgagacggttgaagtttgagtgccatgctgagacagcagcctcaagatcacgggtggcaagccggtgaagatcagatgttgactcagccatggaattgtctaccagaccacggacttgctgaacaatttcattctggatctcatggaaatggttcattgatctccacatgctcaacagcctgcatatcaatattcagatacaatttaaatacttgcacacaatgtcgcaaaatctggtatcatagatgtcagaacagggaacaagtcttacgcgaagcaaagctcgacaagctgtggtgcaagctcattgtcacgcaccctgacaatggctgaggatgtggtagttgcggcctgtgaagtcacgatgatcaacgattgcagcttgtttatggaggccttggtcttatccagcttggtactatccctccctctgtactccaggctctgcagagtagaaagcttcttctcgtgctcaatcttaacgctctctctagcctgaagcagtaaaaagttaatacatatgggaatagtttcaataaagtttcataaactgcttagagaatagaagcatttagtagacaccggacagtaagaatccattatgttctagattgcagaaataaaaagaacattggttagtctcactcaattatcgaatagatatggtataagtctcatgcctaccaagggtaatgcccctaaaggcctaaacatctctggactctggtgctttagacatagatacgctaaatctacctttggcattatgaggtatatttatgtgcagtaaagacaatttcttgaggatctaaaccttcacccacaaagccacaaagaatctcaaaggacaggagtagtttagatataaaaagagcataaaggaagggtatatgaaggtgtggttgagagatcaatggccatgtattgtgcctgcttcctttactgaaagtagtgaaaaattatcaaccaaatgctacagctgtttcagaatccagggtaggcaagtgcaggacctctgtaaagacgctttatgcaatagaatcagattcttctaccacatttgctgaacaaaaggcgggctgctcaaaacaccaatttcaaatgaggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11979 - DNA, 1094 bp, Oryza sativa
ggtggtgacggcggggcgctgctgcagctgagtcgtgggacggcgacggcggcggcggcggtggaggaggagggtggggtggtgatgcgtgtggctttcgacgcgaagcgcgcggcggtgggcgtcggcgcgcggatgctgttctacccgacgctggtgtacaacgtcgtcaggaaccgattcgagccgcacttccactggtgggatcaggtcgacgaggtggggaaaatttcctaccccctcttttgatttcggttgtttttggaggttttcccccctcttctggttgttgatcgccgtggctttcgcgttcatcttgtgccgccgacggattttgccctgtaatgtagcttcttacggtggtttgctgaccatcatggcagtttgcactccaaacgtttagggttaggtctttcctactgcatatgcatagtggagaagagattttcttcgtttatagttcttgctgtatttggatttttgtttcaatttcgattcgtttagtgttttggacctgtatgtgggtgattggcactaccttttctgcagtattgatttctcgatctgtttagagttatagtttactctgctctaattgtgtacttttcttttgcttcgatcagcatgttctgctcggtgctgttcctttccccagcgatgttctacggctgaaggagcttggagtttgcggtgttgtgacactgaatgaatcctacgagaggctggttcccaggtgcctgtatgaggtagtcacacggccaaatcattccactaaatgactgatcaaatgtgctgaataatatgtagttctgtaagttttgctgcttctgtttgttaattccttcctgcgagtatggctcctgcatattatttgttgttactctgataacgaggaggtgcacggccttgttgtaaaccacactggcatatagcataatcaggttccagtggtctcagtggtgcaatactgcaatgtgaagagagcaattactggagatttctgtgtttgccatctagatgcccacccatcagatcaagggtttgagaaaaatactagaagagcccttttgtttagctgatgggaccacaaatcg

SEQ ID NO: 11980 - DNA, 767 bp, Oryza sativa
gtattaccgtaaccacttgccgttgcctcgggatataagtttactttagatccctcaatttatcattgaatctgaaatccgtcctgaaccgtactaccagatatgacgtgtccatcaactttcaaaaccaatacaaataagattccaaagcggtttcaacggtagtttcggctgacgtagtgctaaaccgggtccccttctccgccaaccttgtggctcctcggcatggagaaggatggcggtccatgggtggctgttggatgccgggaaggagaagaagcaagaaaggagaaaagagaaagaaaataaaaggaaggcgatacccactgcatttttttatttttaatcagacactcactgacatgtcgaccccatggtttttcttgactttaagtgccatgccaatgtcatgtaggcgccacatcagccgaaccaccatattgggatcttatttgtattggttttgaaagtctagggatgcgccatatgtattgcggttaggtataaattttagactcgacgacaaattaagggatccaatgtaaacttatttcttgtcttggtgaactactgggccaagatacccagtctgaccaaaaggcccatttacaggtcggcctgccttgtctcgctgcgttgcaattgaatacggcccaacatggaggccattactggcaggcctgctcgcggttcagcaaaacggcccattaaatactcggcccaattaatcttggtgagttcgaggctatcccattccggcccaactg

SEQ ID NO: 11981 - DNA, 537 bp, Oryza sativa
cgttgcaaagagctcttccgcttctgctatcatgccagataatttgcagtcgacctatccagtgattgttccagcttatttctcgccctttttgcaattctcggttcctttctggcaaaatcagaaagatgaagatggtcctgtgcaagaaacacatgagattgtcaagcctgttccagttcattcaaagagcccaatcaacgttgatgagcttgttggcatgtcgaagctcagcataggagagtccaatcaagagacagtgtctacttctctttcattaaatctggtaggaggtcaaaatagacaatcagctttccatgcaaatccaccaacaagggcacaggcatgatctccttctgcacacaactgcatttagatgaatcccaggcaaaataagctttgcctccttgtttttttgtttttattttaagattaaccgttctccgtagtctgtatcatgtgctgtaagttatgctatgtatgaatgtatctgttgtttgtctggcacacatgataaatcactctatgttaacaaaa

SEQ ID NO: 11982 - DNA, 671 bp, Oryza sativa
agccaaaataatcttctctgggaacaacgtctgcaagagagctggttgttgttgtggtttttgttgaccatgaaatagtgtgtgtaacaaaaaagacgagcactggatgagccttacggcagttggcacacagcaccatttaggtgttggtttgctggggaaaaaacagatcttcattctgacaagagacctaaacagagagatgttcatcacattcaacacttcgattactccattacttcatcaaaccaaaggaacacatgtatgcgcatggctttgcagactaactcagttgcactaggtgttttgattgatgataactcgtgtttttgtgccactaccgtggagtggtggcacagtcgggaagatccatgagcatatagtttttgacttttaacagtacgatcatcacttaagacttcaccaaggacaaattaataatcaggatgcaagttgcaaacaaggacaagaaatgcaagagcaaatcattagccagctagatcaatgtaatctacagaaatctacagaaatataaatatttgagctaatgcttgaaatctattgtcaaaccggacagttctatcaattacaaaacattagataggtttgaaccaatgtccttaccactgaagagtctgagtctgaagggcgttatccaaagcacattggcc

SEQ ID NO: 11983 - DNA, 769 bp, Oryza sativa
  unsure (1)..(769): unsure at all n locations
atggtatcaacatgtgccaccttttcttttttgcaaacaaaaactgctcctcactggtttatgaaaaaaccgataaaaaaacttggtttacgaaaactgataaaaaaaccgatgactttcagttaatgctagaaaaaaacaactaaaaccgatcggtttccacaaaatgaccgctgacgatttcatgaaaaccgatcaattttgtgaactctggttgggtccccactgctgtttcatgcccaagttgtgagatgatttgtgggctagggcaagggtccaaaaaacacactctcatgctggatagagaatctggtgataaagaagtgtgtctggttttgtatgtagctgaaccttttgcaagtgtaggtgttaattgggtgttttggaccagacaataccatggcacctataagtgggtgcttctattgttacacgagagaggataagaacttggaagagacatgatagtggcaggcaagatcacagttttttttttcctttttttttactctggtcatgcattgtatgatgatgttctatatggaacagagctaatgatgtggtgtggcttgtgatgggctctacgcctatgggctatggccatgtgcatgacaaaaccaatgatgatgcatgctcactcgatcatttctgtgagcaataaggtcttcaaaatgaggctttgattgctaattctggttgcaaaacattagaannnnnnnnnnnnnnnnnnnnnnnnnnnnnnnnnnnnnnnnnnnnnnnnnnnnnnnnn

SEQ ID NO: 11984 - DNA, 703 bp, Oryza sativa
  unsure (1)..(703): unsure at all n locations
nnnnnnnnnnnnnnnnnnnnnnnnnnnnnnnnnnnnnnnnnnnnnnnnnnnnnnnnnatggttgctacgatgcagttgagtggttcagttgtgattggtgattgtctgtgtaggatgcatcaagcggtatttctgatttgggcctctggaagatggatttgagtgatgatgtgtaccaattgctttctgaaggtacttgtctgcttcgccatttctcaacaactgataaatttgtcaaatgtaaccgttcatttttacttggacgttcatcattcagttgatttgatgtcctttccaagctttgcttcttaaaaggacaaaagaatatttctatatttgtccggccaaattatctttagaacactttccatcttgaaaggcgtcaatgaaactgtactgtgcaaatctgccataggcatttttgatttggtattgtgcaaacaactacagcattctagaactgtatcacaagttcacaacccactttctatcactcttgctcattgcacattcatatcttgtttcagagaactgtttactccactgttgttgcttatatttcccttcaagtttgggacctgattctgaattctttcagaacaatggtgcacgttactgctgatcagcactattcggtcaataatgcagtgcagtcataagtgcaccatttcaagtgtatttgttagttggtactaaatatctg

SEQ ID NO: 11985 - DNA, 687 bp, Oryza sativa
  unsure (1)..(687): unsure at all n locations
nnnnnnnnnnnnnnnnnnnnnnnnnnnnnnnnnnnntcatctatgaggtcagaagttcaacccttggacctgaccatggccggagctcgatgtagcttagtgtatttccattggcttgatcacatattcagacagaaggatctacatgcgaattgctgatgaatcagttgagcaacgcgagttggtcttctgaattgcttccattctacgccaaggaaggatcagaattcagaggcagaagcgaacaatgcttcaccgtatcagatcagatgctacgtgcacgcgcaggagctgacctgctggctcaggaacagaaaagaaattcacaactggaatctggatgtcctacctaacccttctgaatatgtattggactgaacagtcgcagcaacagtaaaagtgcagttcctgagtactaatcctgctaataaactcgtattaacctcgctttctctgctctgactaactacactctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11986 - DNA, 809 bp, Oryza sativa
taaatgttagttgcgactaataagtacaggcaaacgagatggaggtgatcatcattctgataaacctcatgctggcatgtcatttcaagcggtgaacttgaaagatttaacagtttagccaaggctgatggtactgtcagtccgacaacaagagcaatatatagcttcgctgcctttgtttaaacatgatccacaatttgcgtctgcatctgcttcactgctcagtgaagtgattggacatgatctcaatttctcccaaacaaagacatggatttgcaaaccacaaacaggaagtttggcgaatagatcaaagtgagctatttgattcgagcaattcttctacaggctatcactgtcatcagggcaaaaactgtgaggatgaaggatacattacataccaaaaaataaataaatgtatccaaacttacaaaactgaatgattaaggcacacgttatacctttctactcaaataaaaaaaacaaaaaaaacgtgggctttcagcattatatactcatgcagtcatgcatgcactggggatggaagatctcaaggattcagcttctgttgtgtaacggctctcatattgctatctacagtcgacgagtcaagtaacggtggttagttttttcaggcagtttgctcgaaggatgtgtgcagttctcctacaattggcagacattgttcttcctcattgtttctatgcttcctgctatggttgatccagcagtccccacaaatcctagtgatgcacagggggagacagattcttcaacatataacaaaatttctggtagttgaactggatcac

SEQ ID NO: 11987 - DNA, 665 bp, Oryza sativa
cgagctcggtacccattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagcacaaagtacgtacgcgagcgacgtgtacgcgcctggacagtgcacggctgtcaccctcgtgtgccatatttaatttcgcttttctttcgatttttgatcttatcgacgttgattggtacggaatacctcccaaaaccgaaaattatacagggagatttttttttttcttg

SEQ ID NO: 11988 - DNA, 569 bp, Oryza sativa
  unsure (1)..(569): unsure at all n locations
nnnnnnnnnnnnnnnnnnnnnnnnnnnnnnnnnnnnnnnnnnnnnnnnnnnnnnnnnntgcaggtcttgcataaatcgccaaccagcgcatttgccgtccggctcaacatgatcgggccgatctgcatcctgatttcgctgatgggttcattcaacctgtcatcgttcctgacgcaattcttctggcttgcgttgacgctgatgggctggtggcggaacaagcaggcagggcggccggtggcggaagcgcctggcgcgccgcgcccagggcagccagcgcagcaataggttcgtgttgttttggcaagaccgcgctttcgagcgcggttttttttcgctcgcgctatttgccgaatgcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 11989 - DNA, 288 bp, Oryza sativa
caaaaatcatattttcgaatattttacttttttgggatggttgctacgatgcagttgagtggttcagttgtgattggtgattgtctgtgtaggatgcatcaagcggtattttgatttgggcctctggaagatggatttgagtgatgatgtgtaccaattgctttctgaaggtacttgtctgcttcgccatttctcaacaactgataaatttgtcaaatgtaaccgttcatttttacttggacgttcatcattcagttgatttgatgtcctttccaagctttgcttctt

SEQ ID NO: 11990 - DNA, 7795 bp, Oryza sativa
tctagagtctgaatcaaatctatccctacttaaaactttggatttttcccatcatcacaatgtgttttcatccgtcgttgagcaccttctctgcctcgcgcggttagcgccttctcaagattccaaatttcccaactcaaacacaaaaacaaaactaaaaggaatcagactctaatccacccaaataaaattagaagagggatccacgtttgaattctaatccatcgcaacatgaaacaataaaaaaatattccaccttgacttcccttaggcctgacggctgcatgcatcgatgcaatcgctccctccgcctaaaggacgagatcgctcgaatccgctcggcaccgaactgcaccatgaatccgtggatgatctcgtcggtggaaaggatgcaaaaataagaatgcaccatgaatttaaaaagaaaagaggtgcgaaaataagaatgtaccatgaattcaaaaaaaaaagagaagttggacatgatagggccgtggcttctctcaagagtagaaagggagtcacctagacatttttcgttaggcggctcaagggccgacccgaacacaatggaaaaagaaaagagaagttggacaggatagggtcgtggcttctctcgtgagtagaaagggagtcacctagaacattttcgttaggcggcggctcaagggccgacccgaacacaatggcaaggagatatagaatgctagcatccggcacgagacccggggggagaaatatctccctatatacctcgatcccccaacaacggccaccccaacaacggccaaaccctgccaactcccgccccctacagctagggttacaagctcacgccaccgagctcggtggtagcatctcgatcgtgttcttttttataccggtttaagccgatgtagattttccatgtggtacgaaactttgttcttatgggttacacgtgcactaatatgggctgtggcgtcccagtaattatcatatctggtcttattatgtttcgtcctcatcgtaattttcgttgcagaatcaatgtgtccttgtgtggtttggatacaaagccaatgagccaatttttgcatagacgcgtttacaatcttggaatcccagctacaaccatggccggcgtcgcctctccgagacggcatagcaagattgcacctgaacgaacacgacggtgatggcggcgtacacggccacgacggtgccgacgaacgccatgagccggtaggcggtagtcgtcggcggcgcagagcgcgaacgtatccgcggcgaactgcgcgacggccgtcatcatgttggtgatcagcctcgcggtgaccctcctcgacgcgcatccgctgccgccatcgcccacggcgagcagcaccgctaaccagtccctgggcctcggcatccacccggcggctgtagcgccgcctggaacgccatggcggcgaacagcgtggccaccaccaccatccagccatccgcgcatgcacaacaagccgaagccgccctgctgttgcagccactcctcgccgctaccaccagcactaccggctttctcactgacaccgccggcgacggcagcggcagcctgacgtccgatgttctgaacgacggtgtggccattgagagggacctggatcgtcctgtcgccgatgtcgatcaccagcctgatgaactaattaatcaccattgaacatgttcatcaacagtaaattgaaagcccttgagctgagttgattagcctggagaattggcagagtcgtcggcgacagaatcaatcgatccatcgatctctgcacaaaaatcaattatgtgctccagctcactctctgaatgtggaatcctaacatgattaacgtcattgttttgtactctgctcctgcatcttcacctcacctgctctgcaattctaattctcatcatcttcaccccacttgatatttgaagggaaaagtaaaagaaaaatagcatcataaaaagaaaagaggagagttggaccagatgatatggccgtgggcttctctcgttaaagtagctgggaagttcactgacgttaaacaacgcagggctctaagcaacccaacgagaccagggatatcttatctataccctcgatccacccaacatcggccaaatcctgccaactcccgcccgccacagctggggtgacaagctcacatcaccaagctccgcgggagcaacactaccacgtcctgtttaatgcgggtctctaccactataaatttttcatgtggtacaaaactccattattgtgcattgcgccgcgcgtgtatatagtaataatatatggctgaatcaaacgcatggccggcccagtattatcggtctttttacattcttggcacccagctacaacaaccatggccgccgccgcctctcccaaacggtagagcaaggttgcacctgacgaagacgaccgtgacggcggcgtacacggcgacgacggtgccgacgaacgccatgagccggtagtcgtcagcgacgcagagcgcgaacgtcgccgcggcgaagagcgcgacggccgtcatcatgttggagatcagcctcgcggtgaccctcctcgacgcgcagccgccgccgccgcccacggcgagcagcatcaggagcacggcgagcgacgtggcgaaggtgcaggtgctgacgatcagatacagcatcgccttcccggcctggtccctcgtgacggcggccgccgccgggtcggcggcgagcagcgccgcgaaccagtcacgcggcctcggcatccacgccggcggctgcagcgccgcctggaacgccatggcggcgaacagcgtggccgccgccatcagccacccgcgcatgcacagcaagccgtcctgttcttgcagccactcctcgccgccgccaccggctttctcactaacgccgccggctgacgacgaatcaccggcgacggaggcggcagcctgacggccgatgttctgcacgacggtgtggccattgagagggacctggatcgtcctgtcgccgatgtcaatcaccaacctgatgttctacacgatgcaattgatatacacacataattagcttaattaatgaactaatcaccattaattaaacatactaatcaacagtaaattgcatgcacttcagctgagtcgagagatttaacctggacataattggcagagtcgtcggcgacagattcgatctccacatctggccgaatccgccgtctatccatcgatctctgcacaaaaatcaatggcgtgctgactagctcactctctgaacgtcgagtcctaacgccatcgttatgtactctgcttctgcatcttcacctgctctgcaattctaattctcatgtcgtagtctcaattgagttggcaagagaagctgcctaatagcactatcaactgagctaccaactactgattgtgtttcgcaaaatgacctatttttcacttcgattctcttcttatacgtaggcgcaggcgcgcagcagtcgccgactcgtcgtcgacccgatatgataattgcaagatacgcacgagcatctttaagaagagatactaccagactgacagctaaatatttaggacaaattagagaagaattgatgaagggagacagaacaaaatattcaggtgtctgaatattagctcagagctagagaacacatactgtgattgaaaagaaaaaaaaaaactaagattgtaatgctgcttattctgattcccctcgggcaagtgtttgtttaggcattctagctctagcttgattaactaaagaacttagtttgcctaattccattccatccaaaccgtccataaattaactgttgctgtcaacaggaatataactctgctcaactgccctgctctgtcttttagtgtcttatttctatcagctagcatgataatacgtgtgccataccagctgcgcacacacaagaatacatatatttctgaagcatgtccatgtctgtgtttggtagactggcattgatcatgaataaatggatcatctactaatgtcagcttacaacaacagatcaacagcagcagcatgtttctagcagttgatctctccctgtaaaccatccatacaattaaaactgctgcatccagaatggagctacgtaacagatcatcgaacatcagtggctcaccgcaatgttaatatgttatctaaacaacatggaattgtttgttttataatggacagaaacccgacatttgtatccacaaagagtaaataagtatacatggtatttgggtatttttgaaagaaaaaaagaaaagccatacccaataatatattgtagaaccttgtatatctataaggttattttggttaatgggcaaataattggcctatttgggggaccttttggcggctgcagtttctttcaaaattagaagctccccaaacagtccagcttttgaaagtcagaatctgaaaatgaactagaagtcagaatctgcgaaacccaacatttttagattcttagaagctagctaccaaccagctatttctcagaatcttaatctcgcctaaacaggcacaatatctaaatcacgtggcttctgaatcacgacgactgccctaatatcatccctaaaattttccacaaatttcgttaaaaaaattacaatagagttggtgcattattgtaagccagcagctgatgtataataccatcaaatcttccacatattcagatatagctccactttgccggatatgtgttaggcgttaaaaataggcaacacgcagtttgtcaggaacaaattgataacaagataaccattgcgtttttcgacaacgagcgaccgattttcaatcaaatcggcaaagagagatagattaatctactccagaaaaaaagaacagaacaataatcgtagaatcaatttatcgattgggttgaggggtttattcaatcggcactgaccttatataggtgtcttgtctttaaattagaataacatatcattcaaccgaatcaacaccgattaagaaaaatattgtgccgtcccagccgcagcaaattaaatgatggttaccttccttttaaaaatcttgaccactcagatcttctgcaatatgtacccatagtttatgatgcaactctaggatcgagtacacgaaccaaatctatcagaggagggtgaacggtagaaatactaaaaaccaaaaaaatttagtgaaaataaaagttacccttggatttggcgaatttacaccggtcacaccattggatatccgctggtttgaccgcattactcccgttggtctgatcgcctgctcgccaccggtctgaccgatgtgcggaggaggcggcggcagaggagacggctgtgcaggggctttctcgttaagcgcatgatgccaagccagaggaaagcttggcgaagagtgcggggaccttgacgctggagcccctctgccactgttatcaatggctcctccgcacatcgccatcatcctcaccgtcgttccgcaggtctagcagcaaagaagaaagggggagcggggatgaggaggggtagcggggagcggggagcggggagcggggatgaggagcggcggcgtggagcggtatccttcgaggcggtgcgaagagacggaggacccgtcgctcacaacgcgctcctccactaggatctcagtctcctcccgcgcgctcaatcatcatgcccaatagctcccccaacctgcaccgcatccctgacgatgagaccccgccttttgcgacggcgagcgtgccttcggccatctccctggccgaccgccgctgatgagggagaagggggggggggggggcgcaccagttgcgtctgctgagctcccgccaccgctggacggtgctgatgcaagggtagccgctctagccactgttagattaatgggctaggtccaattaaatcctaataaattccattggcccacattaaatgctatgggtaataataccaccttggaaatctaagtgaagaggttcaacttaaatacagagctagtggagagtctctgttgaccggttgagatggtgcgtggacaactaggcggggcgaggcgaggcagacagctgctgctgcgctctctcgttttgtaacggacggtaataaacacggagaattgatttcatatcaatgaacgcgtcggttacggaattaaacgtcgtgaattgattccatcggttacggaattaaacgacgtgaattgattccgtattaacgagcgcgtcggttacgaaattaaacaccgcggttgatgactccgaatgttactctcgcgctcgcatatatatactccgcagcgaccagaaggacttacgaagttcttcccaactcttgcacttcgagttcctcctcctctgtagctgcagaatccttacccggttctgttcacctgcgcacacaggtgtacgggacgagcaggtgcctccagaactccgtccacttgagaacttgcacgggtaggcgcgcaatcaagtttttgggtagcgcttcaagcgcgactgctcctgttcttcgttcttcgacgacaacgttgcatcttcctctacttctgcttcaccatggcttctactttagagaacggaggagacaacatcaacggaggcaatacgaatgcctcaacatcttctgcaccattatctgggtataagattcaaactttatttgattttcttcttgttatttacatgttcacaatgttatccataggatttcaatcctatgtgaatgtcaacgatgtctatgcttattttaccttaagcatgcttatgtttatgtttagccttatcactagatcgtttctcattgtgtatgtcatgtttattgtcttaatattttggattaaaatatgccgaattatgaccaaatttccaacaatccaaaaacttgataggtctttttcggtagttggctttgctgcatcactaaaaccacatgctttcgatggttcaaattagaaaagatggaaagcacacacactttttgtggttgacggcgatgcattgtttctttgtttcacggggcaaaccgagtgaaccgcctctctcccctgaggaggaggctaagttcgaggctgcggatagcttgttccgtggagcattgatcagtgtgctcgccgacagtattgtggacgtgtatttgcacatgccttcagggaaggacatgtgggatgatcttgaggccaagttcggggtttccgacgccggtagcaagctgtatgtcatggagcagttctatgactacaacatggtcgatgaccgttctgtagtggaacaggctcatgaagttcagatgctggcaaaggaacttgagaacaacaactgcgagttgccggacaagtttgtggtgggtggcattattgccaaattgccaccttcttggacagactttgctacttctctaaaacacaagaggcaagagttcagtgttactgatcttattgtctctttgggtgttgaggagaaggcgagggcaaaggacaaccagggcaaaaagatcgagggaggttctagcgccaatttgctgcagaagaagaaccttcatgcatctcacaacaacaacaagaaagtcaagcctgatgtcaaaccaaaggctactaccaattttaagaagaaaggcaaaggaaaggcaaaaggagattgctttgtgtgtggcaagcctgggcattgggccaaggattgtcctgagcgcaaggacaagaagtctgcaaacatggttattagtgagggcggaggaacattggggtatggtaaatttttacctacagttctctctgtctgtcactcacctgattggtgggt

SEQ ID NO: 11991 - DNA, 751 bp, Oryza sativa
cataaggatgtaacaccattcgagaaatgggaaaggaagaaattaagtctctctcacctgcgcacatggggctgtttggccaaggtaaatgtaactatagccaaaaagcgtaaacttcgaccaaagaccgtagattgtgtgttccttggttatgctatccacagtgtggaatataggttcttaatagtaaattctggagtacccgacatgcgtgttggtacaattactgagtccagagatgccacattttttgagaatgaatttcctatgaaaaatacacctagcacttctagtcaagaacctattttatcccctaagcactttgcgccgatagaacacattgatcaaacgcctgaggaaaatcctgaggaggataacattgtagcaactcgaaagagtaagagacaaaggactgcaaagtcttttggagatgactacattgtatatcttgtggatgatactccaagaaccatttgaagaggcatattcatctccggacgctgattattggaaggaagcggtacgcagtgagatggactcaattatgtctaatggtacttgggaagtcatcgagcgtccaaatgggtgcaagcctataggatgtaaatgtgttttcaagaaaaagcttaggcctgatggtacaattgaaaagtaaaaggcaaggcttgtggccaagggttatacccaaaaagaaggcgaggactttttcgacacttattcaccggttgctcgcttgaccacgattcgagta

SEQ ID NO: 11992 - DNA, 14741 bp, Oryza sativa
gaacatgaagtcatctaggcatgttaaaagaagactgaagtctgttagaaagcagaaaaactttggagtgatagcattggactatgtccagacggctaaaaatctggcagatcagtttaccaaggggctaccacgtaatgtgatagacggtgcatcgagggagatgggcttgagacccacttagagttgcacaatggtggaaacctgtccattgtgatcggagatcccgtgaatttggatggcgaaacaaactattgggtaactgagagaagagaccctaaaatgagcttatcttcatgatgcacttctcttctattctgtatggtaggatggtatacaccttaatgtgatccgagtggcttttcataaagcagagatgttatcctacagaacatcttagaaggaacacacctatatgagtccgactgctagtcacagtctatgagatctgggtgatctctagatactcatgaaaaggccaggagtatgacttatatgctccaaacagaggggatgcaaacaacagcctagtaccagttaagggtatgagtgaaacctgaatcgcacaagactgacaattcaaggcatagtccattgttcagttgtgatctggtgtagctcttttcctaggtggaagttcaacttaacagtctccaccgaaacactggtataacaaacaggatcagaatcgagagcatttcctatgagccacgaaatttggtggggattgttagattaatgggctaggtctaattaaatcctaataaattccattggcccacattaagtgctatgggtaataataccaccttggaaatctaagtgaagaggtctcaacttaaatatggaactagtggagagtctctgttgaccggttgagatggtgcatggacaaccaggcggggcgaggcgaggcaaggcaaacagctgctgctgcgctctctcgttttgtaacagacggtaataaacacggagaattgatttcgtatcaatgaacgcgtcggttaccgaattaaacgtcgtgaattgattccctcggctaccgaattaaatgccctgaattgattccgtattaacgagcgcctcggttccaaaattaaacaccgcggctgatgactccgaacgttactctcgcgcttgcatatatatactccgcagcgaccagaaggacttatgaagttcttgctgactcttgcactttgagttcctcctcctctattcttgagctgcagaatccttccccggttctgttcacctgcgcgcacaggtgtacgggacgagcaggtgcctccggaactccgtccgcttgagaacttgcacgggtaggcgagcgatcaagtttttgggtagcgcttcaagcgtgactgctcctgttcttcgttcttcgacgacaacgttgcatcttcctctacttctgcttcaccatggcttctactggagagaacggaggagacaatatcaatggaggcaatacgaatgcctcaacatcttctgcaccatgtactttatttgattttcttcttgttatttacatgttcacaatgttatccataggatttcaatcctatgtgaatgtcaacgatgtctatgcttattttaccttaagcatgcttatgtttatgtttagccttatcactagatcgcttctcattgtgtatgtcatgtttattgtcttaatattttggattaaaatatgccgaattatgaccaaatttccaacagccaccacttctcgtcaccgctgctatgcttcagccgccgtcggatggcgctgacgcagggggacggagctgatgagggggaggcacaccagtcgcgtcgctgctgagctcccgccatcgctggatagcgctaatgcatgaggaaccgcctcagtcaccactcctcatctccgctgttgtgctcgtacaggttccagatggcgctggggagccaccactcctcgtcatcgctgttgcacttcctctccgttgaaattgggagaaaacatgggggagagagagggggtgcatgttgtcaatcttgccgtctatggcattgtttttttaggtgtttttgtttttctgttttcactgttcctcgtcaggtagtgtgtcgttcatttctttgtgttgcttgtgggccggctagctatagcagctacgtcgtgtgtaagacttgaggcgtgcgagttcacgtcgaagtcgtggagtctgagtctcgcgcggcacgatctgacgtgtgggatggcgcacgtcggtgcggatcgtgtcgtgcgcatgatggtccactactgccgatttactagcgttgtttccaaataaaaggagatgaatataacccagaaaagctgctgaaggtgttgcagcgccaattcatgtgtgttcaagttcagaggcattgttgagtgttttagtttgagagttgcagagagatcgaggacgccgggattccgttcaccggctaacagtgcatgagatagagaaggaaggagagagagagggaggaagaataaagagagaggatgatatgtgggcctcataattttttagatgacaaatgggtctcacatatatgttgttaattctaatgccacctaagtgtcatgttaactctacagactaggtcaacactaacacatagatgccgcgtcagcgaaaccgctctccaaaaccattgagggagttaattgtacaggttttaataaataggggtcgagatatccggtgttatggtttagggatacgaattatatttgtttatatttgttcactggttaagggagttaaagctagcgggtgtgctagcagctgattggttcatttgctgtcccttcgttttactgacacatgtccatgcagcattcggggtagggcgctcctaacgtgactcttctcctatcgcgagcgtctgctgttcctgtatttagatatctcgcgtacatgtatacgggtccaacgggagtagcccctcagctagcaacttgggcctatggtcatgagccatgccaatgcttgcactatgcaggtcgagccagcttccacatacattcatgtcctgaaccgattgactgcgtgcctccgtgcatttgagagtattgttggactacagcgtaaaaagaacagcgacagatttaagcgtattagtctcatacaccatttttagtgtaaaatacacattagttcattattcaattaaatcaaagttcaatatcaatgtgttaacggtaaaatctggcagtggggttcagatagaagggaataaatcggtacagtattttatgaccaagcatgaaggatttgagatcaaattgcgcgtcggatggaaactgtatcggctgaaagcaaaagccaagagtcggattgaccaggacagtcaacggccgattcagccgatacagcacagtttgggtttagcataagcccagtttggaataattgatattgccaaatagagataaggctcattgaagccaattgtatccattaattaggttagttacgacagttttgttagttttgtcaagagacggccgtgaaaggtcttgttcgtatggtttgagtcgtgtccataatgaacttattttgtactcggggtataaatataaactgttagggttacgggtaaggtataccctttacctttcggtatacgtcacatatcgatatggtatacctgcgtgtatacggacattttctgcatacattaaggaaattcatcacggagttcacagatggaaggagtcctactcggacaggactgggtcgtcactgtatcatgcagggtccgatatcttcgagttctacttggaaaccgcctgacctgcgatataaaagggaccccctaggaaggacctaaggcatcgaatctcatagccaacacatccaccacagcctatgaagtcggagtctacaggagccaagtcgccaggagatttagttgaaccagctcgattacgatctcgccggtatcatcgagttccattgttccctttgtaacttgtgatttccattatataatcccatatcaactggattagggctaatacctatcaaggggcctgaaccagtataatctgtgctctttgtgtgcttgatgtcgtattacgtagatcctcgtaccagcgtaccccaataccctctatatccggtctacgggtatcccccgtcaacagtggcgcgccaggtagggggacttggtgctcaaggatctactaatatgtcatccagtttcgtcgacaacagcgctaacaccaacctcaaccaaggagttcctacttcgacaatgctggtgtggactcaagtcagcgaaatcgtcttcccggtttacaccacggtgccgatctcagctggtccatcaatgaccggaagcgagaacacggtggctacaacccaagacgactccatgtcgaaggatcctcccgccgaagcggagaacggaacgtcgacgacatccgagcctgagaaggatcttagtgcggccaaaccttgtcttttcgacaagaatcatgagccgacgaggataacttccgaggcgacaaggtcctggtgtcctatccacaaaaccagaaaacacaccttgcaagcttgctgggtttttctcaacgtacacaccgaaattcgtgcctgcaaagagcgtggaattcaacgtatttctccaactcgtgatatctattgtcctattcacaagacaaagaatcacgaactctaaagctacaaggtctttctcaacgccatgaagatgccgcttcctaaggtccatcagtcacgtatctctcttagggatgcggacaaggaacaaggagcgacactgatctcggatcgattcgttggggtaatctacatcgaccctcacgagccatcagttctacatttgctcgaagactatggctcatcgtcaacaagtacgccacgcgaggtgttggctatcgacgggatcggcacgtcagcgcgcgctaatgcagaagcagaaattcaagtgaaaggcaacgctgggtgtagagctttcagtcgttctgtcccgcacaacacatcagcacatcagggccgttctggttgtagagctgatggcgctatcactggacaacccaccgccctgacagtactgcacatcagcacatcagccctgatggcgctaatgctggaccgtcagtgatactgagggaaaccccctatgaccccgttctgaatgacaatctcgcacgctggacagaacggctacgggaatcagtgaccaacctcagcaacgcgttcgaagaggccgccgctgcagcgcacctggaacagccacaatttggcggtgctaatggcgaaaaccctgaacagcaggaatcgcctcatcgagccacccctccacctcacggcaccggtgatctccgcgatcacctgaatggctgccgagaggcgcgacgcgcacgacacaatgggaaccgttcccaacatcgcgtctcttcgtgacgtcaagataacgaagaacaaggaagccacacgagcgaagaccgagaccgcgataaccgccgcaaccaccacgatcacgacgatcacgaacggcgggtgccggacgatacttgtcaaggacgccgccataatgacgacgacgatggagatcggcgccgggacaacaacggggggcgacgacgggattctcgagaacccggccgatgtcctcagaatcgtacaccggaactaagtgacccatcatcatcgtcatcatcttcctcatcctcatcatcagatagacatccgcgaaggacgtatgatcgccgacaacccaccgcccccaacgcttggtgtagagctttcagtcgttcgctacgtgatgtccgatggcctgaaagattccgaccaggagcaatagagaagtacgatgggagtaccgacccggaagaattcctacaggtctactccacggtactctacgctgccggagtagatgacaacgtgttggcgaattatttgccaactgcattgaaaggctctgcgcattcatggctgatgcatctcccgccctacttgttttcttcgtgggcagacctgtggcagcagttcgtcgccaacttccaaggaacttacaagcgccacgcgatcgaagacgacctacatgtgttgacacagaacccgggtgaatccttgagggattatgttcggcgctttaatgagtgcagaaatacaatccctgaaatcaccgacgcttctgtaatccgcgctttcaagtccagtgtcagagatcgctatactacccaagagttggcaacgaggcgcatcacgactactcggagattattcgagattgtcgatcgatgcgcccacgcggacgacgtactgagacgcaagaacgacaagccgaagaccggaggagagaagaaaccagcgaaggacgcacctgagtcaagcaaaaagaaaaattgtaagagtgggaaaaggaaagctcaagcgtaagttctcgcagcagaatacgccgaccctgccaaacgcccagacccacaaggtagcgacgcgaagaatgcatggtgccttatacacaagtcggacagacattctttggaagattgcctcgtcttcaaaaagtcgctcgcaaagcacatggcatcggaaaaaggcaagcgagtacgtgtggttgagaaggacgctgaggcggctactcaggaatcggactcaacatacctagactccgatctccatgtctcgcacatcttcggaggttccacggcatactcctcaaagcgagaatacaagaaagtggaacgtgaagtctgttcgacgtggcagggggctgcacccaagatgaagtggtccgaacagaagatagaattctcggaagaagaccaccccaagactgccgttatcccaggacgatatccgatcttggtcgaacccagtattcggaatatcaaagttgcgcgagttctgatcgacggtggcagctcaatcaaccttctcttcgccagcactttggatgcgatggggatcccacgaagcgagttgacacccaccgatcaacccttccatggaatcactccccagtcatcgtccaaaccattgggcaaaattacgttgcctgtgactttcggccaagcaaataacttccgaacggagcaaatcaccttccggggtttctgattccgattccgaaaaaaatatgaaaatgaaaacgataaagatgatttccatccgtttccataccgttttcacctatagtgctcaagatgccaggaccgaagggaacaatcactattcaaggaaacacaaagctggcagtacaatgcgacaagcggagcctcgacatggtcgagcacacgcccagcctacccgccacagctgagccacccaagaaagtgagcaaaacaaacaagacaccaaaaccggacggcgcaatcaagatcgttccactcttcagtgccaaccccgacaagaccgtcaagatcggggcatcactaggcgagaaataagaactcgcgctcatcaccttcctccgcgacaatgcggatgtgttcgcttggcagctgtccgacataccgggggtccccagggaggtgattgagcacaaactcatggtgcgacccgacgccaagccagtaaagcaaaaactgtggagatttgcaccagatcgaaaacaagccatacgagaagagctcgacaaacttctcaaagctggtttcatcagagaggtactccatccagagtggctagccaatccagtcatggtgcggaaggccaacgggaaatggagaacgtgcgtcgatttcaccgacctcaacaaggcgtgtcccaaggatcacttccctcttcctcgaatagaccaattggtggactcaacagccgggtgtgagttgttgagctttctcgacgcttactccggctaccaccaaatcagcaaggcgaaagaggacgaggagaagacaacattcatcacgccgttcggggtattctgctacgttaagatgccgtttggacagataaccgcaggaaacactttccagtgcacagtccaaggtgcacttagcgaccaacttggaaacaatgtcgaggcctacgtcgatgacattgttgtcaagaccaagacaagcgactcattgattgacgatctgcaggaaacgttcgacaacctccgacgatatcgcctaatgctcaacccagagaagtgcacgttcggagtaccatcgggcaagctgctcggtttcctcgtatctggaagaggaataaaagcaaatcccgagaagatcaaggcaatcgagaacatgaagtcgcccacaagactcatgcaagtacagaagctaactggatgcatggcggcactaagcaggttcgttgctaggatgggagagcgaggacaacctttcttcgctctgctgaagaagcaagacaaatttgtatggacataggaagccgaagaggcattcattgcactcaagcgctacctatcgaatccccctgtacttgtcgctccccaacctaatgaagaattatttctttatatcgccgccacaccatattccgttagcactgtcatcgttgtcgagagagagaaggtgcaacagccagtctactacgtcaacgaagctctccacgacgcaaagacaatatatccacagatccaaaaactgctctacgtggtaatcatgacatcacgaaagttacgccactacatccaagcccacagggtcacagttgtctcctccttccctctcggtgaagtcgtgagaaacaaagacgtggtcggccgcattgcaaaatgggtagtcgagctaagccagtttgatgtccactttgtgccacgaacaatcatcaagtcccaggtactcgccgacttcgtagccgattggactatacctgataacaggttagacaaccaaatcgacaacgaaacgtggacaatggcgttcgacagcgcactcaacagccaaggagcaagggcaggattcgtcttgacatctccttcgggagatcaattcaagcatgcaattcacctcaacttcagggcaaccaataacacagccgagtacgaaggactactcgccgagataagagccgcagctgcactcggagttaagcgactggtcgtgaaaggggattccgaactagtcgcgaaccaggtgcacaaagattacaattgctctaatcccgagttatccaagtatcttgcagaggtcaggaaggtggaaaaaaggttcgatgggatcgaggtccgacacgtataccacaaggacaacatcgagccagatgatatagcacggcgtgcgtccagacgagaactacttgaacccggaacttttctggacgtccagacaatgccatcagtcaaagaggcaagcagcgaagatagcccagtcgcccccgacatcagctcgggggctacagaggcagagcgcgccattgttgatatcgagaccatagacgactggcgcaccccactgattaaattcataggtagcgaagagttgcccgaggacgacgcagaagccgagaaaataacccgtaaagcaaaattctactgtatgatcggcaacgatctatacaagaaagtgccaaatggggtacttctcaaatgcatctcatccaatgacggtagacatctcctcctcgacatacatgaagggatctgtgggtcacacgcagccggtcgcacattggtcggaaaagcctttcgacaagggtttttatggtcaaccaccctcaaaggcgcttgcgacatggttcagcgatgtgaagcctgtcaatttcacagtaaacacacaaagctaccagcgcaagtgctccagactatccctcttacttggccgttctcgtgttgggggctcgacatactcggaccattcccatgaggacagggcggctacaggttcctattcgtggcgatcgataaattcactaagtggatcgaagcgacacccacgggggaaatcaaggccgacaacgccatcaaattcatcaaagggatattctgcagatatggactgccgcatcgcatcataaccgacaacggctcccagttcattagcaccgacttccaggattactgtatcgggctgggagtcaagatctgcttcgcctcggtttctcactctcagagcaacggacaggtcgagagggcaaacggcatagtactacaaggaatcaagacccgcgtctatgataggctcttgtcacatgacaagaagtgggtcgaagaacttccattagtactatgggcagtgcgtaccacaccgacaacgtctaacaaggaaatacccttcttcctcgtgtacggctcagaggccatgctccccaccgagctacgacatcaaagtacacgagtacagaattagtattccgatgagggtcaggaggagcagcggaacgacgatgtgaatctactcgaggaacatcgcgaatgagttgccgtccgagtagccagctaccaacaggcccttcgccgttaccatgagaagcgcatccgagcacgcacgctttcgatcggtgattacgtcctctgacgggttcaaagccaagcagggcgaaacaagctctcacccaaataggaaggaccatacacgatcacacaagtcttgcggccaggcgcattcaaaattgcagacagcgatggtcgcgagttggcaaattcctggaacattgatcaattacgtaaattctatgtataagtcaatcgtatccatacttgtaagacatctcatagcttcaataaagcctattttcaggtacggattacaaccaaagtgttccttcccgatgatcccttacccagatgacatttagcattgaaacctatcctcttgtccctttacgccgtcttgacaaggcctccgaaaaacctaagggatcttcggctggggacgcctagagccgataaggccttgtcggatcctgtagagacgaaagaccatgtaagatctggtcgtgtaagagttcttgccgtgcgtattaaccaagccgtgtaatcggaaattaactttccaacttcacggctgggggctaggatcagtgcttgtaaaaccaaggcaggtcaaaggtccaagagccttatcttccgagaagtattctccgatgacaaggctgggggctagggagagtgtatgacttaaaagactgatcgacgtcgtgaagtgagaagacactcttacacactacatctagagtaaggaagcttagttagatagatcccttttctatttcacaagtactgcttacaatcccgtaaacatccaaaactatattacacttttccctaagatatttgtcacagggtacagagactaccaggaaggccaacgccagtccatagactagaagaccttctctgccagcggcgccatcgacttcgccaggtgatctatctccaccggagttctctgagaacgagaaaacccttcgtggaggaactcgaggtgcagttgcgggcgatgatctcgtatgcaagccaatacatgccctccggcatatcggctcgatcgacggcactcctgcttcagagcctcgtcaatacgcttgtcgatgccttcgagctgggtgcaggccccattcaaccacgagatgtatccggccgccgactcctcgggatccccacggggtactcggagctccctacagactcttgtcatggacgtgcagcaactcttcagatacgagttgaacctcacctcacgacctcggagtgtttccacagccagctccttctttacttccagcacagtcctctcgagttccgctacctcaaatttcgtcttccaatattggatgcgatgatcttggtcagcaggtgcactctcgagatctgctcagcgtgaaaacgactaaatcaagccgctcttctcttccgagaacacagcaaatcaagtcaatccaaacggaagggtaaaggagatggaaacagagatgaccaacctaaggaagtcgtcaccatacccgtgtccgcgggcaaattttgatctacatcgtcctgcgacacacgtggttcaaacgcaagcgtcggaacgatcaccggcaactcaagctgcccgcgctgctggacatcctcgacatcgacatctctacaaacgacaacaaagtacttgggattaaaatgctaaagaaaatgaaggtgatgattgcgcacgcaaaggcagttgaagccaacaaaagttttacaaagcatgactgattaaagagtacaagggaactaaagtcttactcttcaaaaagtgggagaacagactctcccagatcaccgacttcctccatcacgcccttacgtgcgtcgttagtcgctccctgatccaagatccactgaagatcaagttcagggtgcgctaacctcacacacgcgaggacgtgacatgccccggtgtaaatcccgttggacgtctcctccccgatcatggccgcatgcttggagggtatcgcctccatcgccgtggccagttctgcgagtgaagtcatcagcgagaacttgtcggggttcaccgggatggtggtcgtaacaccacatttcccagcgagctggtgtaggctggtgtaggtgacccgtaacgagccacggatctccgacaggttgttctctgtcacgactggaaataacccaacgggcgttccttacgtgcgtgtattattccttgtcccaggaggcaaggtacaccaaaagttgatacaattcagagtttaacaagcggaagcgtatatagataatttattacatgggcagcgaaggcccagcacacaagaagacaaacgaaaaacagcggaagactagggcgacgaccacaggcgcttgacggcaggcacgagttagacaccaaagccttcatcttctaggaactcctcttctgggtttgcgaaaaattgagcaagactgagtacaaccaccgtactcaacaagacacacccacaagtgtagaataaatgcaagggagtacaagggagttataacataggggttaagttttgcagtaaacagcatttaaaagtcacttagttgccaaaagctattttatgaagatgatcctagagctatacaagattattaatcaaggccgtgaacccacacgaacctgccttaacccaaggcctacgatgattcagaccgaactagcaacccgaccctgggtcccagctcgtcccaagccaacccaggccaaccattccacattttagttgttaagcaggttttaagaattaaaacactaacttgggtacattgctaggcttgcccataaccgagggcgcgactattcgaataggttttactctgatcagaggtgtacatctttacccacaagacatgtcttcctcacgtgtaaccacatgccacataccaccacggcatacagacggaagacatgacatagtttccaacccatcctagccatagacaagagtaccgacccaaccccacctacggccggaacctccgggacaggtaggcaggactgagcccctagcagcaggacaccagccccgtgccatgacatctcgactaccgggccgcagctcgtgtagccttcatttgccctagagatgtccatcgacccccgacttcgtccatctgcatccgtgtacttttgtttataaccagactgagccacaaactaagccttacccactagacatgtggaagtacggtagtgctttgcaacagaggcccgaagaccggtccttatgtggccgaggtgctactatcaaaaccatgcaccccgagcccagcctaaaaccattttgagggttttgaatagagggggaggtgtgaatccaattccacaataatccaaccattccaatgtccatgtgatatgaatattcccaaagtctagagttgtaaaaccacctaatgttgcctaattaaccagcgaagcatctacctaaattcatactagtggtaccatgcatagggtacccactagttggggttttgtttattctagggtgaacaaggtaataataacaatagcaataataataaggtcataacaatgataaataggtatggctaaataaaacagtgataacgcgggaatttaaataaagcgataatgcattaatttaaatcaaaataattttataaactgggattcaatatgttcaaggatgatgtgacttgccttgctcgctttcccaaacgtcggcttcaacctccacgaagagcggatcttccgaagctgcagcgtctacacgactaacggaaaggaaaaaggcttttactctaataaactccatataacaagcaggaacaaagcacaaaaatgggttcttgacttcttgaggaaaaattagagacttgaacggtccaattccgagttcaaatggccaagttatggccatttgaagtttatatgctctttaagtgaatatttgcgaatttctttatttaaattttaattttaaaaaaaggatttattgcgtcagccgacgggggagggcgcgcggaccgggtccacgggagtggggcccacccagcagcctcacggtccacggtggacagggtgcacccgggctcactccggccggcaccgtgggccccacgcgtcagccgcacccgagggcgcgggcagctgacggccgggccccacgcggcagccactcggcgcgcccgaaggcagccacgtcggcgcggccggtgggaggcggcgcgcccgcgcccctatggtcgccggcggcggccataggcacggcggagcggcggccgagagaagggaagggaagggggaaaagaggcagcggttcacggctcaccctaggtcgacagcgacgacgaaaaggcgaccggagcggaggaaggcggcgacgtggctcgggtcg

SEQ ID NO: 11993 - DNA, 9189 bp, Oryza sativa
agggaggggttttagggttttttctttttataaaacctttttaactttgtttatttcttaacaattattatttgtgctctgaaaattccactaaaatttatttgcacatttttggaggctttcacacggattttaattattctaggcataatttaaaggatatattttagggtcgttttgggtcgttttaggcgattttggagaagttctcgatgaatcttcggcggagaagatggttagagctcatcaaggattatgatgtgggaatccactatcaccctggtaaggccaatgtggtcgcagacgcgctgagtcgaaaaagccgttgcaacactcttggcgtccgtggcattccaccggagcttaatcaacagttggaagccctgaaccaaagcatcgttagccatggattcttggctacacttgaagccaagcctaccttgctcgatcaaatccgcgaggctaagaagaatgatccagatatgcatgggatcctcaagaatatgaaacagggtaaagccgctggtttcacagaagatgaacatgaaaccctatggaatggaaatcgtgtatgtgttccggacgacaaggaacttaaacagctgatacttcaggaagctcacgaaagtccctattccatccatcctggcagcacgaagatgtacttggacttgaaagagaaatactggtgggttagtatgaagcgggaaattgcagagttcgtggccctttgtgatgtgtgccagcgtgtcaaggcagagcaccaacgaccggccggacttctccaacctctacaagtaccagaatggaaatgggatgaaattgggatggattttatcaccggacttccaaaaacccagggaggatatgattctatatgggtagtcgtggatcgactaaccaaggtagctcggtttattcctgtgaagaccacctatggagggaacaaactagctgaactctacttcgctaggatcgtaagtcttcatggcgttcccaagaaaattgtatctgataggggaagtcaattcacctctcatttctggaagaaactccaagaagagttggatacccgattaaatttcagcaccgcgtatcacccgcaaaccggtggacagaccgagcgtctgaaccagatcctcgaagatatgcttcgcgcatgtgtcctagattttgggaagacctgggataagagtctcccctatgccgagttctcctacaataacagctaccaagccagcatacaaatggcaccctatgaagcgttgtatggccgcaaatgccggacaccactgttgtgggaccaagtcggggaaagccaagtgttctggaccgatatcctgagagaagctgaagctaaagtcagaaccattcgggataatctaaaggtggcacagtcccggcagaagagttatgcagataactgacgccgtaacctggaattcgtagtggacgattttgtgtaccttcgggtcacgccattgcgaggagtacacaggtttcagacaaaagggaagctcgcaccttggttcgtgggtcctttccgcatcattgctcgacgtggagaagtagcttaccagttgaagctgcccgcatccatgggcaatgtgcatgatgtgttccatgtgtcgcaactcaagaaatgtcttcgagtgccgtccgagcaggccgattcagagcaaattgaagttcgcgaagacttgacctatgtagagaagccggtgaagattctggacagcatggagcgcaggaccaggaactgggtaatccgtttttgcaaggttcaatggagcaaccacgccgaggaagaagctacttgggaacgtgaggacgagttgaagacagcccatcccgatctcttcgccagttcttccgaatctcggggtcgagattgtcacgtcccaaaacgactctaaaatacatcctctaaattatgcttagaataattaaaatccgtgtgaaagcctccaacaattaaaaggtgcaaagttaaaagtcaaataaggcttgggggatttttgtatatttcctaaaagcctaaaatgcgtaaataaattttagtggaattttcagagcacaaataataattattaagaaataaacaaagttaaaatgattttataaagagaaaaactctaaaaagtcccctttccctccctctccctcttgggccggctcggctcatctccctccccctccctctcctctccctgcggcccatccggcctctccccgcgcgcgcgccgcttacgggcgggcccgcccgccaccatcgctgacgggtggggcccacccgtcatccccttcctcccgccgctcccgccgcctcgcccgctcctagagccgccgccgccgcgaaccccgccacctcccgtcgtccccgcgtgaaatcaataggggggaattactccccgtgatcctctccccctttccccccctatttccctctctctctcgcattcaaaccggcggatttgcccccgcaaatctcaccggcgccattgatggcggccggacctcccgcgccggtttcctcccttccccggccaccctctctcgaccgggctctatttaaaccctccccgcacctcctccgtccgtttctgcctctcgccgcccttcctcctcgccggaatcgagctcgcgccgtcgctctctctctccgccgtcaccgtcaagctccggtccgccgccgtcgtcgccccggaccacctcccacctcggagccgcctccttcggattcgccgcatcctcgccgacctcgtccacccatccgtttcgctcgccgaccgccggaacgccgtcgaccccatcgacccgagccgcgccgccgccttcctccgctccggccgcctttttcgtcgtcgccgtcgacctagggtgagccgtggaccgctgcttcttttcccacttcccttcccctctctcggccgccgctccgccgtgcctatggccgctgccggcgaccatagaggcgcgggcgtcgcctcccgccggctgcgccggctgggccgccctcgggcgcgccgggtggctgccgcgtggggcccggccgtcagccgcccgcgccttaggtgcggctgacgcgtgccggtgtgagcccgggtgcacccggtccaccgtggaccgtgaggctgccgcgtgggccccactcccatagacccagtccgcgcgccccctcccctcggttgacgcaataaacccttttaaaattaaaatttaaatgaagaaattcgcaaatattcatttaaagagcatataaacttcaaatgaccataacttggccatttgaactcggaattggaccgttcaagtctctaatttttccttaagaagtcaagaacccatttttgtgctttgttccagcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattattttgatttaaatttttgcattatcgctttatttaaattcccgcgttatcactgttttatctagccatgcctatgtacctttgttatgaccttattattgttattgttattatttccttgttcaccctagaataaacaaaaccccaactagtggacactctactcaaggtaccactagtatgattttagttagatgcttcgctggttaattaggtaacattaggtggtttacaactctagactttgggaatactcttatcacctggacactatggaattgttggattattgtggaatcggatgcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcggcctggtagtcgagatgtcatggcacagggccggtgtcctgctgctaggggcttagtcctgcctacctgtcccggaggtttcggccgtaggtggggttgggtcagtactcttgtctatggctaggatgggttggaaactatgtcatgtcttccgtccgtataccatggtggtatatggcacgtggttacacgtgaggaagaggtgtcttgtgggtaaagatgtacacctctgatcagagtataatctattcgaatagccgcgccctcggttatgggcaagccgagcaatgtacccaagttagtgttgtaattcttaaaacctgcttaacaactaaaatgtggaatggttggcctgggttggcttgggacgagctgggacccagggtcgggttgctagttcggtctgaattatcgtaggccttgggttaaggcaggttcgtgtgggttcacggccttgtttaataatcttgtatagctctaggatcgtatttacaaaatagctttgagcaactaagtgtcttttaatgctgtttgctgcaaaccctaaccctctatattataacccccttgtactcccttgcatttatcctgcacttgtgggtgtgtcttgttgagtacggtggttgtactcagtcttgctcaatttttgccaaacccagaagaggagcccctggatgatgaaggctttggtgtctagctcgcgcctgccgtcaagcgcctgtggtcgtcgccctagtcttccgctgtttcccgtttgtctttgtgtgtgctgggccttcgccggccatgtaataaattaactatttacgcttccgcttgttaaactctgaactgtatcaacttttggtgtaccttgcctcctgggacaaggaataatgcacgcacgtaaggaacgcccgttgggttatttccggtcgtgacaagttggtatcagagcccccttgaccctaggacgagccgtagatcccaagccttagcaatattttcaaaataaaaatcctttcttatttgtgaaaatcctttagtctctctctgtcctgctgcttcatttatcgtcaaaatctgatctttaaaatgttgcttttctcttttgtttgtagatggccggcagcatcaaccgtcgtggtctggacctgactggcttcgttttggagctgcggggcatgtgcgttgtcctggggtatccgcatggagtggactaccagggcaagcggctcccggagcaggagggtgacgatgcagagccccacgctgcttgggagattactgcagtgatcctcactggctcacccgagaggacttcgttggtagtcaccgtgggtggagattccttctctgccgcttgccagaacgccgcactcctcgccatcggcactctccaccagtgctacccgaacgagttgcagcactcgccctaccgctaccacccttgccgcggaggagcccgcgactacgccaccttccgggatgctagctcggaggatgacgctaccatcatgcacctggcgcgcatggtggaggcgtacgacgcggcccatatcgacttccatcagatggtgcgtcgtgggttggtcgagaacaacatgaagatcctggagctgcgtcaggagaatctgcagctgaagaaggacctagacgcagtggacgcgcagctgcgtcagctcaagatcgcccagggagaggtctgtcgccccaagcgtcgccgcgtctgccgcagcctgaagatcaccgcccgcaagagtacctccaggcccgagcttgttcgtcagtccctggcgtggacctgcttcgtcgagacccctcgtgctgagcccgcgcccgtggttcctcaggaggatggagcctccggcgttggcagcacggaggatgtgctgctgctcaccttccgccctggcccgtcgcagtagtagacgagcagttagtaggcttgcgtgtgtgttcttctcgtttgtttttctgctagagtcatatggggcatggttatgccggtgtgtggtataactgtgtcggagcttgtctttattttatttgcttaagcaacttgaactttaatgaaccaatttaatagcagtaataaattcaagaattatggtagtcgtgggtggttagttttaattgtcagctctctctgtttgctggttctgtgtggggttttcagatggtgacaaccaggagaagtgctgctaccggtgaaggcagtcaccccgaaggcagcaaccacaacaaccatggcagcccacctccacctcctcccccgcctccaccaccaccaccagacaccaactccatcctcacccaaatcctcgcctagcaggccaacatgatggctgctttcctccaccacatccaaaatccgccacaacataatgctccaccaccacccccacaacactctaaactcgccgagttcctccgcatccgtccacctaccttctctagctccaataaccccgtggacgcgttggattggttgcatgccgtggggaaaaagttagacaccgtgcagtgtagcgatgaggagtaagtcatcttcgccgcccaccaactgcaggggcccgcatctctatggtgggaccatttccaggctatgcagccagaggggcagcctattacttgggcccgcttcaccgccgctttccggagaacccatgtgcccgccggagtcatggcccttaagaaaagggaattccgagagttgaagcaaggcaaccgctccgtgatggagtatttgcatgagtttaacaacctggcccggtacgccctggaggatgttcgtgaagatgaggagaagcaagagaagttcttggcaggaatggaccctgagctgtccgtgcgtctggtctccggggactatctggatttccaacgtctggtggacaagagcatccgcttggaagccaagcacaaggaactggagtcgcacaagcgtcgcttggcgaatttccgcaaccaacagggggctaaccaaaaggtccgctacaccgctacaccaatccctatccagggagatcctcctcgcagcagcaacagcagcagcaacctcgctccgcgccccgacctcaattcgtggtgcgcgtcccacagccgcagcaacagcagagtcagcaagggactcgtgcgccccgtcctcctacgccagccgtgcagcctggtcaaggccgcagggacgttcaaggtcagcagtgtctgtgcttcaactgcttcgagcctgggcactttgcggataaatgcccaaagccgaggtgccagcaaggccaagcgcctccccgctccaaccacggtggtaaggatgtcatacggggtcgtgtgaaccacgtgatggccgaggacgtgctgacaactccagacgtcatcgttggtacgttcctcattcattccatccctgctaccattttgttcgactctggagcttcccacttgtttatatttgtgccattcgtggggagaaatcagttgggggtagaaaggcttaggaaccctctgctcatcaccacccctggaggggttatgacagcaaagtattatagccctgccgttcctatagaaattcagggaattcctttttcctcggatctgattcttctagacaccaagaacttggatgtgatccttgggatgaattggttggctcaattccaaggagtagtggattgtgcaagacgcactgtcactctgtaccgagggccggaacaaccggttgttttctttgcacccccaacctctgtcggtagttcagaacttcatcagataagactgtcggaaatccccatcatcagagagttcggagacgtgtttccggaagaactacccggtatgccgcccaagcgagagattgagttccggatagatcttgctctaggaaccactcctctgtacaagcgaccctaccgtatggcagcaaatgaactggccgaagtcaagaaacagttggaagagttgaaagaaaaggggtatatacggccgagtacttccccctggggtgctcctgtgatttttgtggagaagaaagacaagacgaagaggatgtgcgttgattacagagctctcaatgaagttactatcaaaaacaagtaccctcttccccggatcgatgatctgttcgatcagcttaaaggtgccacggtattctccaagattgatcttcgttccggatatcaccagttgcgcatccgtgaagaagatatcccgaagaccgcattcacctcgcgatacggactatatgaattcacggtgatgtcgttcggtttaaccaatgctcctgccttcttcatgaacttaatgaacaaagtgttcatggaatacttggatatgtttgttgtggttttcattgacgacattctggtgtactcacaatcagaggaagaccatcagcaccatctccgtctggtgttgggaaagttgcgggaacatcaattgtatgccaaacttagcaagtgtgagttctggttgtccgaagtcaaattcttagggcacgtgatatctgctaaaggagttgctgtggaccccgaaacagtgaccgccgtcactgattggaagcaacctaagacagtcactcaaattcgcagttttttgggtttggcaggatactaccggaggttcatcgagaacttctccaaaatcgctcgacccatgacacagttgttgaagaaagaagagaaatttgtgtggagcccgcaatgcgagaaggcattccaaactctcaaggaaaggctggtttcctcgccggttttaatcttaccggatactcgcaaggacttcatgttgtactgtgacgcttcgcgccaaggattgggaatattcatatcacatggacattggaatggttggattattgtggaattggattcacacctccccctctattcaaaaccctcaaaatggttttaggctgggctcggggtgcatggttttgatagtagcacctcggccacataaggaccggtcttcgggcctctgttgcaaagcactaccgtacttccacatgtctagtgggtaaggcttagtttgtggctcagtctggttataaacaaaagtacacggatgcagatggacgaagtcgggggtcgatggacatctctagggcaaatgaa

SEQ ID NO: 11994 - DNA, 20567 bp, Oryza sativa
  unsure (1)..(20567): unsure at all n locations
gggttgggtcggtactcttgtctatggctaggatgggttggaaactatgtcatgtcttccgtctgtatgccgtggtggtatgtggcatgtggttacacgtgaggaagacatgtcttgtgggtaaagatgtacacctctgatcagagtaaaacctattcaaatagccgcgccctcggttatgggcaagcctagcaatgtacccaagttagtgttttaattcttaaaacctgcttaacaactaaaatgtggaatggttggcctgggttggcttgggacgagctaggacccagggtcgggttgccagttcggtttgaatcatcgtaggccttgggttaaggcaggtttgtgtgggttcacggccttgattaataatcttgtatagctctaggatcgtcttcataaaataggttttggcaactaagtgacttttaaatgctgtttactgcaaaacttaacccctatgttataactcccttgtactcccttgcatttattctgcacttgtgggtgtgtcttgttgagtacggtggttgtactcagtcttgctcaatttttcccaaacccagaagaggagttcccggaagatgaaggctttggtgtctagctggtgcctgccgtcaagcgcctgtggtcgtcgccctagtcttctgctgtttttcgtttgtcttcttgtgtgctgggccttcgccgcccatgtaataaattatctatatacgcttccgcttgttaaactctgaattgtatcaacttttggtgtaccttgcctcctgggacaaggaataatacacacacgtaaggaacgcccgttgggttatttccggacgtgacattctcgagttccgacatccggttctcgagtccccaccgttgtcactcgttgccggccactagttccctcattttctggaggtcctcacgaacctccgccaggtcacgcgccagcttatcggcacgctcatttgccgacgacgctgctgccgtcctcgcctccgcaatctcgcgacttatgccatgagcaccaacctcaaggatgtgccccatctcgacttggagctccccccaggtgaggacgtcagcaggcaggcctcgagcaggcacgagatcactggctgggccgttgggcgtcacctcacggctcctgggcacgaccacgacatcggtcgaggccatcgcaggagacgtgctggagttccctccggacccgtcttgcaccgccttcgcccgcgccgacctacagaagattaacatgtctggccctcaagacaagtcgccagaattcaaccaagggaaggacctcaaattttgtccacttacttctcgccaagtgtcaccagattctgccgtcgtggaggtggcggagacgcatccaaggcctaagtaaaccgagtacgacgtgagggggacatcttccgactacgtagttaacaactcaagagacttaccgatgggaggacgctttccggcggctgccgagcacggaggtgaatttcctccccttcctcgggacacggctgccactagtcgtggcagcagcagcaatggccgcgtcggacgcctcttgggcgacgccctccttcaacgaggccgccgcctggtggtccaagagcggtccaatgacgtcggtcagagggagagcctgcaccgcgtgaagtcattatgcgatctaggagcaaaaataaagggggtcgtcaaatacactcacgttaattgcggcttcatgctcagccttccccttctcgcaaagggggatggggacgttactcaccgttgtcgggccactgatcatcaattgtccgacgcaacgctccatggtctcgctgttcaaacctgtagacagaaccagaattcggtaagtcaggaggaacatgcacataaggaagtcaaattaaacacaaagaaaaatacccgaggagaaactcgggtcgcgtcctccggcccagaatagtcaaaggctgggtgggctcgagcctggagcggctggatccgcctaccaatgaagtcggcagcgacttcatacctcgacaaacctcgtactcggaggtcatcgatgggattgatgaagaactgaagagaaggggtcaaggcgggtttggcagtccaagacggaatcttgtctggttgttcctcaggaacaacaaagattggatctgaatcctctacctgaagatagaaccacctcgcctgccacttgctgcgagaagaagggcattggaaggggatatagcgcgactttaggccatcccggagtcggaaaccgacgcatccagataccctggtggattccatccaacgcagcttgtagtagaagcgaaaaaggtcgagaaatggctctaccccaatgtaggcctcacaaagatgcgaaaagatattgaggaaggtgatggaattggggttcaaatggaggaaagaaagactgtagaaactcagaaggcggggggagaaaaccacagagaatataatcctccaccgcaaccatgtgacctaggacaggttcaggttcagtacctcctggttccctctccatggtcccgcgaccggggagagcgcccttgtcgcgtcccaaaacgactctaaaatacatccccgaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattaagaagaaataaacaaagttaaaaaggttttataaaaagaaaaaccctaaaaagtccttttccccccctccccctcttgggccggctcggcccatctctctccctctctctcctctcccccgcggcaaattcggcctcctccccgcgcgcgtgccgctgacgggcgggcccgcccgccaccctcactgacgggtggggcccacccgtcatccccttcctcccgccgctcccgccgcctcgcccgtgccctagcgccgccgccaccgcgaatcccgccgcctcccgccgtccacgcgcgcaataaagtggggggaaatattccccgtgattccctccctctttccccccatttttccctccctctctccctcgcattcgtttggaaacctctcccctaacctcgccggcgccatcaatggcgaccggatcttccgcgcccgtttccccctcgtccggcagctccctccccctcccaatcctatataaaccttccccgtgccaccctccaccgtttccgccactcgccgccctctctccccgtcggaatcgagctcgcgccgtcgctctctctctccgccgtcaccgccgagctccggtccgccgctgtcgtcgccccggaccacctcccgcctcggcgtcgccaccttcggcttcaccgcatccccgacgacctcgtccacccctccgtttcgctcgccgaccgccggagcaccgtcgaccccgtccacccgagccgcgccgccgccttcctccgctccggtcgccgtttccgtcgtcgccgtcgacccggggtgagccgtggaccgccgcttcttttcccccttcccttcccctctctcggccgccgctccgccgtgcctatggccgccgccggcgaccataggggcgcgggcgcgccgcctcccgccgctgcgccggcgtggccgccttcgggcgcaccgtgcggctgccgcgtggggcccggcatcccgtatatatgtatatacatagacacagtttgattattggtcttactatttaaaaagtaaagtgcacgggcggtctctaaacttgtatgggtgtatcaactagatcactaaactaggtcactaaactctcaaaatgaactttttagccctttaacttgtctcgtgtgtcatatagatccaaacgggttccaacccgccccgtgtgctgacgtggcagccatgttggcacctacgtgtcaatagaactcatatatatgtccgccacatattaaaaaaaaaggaaatatttttcccctttcttttttcatttattttttcaaaattgaaaacattattttctcatctccttttaaattttatttttttctacatgactagcatgcatgtggatcccactgacacgaaagtatcaccgtggtataccacgtcatctcacggagcgggttggagtccatttagatctatatgacacatgacgagtttggggacccaaaaatgcatttttgagatgttagaaatctagtcatctagatgacacatctgtacaagtttaagaaccgcccgtgcacttcattctatttgaaaagttatataataattcaacattgtcaaataaaaaacggaattagtattttgaacgtatttaatttcagtaggtatatatactcttcattaattgaagttgggactttaataatcttgtaatatatttacccctcaacttgctgacaaagtatatggaatattatatgaacaacaaggatatatatcttgctgatgacagtgttaaactaggatgaactactattgaacgtgaatcaaaattcatgaactacatggaaaaagttgaaatcggccggcctatgttgtcagtaaatagaagaaatctttagatattacaactttccaacaacattgcatcaaggctcaagcagatcgaacaaggtttttttgctctttcttttgtttgaacaaggacatgttacgctttcccgtataacatcctttatttaatttcgtgaagagagcatatcttttacacttgtatcaggaatatcctttgcaattcttagtattattacaaaatatatatgttgcaattccataagtaaacagaattaaaaagtttgatcttggaaattcttcaatgtacaacctaattttatatttagcatcgggatcttatgtatagccctgggaccatgcatgatgcatgtatgcatatgaacagtgaagacaagataacttgacagatacatttttgtctgcatgctatatatatcatatcgaaaatttaatcctagacaagtatggagctatggacgcactgcacgctcatatgctataaattctttttactaatgattaagtttgtacagtttccagcaaacttgcaactttatttattcgtgaattcggtcctgtaccatgagttcgacagttccattgaaagcttctgttttattcgaataattaactttgccttgcatgcaacgatgcatacgtttatgcatatgaagaaattaattaattataattatctttactaatcccttggcagagctacgccgtacaacgacacgagctttcgtgagtatgtggcagaggggagcgcgccggcgctgccggagacgaggcgcctgtaccggcggctgctggagctcggtgtcaagccagtgttcctgacaggccgcaccgaggaccagagggccatcaccgtcgcgaacctccgccggcagggctacactggatgggagaagctgctgttgaagccggcagctcatgtcgccggcgggctccagttatcggctgtggcgtacaagtccggcgagcgtcagaagctgcaggacgccggcttcatcatcgtcggtaacatcggagaccagtggagtgacatcttgggtgcaccggagggcgctcgcaccttcaagctgcctgaccccatgtactacatcggctaggtcgccggcgtcggtgccggtggccgttgctaacaagctgcgatgaatatagtcacacgttgttgagtttgttagttcagctgtggctcctacgtgttccagaagttagcagttgcaaaggttgaaggaataagtctgctggagtttgttagcagatgcagatgatgcggcgatcaagtccttaagcagactgtgtcagtagggttcgcgtgcgtgagtttagcgcggatgtgtgagtcattgaattcgaaaagtggtatcgtgggatggcgcgatttgagccttggattctagtcatgttatttgagttgtatgttactctattcagttgaataaaaaccacagaaaatcaaccccacaatttccagtacatcgattgttctctgaaacttcactgttcttcctctgaagatctcctttctgcattctatgttctcgtctgttgccgtgtcggattgctgcagtgtgcacacaaagtgtttgatccgaggtttgtcgccaacaagtggtatcagagcactcgggctgagggctgatctgacaccatgtccatagttccggcggcagcagatccggttttattgacggtcgttagcgatcagttttgaccgtcaatattactaaaataaatgagaactagttatacttgcaatgcatatttatgtttaataataaatagtcctctagcactaggattactaacctcttgcatagaatgaccaaaaaatggacgagaatcaacatcaaaacaagcgatcgttcaatcggacgatgtcaagaatcagacttatcaacgaatgggccaaaaatgcagaaatgacatgaccaattgggccaaaattcacaagtctgcacatgggagcaaaagaggaggccaccagccaaaacctgggctggttgggccgacccatggttcggtcgaaccctcctcagcgccgctcgatccagggttggtgatggatggtgtggatggcttccctatagcgattgaagggtattaccaacctttccaaccgccataaccatcactacctgtctgtaaaaggctcactctctctccatttcaagacacacctcaaacaagaagatcatttcatctctcaaatttagtatagtccctggagtatagcggaatagaaatataatagaatcttcagtcctcggagtcttcggaagaatttgggtatgcctctagtagcttttttttttgcggggactctagtagctttttcttcttttgtaagacttatattttatttagaatattcttctttatactactttggtattgtattacttttcgagtatatgaatatctactttactatatgttcaagttatattcattatgatgctagcttatctgggagatacaatggtgtgagtataatgatcatatttacgatgactctatgtcatgacgatgatattagaatagtatttggtaatttaagcatggtgtttagattactggatatcattatttggggttatatgttgtagaagcgaggtgggccgctgatggtgacagctcagtacatgtattcctccgcgcgtgtatatagtcctaagttaatttcctggggagggtagtcctccgtatttagccctgattggatggtcatgacggattgtcgtaaggaacttggcaatcagggttggcttctcgaagcaccagtaggttatcagaaagaggttattagctaagtaataatatggctaggatgtatgtataatatgtatgtatactagaagtataggaatatgatctttctatgttctttccacttagcttagataattatgagtaagagtatgaatgcttgtgcttagtgtcactctaccctttggattatattaactcatgcttagactttgattattacaattaatatataaattattagtatggtatctctattataatcttcccacgggattaaacaaatacgatacccttggaatactctcgggtgaaatgctacaatggtatatccgtgcgcttgcggatgaactctgtaaccataatataccagaagtatttctgcgctattgctgggaattatatttctagtaacgtcgttaagaaataccaacaacatttctggcgccgttgccggggaggatttataacagagattaccatgactaatactttatatttacctctatataatcactgtcatttgcaggctaaccttggttgttttcacttttcttatggaaacagggtagtacatgactggtttcaacttgccggaaaatttcaagaaaaatccagaagttttcttttggagcgttaagccgcgagtcgttgctccacctatgcgggtggatctcaccggcgagaatgcgagtcgttgctccacctatgcgggtggatctcaccggcgagaatgactggtaaccgatactttgttttgattgttgatgactttacatggtggatgtgggtgtttgtgattaaatccaagggccaagctttggaaaccttcaccaagttcaaacccctggctgagaacgtggttgggcggcgcataaagacgctgagatcggatcacggtggcgagttcctgtccggcgagtttgcacaacagtgtgaatcggctggtatccagcggcatttgacagtgccgtactcgccgcagcagaacggggtggcgagcgccgcaacaggtcaatgatggtgatggcgcgctcactgttgaaggggaggagcgtgtcaggctggctttggggggaggcagtgcgccacacagtgtaccttcaattctcaactggccgccaaccaaggcgatgggaaatcgcactccgtatgaagcgtggatggttaagaagccgcacttggcgcatttgcgggcgcatttgcgtgtgttcgggtgtactgcacacgcgaagaacacagtaccacacctcgagaagctggacgaccgaagtgcaccgtatgtgtacttgggcgtggaagaagggagcaaggtgcatcgactatttgatcctcgtcgaggtcgcatccatgtaagtcatggtgtcatatttgaagaaaatgttgtttgaccatggtatagagctacaggcgagtaggtctctgctgaatttgatgtggaggagaccgtcgagcaaccagctggctcgacgacatctgtggtaggcttcgtaccgcggtaccaagcaccatcacccggcagatgtccatgcaaggaaccggtggtggtggaaaggggaaattcttccctggcaagctcactggaggcgtcaccatcactaccgagcacacctgctcattcctcgccccccggatcaccgtcggctactcctaccagatctttcggggaacagatcacgccgcagtctggcggcgacactgacatcaatgatggccctgtccggtacaggcatattgatggcattatgaattaattgtgaactgctttctcaataatccgcaatgcatatccttaattcccatgtcaacttaccgttggtagatggatgagatttttgttgacgacgttggcggccatggatagcactgttgctttcaatcggtagtttcttaagtatcgtcacctaatcaacttcctagttttgaaaatacgatagagatagaggtaaggtgagaagaaaatttagagttaagtttttcttcctaatctgggttgccatgtgacttctcttccttccaattgaccccatactctccaccctcagcttggcaagatggcttgtttttctggttatcgtatctccttcgtccagattccaaatcagacaaaccatatatctgttctatcgtcgtgttgacttcaatgtggtatactcaaatatgtgatttggtttcatatcttataggtagttttggtgctccttcaaaattcaattgggaataagcccaaatatcccgacatgtttacattttatgacctaaacttgcaaaacctgttagaccaacaaaactcatagaatcccattagtgtaaagaaacaacgataaggtaacatgttatctccatttattttattaaaatttttgtactcgaattggagtttttagtggccaccaataggcgtcaactgagaatgaacactcacggctgaatcgaagcacgaactcaagagttcacggccggaatggacacaaaggaaacgcacctgcacacacgcacaggatttttcagcaacaaatgtctttcatattttccctgcaattcacccggtaagtaaacaaatgactaggtccatcaatcttaagatatatcggtccaatcttttgaaggtgctcatagggtaaggtatatgtgtgcgcattatgaatacttgctttggtgctgacttcaccaattttaagatatgctgatctaatctttccgaggtgattataagaatacgatatgtggttgcgcatacatagggaggtaagtgggttggcattatgagcacatgcgtttgtatagtattttaaaaaataaaaacttaagtattattgataaattaacaccataaataaattacgtctacgctattctgcaaaacaactcataacattaaaaaaatattgtcatcatcttcgttttctctttgttcttttctaaagggcctcgagcatggataacagagcttactatatttttataagtatggtaagaacatacatatagttaaatcgattggcgataaaactcaacttcctacttaacgatgcaattatgtatgaggatgccgatagtgaattagacaatatgaaattatggttcatgctggttttaaggagtagatctacatcaatgggagatccatgtttagaggcagcatgaaagaaagccttggtgccattcataatcaagacaaagtaatatttactatatttaagtctacgtatattttacaacatagatattttttctatttatttaaataatttgtactgagatatgatttcttttagcattttttcataaataataagtgaggtgcccgtgcatccgcacaggtttccttccaagtttcttttaactaatatcattataaagtaattaacaagtaatcatggtatttaacggtgtcattagccattagccagccagttcgatgggcagtcaagcgaacttgctgctgcgcccagcccgttcactgagcagccaagcgaactcgtagagcagttaactgcaacgatggtatatttttggcacttctctctataaacacatatattctgtaaaaacgattagaaaaatgtatattttcgaatttttccggttacatgacacatgtaggcccccaatttacctcccttggttcttttcccacttgtctcttgaatacttcaaatctcaattcctaaaattcattctccttcggcaaatttgacaacaccaatcgagagcctaccatgcacgcatggatatatatatacacacacattaaaaaaaaaaacccttcatccagctaccacatctcaatataaaacccttccccaccaccctgcctcttgctgcttctgtaacttccctctccccttcaatctgaaaccataatgaacttaatttcgcttttgtcaggttttagctaggtttaggaggcatcatgaatcgattacatcctgcgtttgttgctagaactagcccaataaagagaacctagggtactggcacatatatatacagttgctgtcgagaacatttaacacacagagaccgggctagaactgctctctggcctgtccctaatcctgtaacgctcaatgcatcaaaaacatcaattttgattggatgccacctctcgatcagttctgtttcttgtttggcacttagagaaaaaccccacctgatcttaccaagccacctcccctacttatggatggaagtgtgcaatctggttacccaagtaaaaaccggccggcttagtagtttagatgtgttagtataaagcccaatgtgaaatttgtataattgccatcccactgtgcctgatgtgcctatttgtatgactgcttcttttggaaccctctaataatccattgtgtttttatggtaaaaagtggacgatatgatcttatattgtggacatgtaaaatattatgagaagttatacagtacttgagaaaatatcttgaggtacataagttttacattaaaattaataccaaaatttacattagaaaatatggtaactctcagtaccttcttaacaatggtaaaattactcaaatattattctgtgcatacacagatatgaataaataaagcaatcaggcagaagtactccctctatccctacataaatcaaaccttagcttcccaaggagcttttaaggagagaaataaaagaccacaatactcttaattaacgtgaatgttgtattgaataatggataggtgaggggtattgaagtaataaaatttctcgttttgcggattggtggcaggtaagaaggtagaagttgtttattttgggacaaatttgaaatctagaagttgatttattttaggacggaaggagtaataagaagaaagggatctacgtgtaaatcgattttgaggcaagtatttctccttgtctatttgaatgagcaccacgaattgaatccatgtttgaaaatgctctccgaattgtccgatgatggtgtagagttttctaaaaccaagttcttataaacttttacatgcttcatcctaaaaagcacagattcttttgtaagaaattaatcttgtttgcgtttcattctcgtgtgtgtgctcgcgtgagaggagctgagtcatcggttagccaacatctttttcctggtatcagttaggcatgggatgcatacaggattcatccaaaaaggacttgatggttggctgtactgtagtttgctgttcgtctggagctagcagttatgccagcaatttgtgatacatatgtttggcttataggttgagtttttgtcacaaactgaatgaccgcaaaacagctagctaacatggatattttaaatttcagttaagtaatgaattgtacatttactttcaatctttaatttggagttcctttagtatcattggaaaaaaaaagtgtgtttcattgacacatgtacgaaataattaatttaacccctcctctcccaaaaacaaaaaaagaccccagatgatgcctgcattataggctttgcttattcccaaatccaccaaatcccaatccttaaaagtcattctcacttgacaattctgacaacaatcttcgaggtgttagtatgcgagcgttcatactcatacacacacatacaaaccagcatccgattacctttgtctcaattttaggttttggaggcattgggaattgattttatccagtgtctactgatagagcaattttacaacgaactagtaagttgagctggtaaagtacagaaagtggcttgaaaatgtataaacgaaatttttgtattttttattatactattacatattgcttactagctagttcttaaactgaatcaaagaagaaaaaaagtaccattttgtctttattacaactgctgaattgaacttctctttatagcccataactttcattcaatccagaggatagttctgacttaaaagtttaagagtacgttcagaacttcagatcgtctatcctataattgatatcccgttgtttctatttgcctgtttgtatcattgcttcctctgtaacatcaattcctagagagcgcgtcttaaagtgatttctcatgtcccctgtaacatacaaagcttgcggagtatattgtggataccagcaaaccaaagcaccacagattcctcttcctatccatcaattaggcatgggagccatactggattcatctgcctctccgatgacaacgccaagttttatagtttgttcctcattgtgagtagcaactgcagcccatagtggtccattgtgatgtggacgagggttaccgatcttccgaaaggttctaataggcagtcaatttgagcggagtcgcgacacagcccgatccggcttctgaacgaacacgctcttgagccccgcaatcgtagcaccacgtctcctctggttatcacccgtatcgaaacgcggaagacctcgccgaaaaggctaatccctgtttgcgaatcgaagaacacaaacaagaacaaggaagaatacaactaaaattgtagatgaatgattaagctcacaagttggtgtcttacaaaccgatctagtggcgaaagtgttcttaacagaataatctaagaaaaacctaaaccctaaaggtgacggctggtactgatatatagagtttacggtcgtgcaaacaacccttgatgcaaccctaatgggttccaatacgatacacggcccaaatgcccaaatacggtgacgcagcaccgggacagattcttgacgtcaaattgttcggtcgattcctgttgacttggaaagaatttggacgtgggactagaaccattggaaatattatcttcttagctttccagccatataaagaacgccataatccgagcatgtatgcgatctgggtgcccgttttagtgcagagggtcctggactccgaatcgtactcgaagtcgacttggtttgggcctccatcttgacttggacgtccttgatgatcctccgcgcctctaagtccctctctaagggtgtgttcgctggttcatgttcccatccggaacaatagacacggaaaacagagcggtccattagcgcgtgattaattaaatattagctattttttttaaaaatggattaatttgatttttttaaagcaactttcgtatagaaactttttgtaaaaaacgcaccgtttaacagtttgaaaagcgtgcgcgcgaaaaacgagggagatgggttgagaaaaaggggttgcaaacacaccctaagtgtctctttgtcctctccatgattcctataattattaggtagcaatatattctcaaaatcatacaaagaagaataggaacgagcttacctctaaattcaattgtctcgcgcgagctcttgttattggtccttgaatgaccggtggaggattgttgtgtgtatccgaaggagtgatgtccttatcatcctccctctcttgaattagagtcgtcctcgactcaagtacatcttcttctctcaagtatggttttaaatctaaatgttaaaagtgggactaaccccaaactcaggaagcaattcaagtttatatgcattatcattaacctcctcaataattttgaaaggaccatcagctctaggcattaacttagacattctaaaatctgaaaattgatcctttcgcaagtgtaaccaaactaaatcacccggttcaaacttcacttcttgcttacctttactaccagcaattaattctatactttttagtcatcttttcaatgatctcatgtattttcaaaataaattcagcatgtgccttagtttcagtgtgaaccctctcactagtaggtaaagactaaactgctccatggcctgtccctaatcctgttacgttcaacgcatcaaaaacatcaattttgatttgatgccacctctcgatcagttctgtttcttgttttggtatttaaagaaaaacaccgcctgatcttaccaagcctcctccctctacttatggatggaagtgtgcaatctggttacccaagtaaaaaccagcttagtagtttagacgtgttagtataaagcccaatgtgaaatttgtataattgacatcccactgtgcctgatgtgcctatttgtatcattgcttcctttggaatcctctaataatccattatgtttttttatggtaaagagtggacgatatggtcttatattgtggacacgtaaaatattatgagaaattatacagtatttgagaaagtatctcaaggtatctaaattttatattaaattttttggtacttcattcgaggatatcaaaattaatttatatatattagaaactatggtatctcctggtatcttttgaaatatgttaaaattaccaaaatagtatactgtgcatacacatataagaataaataaaacaatcaaacagaactagtcagaagaaagggatctacgtgtaaattgattttgaggcaaaatatttatccttggctatttgaacgagcaccacgaatcgaatccatgtctgaaaatgctcttcgaattgtccgatgatggtgtagagttttctaaaaccaagttcttataaacttttacctgcttcatcctaaaaagcatagattatgtttcctggtatcagttaggcatgggatgcatacaggattcatccaaaaaggaattgatggttcgcagtgttttgtagtttgcacttccttgtcagctggagctagcagtgatgcccagcaatttgcgatacatatgtttcgctttgatattatgcgaagagctagctatcgcttataggttcgagtttttgtcacaaactgatcaaagaccgcaaaacagctaacatgtatattttagctttcagatctgttatatctgaaaaggaataactctccccccgcgtcgccgccgcgcctccgtcgccgctccccctcccccctccccctacctcgccgccgccggagctctcctttgccggctggcgagctaggatggcggcggcggggccttcttcgcggcggcgtcccttctaaggcgcggtggaggagacgttcgccggcgtcggggagtggtggcggcgaggcctctgggctaggcagtggcagatccggcgccgccgtcgccggatctggccagcctctccggttttcggccggagtactggcggcggcgccgtggggcggcgtgtgcggaggcggcaaggttggcggcggccggtgcgcgcgtggcggcgcgaggcggcgaagtccagcgcgcgcgtgggtggtccggtgcgcgcgtggtggcgcggaggacggcgcttgcgaggcggcatggcgacatctgctggctcccgatcggcgaggcgcgtcgctgggggcgtcggctacactggctcgccagccgccccccatcgccacacctacccctccggtgtcgacagtagccacaaccaccctcccctctcttggcttcttcctctttgcaagcagaagggggtgtccgccacccttgtctcccttcttctcgcttcctccctggcagctctgctgcctagttgtttagttgctttgcttcttacaccagtgctcctctctctgtgctagtggtgaagttggaggtggtttgtcgcagctgtaaggggtgtcctgcgaaggccggggtcctcgccggaaacatggatgacaccgatgccttcgatgccttctctcctccttgatgctcctccctttttttggccgtctgcttccagtctcggccgtggagtctttcggtggttgaggagaagtgttcgtctatgaaggtggttcagtctgtctgtagtcagggctcttgggcctcgcaagtgcttctagtgtcctgcgactaagtgaacctatcgtagtgccgagttggagcggtgtgcttatcttcagtgccagagttttgtgtttggcggagtcggagctgctgcatcgggcttagccgatgagctgggcaacgataacacaacacttttgctctggcccattgtagatcctcctttggagggagtctcgggtgaaagccctgtcttgtcttccagaatcggcaacatcgacgcttgtgggtgtcgtatccttcttggaggtgctgctttgtggactctctccccctttgggtgaaaactcagtccaatttttgggcaggcgtcggcagcggcttctgtcgttgttcccctccttggaggcttcgccttgaaggtcttgctcttccctcggtcacttttgtggttcggtcgtttgtcccaggcttttttctctgtcttctgtgtaaggtttcgtcagtttccctttagcaaactatgcagttgtaaggtttttgagcccggtttttcttattaacaaggtcaactctcttcttataatattccggtagatctcctaccgtcggtttcttcaaaaaaaaaatattttacctttcagtttataattaatgcattgtacatttcctctcaatactttggagttcctttagtaaaactggataaaaagtttgtttcattgacacatgtatacgaaataattaatttaacccctcctcccaaaaacaaacaaaaaaaaaccagatgattccttcactacatatataggctttgtttattccaaatccacaaaatcccaatccctaaaagtcactctcacagtcacacttgacaaattagacaacatccttcgaggtgttagtacgcacgcgtaacacacatacaaaccctcatctaactagcgaccgtctcaaaaaaaaagaagggaaataccatgtgtcaattttaggtttaggaggcattgggaattgatttcatccggtttctggtgatagaactagcgctgtggagattatgggtaccccatacccacacgacatggttatccgactggttataggggataacttatatctatgaaatatataacggatcatgacttgggtattacgtttccctgtatattatggaacggcctaaagtcctggtttgataagattgtaaagtagatttaggaaaccgataccgtattggttaagatttctatcttgtaatcctgccccccatcctatataaggtgggcaggaggccctctagggggcatgagacaactagatcgtcagatctataatacacatggtggattcaaatccccaaacaggagtagggtattacctctcatcgagggggcctgaacctatctaaatccttgtctccgcatccatccacttttaggtctcgtgcgctacccttttattattgctgaattcatgtttcgacagttggcgcgccaggtaggggtgcgtcaagttttccgtcaagaagtgtgatggaatcaagatcaggagtggccggattttccttcaccccgaaggctggctttcggttttgacggattcgtcttctttgatggtgactccaacaatctctccctcttcgacttgggttttaaccagtcgagagaacggcgatcaaagatttacgtcatcaagttggaggcttcaatcgtcggggtcaccgatatctcctgtgcatctccacaaagatctctgcttcaggagctacactttgtggttacaagaataaccaggttcgtcgttccaatctactaatcgttattagattggtctctgatataactactaattaaattaatctatgccttgcatgtactgttgctggttctgacctccgagtctttcgatcattgtcacgggagatcaagacatcagctcactgagcacacatctctatatgggtagatcgtattgatcttataccaggcgtacaatagaagtccagactcggatttagctgattggatcattctcggactcggctgactactggatgatcaggtcaaaacaaaaatacactcggcatgcaaggaaagcactgggaatgtggtcggcacgagccccaacacttaccagtaccccagctctgggaaaagcaacgaacgctatgcatttgatcaattccagagctattggttttgcatctacatcccagaagaattgccaggcatacacatcgttaattggttgtcatgagctatcctcaataagggacaccaattaatatttccatccagctcatacgcatgtgagcatatatggctaccttgccaactaatcagatcaggagtcctagcaccatactcctacgtgaggatatatgatatattggctgacatcatcaggagatattatctcggactccatcaaaacatgctccggttttcccttcaagcactcctctgacatcatgagcttgagttataaaccactaccggatcagtacaacatggcgttgagtctggaagggcctatgtcttcgttattaccgctggcttgcctccgtcgtcgccgactagtgttctcgcctatacggttggttgatcacaccaccgttgatgggcatcttcgtcttcaccgactggtcaccttcgtcgccgccgattgatgtctttgccttcatgactggcttatttcatcgccattgacggatgacttcgttcctatatcggtcatctctccgtcaccaaggagaatattacaaagctaagtcatcattaattttcttctttatatgatatttttcttttcctctaactcactacatcaattggttcgccattgactagtgagtcgggggctagagatgctatgtcatattttttcaacaattttcataatatttatcttgattgcttgcgacataatctgagtacaaaagtgactatcgagttatggagttctatcttcctatgctttccgtttggtttgtcgatggatagttgcctttgggccgattcctagcacccgggggctcgttggatggaccgagtaacgcaagatgctaagtattatattcggaataaatcaaaagcatagagataagataaatttatttattttcttctcttaacaattgcaaaaatacccgagtagtaaattttgattcgtgaaactttgttccattaatgacgaactcatgtcactcatatgcatgtttgggaagtgcctaggccgactcccggtgcttggtggctatgactagtcaggcagagtgtttaaacgtaatgagtcatctgctcggggaaatcaaaattgacgagaggagaaatacatatttataaacacttttaatacttgaatctttctcaagtactgtatttacatcagatactactcatcctatatatttgttctgcaggatccagatccagatatgcatcaaagggattcatggctttnnnnnnnnnnnnnnnnnnnnnnnnnnnnnnnnnnnnnnnnnnnnnn

SEQ ID NO: 11995 - DNA, 1035 bp, Oryza sativa
ttctcataagttcatcgatagtctgatgtattaagttctattattgtagtgcaaactcagcatacgcatgctcatttctgaagtgctacagtttccttaacccatccccaagaaaggtcgtttcttaatagtccttagtgatcaccagagtcaagacattatacatcagattaaggtagattatttttcattagcaattaataatagtaatagaaaatcacatgtgggacaactaatacaagtcaactgaattgagatcctataacttatttccctctgatgtcagtcattgacatgtgaaccctccaccaagtgggctggtatatcagagactcaaagttatagggatataagttagaggatttgcttcccaagtcaacggcacctttggaggcctcagttcatatgttatggcccttgtaacttagacttcgtttgaaaaggcttcttaccttagattttgagtggcacgtaaaacgagataagccattaccacttaattaattaagtaatacgaatcaaaaaataatattgtttgaattttttaacacatagtttaacaattagggaaacatgatcacaaaaaatgagggagaaacaaatctaagaagcagtttagaactcaacgttactctctgtttttatttaattgtgttgacagtgaaatttggtaatcggcaaagacgtcatcggcttagaatcattatcggctgcagcatctcggaatcagccgatgggagttatcaagtcgccaatagtccgattcctgctatattcggctaaggaaatcaatctactaaaggaagcttatccctaagtgaccgagtttaaagaggatgcgacatggcagtttatctattaattacgaatagtttgttagtttccttttatctttaggaaagtgtgtttagtgtccgataaggactttatattttccttttatctttaggttagtttctttcttatctaaaaaggactagtatctacccatgggtataaatatgtacacctggggtctatgtaatctatcgctac

SEQ ID NO: 11996 - DNA, 165 bp, Oryza sativa
cccctatcagacctcaatcatttgattttcctttccagttggttttctacctcagccttatagatctcaaagtaatgtaatacttcatcctttgttcaataggtacacatagcagaatctagtgcaatcatctatcagtgtcatgaaatatttctttcccccttt

SEQ ID NO: 11997 - DNA, 686 bp, Oryza sativa
tggagcgcaggaccaggaactgggtaatccgtttttgcaaggttcaatggagcaaccacgccgaggaagaagctacttgggaacgtgaggacgagttgaagacagcccatcccgatctcttcgccagttcttccgaatctcggggtcgagattgtcacgtcccaaaacgactctaaaatacatcctctaaattatgcttagaataattaaaatccgtgtgaaagcctccaacaattaaaaggtgcaaagttaaaagtcaaataaggcttgggggatttttgtatatttcctaaaagcctaaaatgcgtaaataaattttagtggaattttcagagcacaaataataattattaagaaataaacaaagttaaaatgattttataaagagaaaaactctaaaaagtcccctttccctccctctccctcttgggccggctcggctcatctccctccccctccctctcctctccctgcggcccatccggcctctccccgcgcgcgcgccgcttacgggcgggcccgcccgccaccatcgctgacgggtggggcccacccgtcatccccttcctcccgccgctcccgctgcctcgcccgcgccctagcgccgtcgccgccgtgaatcccgccgcctcccgccgtctccgcgtgcaataaagagggggaaatcactccccgtgatcccctct

SEQ ID NO: 11998 - DNA, 1040 bp, Oryza sativa
agtggcagagctagaattttttgaaggggtgggcaaattgtaaatgaaaagataaaactgctacccgcttatataatgtttatgtgctcattttactaccaatcgaaggcagaacaattttctaataaaagcatagtttagtttaatatgcatataatttttcactagttgaaaaactacgttgattttaatataaattaaaacggacgtatgccatattatacttgaatggatcattgtcatccattgtgaagcagtcaagtctggctaggcctaattgcatcgtgcaacagtactgcttgcatggctagctgccagtaccgatgcttctaattatgtctacgaagtaaaaaaatcgttggattttaatgcaaagcaatcactcgatcaccattggtggcacacgcagagcccgagcagctgcccgcgctggccgggcagtgaatatgtcgctcctcacaagttctatcaatagtctcatatattaagttctagtactctaatgcaaaatcagcatgctcatttctgaagtgctacagattccttatccgattctcaagtggggatatttcttattagttttaagttgtccttagtgacctactggagccgattgcccgttctaagcgctgacagaaggcaggttaatttttttaattaaaaatctataatttaataggaaaaaagctattggtctattggacgggatcccatcttcactatcggtgttgcgcacggtatgcgctcgcgcgactcgacgcgtgctgaaccgctgcaaactgttgattaccgcatgcattcactattcatgcgccatgtggtggaggggcttgtccagcaggtcattgactcggcggtggaggagcagctctaggaggttgtcggcctctgttttccgaaggagctcgtagcaggtctagcgctcgattttcgccaacaactggttgatacagaggagcgcggcagcgagttcctgcaaacaagctagcggcactgaagcacaaggcgtcatatagccagtgttgccagagctttgtcct

SEQ ID NO: 11999 - DNA, 800 bp, Oryza sativa
tttacggttgatatttcgctcttataactgtctcaaacatagtgtataaaacgcatgcccacgcattcgcgcgggctaccttcctagttttaataatagacctcccaggaacttatttctaaaatgaaccctttcgccacaccatggtaaccggcgtggccaatctgagctaccgcgccattggtcatggtgtcgcaaattaaagggtgccccgtggcagtcgttgccattgacaaggttaattagtccctgacgtggcacaactacctgttccggccggctccttagcgtggtagctggtgtttgccacgcctggctttttggtgtggcatgcagtgcaactagctcaactatttcatatttgtgaagaaatatcatatgataagaaatttttatgtgttaggaatttttttattaatttcatgaccactgtgataggtttcatggtttatgatgaacatgcgaagtttgtatttagaaagttgatactaaacaggtaaagatgggataaagtatcagcggtatttgtgaggtgttattagaaaacttcgtacggttttgacggacttgaattatgtgttaagcatatgaatggttcaagcattggtgattccttattctctgttttcactgcaatttggaaggatggaaatgactaaatatgtcgtaagcaatcacctgaatgctagttggagccagatcgtgataggatggaggaataagaatgcaagtagaagcaggggcggacacaggataaaaaaatgactggggacatgcatctatataacttatagaatagt

SEQ ID NO: 12000 - DNA, 800 bp, Oryza sativa
ttaactctcaaaactctcaaaaccattgtcattaatttcatcctttgactcaaacaaacaaatatcggttttgatgatgtggcatcacatcaagtctatatagacacacaaagaaattatcgtaccaatcaacaataaataacaacagcatatctttactaattaaaatattcacaattttccttttgtcacacaaaaattttgcccgtaaatccgaccgagcggcgccctccatccacacacgagcgacacgcaagccggctaaagcaaaaaggaaaaaaaagacagatcagagatcgaatcaaactcttgatagtgtatggtggggaaatcacaaatcaaagatagattgaaaagccagtcgcggcaaatatcatccagaattctagagtctgaatcaaatctatccctacttaaaactttggatttttcccatcatcacaatgtgttttcatccgtcgttgagcaccttctctgcctcgcgcggttagcgccttctcaagattccaaatttcccaactcaaacacaaaaacaaaactaaaaggaatcagactctaatccacccaaataaaattagaagagggatccacgtttgaattctaatccatcgcaacatgaaacaataaaaaaatattccaccttgacttcccttaggcctgacggctgcatgcatcgatgcaatcgctttttccccccccctttctcccccggggggccccctaaggacagatcgtcgaatcgctcgcaccgaactgacatgaatccgtgatgatctcgtcggtggaaaggatgcaaaaat

SEQ ID NO: 12001 - DNA, 504 bp, Oryza sativa
tgtttggtagtcttgcatgtatagtcgtgttcttatttaggcatgctaatatttcaaaacaaattttacagggtctctattgttcattgaggcagcttcttgaagaaggctttttccatgcagacccccatccaggtaatctggttgcaactgaaggtggatcactcgcgtattttgattttggtatgatgggggatattccaaggcactatcgtgtagggcttatacaaatggtaatcattgctcccttttctcatgtgtaaccatatggttctgttggtttttcttcctgatttggtttttgtcggttgctaagaactgtttttgaccggttgcagtgcagtctggtgcatttctgcacagttttgcatcttcaaattttgaattgaaaattcgaaatgactggtaacaaacttcgaacgatttggttaccatcatattgtagagtggaaataggttatatcatggtacaaaataaatattaagaaatgattttcataatgc

SEQ ID NO: 12002 - DNA, 2700 bp, Oryza sativa
  unsure (1)..(2700): unsure at all n locations
acttgatctgtgaatattttacattttatgttgacttcatttgtgttgatttcttgaattcacttgttccagcttgtgcactatgttaaccgtgactccttgggcttggcaaatgacttccattcacttgggtttgtccctgagggaacagacctacatggggttgctgatgcattacgtgtttcctttggtgatggaaggaggcaatcaaatgattttcaggtttgttaatattttttttgggtatatgtagtggactagcctttactggatttccatctgattcacctctgaaaatgcaatgcattttttcttaaatcatactactacttgggtctttatcacttgtctcgtactaaattctcattatgggtcatttcttttttcaattgtatatgcttgcagcttcatctgccacctttactttagtttaatgtgggtgagttggtgtccttgttaatcaatttttttttgccttatatagggggtgatgagccatctgtatgatgtcatgtatgagtttaatttctctcttcctccggattacgcactggtgataagagcactgggttctttagaagggactgcaaaagcattggatcctgacttcaaagttattgaaagtgcatacccatttgtcattgggaggctacttgaagaccccagccctgatatgaggaaaatattgaggcagctcttgatatgcgatgatggatccatcagatggaatcgactggagcggctggtaaggcgatccttaattatttctgttttgcttgctgtttcattttgtcttgtagaaagaattttgcaatacattcttcataaaaatatataaagattacatatctgtcatgtttatgatgaacaacaattaattttctttcctttagttagttccattaggatgattaagaacttgtgtcacccctatagtcctgtacacttggaatactatcactaggggtgctaaaggtccgaaatccagatcaaatccaccctgctccattcatctgtatgcatacttcccgatccactccaaatcgattcctcattcacagaatccaaagttccaaaccaaccctccccaaagtataaaagcaatccaaaccgatccaatccaaaggtaaaaaaatgggtggaacccattcggagaccattcccaaaccaaaagaaatccaaaaggggggcatcgctgcggacgctgatgaggcaacgagaagatcgttgtccccctccatgctccggcgcggccggcttctagaacacaccactggcggacggaaattcggtatcatctatgctggcagcaactttaacttgtggagtcttgagtcaatggtgatggacagattaaaatttagtctttgcagatcgattagtgaaatgaaaaccaatgcaggagtgagatgtatgcatgtgtgcccaggagatgatcacctggctgcaaccatggaggaagtgagtgcggcggcggactgctgctgcttgtacttgttgctgacgaagatctctgacggatgcaccaccgccttgctccctaagctcgtagcctcaaggtcctcgaactacctcatggtcgcaaggtgctcaaagttgatgcacatggtgtccaagcccagatcggcagcggcgggcatgtctcgggcatcaatgtgctcatgaggaagatcagtgtgtccatctggccagcatagaggatttggggacgatccagtgaaaatccatgggttgaacccattttggacccaaaagtatacagccaaaatccagatcgatccaatccactttcagcgaagtccaaaccgccccagccctacagcttcgtcagatcatttctacccaaccaaatacaatccaaaatgaaaaccaaaccattataccgattcccacccaacccattagtaggcctaacgataacatgcaaggtccaaagttatggacacactgaaatgcttatgatttacaacaattaatttatttccttgatttcattggagtgattaagaatctgtcatacccctcttgttacttgtgcacttggaataactatcaaacacttatatatgcatgaacgtattacataagcataattttctagtgctgaccatcattcatgtgggaccagtattgtaactgcgaacatggcactaagagatagaacttatcatgataattttgtttttgcatcaatatcatgcaattatttggcaaatatccgtcatgtcttgctgtaatggtcactaaaaatccttgaaatgttcagattgcagctatatccgaacagtcagaatcttcaaataagtctgaagatagatctggtgaaaatgctgccaacaaacctgggtggagatcattcgacatgcattctgtggttgcagctacagaagacctttttcatttcattttatcaaggaaaggctggagggttcgtgtttttcttgttcaggacattgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12003 - DNA, 1970 bp, Oryza sativa
aaatataataattgaaagaggcatttattccattgtaggagatatggaacataaaaggataataaagatgattgggtccacctgtttgcaagaaattccttttagggcctttatttcggttggtcgaaatatagttcgccccacctcaccgtgaccacagcataatgatgaattatctccacaagtgaagacctatttgaacaaaattcacagcgttcaaagtattagaaatattacaattgacaatatacagtgtttaagatgagcatcaattacctcccctaactctgtgacaaaagctgcatggttgtgagaggcagagatgttgacaacacgagaaagtgatgggaagggaaccctgctgaatgccgcacactgggttgtatctgggccatgacctagcaccccacacaaactggatccacaagaatagacagaagagtcatggaccaaaagtgtgtgatatcttcctgtcgctacttgcatctggaaacatacagcatgttcacatatataagaaaccaggttggaaatgtcttctaacattaaaaagaaaatctaactttccagtttcatactaaagatagaattgttcatgagggaaactattcccaagtgcaacaatgcaacttttgttgatcatttggtcttcatattggcaagcatagcagaatggcaataagtaacatgtccaacatagagcatactctcaaactggtagagcagatgagctaggatgttaataaaagaaaaaaaatctagaataaaagtaaattaggcaccctccagaacaatctgatgcagtaggcacgccaaataattatgcgccatatatttttaaaatgtctgacttgaaattcaatcagtgtaagaaaaacaactaagatatgatggattcaaagcaactgaggcatcagcaacatattcccattcagccaagtgtgtcgtatctaaaagaaaatgaaaaaacacaaggtaccatatgtttattataaatcatttccaatgtccacatatcctcctcattcagaagcatgccaacttacaaatcaataaatcatagaattgttagtaattttgttcatcaggaatgagctggtcaacctctcttaattctataacaagcaaaaaaaaaaagaaaaagctcacaatagactacaaacgcatgccttaacttggtgttaagatgtttcattgtccctagtgtaatccaaatgtggatatccgattcctatcacgaagtttccgaattcacaaagtcatgcatgcatgatcaaacatggatccctaaaacgggcaaaggtgtgaggcaagcacaatcatctctaccaggctatcctacaccacacaaagtcaaactaaggttgcatttactagtatctcagaattcagatgcgaagcaaagaaatcctcacgttgccggaggaggtgtggacggtgccggaggactgctcgacggactgcaggaacctgagcaccttcttccagctgccgccgcaccgctccaggagctccccgcgcgcggcggggcccatggccgcgaacgccgcccgcgcggcgcagagcctggaggcggcgtgctcggcgagcgggcggagcgcgcggcacgtggcctcgagccgcgcgaggtccccggcggcgaggcggccggaggtcaggacctccccgatgaggtggccggggagctcctccatcgagaaagcccgcggcgccttctcccccgtcgccatggatccacccctcccgccgcgatccccgcctccgcccgacgaaatcttggcggccttgcccctggatcgatcggaatcatccaaggacgacgccgaccccgacgccgccgtacggatcgaaatggcgacgaactccgcggcgagctccccccctcccctccggcggatcaaatcgaatcgaatccaatcgaatggaatcaatcgctcaccaaatcccgccaagaaacactaatccagcag

SEQ ID NO: 12004 - DNA, 8494 bp, Oryza sativa
gttcgagatcccggggggaggagagaggaagaggacgtggcgggcactatcgcctacaggggtgacgtgtcaagccgggattgggcgcgagttggcgatggggacccggcacggtggcacggccaggcgatcggtttcctcggcaactcggcgccacggctggacaaggcgcaggcagcgacaggcgaggggcaatgcaaatggcatggtggggttgcaaattgcaattttgcattattagcggagcaaaagcaccaacggctcgttgattttgttcgctcccatctaatcacattattttttcgtccccagcccgggtggtgttcggtcacaggagtttttgtccaatcccttgtcaacatagtgtggttacagctcgagacttttattgtgctgtgattctttcttttcttattacattatttccgttacacggcggacacaccattatacgtgaaacatgatacacaccactgcgcatgcaacaccacgctcacacttccacgagtgcgtctcttcacacacgctcagagagataaaaactggctgtatatttatgatcacactaaatcctattgatatttacttacgtacgcgtaatatttatgggtagcaagatttgaaccctaatgggtaaagtcatgcactcactaatgactctatcaccaccccgtgctttccttactgtgtagtgattctcgtggcatcatgtctcgatgtttttatgtttatacttggagcacatcctttagtgacataaccttttattgcacactccaccgaaaaccaactatcacatgttcattcttttcaaacactagcgaagtgacaattctttcgtgataggtgatacccctcgagaatcataccatggtccattcttgatgctaccaccaataaattatgagagaatttcttttatgtccaagtcttcgctgctcataatatttctatcaccattatacttacaagagtgaggaagagatgcgggcgacggcggcacgagaggaagacaaaggcggaggcgaaggcggcgatgcgaggcagaggtgacggcgtgagaagaaagcggatacgacagcggcggcgagagaggtaaagggcgagatgacatggaagaggggatgcgggcggcggtggcgcgaggggaagacgaaggcggacgcggaggcggagacggcggcgcgaaacgatactgacggcaccagacagaggtggcggcacgagaggaaagcaaaggcggcggcggcaagagagggagagagcaagagacaacggctagggttttggatctgtgagagccactttgcgaaaaaaaaaccttcagttttgacaattttaagcacagcccttattcacttttttctcttcttcgtgacgaatatctggtttatgtaagggcttaaacgtaaaatatcagttcaaagactgtttgggagggacttagatcgaattaaactcaaactaaagggttttttcgtaaaacttcaagcgcgtactgttcctatcctacgtggatactggatagcgcgtctgcgcgcctaaccggacagccttgaagagtaaattttcatatatttttttttacccacgagtctcaaaatgccctctcgcttgtgaataagtgttgccataaaaatcatgatcctcaaagtgaaaacgagttcaacttaaaattatttgacccttaatttaaggaaaaaccagttcgaaaagcattaaaagttccctttttgattttatagtaccagaagttttcaactcaggggcaacccacattgaaggtatatacaatggtacaacctagtataggctcctaatttaacaccattagttatagattggcttttgagacaacatagcctgcacaaaaaaaaattacttttctttcctcttctctacctccatggaacagaatttccttcattcaatgttaagagtcgatcttgagttgagttggtgtcatgcgtatgaaagggtcaattaggcctagaggggggtaaataggttattttccaacttaagaaatgcggaagccagtaattttcagaactaggctgggaattttgggaacttccgaaaggattttcggaacttccgaaaatgcacagagcaatgcacacaaaagaaaaatctagatctagaagtctattacagggaatacaaggcacaatcagcaactagaccaatagtggcacaagcaagcaaagctagaggagagggataaagaaatatcaccaagatgtagctcccaaagttgttcccggagttcaaatccttgaggggattctactctccgttgaggagctcactaagagccgggtctttgctaaccctttcctcaagaggttgtactaagtactcctccttccactaagaggtatatcttcccttgcggaggcgagatccggccttcacaaacttctcccggccaaccacaggtagatcggtggctcgggagtgacacctagccgtctaggagtcctcaacctccaagagtaaaagatgatgtaaagaactcccggagatgatgcaagtgctcacaaatcttcacaaagaccacaagtagcatccacacaaactcgaatccacactctcacacacacacaccaaatctgaatcaaacacgagtggagagatgaatcgaggaagcaaggctcaaatgaactagagaaagagagcaagcaaagggcacaaataattggaatagaaccagcagccctcacaagtgaggggaggtgggtatttatacccacagcacaaatctgcccattggagtgcaataaaagtaattttcggaacttccgaaacaattttcggaacttccgaaaattccagatctgagaaaaaaatcgaagtcaacgcaatttttggaacttccgaaaaacattttcggaacttccgaaaatttccagaacgcttctgtgtattttcggaacttccaaaaatttccagagagctctcaaacggttctgtgtattttcggaacttccgaaaatttccagaacgctcaaaaacggttatgtgtattttcggaacttccgaaaattcttttcggaacttccaaaaattttcagaacgctccaaaagagaaatgcttcgaagaaaaattgattttgagcacacgcgtcactccttatatgtctatgcatcatcctccttaatagtacagctttcctacgacacaatgcgaggaaaaagatacaatatactatttgatcattgccgcattgcatcgcgatgtcgcattcacgggatatgcattgtattacaacacgttgaggacttaacaaacttcacatttgcttgaataaaaatgttagtcctctctaattgtattgtaatcaatcatcaaaatcattaggggcctagatgcactttcagcgtagcaacaatgtttctctttctcctatctctctctttcatgttaccaaatttacttagatggcaacaaagagagcccgctaataaagatcgttgtatatgatgaaagtgaatgacttacaacaataggatgctcctgtcatcaagttcatcaagcgccgcccttgagcctatctggcggttgcctatgcaccgtcacaataccataacttcgcctatgaaacttgacgaaaaatgttgttccaatacatatcttgctggctagctaaccaatcttgattttatgtataaaaatgtgcacatgcaaattcaaaatgacaattaagtgttttaagaaaaacgaggtgattttaacgtatgattaattgaattttaattattacaaacttgaaaaatagattaatatgatattttagagtaacttttatattaaaagttttcgcacgaaacacaccgtttagcagtttaaaaagcgtgccacgagtatccaaattttcatcccattttttagtggaaacgaacgggaccgaaagctcatctgcttcaatacctgttggcacccctaagcttacacaggcgcaccatcatacacgagctcatcgattgcacctgatcgaactcacttggacacgtcgtcctgtagctcatctactagcaccctcaatctcatctatttgtgctgcccatgagctcaccctcctgccctttctacaactcttcaatggagctcatttgctgtggtacgttaaggaggaagacatggtcacgctgtgggaagtaatggtagtttgaatagaatgctaaaatgagtattagagggaactttcgatactactaaagctaaaatggactttttttccctataaaactaaagtgggaatgtttggcgttgtagaaccaattatccccaagttaaaaactgaaatttaactattcaaatgaactatgatcaaattttacgaaaatttagaagacacttgaccccttagtggaattttcttgaaatttggttgaagttgataaaaattacatatttttgtttctagtagaggaaaaagggagataaaggtgttttgtctaattcccctatgaaaatttatcaaatttgattgtacaatgaaatttctcataatttatatatatccaaccatattatgatgaatgaatattgcatgattatacccatatagcataatcaataagtttattattgaagtgtggttaaagtttaaatataaatggtggcgtcagatgacaagtttcgtaaaaggaggtagtaattagttgaaaagttcagtttagaaaaataaatactagttttgttgttaaaataagtggttgtcctaggtttgccggattgcttgattgcaacaagcagcaactgtgctattctccagatcccagtgacatggcatttcatttcgccaatgctctatgcttcacatatggctctcaagtaccaccatcatgtcagcatgtcacgaagtcccattgccagtggccgcaccaatggttagcagttgctctgcctctacacaccaaatgcaccatcattagtcgtctcctctcacgactacctcatccgctagtatgcccatgattatgtgctcacgaatcagttagtcgcaaattaaagctagctcacatacttgttgcatcctcacccgtgattgaggatgcctggcacaacacaaaaggagaagatgcaacaaccaattaaggtgatgttggcctgcaatgctgacgggaaactatttttcgttttaatagtctattatagtgttggttcaaatagatctactaatgcccagtacaaagaaaaatatgtaacataggatatagattaagatatgcccatatctccaaacaaatatttaacacactttgttcaacttcacaggcatccaaaataattaaactaataaatattataagtaacaaactatattatatttgggtaaaatggccctaaggtttatagtattaggttgtaacttcatcaaatatctcaacaccttaaaatccaaataaccaatactccctccatcccattttaagtgcgacaagtttccgcgcccaactttgataattcgtcttatttaaaattttttataattagtatttttattattatgagatgataaagtatgaatagtactttatacataacttatgcttttaatttttttttaaatttttttcaaataagatagatggtcaaagttgtgtaaaaaaatcatggctgcacttaaatggaacggatggagtaccttttaaccatttttaattcaatggatagtaatgctgatgtattcacattagtttcactagaaaattattattttttcaacgtaccaggtacattcaacacatgtttttgatctcacatacaaaggctaacatccaacggagcaattttacaagaaacaatctgcttccgcccaatacttttataaaaaaacccctagcaaagctttccttttcttctcctgtaaccaccttaaatatggatccctcccacgacgatagcgataaggaagttacttaattacagcgacaacaccaccccatttaatgtgtttctttttggagtctaacagatgacgaggttggaaacctaaccgcgatggcaaaagcaggataaatgcgcgctgttcaatactacatttgtctcaaaataagtgcagccgtaaaaatccgtgtccaatattttactgtccgtcttatttaaaaaatttatgaaaaaatttaaaaaaaatagtcatacataaagtactttttatgttttatcatctaataacaataaaaatagtaatcataatttttttttaaataagacgaacgatcaaacgttggggataaataatacaaaactgtatttattttgggacgaaggtagtagcgttttacaggagtctgatttggtcgatcgcatggcaattggcaaccgatcgctcatcgcctattgctaaccaaaaaaaaataaaaaaataaaaaggaatttctaccacagcagtttttgtgctgggcttgggccaaccgagccgagcaactgagcagctagccatggcccatgggccggccatggcgggccgcggcgcgagcggcatgctcgccacctcgcctcgctcccccacgtgtcaccgcttcctcccaccttttccattttttttctctctctctctctctctctcttctccctccccaagcaaagcatcggcatctctcctccctaaaaccccacctcccgtctccccggggcggcggagccgatgagatcccggccatggcgggccccacctcgcgccgcctcctcctcctcgtcgcccgccgcgctggtcacctctgccgccaccaccaccaccaccaccaccgcgacggactcgtcctggcccgctcgctccaggccgctgccgctgccgccgcctcgtcgccaccaccgcttcccgcctcgcccccggccaggaggtaatcgaatcccacaggcgcttgatctctgagccgccaccatcgcgtcgttctccctaggtcgcaaacccgttatctaccgagagcaggtccattttaggttcttatactacatcgaagtaattgtattcttaacaatttgcactaacggggaggagagaagtgggagatacactagcaaaaatgcacaatgacagcactgatttgcggagccattttgtaacgattattgggataatagcagagaactatttttgcttctcacaagttacaactatcaagttttctctgcctgtgcaatcatgtactagccatgcacgcatctgtttcttggttgtgtgatagtttggagtcatcgttgtcaatccattttaatcttacataccatgtactgtattagataacactgcataaatcataataggcgaagcaaacattttgcaccgtaatggtgctgaatttagctattttaaatgtagcaaacttttaaccatatcagctttctggctgattccttctactttctaagctctcttatgtttgcattgtcatacttgtgttttgcctccatgagtacaacttgatacagttcaactcgctaattcaaccagtcgtaagttatgtaaccatccaatcacgtataagtgcaatatgcactgttttacaaagatcttcaacaaatggctacaccgttgtgctcaatatcactatgaatcaatatgtgttctccctggctctatcttaagtctgaactgaaatttcttcatttgggtaaagtatgtttgcctactcatctcaaccttaattaccacccattgtatgaggtagctgtgaggcaaacgttttgtaccttagtggtgctggatttgtctattttaattatccttatgctagaacgatttgtggcttattccttccaacttttaacttatctagcatacttttgttttgcctccattgacataccttgatacagttctattcgcatgttggaccattgtaagttatttaatcatctggtcacttataagtgcatcaacatataaggtattgctcagatctccaataattcttttcataccaatatatccaataatgactatacactgccacgctcaatcatcactctgaagcaaagttttactccctcagcttgtctaagctcagctgaatgttctccatttgataatccaaatgctcatgccatttcaaagttctttttttttcaggaacatcaagttgaataagtgagtagatatattgttcttaggaggtttattttctgttttgtagcttttctagtgcattctcaagtgttcatggggagagaccgtcctcagaatatgcaaagatcagaaaggagtcgttagaaagccagtttggaaggatcttgggttcaagctcacgtacactatttgcagatcgtggctttggtccattccttgcaatgtacagggcagcaattatctcttttcatgttatgaagctcactatttggcatttattgctcagtgatgtgcacaaacgggctgagaaggtatttcttttctgcctttcttcctactctaagggtgtgttcgaatgccctatttcagctgtgatacagccattttgcacagtaatttgtgtcactacaaacagc

SEQ ID NO: 12005 - DNA, 776 bp, Oryza sativa
ggtggtaccactgctccgtccattaggtaccaggcatccgagtccgagtaccctaaaaagggcataatggtcttatcgtgtcaaaaagcttaacgcgtgagcaggtcttgcaccgacctcttcagcctttcttcttccttcccagtgcggccgcactcactagaagagctgtcgccgacagcaaggacaattggacaaggtaaagcaatgtgggagcaagaagaccagatctactcccctcaaaactagaggcactagatcaggtcgctccaacctcggggggaccagctttgccccccagtgatggaaggagctcgacctgccaatgaaatccttgccgaccactgccttccctgcactaggccaagctctttcttctcatcgtggttgtatggtcaccgcatcaccaagccactcttcctatggccagaggctggtggtgttgctcgtctggagacttgagtttgagggccttggcctcttctaccctgacggcgatagcctcagcctcagccacagcgagtaacgagcatagctagaggggcggtccagcaacggcaaatccccttcttcaccggtgacaagaagaccctcggcggctgtgcatatccatggcttcaccagcagcagctccaaagtccagcgttgtccctgtcctcaagatcagaggtcactaaacttcttgcaaagttctccagtttataaaacttcactgaatttctatgcatatgcagttatcttgtttatgtttagcgaagtttagagaatttaatggc

SEQ ID NO: 12006 - DNA, 4812 bp, Oryza sativa
gtagttatcccactattcaatattcactattttggtgggaggttgaagggggcgaatttttgccattttttccaagaagaacatgaaaatcataaaagtaagtaaaatggtactgatcatttcttattaatttagtagtacttatcttataagatgttaactaatattttgtgtatttttcaacgatggatcgaagttggatgtatacgacttctttgaagcgtcagtataaagagtatagagatggcgtattaagttttatgaataacgcggaggaggataggagaagaagaaacaacaagttttatatatgctgatcttgggtttttggttgggtacattgaggtttttcttttctgatagaccataaagaaatgtcattacgaactgcagcatttccgaaaatgagcacgttgatcttgccactacagcactagaacctaatcaggaacagatcaaatttaagctgatgtggatgtctaaatttgctttgagagaggtgtacatatgttgaaaataaacgaactacagctaaaaaatatttttgatcaggttcctagcacccctctctcaacaagtagatccgcccttgaacctaatatataaaagactactgataaacatgttggatgaggtaaaagctagaaatgttctttgatcccatcaacaactggtattgcatctgaacttccacctgcctcgccatgcatgattgcaaaaagaccattgccaaattgtggcggaacaagtccccaaaaagtataagaatgtagcggttcacctctccgagcctcccagggctaaaattcctctggatcattttgttttggtgtactacatatggccattggggtacaatggctttgaggatataaagttgcaagggtcaggaaagagacaaagacatatatttatagtggaatttactagacctgctgttactacaaatttatttataggggagtgtatatagcgaaagctagtgtcgcaaaagaaaacggaggaaaagacttgtagaaaggacccttccaatgaaaaatatattattttagcaagtttgagaagtgtgctcaataaaaccaagggagtatctctaggacagcagcagtaatgaatgctgcctgtcctcctaagggcttccttcaagttgcagttggtttcttatgtgatttttatattattatggcattcatctattacaactttacatcaaaagtagccgacagattgtgaacggtgatggtagatcgtagagtttaagggaaagacaatagtatattatggatatcgacaaagtcagtggcatattgttgaactgtgacgaacttagtagtactaagtagattttctgagtggtctttcgttgttattccgtagggttatttttgttaaaaagaaaaagaaagtagttcatgtagatagaaattttttttaccatcgtcgggtttgtatgaatgtgttaacctaactagcaagattcaaaatgtgtaacgccttccacgcacatctgctatggtacaacttagattattttgaccagtaattgatcacttgtaaccaaagtatgcagatttttaatgatgattagaattgaccaggaatcgtgccaccatgatgcgagtcatcgtctctcatctaggtacaaacaagatccagcagtggcaccaacaccagcacgcatgaacgagtcccaattagaccggattaactcacccacaaaatactaggaagccctttccagtttttttataaaaatccacaaactttaactttaagtatcatatagaaaactttaaccttaggctgtgtcctttggacaactttcccaacttcactccctcattttccgggcgcacgcttttcaaactattaaacggtgtattttttgcaaaaaaaaaagtttctatagaaaagttgttgtaaaaaattatattaatttattttttttaagttttttaagctaatacttaactaatcatacactaataaggtatcttgatttccgtgtggaggaaattagttcccaacacaagcaaacaaacacatccaagacttggccctgtttggttccatgggctaattattagtctccaccttttagctatgaattagccccaaggatctaaacaggtgggctaatttggggctaaagtaaattcactactagaaaaacgatttttcatgacatttggaaaatatttttcatggcggctacaagaaaaaaccgctagcgtagaaaatcgggggggatcacgggcacattaagagatccaccatataaaatactatatttttcgatgtctaccagcgaaaatcagtatttttgctggcggctactaaacagatccgctagcaaaatgaaaaagattcaccagcgaaaagcaaacttcgctaaaaaattttcgcagtatttaaaacgcgcgctagccttcacccacccacccactgcatttatctctcatcttcccctcacctctcccagatctagccgagcctctccccttccctcccacctcacctctctcccctcccctcccacctcaccgcagcgacggcaggcagacctggcgggcggcgacgctcgggctcgggcgaggaggccggatccgcggggaggcggcgtcgccgggctgcgggaggccggatccgcgaggaggcgtcaccgccgggccacgagaggccatatccgcggggaggcggcgccgccgagccacgacgacgacgacgaccatggcgaccacgacgacaggccggccgcgggcggcggatgtacggcggcgggaggggcggagggcctcctcctcctcccctcccccacggccccacctctctcccctcctccttcccacgacgacagatgtgtggcggcgggagggacggcgaccaccacgacgatgacgaccatggcaattggtgacgatgaccacgacgaccacgacgacaggcaaccggagggcctcctcctcctcccctcccctccctctccctctcccagatctagccggagggtggaggcggcagcgaccgccgcgacggcgatggtaggcgggcgacgacatgtattgctccattttgtttgtactgatgtttcatatatgcatgtattgatgtttgtttgttgagaatgaagtgagaaattgatgtagtgttctcttgatgttggatctgatgtggatttgaattgttatggatttgagatttggggatgtggatttgggaatgcaggtagcagcatggagtttttgctggcggctggaggccagctgcatatggtttttttttctcaaaccgattatcgctggcggccagtataacacagctaccagtgaaaatcgattatcgctggcggccgataaccgctagcgaagattgatattttctctggcctttgctttgtggcggctgcaatttccgccaggaaaaaccaaaaatggccgtcacgaaagatgattttcgtagtagtgattagctcccctcgaaacattagcccctctaagggatgataatggggctaattttttatggggaccatcgaaaagcagccctatctccccccatctctctcctctctcttcaccttttagccctcaattaactcatggatccaaatatatcattctaggctaatgtttagcctaccaattcaagactaaacattagctctcaaaattagcccggtgctaatcttctaaacagggccttaatatcgaaggtaccaaattttggtgtctcacaaattataatgtttggtgactcttagtacattttgaagaatggtaaaaagctgaaagaaagagagagaagattgctaaagtgttattctaaatctggaaaaaaaagtatgctatcatttttaagagaaacacatctaactctaacaacaagtaactcagccctaatctggcagcgctcctacaagccaggatatctgttattcaagagttggatgttgtctatgtcggctttactatgctagctgaatctggttttgcagcattcttgtcgttgacaaaagcgatgttagcactaatccaaacttgcatattgtttttagtcttgcatgagttgcatgtagataggcacgtgatatgtttatgttgatccactagatagatgcatatgtgtgtcatgtaaacaatggttagtccaagctttgcatgtagagttagttagtgctagtgattggaagatgcatgtgttgcagcataactagcaactgaacaagtctagggaataagaggattagtggcgaattagttagctgcatgcaagattagtggagcatgtttgtggcgtggtttagtcagctcggaggagcgattcttgcgcgtgagacgcatagatcgtgtgagtgagtggctcatggtcgtgcgggcgacccggtcgggctgttagctactccctccgtttcataatgtaagtcattctagcatttctcatattcatattgatattaatgaatctaaatataaatgtggaaaatgctagaatgacttatattgtgaaacggaggaagtagctatatgtgcatgtacgcgaggctacataagccgtgtaatcatcagtttgtaagtgagtgaagaaaagaaaaggcatttgttgccaagaaaaaacttgtgtgtgtgcttgtgcacttctgtgtgttcatccccagagagctattgtgtgtgtttgttgctccgtgagtgtgctgctcacgtgaatttgatccttggccaaagctaaaaagcgacaccctattgtggatgaagcaagtcagccaaaaatgcaccaaacttagcagccgctaagccaaaagatgcaatacagtag

SEQ ID NO: 12007 - DNA, 5308 bp, Oryza sativa
ccctaaaattgttatcccatgcagaggtcccctgtggagtgataacgccatatcgaccaatgtaataaacttgggtggtgcacttgttactgaaccttgacaggaagtgtaggtgcaatcacacagcaacatctctggaatagtagtccatgtgctcctccaaacgcttgacaggatgttagttctgacagcatcttgaacattcagacgagagaggatatcggcttttatctctagaggtagactgctcaatctgtctgacttcgcggcacgtctagacttcaccttggccttctttgagctacccattactttgaaaatgccctgtcgttaccagaaagcagcaaacttagatgggtatgcattccatcgccagcctcggaggaaaaataaataatagaaatcacaaaatatagtacagtgaagttgattgaggacagagtaaagtactgatgactagccagcattcagagaaacaagactggaaaatttttttaaccgaacttaacacgccgactcgtgggtccttctctgaaagcaactctaattgtcagttaaagtgtgtataaaccatctggtaaggaatcattatcaactatcagctgcagagatcaaacttgtgcacagctgcaagtatggaaccactggatcggtaagcatagcacagtttctgctgttgagatgaacccatcagaccaaggatcaagtggcacagcacatgtttggggtatcacatcaaatacatatgagaaaatcccttatgtacccatgaattttcgcccaatttcttctgtgcccctaaattttgtcttatcccctacgcacccttgagttttcatttttatccctgatatacccattccgtgagttgactgtcaattgactgttagatttttccaaaaatgtctacattacccttgtgtcttacttattgcttagtacagagtagttgattaaaaaaacatggctctcaaggtaaaagttgattcatttataaaaccaaacatgccataattacttaatctaaaacatagatttttaaataggtttcaaatcagatttgatgaaatttattgaaaattttcgctgaaatttaaataaaaaacagttttggtttttcgaattccgaataaaacattttttggatttcattatctttaaaaaaatgtttgaaaaattaattttgttttcgaaatccaatgttaataatcatgtccctttttttatttttaggttaagctttttttattaacaagacttatgtttttaaattagaaagcatgaagtacaagcgaagggcaatatagtcattttgggacaattctaacggtcaattcacagtcaactcacaacatgggtatagaagggatcaaaataaaaactcagggacatacagaggatgaggcaaaattcaagggcacgtgagggattaagcaaaaaactcatgtgtacataaggaattttctaaatcagttgtcacatcactgagcaatttcgacggtaacctgaatggcatgcagatggcaaatgcatgagaatcaggaacggagttaaacaaaaaggggaagtctaaccctacatgaacaactctgcatcacaaatttcacccggtagcatttctttcttgcaagatccatcgaagaacggacaggttcttgattatggccacaacgacaagaaaactaaaacaaacccttcacagcccagcccccatggcgtctgaatcatcatcagcagatcgcatacgaaaattctctaaccaatcccagccaagaatcacacatctagaatgaactagcgtagaaaaggtgcaccatcatcatcatcatcagttcatcatcaccacacgaagtcacgaagaggagaaaggggtggttacctagaaggaataatcaatggaggatcggtgggtgaggcccttaccaggagagacgacgaagaggcaatgcgaggggcgcggccaagcgcagacggggagagggagggagggaggcggccggtcgtacggcgcgaggcggcgatcggtggcggcgacggcgaggttttcgcttccccctctccgccgagagaggatgagaggagagtgaagagaggctgggccggataggcgcattttgggcctcaattggatgggcccatatgtcggctttgattttttttttcaaacttatttttttggtttggttaagtttatagaaaatttgacaaaatctatatttcttttatttttcataatatttttgttttgtgctgaaaatattattatatttttctataaagtcggtcaaacttttaggaaaaagtgaaaatagtccctaatatgaaatggagggagtacaattataggccaaatttgggcccataaagtggtgggctgagatttcggtccatctaaaggaaggacacggatggacctccatcccagttaaaaggggccgactggacattgaccgtacgtccgtattgcagtcatgtgttagaatttgtttctcttttttttaagcaaaaacgaacaaggtttattatttttgtttcagaaaaagcaaaaaaaaagagaaaatttcataaaactacatgtattttgaataaattatcaaacaaactatatatttaacatgatgtatcacaaaactatagatttaacactaaaattattatagaactatagaatggaatatcacaaaactacgcatttagtaacacagttatcaccatattatagaatttaaatatcataaaactataaatttagttacaaagttaccataaaacttggacacctttaactctaacataacattattgattattgttaatgatttgaactcaaaaatatatagttttgtgataattttattattaaacatgtagttttgtgataaatttagtgttcaatctgtagttttgtgatatatcacattaaatctataattttgtaataatttgaccaaagcatatgtaattttgtggaaattataattaaaaaaagttcacaatcgctgccggctgccgctgtcatttttgcttgggatcacagctgcttcagatacacccacatctcaaatgcaaagcttcatcatcaaattaaagaaagaaaaaccttcgaagcatttcattctacaaacgttgggcttacctaccgttcgttcgctgtacaggtgatgaagaaactgagggtggtattgcttgtggttaccaagtggctggtgccaaccacaacatcgttttttaataactgtacctggaaagcgttgccgtctaaaagaaacaaacacagaaagcatgtcacccatgtcatgtcatgtggtggttcattatccgcaatcgcctcttgtacatatgtcacgtgcataccaccaatcaatgacaccaacgcatcaaagaccacagacaataatcacactgctgttttttttatgtgcatatcctggttgaccgggaaaattttgttccatcttgacacataagtaaattctcttcttaaggatatagaagggtaaactcactgttatcaaagaaaatagtgcttgagaatctatgcaacataatagcccaccaccaatcacttttgcacgttctacagattaatccctgatattttttatatcatgcgatagtcatgtgtttgtttgaatcaagtaaataacatatatttaaataaacataggcattttaccgatagcaaagcatgggtatttcgctagcattcaagaagaagagaaacttggaaagttaagccatcatgaactaggaaggataatgtgctagagccaacagttcaacacttgattgaactaactgagccaagggaaagaaatagtttgtcactctaatcacaccaataatttttatacatgagaaaatggccgagttaaattatttaatacaccaccaaattacctcactatatgctcctttagctacaacactgtcctccaactttgatcttctcccgtttaccatatactcacaaatcactgaaagctagtataaaaatacacttgcagagaagaaacctgggatggaaacaatatgcatattattgggactaaaattgcatcttggagttgaatttacccgctgggtgccgcaattactatttcttccatactcttctggaacattatttctgtaggttttaagcacccacgaatgtactcctgcccaagttgtgcgcgctcgttgtccccaaacccaaatacaatgcctctgtttgtcactgcaacagtgtggtacaggccagtgctaatttgtgaaacatagtgatcacgcagactatcgaggactcgaggcctcattactttgtcggatgatcctcggtcaggaaaccctaaactcccaaagcccatccatccgaatgcaaaaactgagccctcatcagtaagaacaaatgtctttcttttccttgcacagacctgtcaaaattaaaggaacatacttaagcctttatacatgaaactactactagttctgtttcaagatatgattgttattagaacaagaaactcctatatcatattagcatgtagcaatgcataacttttgttttaaatacgaaaaccatagcaatgccctatttcttgctacataaagtatattacctcagcctaatctacatgattgatgatagtttaaaccaggtttattcttcgatgcttaatgaagtaagaaggaaaatggtgcaaacatatggaacacacctgcacagcaacttgactcttcaaactgctgatcaattctgggctagttttgtcattctcatcaccatggcctaatgctccacagtaacctctgccccatgtataaacctaaaattttcaaaccttaacttctgtctgaagatacataacaatcaaaacatacaacagatagttccttgaacagtgtatacttacataacccagtgcatcaagagctacagcatgctcatcaccagcagacacgcgaaccacatgaatattcctcctcttgaatgactggattgcacgtggacgaagttcatcatgctgatctccatgtccaaggcagaagttggtacaagagccaaaggaataaactgttccatcatccgttacagcaaatgtatagctggcaccagcagcaacctgcactaccggagcaaggccttcaaataattcaacgatctttggagtagccctgtctattgtgtcaccatgaccaagctggccatgtgtgttacttccacatgtatatacttgcccatccgttgtaagaatgacagtaaaacttaaaccagtggcaacctgcaaaaaggggaatagatagaattaagaaaaagaggaagagt

SEQ ID NO: 12008 - DNA, 656 bp, Oryza sativa
cctgcagccctcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaaggcgtggcaagccaacgttaagctgttgagtcgttttaagtgtaattcggggcagaattggtaaagagagtcgtgtaaaatatcgagttcgcacattttgttgtctgattattgatttttggcgaaaccatttgatcatatgacaagatgtgtatctaccttaacttaatgattttgataaaaatca

SEQ ID NO: 12009 - DNA, 350 bp, Oryza sativa
tccccccgcggcagagggaggaggagctctgccttcgtcccttggaggctagcgcggggagaggcggggccgagtcgatgacgacggcgatgacggcggggcggtttggagcggagcgacaacacgggcggctggcgtgggcaggcgctgacggcggtggcgaccaggcggtcggccaccatggcgcgcgcgcgcgcgggaagcaacgggcggcgcggcgagaagcggcagcgagggcggagagcgctcggctcggcgcggctcacgcgcacgcgtgcgcagcgcacgggtagagcgggggagagggagagggagagagagagagagagccggggagggagggggagatg

SEQ ID NO: 12010 - DNA, 746 bp, Oryza sativa
agtaacattaaatctccagtcataaacggctacaccacgttgaacaggcccaaccaacccacgtgaactacagtgcattgagtcgatttattaaggtgggactaatcacggtgaatctggtcgaccgcccgtaactgcgggcacggctattcgaatagttttactctggccagaggtgtacaactgtacccacaagactcagccccacgacacgtttccgtgcgccgacatgccaccacgacatactggaaagaggccgtgacaggacccttcgcataaccccctctaaccgatcgcaccacaccttagggttcgcccccgcccccagcagacaatgggcagccctcctctcgtgccgcgatgaatccagaagccgatcaaccggacaccccggccgacccaactccatcatgcccaccctcgcctgggtacgtcggctagaggaaagctacactacaagcccagccgttaccacgctggcttgtggtaagtacgataagttcttctagggcatcccacgaaccggtctttaattgccatgggtgcgactagcataaccatgcacccacagcccaccattcagtcgcattctagttggataattacgacaatgaagcatggccagatgtctcgagcacgcagctcattctgatactaaaaaggtctaatattgtaattatcccatcaactgagctagtggtaattaagcatggctaagcatatagttctagctaggggctgcagga

SEQ ID NO: 12011 - DNA, 26925 bp, Oryza sativa
  unsure (1)..(26925): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttcattagaggtcacatgaaaaagttatgaattattttttgatatcccctttttagaccgtcctctttagggactggggtgacacaactgaacaagttggatgatctaaatgagtgatctgcaagtttagggaccgggatgacacagtcgaacaagtttgaggacctgaacggtcgatttgcgagtttagggaccaggatgacacatcggtacaagtttagggaccggtgatggattttactcgttgctattttaagaaaacgttcaactagagaaatgtttggaatgaccaaccctcaaatttttatattagaaactttttcaaaaacacaatagattttgatttagggagataaatcattttgagcaaaaacaagatcatataagatccttttaaggccactttgctaaaccattttagaaattagaacttttacttcaaataccttgaaaaatatttgaaatacatattgaagtacttttgagaggatttccacagatttttgcctcttaaatgagatttttgacttttgaccaaaaaggctatttgaaatggctatatatccaaattttgaaatcttttatattttgaaagcatgggatataaaaatatgattaagaccactcccaattgatgtatttctcactttaactccattaagtcaaggtttggaagaaaagaccaaatttgagcaaaaagctacacaagctttattttaaggggcaattgtgtttctgcccttgctttacgattcaattgtgattttacccctactttttagggtttgtgattttgcccctgctttttgaaccgaagcagccgtctgcccctagttttgacagaagtttggtgggctcgaaattttcgaattaaaagaagaaagaaaatatttttatcatttgtgaaacaccattctacccttggtcaaatgaaagaagcaggagtcttgtccccaatccgtcactatgccaaatcgaaatccctagctcttagcaagcggcggcggcgactcacggtcagcgcgaggcagggaggagcggtgaggcagggaggagcggtggagagcagcgccagagtcgggcgcaggcagggaggccgggccgggcggagtcaggcgtggacagggaggcttggcagagtggaacgacggcattgcggtggcatcgaccggcgggcaggcgcacagggaggtgcggcgtccccgcggccagcgagcagggaggcgcggtgcggcggcgccgcggttgcatgcgcagggaggcgcggcggccggtgcgcagcggagaggagcgacggctccatcggccagcgagcagcgtgtagtgaagcttggtggcgggatggcgctgttaaaggaaatccttgccatggaggagattttcatggaagaagcctgcatgtattgtcttctatttttgtgtttgtgaattagatctggatgcacttaggtccctaggcgaatcagctaattgtttcggaatatccataccaattgatgatgctttgtcttttggtaatatccataccaactgatttatgctctgtattagttatggatgcacttaggttcctagggtgaatgagctaattgtcttttggacgaattagctaattgtaaatttggtttcttcttattgtaggccgattcatagcgaattgaaagtagttattagagtgggtcatatttcagcttgccagatggcgggcaaaagacctacctccagagcaaaaccttgccaacacagcatgttgacatgcacaactattcactactacaattagtctcacagctagtcaaaaaaggaggcaaacaggagagggcagcagtgaaccaattgtcactcaaccatcaatgtgagtcattcatctttactctttgtttgctgtttttacatacataaaaacatgtttattaacacattttcacttccatcttatcaagtcctgctagtgcaagtaatatgggaggagaaagaccaccaacaaagggaagagggaggggaaggggaagaggtaggggaagaggacgagcaagtggaagtggacgtggaagggaaaggggaagggaaggggaagtggatggggagggatgctagctgaattgtttggtccttcaatgtgatatttgaactccatatgtaatcggcatgtactactttacttttcctagacatgtactgcttaattgtcatgtaatttgtggtattatgttgactatgccgtactgtcaaagctccctactagctggcttttgttggatattaatgtgtgatgttcagtattgtgctactttgtgatgcttgcacatgttatatgtgacatcttgaaaatatctgttaaaattgtgttgaaattattgctgaaattttgtccttgatattgtgctgtcaaattattgatgaatctctgtcaaaattttgtccaaaatattgtgttctgtcattgttttataaactgtgttaaaattattgctaaaattccatcaaaattgtccacaatattgtgttatgttaacttttacaaaatttgtcaacatttaggtcccatatgaaattcgcacaaaattaacttgaaacatatacagtgtgcatgccaaaacatgtccaggggtaaatttgtccattcaccacacatttaacaccgttaccattacttaacagagtaggggcaggcggctgcttcagttcaaaaaagcaagggcaaaatcacaaacccttaaaagcaggggtaaaatcacaattgaatcgtaaagcatgggcagaaatacaattgccccttattttaaacatttttcttccaaaatgcaaacacaaacatatgagatggttttggagagaaatgagtatgaatgaatgttatgtactcatttgagctagcatgatgcgtttacacaaccccaacaatgacaactcatttaagtgctagtaagtggccatttatggtctagatagtattttggtcaagattggaatctaaatttcttttgattgattggccttttagagaaactttgaatacaaaaatgtttgaattagccaaccctatctttttcattttgaaaccattcccaaattccttttagaattaattgtataaaaaattgaagttaaaagccaaaacaagatacttagaacttcattttgggttgaaattcattttctttgaaaattagctcttctttgaaaaataaaaatattggaaacttttgaaacacactttaaaataatttccgattagattttcatagaaaagctatagttttcaaaattttcacttttgcctaaaaggtttattttgaaattaccaactagcacttagccaacttgagcacatataagggatgtgatatgcatgaatatgattgagtactaaacactcaccacaacctatcttgctcaaaaatgcataaatgatgactttcatatatcaaggaatgtaaattcttaaatgctttgttaatgcaatacaacctatacaaggttaaatacaagataattcaatgtagatacatgttactgagatgacattggttcttgacgtgaattttgcaatggttggcttcaaattccaaagttggtgagatccaccttttcttgcgtgaaccatacctcaatgcctctccatgtacctatattctcattttagcacattttggtcttcaacaacattgggtccataaaggtaagtcacatgagacttaggtacccaaatggattttatgctagcatgtggtgaactaatcaccctaatagcacaaatgtcctttttggcatccctaggcaaatcataatcaaatgaggagtttggcttaggaatgttacccatgggacaattgttaccaatatgtccctttgcacggcaattgtagcaaagtcgattcttgtctttacatggtgctttcttcaccacatcttgcatcttctctgctaccttgctacttgctaccttgatattaagcttcttccttgatgacacaaagtgattcttcatgtgagggcaagatgcaacttcatgactcttctcattgcatccatagcacttcctatggcttcttcttgttctcctctttggaagtgtgacttggtcatcaatcttgttggaacatatcaaggcatagtgtcccactttcttgcacatgaagcaagtaatgagagttttgatccaactttgaatttgccccttactcttgttgttggacttattgttttcttgacaggacttggtgcaagctacggttgatcccttctcaagcttcttcaccatgttcccacggttatcttgagaaggttgagccttgtccacaagtccatgatccatatgattctccctttttcctacacaatccaaatcacatgtagtgctcggggaaatgtttgctttggagcaataagtgtcctcatgttgatatttgttcgacgaaattttgtgcgcttttttatggattataaaaatgaactgtgcggagtactgtagttgagaactaatgggcaagtcacgcgcaaggaatacttggttgtttgcctgtgatttactttcatgtgtgcattccatgattacttaaagattccatgattatttaaagaaggggaattagtacctagtcatagctaattgccgataagcacacacatgcagcaaatcatcagtacttagctactcaccggacctgccagaagtgccatttatctacccgggcccacaaatctgctagatgtggatatgatcgctcctgatcagtataacaacatggaaatacatatgatcatatctcctcttgatgttataatttcaggatatatcattttaatggaaatacatcattcacagtatcacggttagatggaaaatagcacatctatttcctactttaatcaacaggaagcttcctgaaggacacaagtatagaagcgagctagacaattaaatggcaaattataatctccgcattcagcattttttggcaaagccatgcacgggcatgcatatgcaccgacctgcagctgctatagaaggccaagcaaattcacaacggggggagacatgagagaaacaccgagaggcagcagagagagtacagaggcacgagtcgagggcctgcagttcacgccgccgccaccgccaccgccaggcgctgcgccatgcccagccttggcagtagtccgtagagagacatacacagagacacatgagagaaacacagagaagcacaaggacaggctgctcatcggcaaccatcacgcacgtcgtcttggctggagtatctcggcgtctggcgggaacgtgcgtgcactgcggccggcaacatcggctgctgtacctcggtgtccggcgaggaggcgcgtgcgctgaggaagcgcgctaaggaggagacgatcaccaggcagacgatgctgctccagttcactgccatgggtaactagcctattttcttttcatccctttgctccatttcagcgcatgcacgctgggatgatgcatcctcagcagagaagatgccggatgcaccgccatcgccagagtcgccagagtcgccagagttgacgtcgtaggcaagcctccgtcaaggttgagacgatgtttctgcacggcgcggcgatgtcgccgagatgcttggacgtcgtcgccttgccggtcgcggcctcttctacgcaacgccgtcgactttccgctcgccctcatcaacactgctatcttctacacacattgtcttgctgcttgaagagaacgccggccggagcgccactactcggtgcccgcaaggcgtcatcagctccggctgcgtcccgaaccatctcgctggagttgccgtggacaccgctgagccgcccaagtccatggacggcgaggcgttgccggctaacgctcgtccccgtcatcatcagctgcccgccggagaaggccattgccaggtcgccaaggtgctggttgctgatatccggaggtcgttaatatatcatccacaagccgcgatgggtatcatcggacccctgttgctggcacctgtcatgatgcggccttgctgggcagggatgtccgactgagactctactaatcggcgacgccctccgtcctccacgctcgttgtagcctctgcggatcgccgttgacatctattaaatcattggcttcgctgccggcgtcactatgctgccgggnaagctgcncnngacccaaaaaggnccccccccaaattttttcccgaaggcatcatgccccggatgccatcatgtcgtttgcagccgccgcgctgaaattactcagatgattgtattgtgcatgcgcactgtatgaatgcatgtatatgcatgctactgtacacgatgacaagcaagcaaacaagacctgtatatgcatgctaccgtacacagtgacaagttaaaatgagttggcaaattcatactcatttggtgctgctccgcccttaaatcttcaagccctgactaattcagctatcatccgtgttgatcattcatacctttataatttaattccgacgcaattgctatggcgtcgagtcatccaagctacacaattccatacatgtcttcaacaacaatataccgatgaggctgaacggcagggtgggcggagtctacatgaagactatgtcagtaacatcggtgcacggaccgacgaggccgtggaccactgccggcgcccacacacatctactccaccatcaccatcatgcatgggagaacgtgaagcgaagaccgacgacgcagtactcccaagtcaagccactgcgatcggagacagcccaacataatttgggtttggctccgattgtcggcgcatatacaagagggccacccagttcctggaacacgtctcatcgttcccaggctaggctatgcccctaacatcccctaaaactgttggaattaatgaatgggccttagcccactcgaagattaattctttggaaaatcacaaaagcccacctcatgggatggcatgcatgtggagtttagtaccaccttgcttattctaggagagggggacctccttaaaagagaggatgccctcctagtcacttgaagcatgtgtggtggagagaagaggggaaacacacgcgcgcgctcgctcgcctcgcctcgcttggccgggcagggcaggcggcgcgcgtgcccgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcggacccttctctatataaaccgacctgccgtcttcacgcagcatatgcgaaaatcaatctagggtttgcctcctactctgtactgcgccgtcgctcgtagactactccatctcgctcgccggcgtgcaccggcgatcgggaaagcaggttccggaacctctgctttagacgttctgcaccgggagaaggcggcaataaggtttttgggaagcgcttcgcgcgactgctccctgttcgttcatgacggctcgctttcctcttcgctcgcgtgtttcgtgctttcgtagacacctgcgaaaagtttcgaccaagcagccggtctttccgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaatccaaaaaccttattataggcactgtgattttactatggctggttttgccgatgcactgaggccggataaattcaccggtgtgcattttaagagatggcagatcagggtcactctgtggctgacagctattaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaagatggctgacaaccgctctgtagtcgaacaggctcatgagatacaaaccatggctaaggaactcgaactccttaagtgtgtcttacccgacaaatttgtggctgggtgcattattgcgaaactacctccatcttggagaagtttcggtactgcactcaaacacaagagacaggaatactccgttgaggggttgatagcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaataatcctaatcaggatgagaggatttgctttgtgtgtggtcaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcaaagcaacccgcaagcctcacaaggctgccgaggagagaaacttggcaccactagaactcctacattcatatctttgtgaaatgaatggggtgttgacgaagggtggaaaacgatatttcatgacattcattgatgatgctactagattttgctatgtgtacttgttgaaaatgaaagacgaggctctagactattttaaaatttataaggcagaagttgaaaatcaacttgacagaaagataaaaaggcttaggtctgatcgtggtggaaagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctatcttctttgagagctttttcccaatgaaggatacacatagtggttcgaaccaaccatctgaaataattcccagttcaatcacaccaccagaacaaactgaacatacacatgaacttgtctctgaggaggatgttagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattgtcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggaaaagtgtgcaaattgttgaagtctttgtatggtctgaaacaagctcctaagcaatggcatgagaaatttgacaaaacattgacatctacaggctttgcagtcaatgaggcagataaatgtgtgtactatcgccatggtgggggtgagggagttattttgtgcttgtatgttgacgacatactgatatttgggacaaaccttgaggtgataaatgatgttaaatcattcttatctcaaaattttgatatgaaggatttgggagtagctgatgttatcttaaacattaagctaattagaggtgagaatgggattacactcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctggtgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcaaatcccttcacgaagggactatcacgaaatgtgatagacaatgcatcgaacgagatgggtttgagacccatgtgagttatactatggtggtaacccagtctatgtgatcggagatcccgtgaattagatcctgggaagaacaaaccattagtaaactagaggagagtatcaatatatataccctctccaagtgaagatgcatatactctcgtgagctgcaaggcaggttggctatgccttaatgagttctgttgactttaattagcaaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagtcacttgaagcatgtgtggtggagagaagaggggaaacacatgcgcgcgctcgctcgcctcgcctcgcctggcctggccgggcagggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacctgccgtcttcacgcagcatatgcgaaaatcaatctagggtttgcctcctactctgtactgcgccgtcgctcgtagactactccatctcgctcgccggcgtgcaccggcgatcgggagagcaggtctccggaacctctgccttcgacgttctgcaccgggagaaggcggcaataaggtttttgggaagcgcttcgcgcgactgctccctgttcgttcatgacggctcgctttcctcttcgctcgcgtgtttcgtgccttcgtagacacctgcgaaaagtttcgaccaagcagccggtctttccgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaaaaaccacttaatcttaagtgtgcactgcaatgattggaaggcctactcttgtaccacaatgatattcagccagtgtgctagaaaccagaaaagcagcgctattccgagtgtcacagtgattggtcgacgcaaggccataacaatatgtatctctacatcgagccagagacctatcccgctgataatcgagcaaaatgattggtcaatgttctcctgactattctcccattgctcacatggcaccaagacggtcaagaagactagaagagttgtaccagcctcctagtgcttacaaccaaaaaaacctatgtccactataagtacaccatttaagaccgatgaggctaaacggcatgaacaagtgaagtctacatcaaggcgacgtcaccaacaccggcgcacggaccgatgaggccgtggaccgctgccggcgcctacacacgtctacatcttcaccaccatcacaatcattcatgggagaaagtgaagcgaagactgacgacgacgaccagcgcagcttaatcggaggtatctcacgggtttaacccgcgagagcaattaaccgggtgtcttccgagaccccgagaaccaggagaacacaatcgccaaggcagatccaccttgcctataggccgtggagcgcatttgatcaaggattttgcattgttttaattcatcaagaattataataaatacattttcctttgtctattttatttgtgtacttagtacactggcacgcccgcacattttatttccctgggcggggagattctagtttaaattctctccaaacaatatttgagctcttgattttccttctccaaagatgctacacatgcaatagaattagtggcacaagcaaattcatttatcaatttttcatacctcataattaatgaagaattagatccctcgagtttcttgtgttcatcggctagacccttgatttcttcattcttcttaatgagacatgcttgttacttctcaataatcctcatgagcttgatcaccattgttgtgttcgtcttgttcaagtgatcaaccacggagtcatcatcatcacccataaagcacagatgatcttcggcaatggaagatgaacaaattgatggtgtggattcttcatttaatcattgatgtccattcattttctccttcaaaaggttagtttcacaagtactacatgaagtagagcatccatccatatcatccacatgcacatatttaatgctaagtgatatgtatgagtcaacaacacaatcaaatatatcaatttcattatcagtgttgttggagtccaatgggagagttggaagatcatcaaccttactcaccaatttattaccttgctcatagttgcatgttggtgagatatatgatggggtgagaccttcttggtcggaggagataatcacttgagacttgtcatgatgaggcgatgaagtagagcaatccccaaatgatgcttccacaagagtatcatctccatcagatttggacttgtcatgtctttcctttagtgttgtccaaataagatgagcatcttcaagtggcatgatggttttgaacacatcttcacttaaagcactaaacaaaacattagtagctttagcattgagatgtgtgcatttcttttcctcttcaaatgatagctctttatcattaggaggagaaatactcacatctacaactcactctatatgcagacccatggccctaaacacattaagcacacgagtactctaagatatgtaatttgaaccatctagcaaaaggagttcaaggaacatttcacctcttgtcgataatttctctccaggcggtgaagcccgaaatgagagatctcgctctgataccaattggaaggaccttgatgtcgcctagaggggagggggtgaataggcgttcctaaaaattatcacaacttcatagcatattagaatgatgagatctttcagttcaaatcgaaactttaggtatgggattggaagtttcggtctcaaccgaaaagttcagcggataacggaataaaacactagctatgaacttgtagctcgaacaaacaaaatgtatatgaacaaaaggtgacaaataagttatctatccaagatataaggtcaccaactatattaattaaccatgcaagtagaacggataaaaacaagctcaagcacaatatgagagaatgcaagaatgtgcaaaccaagagaggagatgcgtgattcgtttcccgaagttcagattcacggatcctacgtctccgttgaggagccacaagggccagccctatttcaaccctttcctcacgaggttgcacaaatgcactcctcggttttactcttgatttctttccttgcggaggagaaattgaagccttcacaaacattcggtggccgaccacaaccttgggtgctcaccggcgacgcctagctgtctaggagaccttaatccccaagagtaacaaacacaatcgaaaatttgcttgctatgaactcgagtgctcaaagtatggagcgaagctcactagctctcaacttcttagtctctcaatccaactctctccccttcttaaatccctctcacaaagaggcaccacaaaggtagggaaatggggatgactatttggctttgaatatgtctaatacttcccaagaacagtagccactcaaaggagggatggaggagtttatatacccgagcccctcaaaaactagccgttggaggccaagaatgtgattttcggaagttccgaaatgcattttcagataagtccaaaaatttacagaagccaatctcagattcgcagccatttttggaattttcgaaaattttcggagtttttcaaaaattttcggagtttccgataatttttcggaatttccggaaagcacagagtaaaacgaccataacttttcgctcgggagtcctttttgatgatcttggactctatgtaaagctcactcagaggactactcaactcattttgggccaattgcatatttagcactggtttgaatcggtattgtgaatttaccactataaaaaacgtaattgcatgcctgccatcgaaaacggttggaacccacgtacatattggatacacggctcggaatatcatcgttagactatgggttttcacaaaacaaataggacaaggatgcccctgtccctgctacagctgctgctgcctttgtccgccattgttgctgctcttgctgtagctctaccagcttgctggcttgctgctgtcgcagggacctgctgctgctgctccaacgacatgcctatagtgagctgatgccacacaatgctgctggggccgccacaagcacggctgttgtcgcatgcttgtgctacagccgcaagcattgctgctcctgttgcagctgctatcgcggcggctgccgtcgactcgcacttcccgcaagattacctcaaaaatattactccgatgccgtcatggtgaggactccgaccgccacctacgcgcacactagccgccgccctgccgccgtctgcctggccacacgccgcggtccacacattatcccgtcatggcgtcatgctccaacacaccgcccgtccacacgccatctgcccacctggccgcctccacatcctcctcctgcacacccgcaagagagaggggtgcgagatctattccggctaggggaaagatggtcttttcatgctccttgtttttgcccttttaatcataccagtttagatggtaatgtcaaacggaagcaatgcaaactaatttcagcggcaaatttgcagtttgcatatttataatggcttattcaagttagggggtgaaaccggtggcatatacacctcgacgttgtatccctcttaatagtacggcattcctaaactcaaatataaataggaagataattatgtcaacaggaatgccttcttttcatctttcttttattgtcttaagggataccaatgccaaaaccgtttcaccatatattcctcaaatgattgatgcgattacttgtagcttcaaatggcctcgcacggtccatcatgacaaagccgtcactcacccttcaccaccggatttggttctttggcaccaagccccttgcttgcccttcaccgccgcatggtccatcgtgaccgagcattgcttgtccttcaccgtcttgccatagtagtaactttgtatcccacatcttcagtgtcgggtcccaaaactaatgattcggtaaccgacttattaaaactgtatcaagccctggatcagtagattgatacaggttcaataatatggatcttcattgcatacatttaatcaaggctccagaggagatgttattataaaataataggacatttagaagtttgtggctaactattacagtagaagctataggatgagccaactctaatgttttgctatagacttaaactatctagtatatgcttgagaactaagttagaatgagactaacttatatgattgaactcccggcttcggcaagaacatcaaatggactctgaaaaaggtggggttaagcaaggatgagtacaacgtactcagcaagctattatattaatcaatattgaatgcatgaaatggtaatatttgagtagagctaagtttacttgcagaaggctgagaatatagaggaagaaggcatgtaatgttttaaatgcaacagtatttaataaagtttagaattaagtttctaaccaaataccatatgagtctcgatactcaatccgtgagcacggctattcgaatagattcatgaatattcatactgcagtaaatgtacgctttacccacagcccacgacttgctgataatcatcagtttcgtcatggcctagtattagattactaacaatagtggcacctgttccatgaactctagtccccatacgctctgaacgtaacgttatcagcagcgtgaggagttatggcattcccgaggtatttagagagaattgattgtatgacaccatgccaaacagactagtcatcataatttatctcaaacaaatatttacctgcgcctcggtaaatatcacaatattgccccgctcgacataagttttcctcctgcatgaggacttaaaaagaaccactgtacataggtaccacattgttaataacataatgctagatctatacctgcacttagagctgtggtcgtacccgttcgttcttcataagtatttgggcagtcttatgtcggttgaaacagtactagccacccggaaatcaactatttctatcgtactgttccaatctaagttcattatattttatgcagtctaactaggcagggctaagcaaaagctagcatatctggtttgctatgtttaggttatgcatttgaaatcatgtatgactaatgcatagaatagagatatagaatatagggtaattatgctcaaggataagaataataacttgccttgctccagcgcaaataaatccgagataggcaacctgattatccgatgctcgaaataccacaggttgccatccaaatataatagactctactgaagaagaggaagaaccaacttcaataaaagccataaaatagcaagaaaatgatgaagagcgagaaaggctgggtttagggtatagatatctcctttataaggtgtagggattgttggctaatatttcaggtatagattctaaatggttggaggctagaggggattaagcaactattctcgcttatatttcatgtgaaagctttaatatcttggagagtaggggatataactggttaagcgagtatgtggctagtattggctggtggtaggtttaggtaggtttacacctagggtttggttatatttaagccaattgtggagtagggcaatatattagccaggctctatattatatgtataggttctgggtagatggagaatatatggtgggggtgagtaaaattatggaaagtggtatataggtaatattgtagctgatatggaaattggaagacgactggaatttgactagcaaggtattgactaggatttggttgtgtactagtcgatgctagaattgagtagcataacgactaggtttggtatcttctctagctggtgtcgatggatattataacggctagaggaatcggaagtttgtacaagaagtgttactccgacgaccgtgagtggtggcgaagtggctaggatcacacagagttcaagagcgaactatgttgtgtgctgtggaggtcgaaggaatagtgaagctccgaccgttgtacgcatcgaggcgtagggtgccaggagcagcacttcgaccttgggtttgggttttgccaggctttacaaccaactgttcgacgtcggggcctgtagatcgcacggacgcccacatagaaggtgtaaagttctaaccggcagctttttagtggctgaagggtattttgggttaaaaggaaatatttgaaatacaaatataagtttaaattggaaattcaaatataagattaattaaatcaaatatttattcaaatggtatttgaataaattaaggaaattcaaataaaatcttaatatagcaaatttgatatcaaaatgaaggatttgaatttagatgaatttagatccaagtttcattggaatcggatatatggtttaggagatatgggcttctaaagattggggtttgaattaaatctagaaaagatgaaagtgcactgttcatggacccacctgtcagttctttatttctttcttcttttcttcttcttcttcgttcgtttcttctcttctcctttccagtcgagtcacaggggagagagggagagagggtcgccggtgctccggtggccgggaggtggcgacgccggcggcaaagtgtgttcccgagcgtcgcgtgtccggggagggcggtgtccggcagggggagtgagagaggagaccggaacggcgatgacaaaagcttgccccggccggtttgggaagtaacggtggtggctaatctcggaaggggaaaggaaggggaaggttagggaatggatttgtctcgtcgaggcgaacgtattggcgcgagggcttggtcggcaatgctccgacgagggagatcggccgacggccggcatggggaggagagagagaagaagagcttgagcttggatgtgtgtggaggaaaagggcgacctcgccgggtacttataggcggcaaaaggcggtgatgcaaggcggttccagaggagaagatcgaggagaacttcgcgacggcgccgtggaaaagaagaagtcggcgccagctctgtgctcccattggatgtcgacggcggcgcgagcacgtggcagctgctgctgtgttgggtggcggaggaggagcagcacggcacggcgacggtggcggcgcgacttggtggcgacggcaagacggcggcgacggcgcacaaagccgtgggcggcggcggcgctgtggcttgggcgccgagtgcgcccacagagaggagaaagggcggctcagctggttgggccggcttgggccgtgcgagtgagaggaggaaaggagaaatgcggcccaaactcaaaagggagaaagtctaattttgtatggagattgaataatttgatttagaggagaatttgtgtttggagggacgatgaaccatgagtttctctcgacactcaaggctgttgttggcccgatctttcggtgagttgtaggtaactacaatttgggagaaacgttgacgatccgactacaaccatacgagacgttgtgttgcgccttagtgatcgatacacctctccatgagttgttgatcttgccgatgcagatcaaacttattcctgtaagaaaatcgaataaacaagcaagaacaagataaaagcaatctgaattgcaaataggaatgaatacacaagataagttggggtttcgaatacaagcagacggacggtctagccgacacgcgtgctgcaaggaagtagcaatggctaaactttcatctaaacaaaacccaagaaactctaaaggggtacctaactatttataaaggtgggaggacgacctaggggtccctagggtcatgctccacctggttggggcgcaccccacatgggcctcacatgggccggggtcccaaacaaaggtacaaggccaaaggcccatgactggtgacgcagcactttatttcttcctttgtggatgtctgggatggaatttggagataaggccggatccgttggaaagaggactccgagtgctttccatcaagtactcacgggtcaaaaacggaggttgtatgcagattcggcggccgattgaacttaacagtgtagcaggtggccgaatcggattccagcacttggaggacttgatcttgatatcatcttgttcatccatgatgtgagcaatggttgtatccgtagtagccatggtcacatcatcctccccttcttcacggaaaaccgtcctcagtttttccatatggtgctcgtcatatagtccattcaaaataatctgtttcatccaatcaaaactagagaaactcgaagttgtgtgattagcaataacatgtttctctaaatctgaacaaatgaaaactctatgcaccaaatatattcctcttaatggacccggagttactctcaacactcaaggctgttgttggtccgatctttcggtgagttgatgataactacgatttaggagaaatgttgatgatccgattacaaccgtacaagacgttatgttgcaccttagcaatcgatacacctctccgtaggttgttgatcttgccggtgcagatcaaccttattcctgcaagcaaatcgaagaaacaagcaaaaacaagataaaagcaatacgaattgcaaataggaattagtacacacgataagttggggttccgaagaacaagcagacggacggtctagccgacacgcacgttgcaagcaagtagcaatggctaaactttaatctatcaaaacccaagaaactctaaagggctacctagctatttaaagaggtgggaggtcctctaggtcgtcctccacctggttggggcacaccccacatgggccccacttgggctggggtcccagacgaagttacaagcccatagacccattacaggtgtcgcagcactttgtttcttcagttgctgccgactgagatggaatttggcaataagctggattcattgaaaagagggctccgagagctttccatcaagtactcacgggccgaaaacgaaggtcgtatgcagattcggcggccgtttgaagtcagcagtgtagcaggtggccgaatcggattccggcacttggaggactcgaacttgatatcttgttgttcatccatgatgtgagcaacggatgtatccgtagtagccatggtcacatcatcctcccctttttcacggaaaaccgtcctcgatttttccatatggtgttcttcacatagtccattcaaaataacctgtttcatccaatcaaaactagagaaactcgaagtagtgtgattagcaataacatgtttctctaaatccgaacaaatgaaaactctatgcaccaaatatattcctctatcattatatttgccaaagatatgaaaaatagcattagttggacatggcaaatcagacttagtaaataatttctccttcaaattatcgagctcacaaaaatcatcaaactgaacatagcccaaagtatttaaagaagatagcaatttacgttcctcaacttcattagcaatgtgaataacatgcttaaaatcaacacacaaagaaacactagaaatagcatgttcattcactagttgtggcatggatataagtgaagcattatcacacaactcttctttatcacaaggaacatcgagtaaatcaacttgtgacaaaggaatactagcatttggttccactaacggttgctctactttagcatgaaaagtggacaaatttacttcgttaacaacgcactcaccttgattaatttcagtaccatttactttacctttgatgtcctcttctgatgatcgaggtgtctcgaacttgagtgtgaacaatggaattggtggctctttcatgtctctctcctccttttcgtgattacgcacttcctgcaaatggttagtaattggaggcaaagacatagcgtgtttctttttcatatcctcctctattttactttcagcattgcaagcaagttgtaacaaatgagaaagagatctatatttttcacaagcaagcatgtcctgaatttctttgttaagtccacgtaaaaacctcaattctgtagcttcttcgtattcatctaagccacagtgtaataaacaagcatgcatatcatgatagtatgaagtaataattttggtatcttgttttaaacattgcagtttgttgagcagaatatcagtataatacatgggaacataaacatctctgaaatatcgtttcaagtctttccaagattgtggcatttttttatgcctacaaagatgtttccaatcattagaatcatgtttaattaaaacactagaggcacacataaccttttgtttctcagacaagacatgctttataaattctctatcaaccgctagctcccaattaatgtaagcatgaggatcataatttccctcgaaataaggtagtgcagatttgatattacatagaacattgtcacttaccttataatcgtcatgttgatcactcctcatgtctcgacgaagatatcgatgttgagcacagctatccccaattatcttgcgtatccctgtcattgttagtagaaaagaagaaaacatacacaaaaatatgcgcgttcctattaattactaggtagtggcagctcaaaaatcacacacactcaagcttttaaccaagctcttacaagatcttaccaatgcaagcggaatggtgacatacaccgactcaaccaagcaccccaatggacgttggatgtatcgatgccttggcaaacacttgctgtacggctgcaatcacatctgtggagctctgggtaggcttaaatatgtagcaaaggaatagcaaatgctcaaatcagagaatgcaaagttgaatgatcattcaaagttaagtaccgtgctggtcctaggctagaatgtactagagacgcgagcctagacacaaacgataccacaaaatagcactagaaataactcaagcacactccgatatatcaaattaatctcaaatatacaactgatttttcttttccttctttcttcttcttctttcttttcatgttttttttcttttttcttttggtgcggctcttttttttttgtttttttatgcacctttctgcctttttttctccttttttttgattttttttaccaaacacaaactcaaggaccttattgtaagattacagggactcaaatgaaaatacaaaaattacagggactcaaatgaaaaagtcctaatccaaaattaaaattatacaaaaatggaatgctctcgtcccgtagattctgtttttgtaaacggatctccaatctgacactccaaaagttttcaccaagatgtctagcaactcacggtgcggactgaaaccgagagtagaggaaaggagtcggactttgtcatggtggtggtgggtgcggggtggaaggaaacggcaggtgttcggatttggtgcgcatgaaagagataagaagaaaggaaatatgatcttcagccgatccaatcaactatttccttcccgaaccaaacaaaactaatctaatctctaccttccatcttccgcacgccttccatcttcttcaagcgcatcagcacggccatgcaagatcacatacagaaccacggaacagagggcaaccacacggcataaatcctagatgcaacttaacaactccaaaaccaaccgacggaaacttctgaaaactacaaaaatagaactgtggcagcgagccgattctgttttcgtaggttccgacaacaacagagacaagggggcggcgacgactgtggtacaaaacgtgaccagagcttgaaactctaaacgaactagacgctaagaccagcaacacgacgtgacgatgcaacacaaaattcaacaaagcaaaaactgaaaagaacaatgcaatggtacaatatggctaggtaaatgatacgaattattttgtatggctattttctggttataggaagataaaaactcactgagcaacgaaagctctgataccacctaatggaccctgagttactctcgacactcaaggctgttgttggcccgatctttcgctgacttgatgataactacgatttgggagaaacgttgacgatccgactacaaccgtacaagacgttgtgttgcgccttagcgatcgatacacctctccgtgggttgttgatcttgccggtgcagatcaaccttattcttgcaagcaaatcgaagaaacaagcaagaacaagataaaagcaatccgaattgcaaataggaattaatacacacgataagttggggttccgaagaacaagcagacggacggtctagccgacacgcgcgctgcaagcaagtagcaatggctaaactttaatctatcaaaacccaagaaactctaaagggctacctagctatttaaggaggtgggaggtcctctaggtcgtcctccacctggttggggcgcaccccacatggtccccacttgggccggggtaccagacgaagttacaagcccataggcccattacaggtgtcgcagcacattgtttcttcagttgctgccgagtgagatggaatttggcaatgaggctggattcattggaaagaggactccgagagctttccatcaagtactcacgggccgaaaacggaggtcgtatgcagattcggcggccgtttgaagtcagcagtgtagcaggtggccgaatcggattccggcacttggaggactcaaacttgatatcttgttgttcatccatgatgtgagcaacggatgtatccgtagtagccatagtcacatcacctctatcattatattcgccaaagatatgaaaaatagcatttgttggacatggcaaatcaaacttagcaaataatttctcctccaaattattgagctcacaaaaaccatcgaactgaacatagccaaaagtatttaaagaagttatcaatttacgttcctcaacatcattagcaatgtgaacaacatgcttaaaatcagcacacaatgaaacactagaaatagcattttcattcactagttgtggtagggatataagtgaagcattatcaacaactcttctttatcacaaggaacagcaagtaaatcaacttgtgacaaaggcaaatcagaagtagtt

SEQ ID NO: 12012 - DNA, 25342 bp, Oryza sativa
gatggtgaagatgttgatgttgagcatgaccatcttgtttccccttgcacaatcctgccatggttagtagcaaacaaaaaacatacacaagaatatgcacactcctatcaactactaggtagtggcagctgaaatatcacacacactcaagcttttcaccaagctcttacaagttcttaccaaagcaagtggaatggtgacgtacactgactcaaccaagcaccccaatggagtttggatgtatcgatgccttggcaaacacttgctgtatggctacaatcaaatctgtggagctctaggtaggcttaaatatgtagcaaaggaatagcaaatgctcaatctagagaatgcaaagttgaatgatcgttcaaagtcaagtaccgtgctggtccaaggctagaacgtaatagagaagcgagtctagacacaaacggtaccacaagataacatcagaaacaactcaagcacactcttaatatatgaaaccaaactgatttttttttgccttctttctttctttgtttctcttattttttattttctttcttttctttttttttggtgcggcttttctttttctttttttatgcacctttctgccttttcttctctcatttttattttatttttttaacaaaaaccgactcaaggatcttaatgtaagattacacggactcaaatataaatactaaaattacagggactcaaatacgaaaatccaaacccaaaattagaactatacaaaaatgaaatgctctcgttgcataggttgcgtttttgcaaacagatcttcaatccgacgcacgaaaaattttcacccaagtgtatgggatgtcatggtatagccgtgagggagggagtctgactcagaaatctcggcctggtggtggtgggcggcaaaggaaggacacggcacacggagtccgaataaaaggaaaactctcatgcaaggaaaccgaatccggttcaaatagaaaccgatccaatctactaccaaaaaccgatctaatctactcttctccttccttcttcctcatgcacaacatcacatgcgcaccatcacggatacaaccacggcatagccaccgaacagaaaccttagatgcaactcaagaactcaaaaactaaccgacagaaacttctgaaaactacaaaaatagaaccgtggcagcaagccgattccgttttcgtaggtcccgacgacaatagatacatggaggcaacaacgactgtggtacaaaacgtgaccagaactcgaaactctaaacgaactagacgctaagaccagcaacacgacgtgacaatgcaacaaaaattcaacaaagcaaaaactgcatagaacaatgcaatggcacaaatatggctaggtaatgtatgaaatttttttttggctattttctggttctaggtaaaaatgaaaactcaccgagcaacgaaagctctgataccacctgatgaaccctgagtttctctcgacactcaaggctgttgttggcccggtctttcggtgagttgtaggtaactacgattagggagaaacgttgacgatccgactacaaccgtacgagacgttgtgttgcgccttagcgatcaatacacctctccgtggattgttgatcagcacttgaaggacttgattttgatatcatcttgttcatcgatgatgtgagcaattgttgtatccgtagtagccatggtcacatcaagctagctccaggaagaggccaagaaaactgatcattgatgatgatgatgaagactcggacgacataattcccaagagagatattttcaaattatttgagtgcaatattttagaggtggcatataatgagatttatttgatgcactcaaataagagagaggaatatatgaataaaattgaagatatagttgggaatatgggagggaaatggagggaatggaatacataagattttagccccaaatatgtggtagaaatctagagaattaattatgggctaaatgagattttgaatgacaaggatataatctatttccttagcacaagagcaattattcacaatgtttgtaataataccattcttgtgccgagaagggatcaagccgtaggaattaaactggcggttagatcaaaaggaggaatttggatatttggatcgagaatcaaaggataggtttaagattaaaggatgggttaacaattaattccaatggaattagaatttttggtggtttagattcaagggtaatatgggaaggtttctaggaccataattcataaaagggtttttaattgaattgaaatagaggaattttacaaaagaaggtttaaagtgaaaaatcgaatcaaagtaaataccttggtttaataagatcaattttagaataaaaaccacgaaagactttaaatagcaaagagagattctacgcaagttaatttttggaggtctctttaattatattttcctaggtttaaaaggttaataagaacataagaaccagcatgatgcttaattagaaaataagtaattttcaggatgttacattcaatatcttcactttgtcattcttggtatcatttggtgtaattatatcatttgagcattaacacctttgcaatccttgagacctatttttttcattcaactcaataaaattattagtcccaatgatctggttgtcaacctccacatgttaaccaaccgatcgcatgtataataggatatgaataaatgatgagtattaatcaacaccagaagtgtcatatactcaaatatatgctcaaatctaaagatctcaattaaatgaaagtgaataacttggatcgattacatgcataactaaagtataggatttgctccccctagatgtatgcatacaaaaatatttgtgtgaagcaagagtatacataacaagatattaaacattgagagcttatcctatacaagaatagaaggcatttatcaaatatagacattaaaataaaaacataccttcatcatctccatgttctcaatgtaaagagactaaacaagatatggctcaaacaaaacattagtctcacatgaaaatattatatatgaatatatcaatatgtgcatggagagaaagagtgatacatatagcttgatctccacgcatttcatccttataacaatattagtctcatgtaattgaatttgtcattaatcaccaaaaccaaactaatggcacttgaactttcagtaagcacttcaactggtagcttcctggaccataaaagcttcttaacacaactgttgcgatgacacccttcatatgaccaatgagaaaacagttgctcacttgtgaacaagtatgaagaaagacatcaagagcaattgtgtctaaatgaatattcattttgatgcaattcgataagagaaaaagtgagatttttttagataatggaataaaacatcctgacttttgctctaatagctacaaccaattattacaaggttcaaacaataaaaaccaaacaaggtaaagatcccacaactacagaattctattggtgaatctctatccaaagttggcaaagagctgcatgatcgtcgactcaagtttatgatacgcatcttttattagcttgatatgatcatcatgcctttgtagttgaggtgatctatcaaaaaccatttcatttctactaagccagagagcccaacaaacagtggaaggtccaacaaggataagttccttgatttttttaattaacaccaacaagccaattcccaaacatatgagatataatatgtggagggtataatccaaacgagaattgcataaatctccaaagaaatctagcaaaatggcaatgtaggaaaagatggtaaatcgattcatttttcatacaaaaccaacatctcaaactaccattccaattcctcctagccaaattgtcttctgttaaaacgatctcccggagatgatgcaagtgctcacaaatcttcacgaagtcaacaagaagcacccacacaatcttgaatccacaactctcacacacgcaccaaatccgaatcaaacccgcatggagagatggaaacaagaaagcatgaatctcaaatgatccaatcagtccagcagcactcccaaatggagagagtggactatttatagctacacctccagatctgcccattaaagcgcaaatcactcgaagtaaactaaaaagggagaatcgttctagcaaggactatacaaacccaatgtgtttacaagttcgaaattaaaagcgcaagataagttactcttcataaaaagggaggatggtctccgacacctccgacatcacgtccttgctcgtgtcgtctgcccccttggtcaagaccatgttgaggtcgatattagggtaggcaagcttgacgcaggcaagaatgtgacatgcgcctgtgcgcagtccggtgcaggtgtcctcggccaccttggcggcgtgcttcccagggatcttctccatcgccttgatgaggtcatacagagaagacaccagcatcgtctcgtcggagtgttttgggatgtcggcttcgatgccgagttcccccgcgagatgatgaaggagagtgaagttcttgtggacggcatcccgaattggctccaggtggtcccctaggtccaacatctgctgctccagcccgtgccgctgtgactcgttcccaacaacgagttccttcatcttctgaaggtcctcgtgtgctatgttgtcacaccctaaaaatcctaaatatataaattgttgtttaattggaattattagaatttattttaaaagcctagaagagaagatctaattttaattaataaattccaatatacaatggggccagataaaattttattaaatactttgcttaactctataattcctagatttttctgggatttatttgagctaaggaagtatttttaataaatggaattgcatttaatgaataatttaaattggaaaaggttttaaaagttttcttttggctttgggccgaaagtcggcccaaaaccttctctctctctctctccccggcccaagccggcccgcagccgcccgcccgcgcgcgcgctcgctgccgctgacaggtggggcccacctgtcaggcctgtcgtctacctccggccggccgccgcccgaaccctagcgccgcgccgccgtcgtctccttccaaattcagccgcccctttccttttccggtgaaatcaatagaggggaaatgatcttcgtgatccactctaccttttcccttttggaaacatcgtctaaatcgctttggaaattcgcggattcaatctcgaatcggattcatctctctctcccgaaccctaatctttccttcgcgtcgccggtcgccgtgggccttcgccgccgcgccctagcccctttttaagcacccccaagcccgccgctacccgtcgccaccctcgtcttcgtccgccgccgcccgtagcgccctagccccgtgtagcttcgcgccgccgtcgtcgccgccgctccagccgtgcgccgccgtcgctccagtcgtcgttgccgctcgggaaagccgccgtcgtgatggccaagccgtcgctgacctcgtccgcccctccgccgtcgctgtcgaccgccggaacaccgtcgccgtcgtcaagccgaaggtcgctgccgtttcttcctcatcgccggtgccgtccgttgctcctccgccgctactttggtcaccggtgagttcgccgtgccgtccgctacccgtaggtgctctccgttcgcgccgccgcgccgtcgttcgccggcgagcatgcacgcccgagccgccgccggtggcgatgtcactgctgacgtcatcgtcgtcgtcccccgtggcctggtcgtggaccgatggatcttggccgtccgttttggatggatggatctcggccgtccaatctcgtgaaccaccgccgtgcacctggtccttcgcgaaccctagccgctgacgcaataattccctttgtccttttcaaaaataattcattattgcgtcataattcaattaaaatccatataaatgatttaatccgatttaatctttgaaaattcataactaattcatcttagctcggatttagttggttcaagtctctaaatttttccaaaattgagatctacatgttaaaaataaccacatgtactgttcatgcttgtttgtgtgctgttttggtgattttgctcctttctgtttagattccgacgtttccggagagtccgtttttgcaggagaagaatttgaagagttccaaggccagcaatgcaagtcacacagatcccccaaacaaccctttgagcatgttgaacctgtttaaagctattgatttatttcaacttatgcattgttctcgaatgtcattgggtggtgagcctttcccatttaattatggccgaagatgactttattttcctatgggttataatttgactagcatggaccatatatattggattggttcagctagatgttatttatagttgcttagccgtgcttagaaacattagctcattaatgggataaatcatgcttcactatcacttatggatatttaatggaagctcacgatggtcaatcgtgattggttaattaattaatttgccaaataaaacttgataaaggtgggttgtgagcacatggttttgatggtcgtgctcatgacaattaaggaccggttcacgagtttcggttgtgaaacattaaccgtgccaaccacaagccagcatgggcaacggctttaccttttgtatagcatggatcattgcggggcaccagattgagaagtggcggagataagcccacgggggtcgctggggagtccatgccttgtttataagggagtgattatgatccaggaatggtgcgctgtggtggattgtgttgtgcgaagggtactgtcacgatttccccctttgtagtgccgtggtggtacttcggggcatggtaacatgtgcgggatcgtgtcttgtaggtacagtggtacacctctggccagagtaaaactattcgaatagccgtgcccgcggttatgggcgggtctaacaatgtctttcgtgattagtttcacacttctcaccataataaaagatgctataactggtaataatttgattagctcctggtttggaatggtatattcctggtttggagatagaactgtgcagccgggatggttgttcagaatggttgggcctatgcaacagggtatgttgtatagcgttggattaatattgtttaattattacttaactgttttattaaattctgaaatgtttattaaatgctgtttatgcaaatgaaaccctactatgccatcctttgttatcctgtgcacttgcatatttgctgcgtggcttgctgagtatgtcatatactcaccttgcaatcattaatcagaggaagagttctacagtgatgctgatggtgtagaggattaggtgtagccctggtcaagctgcctgtggagtggagtcgtctgcgccgtttatcttatttttccgctgcttagatctttattgattgagaggaactatctacctctgtaatgacattttattcgcttattaattagagtaataattgtactctattatcaatttgttattgtgtgcctcagctgattcctggacgagggttcacacacatgtaaacgtttggaattttggatagaaattccgggcgtgacatatgtcgagttcctgctcgagttgcagctctcaagcgtcagcttcaaggagacgccggccctcagccaacatctcggcgcctgtctgtggggcagccagcgctggaggaggcgaaggcggaagggtgacaggtggaggggcgcgggctgcgacgaccactggcgccacgcttgttgcgacattgtcctctctgtgtgcggaggacgccggagaagccctatgaagacaaatatacaagttatcagaaagaccaagtcacgacaacacgaaaaccgagaacatagagtcaggacattccgcttacttgctcgcgactttcttcagcagcctaaaaaatcagtcaacgccttgattgtctagatattatgtttcttttcatacttagtgttgcatcagttaagtttgatctactaagtcgtgtttagaaccataacccctagcctgctttttgactgccaataagggtttcatcgaggtttcagccgatgagttatttggacattgcattggcttataaggattgcatataagttggatttagccgattgcaacaatgattttactgtttaatctaatcttgtggattttatgacatcggatctccagtcgatatattatttaaccttcggatcagtgcttattctatcatatcattgttagccgattggtttctactggattatattattgctttcttgcattatcatcagccgattgcctttgttatttatatcaagtatcagattctacatcaaacacatagccgatagcttaaaaccctatctctatcggctggtatcggcatctgctggaatcattccatcggcttgacagccgatcggcttattgatctgatgtttacatatcttgtcagttgcaggatcaaactgactggcacgcccgcatctcaataacctttggacctgcactggagctaagcagatctcccaggccggtgtgtgtttttcgcatcaacacaatggaaccctatcaaaccactcaagatatggcagccgatacacatggatctgttccttaggtctaagtccaaactgctcctctactaacttcgcaattctatcggcccaatcttctatattctgatgtgttttatattcttctggccgatattgttgatgtagctcgtcatgctgacactgatgtgcttgcccccccaagccgatactgttcttgttcttcagtctgccccctgagctggcttttctgattaattaattcatcaactgttaccttgatcaaattttgtaatgtatccgtgaaaactctagattgattaaacaatgcgagatgaaccgcttcatcaactgtatcttgaagtatttcaactatcggcttggggaattgagtcttctgaattggcccttcttgtgtcatgatgaaacattgaagacaacgcatttgaaaatcagctacaaactgctccatctattgcctctgttcctccattaaattctccactgtgaccatgatattggcattgacttcttaagacatgtaggtataaaattcgtggttctaccgggcgtaccaaaaagcgtgttgatgtgaaaaacacacactggcctgggagatctacttagctctagtgcagatccaaaatattgatgagatacgggcgtgccagtcagtttgatcctgcaaactgacaagatatgtaaacagcagatcaatgagccgatcggctgacaagccgatggagtaattccagtcgatgccgataccagtcgatagcaatagagttttgagctatcggctataattccgatgtagattctgacgcttgatgtaaataacaatgtcgaggcaatcgactgatgataatataatataacaataatataatccagtatagaccaatcggctaacaatgatatgataaaataagtattgatccgaaggttaaagcagacatcgactggaggtccgatgtcataaaatccacaagattagataaatcaatgaaatctttgttgtcatcggctaaatcaatgaaaccagagcgatccaagagatcgaagcgatgcagccgtgaacaacagcaatgtagccgatagattcaccaggtccagcggaacgtagtacttaccccttcgccggagatcaaactgaaccgatgcagccctctgtcaggtgtcaagttccaccggatgataagtaaaaacctcggtaaagagggtggcgatgcaccgagagtagttgtattgatcgagagatagtttacaatgacccatggggagatactaaacataaagtcattatttgacactaaacacactttcctaaagataaaaggaaactaacaaactcttcctaattaatagataacttgccatgccgcatcgtccttgaactcggtaacttctggataagcttcctttaatagattaatttccttaaccgaatatagcaggaatccaactattggcgatgtgataattctcttaagggcttaccaaatttcactgttaacataagcgtagtcgtgaatgacaacgtgaactcatttaagttgaagtcggggctactgtcatggttacggataaggcatatctcctatcctatgacttatgtaatatgcggatacggtacaccatcgaagatatgatctatttccgtatacgataaaggaaatcacaagataatatggaaaatatccttataggcaagtgactaatgacgtcttacttggaaagggttgggtttcttctatatcgcgtgtagtccgatgtccccgagttctacttggagactaagttgatccacggtataaaaggcgtaccccctggagggttcaaggcatcgaatctcaccggcagcatacccaccatagtctacgaagccggagcacgtgaagccaacttgccgggagatcttgtctaatcccacgactacgatctcgccggtatcatcggattcatctactcttattgtactatatagttttccatatcaatattatataaactgtactagggctatacctgataaggggcctgaactagcacaatccttattataatccttgtcttcttgtttgctagatgccatatcgcatagatcctcgtaccaatgtaccccaataccctatttatccggtctacgggtatctcccctcaatagtgctgacaatggatcaggtcatacgtgtacggaactgggctggtactcaattattttctgctccgtcattcgtcttcaatctgttcacccaggaaactcgtcgatctataaatgctctgttcacaccggtgctggtggatatggaccagatgcgcaaagctatggttgtgccaatcggcgttgtagtttcttccgtgaatcgagagaagagcgcattatgtggtgatcttatcgcgtagcaagccatagtttcgctatctcgggccggttgccaagaggccgacctatgttgttgggtttagataggctatgccattctgtggaatgttatgccatgagtggttccatacattattcagcaaaaaccaaatgtccaacaagagaaaaacagagatgttacttaatgcaaaggccataggtataccaaatttttattttatctaactagcaaaatattcatgcgttacaatgggcaaagccaaccgtgaatataacatgttatggcaaaacgtacgttggaaaataaaaggttgttgtgtgatgaggaaaatatagaatgtaagaggatattaagcatagaaaataggtccggacatatctgttttagcacaaatgaatcggaatttttcggttttggaccatagcatgtacagtcagcaaagtgttgacaattccatgccaaagcatgttttaccacctttacatgttcggatcaccatattacgctatcatgggaattggtacgttctcattccttccatgttgaacaatctcagagcgacatagaagccaaatgtagctcagacaaaaactttctataggcttgtgcaactaagtttaatgcttatacatggcagatgcccttatcttgcaaattcaatgcccatagatgtcttcctgctgtcatactccattgttttaacaggagaataacacggctctgagatgctaccacttgagtttcccaataatctgagtgagcgaataccctgaagtgtgccagtgtgttgttgtgacgccgtatctgccaattgccgaagtatgtctgccacatggctcattgctggcctgttctcactgtccataactaagcactggcttgctagacatgcgaattcgtatagcagttccatgttatcctcatgtagtatttctttatctatgtgatgatcaatgtttcccttcttcatagcatcttggaagagagaggcgaggctcacctcattggatagaggcttcctacgtgtcaagagctctagaagaagaatgccaaagctgtagacatcactcttatcagtcaactggaacgtcatgaggtattctggatctagataaccaattgttcccttcactacattaatattttcatcagccgctgccctaaatattgagcacccaaaatcagaaacttttgcagtaaatttgtcaccaataagtatgttggcagatttcacatccccatgaaaaataggatgatcaagtgaatgtaggtatgcaagtgcttcagcagactgggcagcgatttccagtcggatatctagtgttctagtggatgcatcgctttggccatgaatcaaatagtgtagggtcttattcggcacaaattcatatactagaacaggaacttcaaactgcagacaacaaccaagaagtttgacaatgtactcatgtctcactcgggagagtatgagcaactcttgtccgaattccatcctcctattcgcatcgattcccttgcatctctttattgccacaggattgttttctggatctagatcaaaacctttgtaaacagtaccctgaccgccctgaccgaggattgcgctctccctgaagttgtttgttgctaactcaatttcttctctgtcatacaacttaaatgaaacttgattctctaatttcatcatatcaagtaataattggcctccatgttgacgaaaatatgcatcccttttattcatgagatcttgtctaaccaatcgacgtttatacttgatccattctatgccaaggaaaattagaaggccaacaaccgttgaggaacaaattcctgatttttttagatcaaattagtaaattaagtaagcatcttcatatatatacaaacacacaaaacataattgtaatgcatttatacctatagccaacagtactccatgtgttagcactttctgacactgtccaactgaggcattgcctcgggtacccgcaggacaaatacattcgaacccaccaagagtattacgacaaatcccgtggcaattgttattcatgttctgatccgtgcactcatcaatatctacaattagtcattaaacagagagagagagagagtttaagtgaaaaatatatcatagcaaatatagaaaccaaaacaaacatgtatagactaacactttcatggtagcagttactccctgtagccctaaataagtgtagttttagccacttaagagaaccacatgaaaaaatatgctcatcttttcatgccgtggtctgtctgcataaatagatttttagaccgcatatgaaaatgagcctcgatttttaaaggcacgatcatttatggtccgcctacaacttatataggtcctcttatagaaaaataattatctagtagttgttaacaaacaaatttggtagcatctatgtcaagaaagaggatttgatcaaagcggagttggaggcggagatcaagttcggaaacaaagacggctggagttcagatcggctacggttaggatcggctgagtctgagtcgagctaaataagccgatatagccgattccaacaatacgacttgtgcgcgacatcgggtccaagttagtgtactgtcaacagtagtgaaaggtatattagtcttttaacctttttcttaatatgtgtttgactagttcaaactgcacttctttagagtaggaggaagcagtactactaaaaacaaagatatatatatatatatatatatatatatatatatatatatatatatatatatatatatatatatatcgacattctcttcacaagagatccaaactaatgcctgattcagtttcccaaaaatttttcccaaaaacatcacatcgaatctttggacacatgcatgaaccattaaataagattaaaagaaaaactaattgcacaattaggggggaaatcgcgagacgaatcttttgagcctaattagtctatgattatccataagtgctacagtaacccacatatcctaataacggattaattaggctcaaaagatttgtctcgcggtttccaggcgagttatgaaattagtttttttatttatgtccgaaaccttttccgatatccagtcaaatatccgatgtgacaccaacaaattttcttttcgctaactaaataggccctaattgggtgaacgagacaatggaactttttttgaaaggtccgtttaatttgaaccaaatcaaatagattgtgcgtctacaatgtgtagctaaataatactatgtaaaatctatttagagaggtatctcaattttgccttaactagcgacgccaacatagagaaacgtggagaagtccagctattacatggtaatacatgcatgcattttttttaatatacatgtacgtccttttcctcttcaaacaaagttttctctcaaattacttatccgatctacaatctgattacaccattgtgttcgttacaattaaatcttcacaacaatatcttacatgattatattacgatgaaaaaatatttatatttgtaaattacttttattatatatgtaagttacttttatcatatatataagttacttttagagttgactaaattacttcttagacatataaaagtaaatttaatagagtctaaaagtaatttaaatatattataaaagtaacttaaaacaaaacggaagtaattttgtcacgacattagaagtaaattcgtcgtagggataaaaatatgactttatctagaaattaaatttaatcagcacagatcaacacacataagtttaatattttttaaaagtaatttcaatgttaattggaagtaacttttgcatggttcaaaagtagctctctataaatctgtttaatcattgattgtctttttctttcatttttgtttttcatatagaatgagaaaagaagatactatcgtatttttcaagttgaaaggagatactagatggagtacaaactagctatcactagctgtgtagtcacatccaattaaaaaagacattcattaaagttactttcttttggttataagttacttctataatatatgcaaattacttttaggcttcattgaatttacttttacatgtataagaagtaatttagtgaaatttgaaagtaatttagatatattataaaagtaatttataattttttatcaaaatataatcatgtgtgatcttgttttaaagatttaattgttacaaacataatggtgcaatcggatcataaatcggatgagtagtttaatagaaaattgtatttgaaatataggttgataatgtctctcatagatgaactggtagctggtttagacaaactagttaccactagctgtgtagtcacgtccataatactaaggtgtccttttaacaaaatcaaatactacaaataagaaacaccataagtctaaattaattaattgctctgatcctcaattaaaacctaataatactctgtttgttgtttgattattacctaattaatcctatgttactgtccaaactaactaacacagcaactattttaattcctcaatcaagaaaagggaacattcaccttggcaactgctgggatcttctgggtgcaggtaaggatttccacggaatcccttggaacaattgcagatgtagcctagcccgcttggcgagtcaaagcactcactgtttctgctcctgcacgcataggactcgggactcgctcgcctcgcctgctcgcaggtctcgtttccgatggcccaatcaagcagcaaggggacctgcccgttgaaggtgtcgttgaacgccgacgaggtgacgtacgccggggtgaacctgaaccacgacgccgacgacttctccatgagcgccgcgtagctgcagcggctcacgttgtggatggccgtcgtgttgaagcggtcgtcgaaccagacgtagtagtactggagccccacggggatggacgtccggcagcatccgatgccggagcaggcgccgacgtcgtcgtcggtgacggtgaggttgccggcctgcagccggcacgtggccacgcacccggtggtcaggctgccgacgtcggcgtccacgttgtcgccgccgatgtaggcgagcgtgcggcacccgatggcggtgaacacgttgccggtgtgggagaacctgtacggcgacgaggtgaagtcgagcgcccaggtgttgttttcgggaccgtccatggcgccggtggccgggttgtagcagtaggaggagatgctcatcaggatcctggcctggccttccggcagcaagacgccgagcagctcgacgtcccagatgaagggcttgtacacgccgttgccggtgtcgttgcagctgatgttgaagccgtaggtgccgtggcccagggcgcagccgggggcatcgccgttgaggccgaacgggtaagggatgtcgacgtcgccgcatcttctccggcaggccggcggcggctgtggttgcgcgacggcgaaggagagccatgccgtagttgctacggcgcctaggaggcatagcagagccgttttcgtgtggatcgtcattattcatcggtactttgctattgaggaatggaaggaaaatggctagcttggtattcctgtattccaacacgaagatatactacttcatccgtcccacaatataagagattttgagttttttttgcttgcaacgtttgaccactcgttttatttaatttttttttgtaaatataaaaaacgaaaagttgtacttaaaataccgtagataataaagcaagtcacaaataaaataaataataatttcaaaaaattttgaataagacaagtggtcaaacgttacaagtaaaaactcaaaatcccttatattatgggacggagggagtacctccgatctataaagaatatagttttacactatttatgtccaacgtttaatcgtccgtcttatttgaacagtttttttattacttcctccgtttcacaatgtaagtcattctagcattttatatattcatgttgatgtctagattcattaacattaacatgaatgtggaaaatgttagaatgacttatattgtgaaacagagggagtagtattttttttgttgttattaaatgatcaaacataaatagtactttctatttgactaaattttttatatattttttcaaataaaacggaacgttaaacatggaaacccataactgcatttaaaatgatacggacagaggtagtatatgtattcatgtggtagatttatggttgtagcagctggtgcgacttgcagtgctagtacgaccggtacgtagtatcaataatatggtttagaataagtaatattggacacagtccagtctagcgattgaaaggccagtgattcgattttatataattctgcagtggacttgttctgcgtctgctttgtacctactccctccgtccaaaaagagcattccaatacaaatttagtgaggagtaaagatgatcaaaatgctcctcattatcgaaaaaattagtaatggtgataggtgggtacagggttttcgagagataaaacttctcgttttatatgctaagggtaggtaggatgatagaaattggtttcttttgggacaaaattcaaactccagaagttgagttttttttggacggagagagtaatatctcctgtaaaaggatgaaacacattgatccataattgtcaaagcatcgaagcaaaatgttcgagtctacgatctgattcgtgttcacatagttgactttgcgtgagcattgttgtacattttcttcgactaggcatcgaaatcaactgcctgcagtttgttcaatgaatgcaaaaaagtatgaaaggtatagttggatgccgtacgttatatcaataatatggtttacatactactatatatgggggaataagaacaaggatgtatattgctagtatagtagtatgtaattatgcatttctactcattgcatgatctaatctacttatatcatctcattgggtgtttttgtctatttatcaggacttgctattttctacgtcaaacttatattgttgctaaatttttctataaacttgataaaacctaaaaagtttgaaaaaaaaatcaaaacggcttataatatattataaaatgaaggaagtacatacaagcttgagcaccgttaattcctaaaatcaaagcaaacacaagcttaagttgagaaaacggaatgaaattataatattacaaaattaaggtaaaattagaattaaaattgaaattaggggtaagaacttccatatactgtgaatataagtgcacactgactagcaaatatcacaaaaatgtctataaataattggacatttacttctaatagtattacacatatctacaaagtctcatatttaaattcattatattttagccgtaacaaaaaaagttaaaaaatctgatagtgttaaggataaaaatctgtcagaattttatcttttttttacagctaaaacataatgaatttgaagataagatttcgcacgtaggtgtaatattattagaagtatgcgtctaatttttttaaaattttgtataacactataaaaaatgcccatgcgttgcaacgaggaggttatttgaattaccttattattatacggtttagctaaggtgaaattcaccgtggaaatttgcttggatttgtttttttataaaattatgagctaaaattaagagtttgatcgtctcaagttaccatttcttatacgactccttctgtatttagagaacgaacttaaaaccatctcaagcatggatttgtatttccaaaagcgagtgaatttaaaaccgactcaaacacagatgacatatcaaagtaccaacaaaaacatctttaatttttataatagtaaagatttatataaaaaatttgaataaaaagaacggtgaaagaatcaacagtgtcatatattaaaaaacgaggcagtaagaaccaaaaatatatttttttctccatgtaaagaattcatctgacgattgccctataaacaaaaactcaagttgtctagatggcaggaaaactaaataatttgttctatgcgtatccatctaatacacgatgagtagatcttgtcgttgctgctggcaggtgcatgccttggtggttcgcctcgccacgactgaaccatcggcctcaggccttggagcgcacccggccgcttcctagctgctaatcaaaacgcagcctcaaccaactgcgctcgtcgacagtcgaacaatctgcaggtgtgtacttacgatactcttgcgtatagtactccctccgtttcaaaatatttgataccattgactttttggcacatatttaaccgttcgtcttattcaaaaacttttgtgaaatatgtaaaattatatgtctacataaaaatatatttaacaatgaatcaaattataggaaaataattaataattacttaaatttttttaataagacgaacgattaaacgtgtgctaaaaagtcaacggcgtcaaacatttcgaaacagagggagtatatctgtgtgtgtgtatatagttatagtatatacatagatcggcgggctctaattcaggcgattcggaacgtaaatgaaccggattttgcaccactgcgtggaaacgtgatctcatccatcgtgcatcgttgcgtagcttgtgagagctggggaatcggacaacgcctgactgaaaccaaattgaacttataggactgcggttgaaaaaaaaccaggagaaaatggaggtgtggggaggccgtgtggaagtcgggcgacttaccaaagcatgaggcaaaaacatcttcaatttttataatagtaaagatttactagttggtgtgtacggaaagcttgtgtcactactggagaaaccatattttgtcggtcgtccaaaaaatacaatagtctcggttcgaatagtaaccgggactaaagatcatttttagtcctggttaaaaaaattttgatctttagtcccggttggtgtttttagtcccggttcaaagaagttaccagatctagttaggccccaattaactttagatataccccaaccgggaacaacaaaaatcctcccgagccgcgcgcgcgccaagtccgagacttatcgatcccctccccttcctctctccctgtttaatatcggccttatccttctcatctcgatccaacaaccaagcgcatgcacttcccctctcctctcctcttcctcccccttcctctctcctgcccctccccacgaagttctctactagtactcttgctctctgggtcggcggcagctgggagggcgtggcggcggcggccgccaggcgggcacggtggcggctgggtgggagcggcggcggccgggagggcgcggcggcggcggccgccgggcgggcgcagtggcggctggcgggtgggagtggcggcatatgcatgcatggaggccgaccggagatttgtcctttttttttaagaatttgtgattcattgtattgattgagatgaagaatttgtgattcatttgatggattgagatgtataatttcttttttttagaatctgccatccattgcatggatctgtgatgtatttaatttgtggtatttggaatattagtttgatttggggatatgcattcctctggatttgggagaaaatcactagaaaaaaaaacaatgaaaaaaatagaaactaaccggattgccgctgcccctaggagtcatctttagtcccggattcgtagtgccggttggaaaaccagaactaaaaaggggttcccaaccaggactataaaagattctccagtagtgtgtatatataggatatatatacgaccccgtatattggccattggagtgcaaagtctgaaagatcagatattgttacgtggttgtgacctgagaagtttaagcaaaatagacaaaagtcgatcttgtgagatcagatgtacacgtgatgctttgaatggcaaaaagttactaccacatctatatctatccccgtcaacgcagccgtcataccataactatcgatcgtctacaacagtccaagatgtgaggcctaaaatattgacgagccgcaagtactgattagagaagctgcacgagatatatagcagaggttaaataatttgatctcaactggcaataacgagatatagacaacggtaggatgatataggctttttacttaataactaggaagaaagcctgcgcacatacgggaaatttatttactgtttataaaaaaaactaaatgaagctttgcctcgctatatttactataaagaatgctccctctgtcaaaaaaaaaaatactcacttctatgtttgaatctggtcatatgtatccatattcaaattcaaaagtgggtttttttgacgggggagtaaaccataaatgttgacatactaaataatatgaatatctatcatatccaaacaaaaatctttttgttctcactcatcaccactacttactatcattgtcttaaaatatgaaggtctttttaattgatagaattatatatgtaccaaaaaataaacccaatgcatcattaataccaaaaaaggttcatctctacctcattccaaataacatgacttacaggtatccaaatctatatataaatatttaaatataccgcttctaccaattaacaggatgaaatcattaaacttatatatgaatgcctctctaaaagtcgggtgaagccgattgtagccgttaagattttttctttgatgcctttattcttgggttccgcattgatatagtcgagctcctaaagataagcgtagagtataattttataacggattgtattggtaagtaggtcagttgagatccatgcttggcatcatttagggtgtgagtgaaagaagatggagatgatgaaaatagttttttttttatgtctttgagtcgatttattgtatagagtagacataatttattttctcttttaaaaattagctcggttgatcattcgactctactttaaatttaatagcttcagtcaatggtgaggaccacgtaaaaaatatttgctcaaactgtgatctttgctaacatatgagttaatacaagtttttatttttttattatattatacatctatttcaccaatgcttgttcgaaggaatatttgtccatcatgtatgtaagtgtatccatagagtgcatctgcacgcatttagacgagctcatattattgctttttacatcgttagtaaaaaaaatacttcaagtaaattgacgagaagagggtagagcaacgggtggcatgaggcggcgtcatggcatgtcttctctttccatatcgctaggagttttcgctatgcatatgatcaatttgggaaaaaccttatagttggaaagaggaagaaaacttctagatgggacagatcatatactatttttttttcttttttatctattgtgcacgtatgtaggagttgtgtatgtatataagtacagcttggatagtttttagggcaaaggtattactgtcatatatctaatttaatggttgaaaataatggatcgccgattttgagtgtaaatagatgttttgcttttttaataactttttctagattctatctaattagagcatcacgtgacatcttatgagcgtctataggagtgtaggaatgctattacgcatagtcgcaatctaattgtagtaactattattttcggtggattggttgcatcctctttgacagttacgtagttagtattgctttttatcttcggtgcctgatgagacacatgctcattagatctcagctaatcgttatatgcactgtgcacagagacctcataagtaatatgacttggcgattagtgaatatggcttgtatataaaacttacatatatggtatatgggatcaatgaggatatacgattgatattttaggctagaattgaccaagtatattgtacagtacatattgtgttggtatctaagtaataagtaataagtttaagagtgtgttctaaaatgcttctgggattagttactcccttattcggtataataaaaaattaacaaataaataatattattactttttaaatcataacattaaaattattaatagtatacttaataaaaaaaactttccttatttttatgaatagtgtagatggttagtgcactaatatttgccaagtttatattatatttttggtaatttttttaattattaagtatttgattggtagagtgtaattataataatttagtaatattattcttatataacagtattttcttatagtagggagtaatttttttaatgttactcataactggagttgtttttatttttcaaaatgcatttctaatttaacaatacatgttattaagtgatatacaattatataattatataatgtatattatccacttatttagatattttataaatattttgatgacgtgcgtatagtacaatacaactcaaaataacttatatttgtacaactatgggctgaagcctggaattattaatgtggtttttatctcatgtgcaacgtacatactccgaactatatgggctgaaatatgaattttatttttctcatcatgtgctcgtgaaaaagaaaaataaaaagaagacatggggcccacgtacaaaatatgtacgtacttgacgtacgtacacgtacgtgccatgtgtggctttttaaagataataaatctaattgacatttttatgctatatctaatggttaaaaataatattgggtccaccagattaaataaaaaccacggccagatgttttgcttttttttataattcttctaatttattagagaactacgtggcggtataggagcatttgtatgggtgccacgtgacggacttttagtatataataactaggaaggtagcccgcgcaaatacgcgggcaccttattgaacagtgtttgaaattttgtgatgaatgtttatgtataggattttttttatactcttctaaatctatatttatcaatatttttttggattgttttggaagtttgtttcgatcactggacgtacgagcgtgcgttaagagggaacatgtttctggatatttgtctatatgcatatgtaactatagaggtaagttggaccgatgggaacgtcagatcctttgaggggggtgtcttagacatcctagtgcaattaggatgtggtctatgtttttttattgaaaggatttgatatgtgttgtccataagcattgtgtgcacatgattagtagtactatcttgctatttaagcaagagtgtagccaacttgtaaggcattatccctccaaccatatcatttttgggttgactattttatgcgaagcgagaatgaaagtgtaagtggggtaatatttataagtaagcgtgccaattggatggaggctgggctgccttgttctgaagaatgggctgttacaaattgtaaactaaaattacttgcatcatgtcgtcttaaatttatgagaaaaatatgtcacaataatggagctggttcatatgaaaatattatttttatactacatgtttttatttttaaaaatatttagcatcttagtttaaacttttaattaatattttttcttgtatacaaaatatgcctttgtagattttacgatatattaatataagaatttttctattaaaaatatgataatatgacttctttatctaattaaacaaatactcatgtacttctatttacttctactacctccatccataaatcgaaggatttaaattttatatcctaaaatataaggaattattaatactactcgttccatctggtcattcttcatttaatttttatccaacattactctaaccattttctaactctctacataccccttatttaatgagccttatttaatcatgggtatcatagtatttttttcattcctccttgatttctactccctccgtaccagaatataagaagttatagagttggatacaattattaagaaagtaagtagaattaatagggagatgttatgttgggttgagaaatgaaggaaggtgagaaaagtgaaaggcggagaattgtgattggttgggacgtgaatgttggtggtaatgtaccgtaagtgctaaaagttgttatatttcgggatggagggggtataaaattttaagatccattataagacggagatatatagtaataaaaaagagcttcattcatagacggattcatttgtaccttatagattgatttagcttaaatagacccggtatacaagttgggaaatataattaagttggt

SEQ ID NO: 12013 - DNA, 11218 bp, Oryza sativa
tccgtgagcagggaactggaaacatgtgctgtacatacgcactctgacggcctctgacggcctgatcgatcagtaggtgtttttaatatatagatctaatagtttaaaataaggtagatcagtttgggtaagatgacttcagctcaataatgcatactcctgccatagttactacaatgtagccagttgagatccatgcttggcaccctttagggtatgagtgagagaaaatagagttgatgaaaatagtttttttatgtcttgagttgatttattatatagagtatatatagtttgtttatggtgttaatcgatactactaaattttagtggtatatatataagtttctcttttaaaaattagcagggttgatcattggactctacttcgaaaaatctaatagcttcgatggtgaggaccacgtaaaattttttttctcaaactgtgatcttttgcaaacatacaagttaatataagtttttatttttttcgtgtattatacatctaattcaccaattcatgtttgtggggattaatatttgatgaaatttattaaaattatttgtgcaaaatgttaacactattttgatggggacgacataaaaaaaagagataaatgtagttacatgtttgtttttttctagcgtagtagtttctagtatggacgtttgtttttttttcttttcggataaatatttgtctatcatagaaattgggtttgcgaatttgtattcatgatgtgcgtccgcatgcatttatgtgagctcatgtgattgccttttaaattgttagtaaaaaagtatttttaaaaatttgatgggaagagggtggcatgagactgtgccatggcaaggagtgatcactacatatatgctcaatttagaaaaacaccttaatccggaaagaaagggaaaacaaccatatgagacaaatcatatacacactcttctttttttttcttttttatatatctgcataggtatgtacataggagctgtgtatgtacgtaagaagggattagatggtttttagacagagggattattattatagatctaatttaatggtagctgtgtatgtacgtaagaagggattagatggtttttagacagagggattattattatagatctaatttaatggttgaaaaataatggatcaccgattttgagtgtaaatcgatgaatagttatttttattttattttacagtttttcttagattagttctaattagagcatcacatgacatcttagaagtgtttgtaggagtatagaaatactattactcatagtcacaatctacctgtagtcaagtattgtttgcgatggattggttgcatcctctacttacctataatttgttgatcattacacacttagaattgctctttatcttcggtgtttgatgacatacatgctcattgctcattagatattagctaaccggccgttaggtgcattgtgcatgaacaccccgtaagtaatatgacttggtgattagtaaatagtgacttatatatataacttgcatatatagggatcagtgaggatatacgattgatattttaggctaggattgaccaagtatattgcataatacatattaagtttttaatacataagtaataaatttaagacaatgttgtaaagtgcttataggatcagctactccctatttatttggttgaaattatttatttggtttttatctcatgggagtgaaaaagaaaaagaaaaaataaaagaaagggagggggggagggcgtacactaacgaagtatacgcacatgagcgtacaagtacacgagcgatcgatcaacgtggacgtgtggctttctgaattctaaagatgaattaaatatatttggtatttttagatataacggttaaaaatataggtccaccagattaaatgaaaattaatggctagatgttttaaacgccacttggcagtctaggagcgtttgtagagatgccatgtggcggcttaggagcgattatagtaagtttaattgacttttagtatataatagatagatagatttacggagttgctagaaatatggcgccatatactacagtcgattttttttcagccacttacacattagttacacctcatttacaccccacttacatatgtaattagtacgtaatttttgaatttacatatgtaatttttgacttacatatgtaattttgagacttacattataaatacactaaaattacatatgtaatttagggacttacaatgtaaatacatgccgactattttttgatgaaaaatatggtgccataaatatagctacaccctagatttataagcggcctacttattagttaacttgatactttcaattttactgtagttaacgcagtatgagagctgctagatgacggtataccattataaaacggtatactttctaattttgataagaaagcaagacgtgcgctcatccgcatatgactcctctcacggcaataacagcagtgcagcaccttcacgcgttgcctacctaggtctcttacagtgctcctagctggcgcgtgatctcgttgtgccacggcggattcgcgtcaacatggagcgggcgaccgcgcctcagctaggtttctcggcccctaagtgagcgacgcagaacctcgccaaaacgagggtgcacagcaaagagaagacgcgggtcgcgcacgctgtgggcagcgtagccttgcgctcgcgtgccctagcacccaaaatctcctcccaccgcagcaaaatccctgattcgccctcctgaaatcccctcccgccacagcattatttctcccaccacagatcagattggaagagaaaaggcaagaaaatcttggggattggaaaagaagaacaaatcagattcaacaagataaaaaagaaaaagaaagcaaaaccatcatagaaaaatacgacgactgggtcatgctcgactccgacaaccccgcctgctccgactccgatgacgaggaggacgacaatgaggtggggagcgacgctgacggtgcggcaaccactggcgccggcgcctcccggggacgcctccctcacacgtcagttgccgcggcgtcagcgctgctcatgtccactagcgccaccgccgacttcgcctccccagcccgcgcacgtactgatgaggagaggagtcctccagtgcgcgtcggtcaccgcggcgtcggcacctcacctccccggtgtcccccctcaccgccatagcatgtagtgggtgcggcgctggcggcgcggtcgacggcaaggcgaggcgcagggcggcggtgtcccaggcgtcccccgcgagggaggagagcacgacaaagaaggaggagacagtgaaggggaggagaagcgagcggcgcggtcgacagcgaggcgaggcgcacggcggtggcatcccccgcgtgctgccgcggcgtgggaggcgaggaggcgtggcggcgtgggaggagaggaggagccgcggtggtgcgggagagaggagaaggaggcggtcgtgccgaggagaggtgcaggaatactcttgcgagtagtaggtgaggaccacgctgaagggtagttgagagaaataaatttcgttccgctctgtagtaacgcgcctagggtcacgcccactgtgggcttgataccctttaccagtgcctccatccaattaaccacacatatatgggtgcttacactatggggtgggtgtctttgggtcaactttttaggctaggggtatgggtcccatagcttgcactgtgagaggccttaggctgtacctacactactccgtgcataagcacagccatgaagaacctgctagagtttatcagttcaccaactagtctgatgagacctgctagagctgtcttttgatgggccatatacctcatcctacatgtatcatacttgttgatatatatatatcttgcaaatatcgtcactcaccactaccttttaatgtatagtcactcgttgatacctgcaagtatcatcaccggtacctagcaggtaatatacactcatacttggtaggtactatcatcgatacatacatgtatcatcattagtacctgataggtaccatcactaaacagggagtttcatcattggtacttagtatcatcgtactataagtatcattgttagtaccttaaaaatatcatcactgaacagcatgcaaatatcaacatgcaaaaaaagaataacaacatcaacaacatcctagaagcagcgcctcgatggttgtcgtcgttgcaggaggtcatcgctagattcaggcacgccatcatcggatctgcctccaccgccgcttcctttcttgaccaccaccaccatggcgcgctcctcaacgagctcctcctgccagtgtggatgaagatcggaacaatctcagttctggccaggaaatgatggtcgcagtcgatgccctgtcgcaactatcaccgacacagtagcacctgaggcaagccatagacggatccaatagtgaggctattggatatgggaccacgatgccgagccccacagccaccgcagctactaagttccaccgccgacaagccccccgcagccaccaagctcggtcgtcgagccagcacctgccgctgttgaaccccgccaccactagcttgtatgcatggtaggtagagggaatgaaggacgtggtagtgcgtgaggataggtttgaaacttttggctgggagaggatggtattgaggtactttagaaagatgggggcatggggctagctgcctgcatagctgggtggtgcacttttaatatagcgatttttctttgtgcgggtggttctctttagcagctgtctaaaaagtttacgtagtctacttgcgtatgtgaaaaattggtttttcgataaaaatattcggtactaggaccataatacatatgatgaacaaaaattttgaaatgaggattactttactaaaatagctttgaatgcctcaagaaaaatataggggcgtcacagaagtcaactaaattcgcttaatcacaaaacaacccatgcatgtaagtttcgtggccccgtaacagtatagctgttcagctattccctgctcatgttgactgttccatttcatcatgatcctcatatgtacgctccatgataatccgccgccccccccccccaacccacgcgcgaaacccagccacatatggtcttttttattggatactccctctgtacctaaatataagaaattgtagtgagatatgacatattctagtacaacgaatctggacagaagcatgttcagattcattagcctaggatgtgttactagcttttaaccaaaatcctttatatttagggacggggtggggggagtactaaagtaatgaaatatcctattgatggtagaactcgtgggactagctaggacaacaggctggaagtgacaaacattcgataataatgtacattacatgctttctaacataaattctccattcttcagaacattgcagttccaattgttgttcccggttattcctgaccccaaagcaatgcccacccctccaattactccaatagcctagtcctttgtagattgtgatgggtagcaatttcactttcaaacactacctgtagataaatcaattatagacccatcaagaaggtccgtgtggttagaatccttgatgcttcccattctaagaatatatatgtaccgtcttgtgcacatatgacatgttctatcttctatttgaaatgctggctaatgaaatacgtgaccgctatttatagtctgttcaccccgagaagcggcattacctggtttgctgcagtactgttcattctttcgctcaactaccaaaaccaaaagatccctaccttgtagtggttttaggccatttatttatccaaaattgactccagtactctttgatacatgtttggcaagacatatgacttgcttttctactactcgtaaaagtttaaatacattctcgtaatcttggtataattttgcttaacgtagagaaatttttcttccaaatgcatcaaattaagttgatggccatgctgattgatcgatatcgatgtgacattatgaaatggatttggcctggttaaatactccaggcgagtgtccaaagcacatgaatttggtatcctcatccagactagtactagaacccaagagagaagaagtaagcaagtgggcggagaagtaagtgaaggaaaaagaaggcggcgcatggctgtttatatgcacggggcagtaaattgatgtgttgtgataattgaagccactctaggctttgttcttttgtgctaattggaaccttccgtttcagcaagggaaacggaaaagcacattaacatatgattaattaaaactaacttaaaaaatagattaagggggtgtttagatcagggcgtaaagttttgacgtgtcacgtcgggtattatataggatattcggacactaataaaaaaactaattacagaatctgtcagtaacagcgagatgaatttattaagcctaattaatctgtcattagtaaatatttactgtagcaccacattgtcaaatcatgaagcatttaggcttataagattcttcttgcaaattagtcgcaatctgtgtaattaattattttttagcctatatttaatactttatgcatgtgtttaaacgtttcatgtgacggggtgtaaaatttgtgtgtggaaccaaacagggcctaatataattttttaaagcaactttcctatatttttttttttgcaaaatacaccgtttgatagtttgaaaagcgtgcacacgaaaaacgacaagagggagttggaaccattccaaagaaagcaacctaaagagtcattcagtgcacaaatattgcccatgatgaaataagtattagagcaagtttaatagtataaccaactgctagcttcaattcatctataaccaatctaatagctcattcatacaatagttatatactatactattaatatctggccccacttaacatacacacagtgcatcttggagtccgtgctacagctggctataaatctgtagcccgttgttcttctctctccttatttatctctttaaaatatatttgtagctggcttatagcctgctattgtgtatgttcttagtagcaaaaaactttcacctttaggccttgtttaattcccaaaatttttttctcaaaaaacgtcataatcgaatctttgaacacatgcatggagcattaaatatacataaaaagaaaaactaattgcacagtttgtatggaaatcacgagacggattttctgagcctaattagtccatcattagccataagtactacaataacccacatatgctaatgacggattaattaggtttaataaattcgtctcgcgatttccaggcgagttatgaaattaattttttcattcgtgtccgaaaaccccttccgacatccggttaaacgtccgatgtgacacctaaaaatttttcttttcgcgaactaaacacacccttaagctgctaattcaatcagaatgaatcgtccgcttagctgagaatgaatcgtccgcttagctgtgtaggtactcaagcttgacagagttttgaaggcaatcctaaacactcgtgtgggagagccaaagctgtgcagaacaaaaggtgggagatgtgtagcaacgaagaatcagatagatgaacagaagtgagttcctctctgtttatcccgtaggtggataacgtctctgaattaatcgtgattgatcgatattcatgaacttgcctgttaccagagtaacgagagtaacgtaacagaaacgtgagtgtccatcggtttcgctttctcgtaaaaacagaaacgtgaagaaaacgagcggccaccctgccacgccccgaccagctctaggacgcgcgtgcgcgttgcattctcaccaccaactcaaccgctgaaaggtgctctcaattactccctccattctcttttgattttgatctacatattttgaaaaacagaaaattccatattgatcagcggattacaaaagagctcctgaaatctcgcgcgaagggcgacgcttcgtatcgctcgcctcgtttccatcaacgccgcgccacatgcagcacgccctctctggccgagttccaattcttaagcctcttcgtttactcccgcatgcagcacacctctctggccgcttgcgtcgcgctcgactccgctgctcgcgtcgagctcgccgccactgctcgccgccgccgctcgcatcgcgctcgcggtcatggctgacccgctcgcctcgcttgctcgcgccatggaggtggtgccagactcggagatggaggtagcgccggtctcgtcggaggtgttgctggactcggagtagtagttaatttaggctgtgtgtttgatacctggggttaggggttaggaacccaactctactgcacggaaaacggagtaatccattaacacttgattaattaagtactagctattcctttttcaaaaatgaattaatttgattttataaagcaactttcgtatagaaactttttaaaaaaaccgtatcatttagcagttttaaaagcgtgcgaacgaaaaacaagagagatgagttgggaacctcgtgaaacgaacgcagccatactgtgatactactctctccattccaaattgatctacatatttcataggtataccaagacaaaaaaaagctaataaatctctcatactatatttactctatcaacaaactcgatgcatgcaccatcctcactattttctagccaatagcaaatcaagatattgcatgtatgttataaatacttgtgtgcatggatgtatgcatcaatgttcatttactccaatacacaaataaggaatagacttaatgaatgaacacaaatatatagatcatttaggaataacctcaagaaaattatacgtagatcaatttggaatgcagggactatctcatttgttttcaaggtattattaatctcttaacataaataatgaggctttgaaattgctggaattaaactgggtccagtccttttaattctaacaaattaagtactagtatatttattagtaccttgctacacggagccattgctctggatctctcctctcaatttacatgtcaggctccccacaactcatccacccatcaaaattgattagttcaacgacatgaccaatcaggttggaatactgaaccgaggaagagtgtaagcgcagcagttactatgcatgcatagaggttgagccaatcttaagcatgtatagtatctaactgtacagactttttaatcctttcttcctctacgaattggaaagtaacttaagccgcaaagaaaggattttaaaagtaaagcaaaataagcgactagggaacaaaagtataccggtagctccaatatgcagaacaagtaactgcagtgaggagtgatttgctcactgggtttcacttgtgcaacgggagatgaccaaatatcgcgatcattccagatcatcagagcaactatatgttttcctgatgtcgctcatccctaattacctacctactccttaattagtgagtgcaccgtgtatgcatggagcttcactataaaaatagataaaggtgtgtaggtagactagatagtcaagatattgcaccgaaatcaactctggtaaacaaaatattttttttgaaaaaaaacaaagaaagtgggtcatgaatatatagtgcagtactacaaaatgaatgtggcaaggggtataagctattcctgctttgttttcttcagacggtgcgtgtgtctatatgtgtgtgtgtgttgggggggggggggggggtggtgtgtaagaaagtaagagcatatggtcacctatagaaaactaaaatgaactattgatcgatgaaatgttcattgaattgacttgatgaaacatacggcaaaatggcttcattgaattgacttgagcggcaccaactctactcaagggatgaaatgttctattaatcaacatatagggagtaaatgtatttgagaaagtttaataatgtagccaactacttactctaaaaattaaaatatcatatatagccagccaaatagctcactcattacaatagttagttgtaattatatattgcatcattaatacaactaatccacacatccctgtcacataatttattggagctagctcatgctgcagctgtctataaatttgcagcccgcttttattctctcatctcctgtctcatccacataagcacaaatatgatgtggtaacttgtacaacctatgtatatcaccctattgtactcgctctaataccgattagcagtgtttgtggcaagatgcaacctttttatgtgattgaacagcttttaataacattagattaatgggcaagggaccatcaattaaataattattagggtgccatttgacatatcaacatttaagttctacgacaacgggctcgttcgtttggtccaacggcttcatccaaagaaatttaatggtcatctctactttatgcactacagtacgattgacggcagctgggaagcaaagtactgtcgtgagccaacagagcaggaacggagcgaggaggcgccgttggatggacgttaggccgtcggtggagatgttgctgaggctgcttagcagctgttctgaggccgacgcactgctggtgggaatcacggcagtaatgaaggatgctaaaagctaatttatgcaagatacgaaatcaaatggagagattaacacaaaggtggtcgcattaatcataatagtctcgtacaggaaaattagacaaataaaacagtactacaaacacactgacttaacacatgcaggaacagacagatcatagaaacacacagactgctacataacatatccacaacagccatggctatgttatttattttaaacggtgcgccctaaaaaccaactagttgtaaacttcatcggcaatagcgtcgcggactgtattcattacttccgcactgttgggtgcatcgtaccagccgcgtagaggtggagcgtctgaaatgattgggtacccattgtacaatgggttttgtgtaaggaaatgagtgtcggagctgtcaatcctgaagttatggagagcgaaggcagaatgtataatcttggtatgatcgtcactcctagggaagtaaggtcattccctcaggattctctattggcttttgatgact

SEQ ID NO: 12014 - DNA, 1526 bp, Oryza sativa
agtggtacaaaaaatgtgggtatgatggtaggaatccataccggcttgcatatcctgagtccacaagaaaatatttccctgcaccaaaaaataacaaactcatttttttttgtgaaaatagatagtcagctttgcatttgtgtaagattaaatttaaaacttaccccatggtagccttgggaaagcaaagggatagctccgtactgcttctgtcagtactctttggtcatgcacagaccctggccatccagcatctgcaaaaatgacacggtcgtcccatccaacaacaaaaagaacattcctagaagtaatgtggtgacagttcctatgttgaatggaatcatccactaccacaatgcaaggaatgtgtgttccatccactgcaccagccgcaccagcaaatggcagaaattcttcctcattaacaacacgataatgaactctctcaaagtttggatctaccggcttatttttgtcagcagccattgcataaatagcattaagtactctatgaaagtacttagagatagtagacccagatcgcaccatcctattattagtcgccctatttgaattgccccccgccatgatgtacagaaatattccaagtgcttccattaggcatacctcaattgatccatgcagattgtaccgattagtaagtaccccaaacagagcatggatttgatcaggcatcagacggaaaattgcttggcattggatgggtttgccattgtctccatcatccattccattccagattgttgcggttcctgttgcggttcccgacgtgctgccctcacacttagccttgccttcaaagccgcaaccaacatgtccagaatggagtcctcttcatcactgtagtagccatcgtcagaaccatatgacctttctgacgaagtgctcatgtttcctacatcaacagataacaaagtaatatcatggtacagttagcaccctatgtgctgaaaagaagcaatgcatctaactagggataaatagaattgtcagtttacagatatcttagtttagtttattaaattcctgcaaacaaaatatccaggggttaacatatcgaatgtattagtgcaatggttagttcaatttagtatagtcctgcaaaacaagaaagttattgagataagtaacatattagtcgaaacgttagatcaaagtattagaacatattaaagcaactaacatattagtccaaacgttagatcaaagtatcaaaggcctgcaagaaaggcagggattaatgtatagaacatattaaagcaatggtactgtaaatgtagttagggtaacaataaaaaattacctacttctacaaaatacaggaagtgaacagagggcatataaatttcagctgaacttaatttattcaagcacacaagctcatagttctaattaatggtgccgaaattgttcatgaaacacacaacttaattaaggcctacaacaagaacgatgcccgatatgaatcagaacaagttattaaacaaacatcacagcggaattaa

SEQ ID NO: 12015 - DNA, 10535 bp, Oryza sativa
gcagtggagcaaacagcagagggtctggagcgaatgctggagggtagggtagtccaccatgctggtggatgaagttgaggcgctcctccggtgtgatgcagtccttaatgaagaaatcgcgcaggtacccatcacgaaacatcctcagggctgtgtggtatatgggatcctgcctagtaatcccatcagccttgagcatctccatgcatgctctagcgctcttcgcttgcttctgctcctccctccttgcccaactttcgttggactggaccctcaggtccgcaagcctgttcagtgcatccctggtggagtcgctccttgtcctcttgctacttccacctgaagagtaccccggcgccatgattctcttgccccttctgcgcggtcctgaagatggctccggagagggtggtaggagtgccaggttggtgaggtcatcaacatcgaggatctgagcatcttgtggcacctatggtgctgccggcctatgccgaacaacacccgacctgttcagcatgacagtcctaccaccatacaccgcgtgatgctctggaatgaacttcagaggtccatgcctgaacacacgggcacctctcctcatctgcaacaagaacaaaacaattactctttcaatatgaagggaagaaatacaaacagggcatgcagaaatgtcataaatacaagcagtagacatagccagtgcactgggcagaaaaaaaaaatcaatcacagatgatgtgtgcagttatatgtactcataaaatgagttttctgccattatttcataagccctagacagaagaacttgcagattggttgtacaatttcataaatagcagcaggtctgacatgtgcatgtaaaatcagttaactccatctatcagattagcaaattgtttggcacatgtattaacttccaatagtacaacaaaaggcaagatcaactagcaagcatgtactaatgaatttagcttgccttaagtttacagatatccactaatctaaataggtacaaatacatatgtactatcgtatattacacattcaggtaaggcaatcaatcacctagcattcatatttgcaaggcagtaggttttgtaaagttctgatgtaatttaaccaacatgtgaggcaaagcagatgtaatatcaaggaagtggaaaaatgagtaattaaataagcagccttctacaaaaataggacaatgtaaatcacatcgatcataccatgagtaaaaacactcggtgactattgaccttacaattagcaaaatacaatttgggccttgatgctaaacttttcaacagctgtgctggcaaatgaggatgccatttctcacgagagaaagttaggtgatacatgacacgaaaagattagtaggtcgaaacaaacgttaatgcgcacagattaagcctctgataaaaaacctatgacctctgtgagcatgattttggatgagtaggatacgtaataattatttaaacctttttatgccatttgtgaccaccacatgattttggatgagtaggatacgtatacgcataaatagccactcaaacctcaatatgttcatgatcacaacttaataccattcaatataaaatccgtaatgccgaataatgagcaaaggagatattgcctagacttagcatgccagtcaactttagcctcagtcaaaccacacgatggcagcgaccaagactgtgttcttttcctcacttttccaacttccctcgttttctgcgcgcacgcttttcaaactactaaacggtgtattttttgtaaaacttttctatatgaaacttgctttaaaaaatcatattaatccatttttttaagttttttaggctaatacttaattaatctcactataatcgcgtgctttgtttttcatgtagagaggcaaggttcctgagcgcagcccaaatgtgttacacatcccaggagacttgactcaaattgcttaagctctacaatatctcaattgctcaaaattcttactcatgctcagctatccctaggaagaagttgctagctttgcattttcatctaagccatgttatcaaggtaaagtacataaaagatgacttagatataaatagagacaaagaactagattacttacgtacgaccgacagggcagataaatatcgattcgcggaagcttggctacccaatccacaagcaaaccactaggggtagaccccatttagaatcaagccctaagtaaagcaacagtcccgaacactcaatttaactaagtctatacttgcaaaacaaaattaaacatatacatagcaagagtcagtacattaatcgaattaatgtactagcaatcacaaatcaatcctaacaaactacatgcaaggcttgcaagcaaagagggctatatgtagctcaatttagcataatagcaggttttatttcacaagcactagcaactccgatttcgaaatttttgtgttaaagcgaggacgaagaatgcagtgagttgcagtgctaggtgttaatgagatggatccaataccatttacgggccctgggcgtcacagcatcactactgcataatcacttttttcggacaagatcccttccaggctataggcgggccataactgtccccacatgcaaaaatctcttccctgaggatggttcatgggccagtaggcagctgcttaagaggcccactgttagcgaccaaatttggtaagacatgagccagattcggtattggaatcaaagtagattcggcaaagagttcgattcgaagaacagagtgtgcatcggctgtgaaggcatcagttggagtctgcattgactgagatggatcgaacagaggacagccgatacagccgattctaatgaaacaacttctagaatcgatcaacgtgcaacacaagaattgccacgatggagataagctctcagaaagacaattgtatatattaattagtatattttatgtaatttccttagagatatgtttgggtaaaagtctgccgtaaagacttatgtgtatcttagagtttgttagagataagagtcgtgtccggcaaggacatatcatgtatctcgggtataaatataacccgatcccatgtaatttacaacaacagtccaataacactttcggcacatcgccaacctttttactttcgttctatttcggcgagttcttcctttcaactagaggtaaacttgtcatgacggcttgcgttctcgggattagtgcttccatctttatgacactctaatcttgtttatgtaattcgtcaagttatcatatacacttcataatatttattagttgcattatataacttgttattggctagtttttactgttagaaagtagcggatagagttagatctcgttattggtttagattatatcgtgtatctaccatgtcttagaggttttcattatcttgtttagatcttacaattatctttatggttaatgatgcatcggttgagttcgatctattaaattctatctataattgtgatatctagcctatttcatgatcatcattagagatattgtcggagtttcagccgatcttacctgatttagctactttatatcatgtatgcttgattgttatgctaaatatgccctttatattaagatcttgttgcattaaggtatattacactttatgcttaatatattttgtctgtttctatatcttaatatagagtggtattagagtattagccgatacatgctagatctatctgattggctatgttataaacgttcacataatcatgatcttaatgcatctttagacttaagtgatttatactgtttcgacatggcgttcgatctatatcccaatcacttagtttaagtatacatcgagagaaagattatatatcgttaatatctacagctgatcgagtagatttagttttatattactttattcatcgttgccgatctaatgtcaataacatcggctcgacgattgacaatatgtcatcggctctcagccgatcggctatcatttatggatttaacctcgttttcttgtcttttattcttgttgattgcaggatcaaatcaactggcatgctcacgaacttaaaagcaagattttggacctgcacaggagttaagtagatcttccaggccagtgtgtgtttttcgcattaacacccacctgcggtaataggtgcatgccaggtcaacggggcatcgtgaagggtgcttggctagcaagatccagttggcactttaagcggtggctcaatgccgatgacttggagtgtgtttgtagtggtggctactattgggaagatggtgtcctaattgtgtggaccatggcacgtagaaggagcatagaccatgcagcacctatgaagatagatctacgtgacacctcccatgagtaatcatgcatttagtcagcttttgcctgtacgcctaatcggtgctcgggtgtggtctatacggaggccacatcttgctagttgttagcatgaagtggcatcgggtcaagacgagctagccgatgacagagtggtgtggtagctgcttgttgcaaagttgttgaggcattggcaccgggcaaggcccgtgcgaaaggtatatacctagcactgaggcgaaggcactattgaaaacttgttgctgcattagatccttccatcttgtcggatttgtctcctttctccaaatctagcctatgaggagaattatggtgttctagtggctgtggaagtgtttctttgcgctgttgcctagtttgcggcgtggggtcgtgcggtattttcagttggctttgagtggaagactttcttagctttgaatggtacgagcgatgactacattcttgagtgttgtttgtcttcttaaaggcgttgccattggtgtcctatctcccatgtcctgacccttgtgatcttcaatgtgaaaatctaaatgtgagttgtcgaattgagtggtggagctagtcttgcctgtatgtcttccttggatgactgttttggcgttcctacctcatattgggcatccaccagtttaggaccaatggtgattagattgagatgtgttggttgattttgtcgacttgagtcgataaggattaggaaaagaactaaaccaccggtttccttatcctaacaagaaacaaactaagagataaattcgttttttgtgtgattggtacagaaaacagaatcctaaactaattgagataacccccgagccccaccagtgtcgcttatataaagaaagagaaggagggaggctgggtgacgatctgatttctctctaacctcaaaccctaaaattaatcgcccgatcgattagacactggaaggggttcgtgaggttttctctgtgcttcctttccatcaacagagaagaagaagaaagaacagaagaattggcaaagcttatggcttcagttcatccggtcagtaatcatctcaattccgcacttagaattggtgatcatgtgttaagctaagcaaattagatcctgagaattaaatctaacattgtggtatcatagcaattgcttagccacatgttcccatcatggtcacaccctgaaaattcaaaatttaaattgttgtttagttggaattttttagaaataattttaaaagtcttgaaaagaaaatctaatcttaattaataaattccaatataaaatggggccagataaaatttcattaaatactttgcttaattctataattcctagatttttctgggatttatttgagctaaggaagtatttttaataaatggaattgcatttaaggaataatttaaattgaaaaaggttttaaaaagtctcttttggctttgggccgaaagtcggcccaaaaccgctctctctctcctcggcccagttcggcccagtccgcagccgtcgcgcgcgcgcgttcggacgctgacaggtgggtcccacctgtcggacccatcgtctaccttcggccgccgccgcccgaaaccctagcgcgccgccgccgccgttcctttccaaatccggccgttcctttccttctccggtcgaatcaaaagagggaaaacaatctccgggatctcctctaccttttctcctttggaatctttggctaaatcgttttggaaagagttggattcgagttcgtcccggattcgttcttcccgatctttccttcctcgtcgccgaccgccgtgggccttcgccgccgcctctgagcccctttaaaaggacccccggtgtctcctctacccgtcgccaccttcgccttcgcctctcgtcgtcggaagagccctagcgccgtgtgccctagctttgccgtcgccgccgccgctccagccgtgcgccgccgtcgtttcagccgtcgccgtcgctcgggaagaccaccgtcgtgctcgccaagtcgtcgccgtcctcgtccgccccttcgccgtcaccggagatcgtcggagcttcgtcgccgtcgtcaagccgaagagcttcgccgcttcctcctcgtcgccgtcgccgtccgttgaccttccgccgtcgttttggtcgccggtgagttcgccgtgccgcccgcttcgtcttggtgccctccgtttgcgtcctcgcgccgccgttcaccggcgagcgtgcgccgttcgagccgtcttctccgccgagccgccgccgctgtcggtgacgtcaccgctgacgtcatcggggtcgtccgccgtgagccgctgtggatccgatcgatctcggccgttcgttttggattggttcgatctcggccgtccgttcgtgtgaaccgccgcccgtgcgcccggtccaccaaaccctagcccgctgacgcaataaaccctcttttccttttcaaaataattcattattgcgtcataattcaatttaaaccgatataaaggttttaatccgatttaatctttaaaaattcataactaattcatcttagctccgatttagttggttcaagtctctaaattcttctaaaattgagatctacactttaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggccgttttgtacttgattaccttattccttgataccttgggttattacaatttgactagttgagctttatttatattggttcaactagatattagatataattgcttagccctgcttagaaacattagtacacattcgggataactaatgactcactaatatttcatgatggtttcatgatagttcacgatggtcaatcgtgattagttaattaattaatgtgccaactaaaacctggtaatggtgggttgtgagcacatggttttgctggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactggtaataatttgattagctcctggtttggaatggtatattcctggtttggagatagaactgtgcagccggggtggttgttcagaatggttgggcctatacaacagggtatgttgtatagcgttagattaatattgtttaattacttaactgttttatcaaattctcaaatgtttgctaaatgctgcttttgcaaatgcaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgctgtttatttattttccgctgcttagatctttattgattgagaggaactatctacctctgtaatgacattttattcgcttattaattggagtaatatttgtactctattatcaatttgttattgtgtgcctcggctgattcctggacgagggttcacacacatgtaagcgtttggaattttggatagaaattccgggcgtgacaaagagctccaatggtctagatgtggacatgatactcttagtaggatgagaacatgcaacttatttgccggcttgacaagcactacaaagcttatctttctcaaacttcacatctttcaattccacaactagatcacgttttgaaagtttgctcaattgattcatgccaacatgggctagcctcctatgccaaagccaacccaatgaagtttttgcaactaaacaagttttcaaatttgcttcactagaattgaaatcaaccaaataaagatttccatatctaaaacctttgaacacacaagacttgtcaagaaggttagaaacaataacttcttgcgggaagaaagcacatgacaagccaagatcacaaatttgagcaaccgaaagcaaattgaaatttagagatttaacaagagagacattatcaattaacaaatcattggagatagcaattttacctaacccaattatctttcctttgctattgtctccaaatgtcactttctcttgttcattccctcctacttcaaatgtggtgaacatagccctatcaccggtcatgtgttgagtgcatccactatcaagcacctaatggctcccaccggtgcagtagttcacctacaaaagaagatcaagctcttttaggtacccaaacttgtttgggtcattggaggttacagaccaaagctttgggcacccaaatggcattctttttaccaccgagtataggggaacccacatatctatcaacaatgctaccatcatgagccttcctaagcatataatgagaatcaaacatgcatgtcttaggaggcttaccaccggggcaatcattcaccaaatgcccaacctcacgacacttggagcaatacttaccattactcttgacaaaacgagtggcacggtgagaaggtttcttacccttctttggaatgaatccaagtccctccttgttaaggatgcaccgttgctcactcaaaatcttgtcaagagtgttcttacccttgaagcacctctccaagctcttattgagcttagccacttgctccttaagctcattgtttttaacaacaagtgaggcatcacaaatagaaacacaagagttagagctagagctagacatatccacaagatcatcacaagaggtagaaatgctagatgatgcaacatgagcaatatggcaagtagcactatcatcaagcaaatcacaagatatgccaacatcaatgagagcttcatgttgagtagtggaaaggaggttgtcatgagcttccttaagcttctcatgagaaatggtgagtctctcatgagaagtctttagctcctcatacaagacctccaaagaagcatgatccttctttagggccttgaacttgacaattagccgcatctacaatctgtccatgttttgttgatgcaaattttatttcaagattatgtttattagattaagttaatttatgatcttcttctgtaatgcttaagcttcagtttaattaagttaattgtctcaagaaaataagttatggcctcggtcagaattatggtttcggccagcattaagatagatgaggattggggaagaatgagctagggttagggttctcaccctccccgtcggcgactttttcggcgtggagcgaatcagagccgtccattagatcggacggttcagaccgaccccgcgttaggccatcttcgccgatgggccgcctccgccgatgggccgcacggcctctgggccgcaaaaaaagatgctgagccgcgccgctcaagcttgcgagctcacgcgtagacgggccggcccgattttgggccggcattggaagaagttggccgaaatcaatttaattcactaagcacctatttaattaatttcaaaattacacaattcaatttggcattattttagccatttaaaattgctggaaaattatgatcaattatttggtcgttcagaaagaaattaatgatatgatattatatttgaccaacgt

SEQ ID NO: 12016 - DNA, 1432 bp, Oryza sativa
tcctgcagccctgcgtgttgtcgtaggttcgagtcccctagagggctacatttttttgtttcttgtttttttacaaggcgcagggtggcctgcggctagcctgtcttggctgcccatgtggaaaatgggccgctggcccagctgaaggggcagagcgcgagagggaggctggcccgagcccaagaggagagagtgagccagaaatggtccaagagagagtgtagcttttcatttttttaaattcatttgaacctcaaattcaaatccttttcaagcaaaacaagttttgaaatgccttttgattatcgtcacactgtgacgattttaaaatcacacactgtgacgatctggataaaaccgtcacgagttaacgggccaagaatatccactagtgcacgtccacgacggaaaacaaattatcgtcacggattgcctctgtcagtgacggtttatgaatccgtcaccaagaattcgtcatggattaacaagtttcttgtagtggaattccaagttctctgtcggagttttaacacgctgatgctacaatctgaaagtcgttgtcgccaccgctggtgagttactcattcccctccacaaattcaatgctaggttaaatatgttacatgatgacaaaacccagtaatttaaaagttacagataacacttgaaacatcaccaaatgagagtatgagtctgtatatatactgatgacatgatgacatccagttgatccttctttttttttctgtatgtcttatccatttccaaatgatactgtagcaatctatcgctcatggtctcggagcggcacacgcaaggcagggacaagcaggaggtcggagcaccgccgcgtggtgagccccaacgcctccgtcatgtccagctcgccgggaagcatcccgccgggcagctcccagtcgaagtggtacaggagggcggcgagcgcgagctccatgttggccagcccgaacgccatcccggggcacatacgccgcccggcgccgaacggtatgtactcgaagtccgtccccttgaagtcggcggcgccgacgccctcgaacctctccggcgcgaactcctccggcgagtcccagtgcgccgggtccctgccgatcgcccacgcgttgacgagcaccatcacaccctccggcacgtcgaagcccatcacccggcacgtctcccggcactccctcggcagcagcatcgtcaccggcgggtgcagccggagcgactccttgatgaccaggtgcaggtaggggagatcgcgcaggctctcctcggtgacgccgtcctgcccggcaatggcgagggctcgtcggacctcgtcctgcgccttgcgcatcaccctagggttcctcatcagctccgacatggtccactgcagcgacgtcgccggcgtctcgctgctcgccacgaacatgtcctgcacaaa

SEQ ID NO: 12017 - DNA, 878 bp, Oryza sativa
agcgcgcccgcgacgtggtggaggtggccgatgacagggagcgcccacggcgacggaggcagccggccgccgccgccgccgccatgccggagcgaccaacgggtcaggcagaggaaggggacggcgaccagcagagcaaggagaagtagatagagaggaagctcggccatggtgatttcccgtcgcaattcgtccgcacgtgctagcgtgttgtgccggtcattactcattaacactcatcgggttagagcaagtttaatagcatcgctaactattgagtattgactaagctaacatgcatactatatagtatagattatttttttcctcactatctttactctttactacttaaaaaattcgtagtggtgatggtgaagccaacgtaaacatacgtatagacaccacacccgcgcctccccctctcacgaccgcactcgcgcctccccttctcatgcccgctcccgcaccagctaaaaacgccctgcaccgccgccacgaccacaccgccgtgccgctccgccgcccctctgacgcctgccgccgccgctccgtcgcaaataatacctcacgaaataaactcataaatataatagtcgcatacaataaatttatacactccatcaatatactttataaatttatattttcttgatactagagggtaaaatagactttatgatgtgaatttaacggtcaactaacggtcaattgacggaaggggtatagaagtgatccaaactgaaatttaggggcatgggagagaatgagcaaatctcagggggtatagaagggattaggtgaactttcaggggtacacagggaattttctctttaagtagagtagggtggttcaaacagatctaaaaaatacaagt

SEQ ID NO: 12018 - DNA, 830 bp, Oryza sativa
gaaccactctagcgcctgatctctctgcaactttctgcagagttcagtgcttaacaaaaacaaactttggcaaacattggggttaacaccaatgagccacattattcatagcaagtacttacatgattggaaagatagaaccaagcacctactactattttattcatgggaaaggaaacatctaattagcataatacttattttccttccctatctctatgaatgcacgcttgattttagcgcacaaaccgcgactaagggtatcgaaattatttctaatgtcagcaagctctacccctagctccgcgttgcgatccttaagctctatgttctccttgcggagtttcttcacttgtgcggcgagcttatggatcgagggctccggcgatttcacctcctcttcttggaattggctgggagccctcacaattggagggggcttcaaatgacgcttcaccttcataggtggagggctacgggattctgctgccccctccttttccgatgccatcaaaggccgtagtaaactcttaccatacccactgccgggagttctcactccttggatgcggaatcgctcctccttcggagtagacggagtagcggtgggtgtggtatacttgtggagcatctcatctccttccttggtgaacagggtgcccacatagcgctcggcgagaggtggcgcggccttcccgtcatcttggaaaagccgtcgtgccttcaacaagccgagttctcccgttgtcggccgtcgcgtaggtgaatccccccagatttttgtccttgtgacatggcgaggggagagggatcacgctgccgaacggggc

SEQ ID NO: 12019 - DNA, 475 bp, Oryza sativa
aaaggcaagtgggcaccacgcttcgtgggaccctacaaaatcttggaacgaaggggagaagttgcttatcagttagaacttccatccaatatgatcggcatccatgacgtgttccacgtgtcccaattatttagcaaattacgagaatgcttcaacacgttggcattatcgtaatttgctaaataatatttgacaaaaaaatcgagggggattttttttatatattttgaaccaatcgatttgcttgcagactcgtgcgcaactactcctctagctttagtgaccgcggtggctcaacaagctagtctttataaggaggatggaggggagggcacaacagggggaaatcgtcatgcttagagggatgactgtgaaaggcggtgaacataggcaggtcatcgagactatggtaccgaagctgcagagatgaaggagggtggtgggccactggtagcaggggcgaggccaggagagt

SEQ ID NO: 12020 - DNA, 663 bp, Oryza sativa
gcaatagcattgcaactaatagttttaggaaccgaaaaataaatggtaacagaaataagcgatctagtgaatatccctccgttggattgtgaggcagaattgcctccgttggtgttgtcgatcgaagcgccgcctcctgctccgggtgcacctccagtagaagccatagcgacgacgacgatgagcagaggaagtagcaagagcagtcgtggggaagcactccccaaaaacctgatcacccgcctacccgtgcagatctcaggcaagggtgtggttccggaggccctgctcgtcccaatcacttgtgcgtgcaagcgattagaaccggggaagaacagaagcaacataggcacagaggatgaaccagcaatggagagaattcgtggagagcctattcgtgtgtcgctgtctcgtcctaatagcgcaaggagagagaggattcgcatccgttgccgcagtaacgatgcgatcaatcagaattgattcccccacccatcacagaggtaatctcgtgaattgaattctcagcacagaggatgaaccagcaatggagagaattcgtggagagcctgttcgtgtgtcgctgtctcgtcctaatagcgcagggagagagaggattcgcatccgttgccgcagtaatgatgcgatcaatgggctgcagga

SEQ ID NO: 12021 - DNA, 7290 bp, Oryza sativa
tcctgcagcccaacaaactaggaacgagcgggggagagcgaagttcaaaaatggggctgatcgggcgcctccctggctcggccgaaccagcaccttggtgggtccgattgagctccatttttttcctaggcctaataagtcctaaactaagcacaaaaatgacaacttaccgggttttaagcatgcaatagatgagatcatcatggttcataatcaactaatttaacaacatccacttcttcatctaaagtttcatttggctcaaggaaagtctttaagcgttgaccgtttaccttaaatatgttaccgaagtcatcgcggagtgtgattgccccgtgcgaagaggtgtcgatgacgtcgaatggtccttcccatttgctgcgcagttttccgtggccgaagagtttaaccctggagttgaacatcagtactttgtctcctggcttgaatttcttgatttttatccttttgttatgtaacgtcccgccttcccccaagccgggcccacttacatctgatagctttcataggtcatagactgccctcacagaccaacacatgtcttttctgcacattttgtcctcactcgtgtgcacccgggaaattcttcccggtcggtcacccatcccaaattgctccaggccaagcacacttaaccctggagttctttggagattggcttccggaaaagaagttgcaacttgttgatatgagtattctattaatcctattaagccctaggccgggatgttacaccctcacccccttaagagagatcgacgcccccgtcgatcaaccctaggccaggaacgtcctctcttggccacgcccatgtgtccaatgacagcgcatgtgccatgctgtgtaaccactccaggtctacaccagccatgcgcaccatgcctgcgcaactgcgatacacgcgcccgtgaaaccgcgagagtcggctctgataccattttgtcacgtcccgccttcccccaagccgggcccacttacatctgatagctttcataggtcatagactgccctcacagaccaacacatgtcttttctgcacattttgtcctcactcgtgtgcacccgggaaattcttcccggtcggtcacccatcccaaattgctccaggccaagcaaacttaaccctcgagttctttgtgcatttggagttttggacttgtattccataatagctcccatgagcataatctaaaagaattatttcactaaacaaacctatagttaatcttgagtgataacatgtggacttaatattaaactcaaatatcatcttctcagtctaaaagaagtttaatgtaatccctataataatattagatgcaattatgaagtgggaacacatatacaaacaaaggtcatcttaattctctaaaatattttgtgcaagataaaatcatggaaaaatttatgtggacaatgattagcacaaacttatcctccgtaatttggtaacgtgttaacactcaagttgatatctcaaattaatcggtcgaaacagacaactaaaagaaatcaaattaaattttaatcggctaaaaccatatttcatccaaaagtacatttaactgcacataagtgaacatggaaaataatttattcaaatactagattagttatcatgaataaatgtaatttttctagaattttccttctctgtttaagcctcctaaaaattcaatctagctttctaatagcccatctttgtttaatttctgtgagcagtccacccattatttttgagtgcaaccaaagaaaatggaatctaggtgtaatcatttacctccagtaaaatcaacactaattaatttggtccacacattgaattatgtagtttcaaagttagaggagaaaataattccgaaaattaatctaaaaatcaagtttacccagaatcttacccaaccctctcaccctagcctagtttgccacgacctggacccacctgacagcctcttaagcttgccttgactctgtccatcacttcctccactgttccagccgagagagggagagattgagcgagccgacgcgtggccgcaacgtgtcgtcgatctcggtttcccttttctcgctctctactcctcccagacgcgtcgccattctccacacatcactttggagctgaagaagccgagggagaggttctctgcctctccgtcatcctcaacctcgccgccggtcgtagtgacgacgaccttcgccatctccgtttgagtcaaggtcacctccatctctttcgcgttcccatctctccacacaatgccgagcatttcctcttttgacctaaacccctctcgtgcagtgcatcgccgggaacgcaagccacgtcgacaacgccctggagcacgcaccggagcgccgccgcttcaaccatcatcgtcgtccggccattctcattcacctcagagaaagctgctgcgccattgtcattgcctcaacctcctcttcaaaacgcctcaagaaccccagccggaaacatcaagaacacggagaacacatccttttcttcaccggcgccaatctaggatcgcctccgccgtcatcgtcgattaccgctgcctcggtgagccattgttcgattccttgcgcatacaccatctccttgacctcacaaccctcgtgcatgcttgcttgaagcagctcattgtcccgttcgagccgtcgtcgttcacccgaggaggagcgccgtcgccgagccgttccacaagtcaccgctgccgccaagacctcgacaaccctagctcgacccacggtgagcatcctgaagtctagaagaccacatgcatgcatccttttcgttcgtaatcgacttccatgcgcacatgcactttcaccccaaaaccaccgccgctcacactcgccatcggcgctactccgatgtcctctaaccaagaaaactagaggaatggaatcgcgagagcttgctcttcattttatcttttgacctcaacctcaagcgagccaccgtttgccgccggcgagctccagatcgagctcagccatggctagctctgctatgtctagagcagagggatgacttccgtgaattagattaagtgcagggatccgtttacaattatagaaacacactgacatatgggcctaggactgcgggttgattcctagaaaactcaagggcctttgtgcatattggtccctcacagccatgtggacccatcctttaaaatctgaagaaaaattaggaaaatgcccaaacaattatatgtttagcagaaaaatgcacaagttgtaaaatctatataaaatcaaatatagctcattttgaagtgattccagtttctgtagattcttgaagttatgaactttattccaggaatataaaacttgacactcactgtacaaataatgtctctaagatttatctaagataagtcatgcataaaacatgtacaaacttataaaatacaaagaaaattcatttcaactcattttgaaacaaactcaaaaacttcagattcatcatcagacactctctgattaggtaaaataaaagtaatgacttactttgcatcaaaagcctctaaaactattatctttaaaatgactagttttagataagctaaactttagaaattcatgtagaacccaatttagcttcaatttgaataaacttaagttatgtaggatcactaacacatgtatttccaagttatgaaataatattatatacttgctgtgtagtaaaagtctctaaatattcatataaggatttactaacatagagcagccattaatttgtaaaacttgtagaaaattcatttttagtccaaatgaaatgaacaaagtttctatagaaccagcaaatagttatcttcaacatagtaaaataaaatttggcaccttctgtagagaacattgatcaaaaccttaacttagtgaaataagaatttaaacacatagtgttgtttaagtaatacataaacatgtataagtatatatatacactttaggtctaattaaacctaaataaaaacttgattgaccagtgaagccatagttccatcctcatccactaaacttagaagaacttggctcatataacaatttctaggttaatataatatattgctagtttagattaaagcgtctctactttataaaatatgaaccatagtagtaaagaccataaacatgtgagataaaaatgttttagttaaccaaattattccttttattcaacttaaacatgaagtagcatgttctgaacctataactcaggagtcatacatatataaaacactatatgcctaaaacacgttgtaacttgtaaaatgcataaagaattcattataaatccaaaaattgtgaaaccaaatgtgttagtcttagaaaacacatctccacacccctgtgaagtctaatctagtaaaaatcactttacaaaagtattccataacactacctaagactatactactataaaccgataaaacttctaaaaattcataactccctaatggaataagataaagataaaataaaaattctttcacctaaatttattttagatcagtaccaacccactgtgcataaatcatgcattttagagcattttggattttcaactctttcggtgtttaattgcatatcgtgtcctttatctagataattgcgtaatcggtgaagaagtggattaggtgctaacaattctctgatcaaggaaagttttctcctcccatcctttgaacacattgaatcccatgatttgaggaatgaaaatatttgtttacaaagttgcatgtgaacttagactatatcggtatttgaaattgggttaaggtagttatgacctatttgctgcatattccaccttgaataattgatcctcttgctgtttgaacccctagaaatggttagagtacactctttgtgctcaaatgggtttatatatgctctatgtgcaactacttgcttagccatgcttagaaatatgcaaatactcattccatctataattaaaatgtggtttgatacttgaacctttgctggaataaaatgaatatgatgagtatttgcgaactaaaatgtgtaaaatgtgattttacacttgggcagcaagtggtgtgcatatagtgttagttgcataccgatagggggagtgtttgcccaagtccataaggaccgaacttgtgtcacccatttaaagttattcgtacatccacatgtgctagtatgggatggcctaagctgattaatctatttaggactagccttgcattctggtaggccggtgtgtatgagttagtcgataattctgaggaattagtcgatgattcagaggaacttcctatttgccccgacgtggtagtttaggtgactaagtctgtccaatacaacggtattgtgccacgtgggtgggttcccgttgtgtccgccaccacggcgttaagtttaaggcgtgggcccgccacttaacggttctagacatatttccaagtatgcctaggatggaggaacacgtatcgtgctggtgcaaggctagattctaagtagtgtaaaggcttcgttatgacctctagatcacattcaacatgaagagtgtgatggagtcttgcaaactcaaaacaaactagagagttcatatcatgtgggtaaagctgtacaaactctgcagagttctttaaactaattgattagccgtgctcacggtcatgagtgctttggtgatgtgtcatgagtatagactatgttttaaaaatgtgatcatgtgacattggtttgaaattgataaatgtgttgagttgtgtatgtggtgatacattatgacttattattaagtatggcaataagagattgtttatgacggaattatgaagaagctaataatgaaacttaaaacttgtctttgttaattgaagcatcaactcctttacaaaagaattgcgaaacaaaacttgctttatgctgaaaatgaactacatattgccttcctttgaatatatgccttacatgtagtatggtaggattgacttgtgcttgccagtacattaacttgtttaatgtactgactcttgctgttgatataaccttttgtttgcaggtttagtcttagtctttgagtgatgcgggttccgattgcttcttctaggatgagaacttaatggggtatacccctagtcggtgtgcttgtgtttgggtagtcaagcttccgctgttctctaataagtctatttggccggttggcctatgtaattattaagttgttgtaagtcttaagtttctttcatcttagttgtgtttgctatgtataatcatgcttaagatgaaagtgtgaatctagtgcacatcctgggaactagattcacatgagtatgagttaggaatatttgggaggttgcagatctttagccatttttgtcaagtctcctgaatgtgtaacacatctgatcgccgccttcgagtggtttgacgggcacatctcaggctgaagttgactggcaggctaagggcccagcaatgtctccaatattcctctctcgaggcgtcggatgtttcattatgcttgtttgatgacttgaattattcacttcatctctcaaatataatggaaggtctggagagcctatgacatgtcatgccagcgcttcgtcctttctttatatatctttgcgttgtggtaagccatttctctccattcctcaagttctgcaatctgcatttttctccattctcctgctccctcaaaatccatgttcgaattcctgatggcccaatatgctctatgctcaagttctacgggtagtcgacatgacttcccatagactatctgatatggggacattccaatgggtgtcttgtatgctgtccggtatgcccacagtgcgtcctgcaatctatccttccattctgttcccattttgttgaccgtcttttgcagaatattcttgatttgtttgttcgatgtttctgcttgaccactggtctgtggatggtaaggagtggccacgttgtgtttggcttccatttctcgtaggaggtctctgaaggttttgtcaatgaagtgaaaacctcggtcgcttatgaccattctgcgggtaccaaatcttgggaagatggtttctgtgaacatcttcttggcgtgcctcgcatccgcggcgctgcacggcatagcctcaacccacttggagacatagtcgactgccaccagaatgtactcgcagttacgagacttagggaaaggtcccatgaagtctataccccaaacatcgaatatctccacttgcaaattgtatgtaaggggcattgcat

SEQ ID NO: 12022 - DNA, 3632 bp, Oryza sativa
gcatacccgatataggtagggctcatcccatatatgacggtgactttcatacttcagttttcgttgattttcccctggtggtatgcacttggataccatgtagtttactatgttagcatatcacgtgttggagtcgcgaaccgtcatcagcatgtcatctctcaagagatcatttatcggttgttcctgcatgttagtgatgtgcaatctggacaaatgatctgctacataattttctactccctttttatctttaatttctatgtcaaattcttggagcaacaaaatccatcttaagaggcgtggtttagcatctttcttagtgagcaggtatttcaaagcggcatgatcagtataaattatcaccttggctcccactaagtaagatctaaacttatcgatagcaaaaacaaccgtgagcagctctttttcagtagttgcataattcaactgagctccggttagagttttgctagcgtaacagattgcatgatgctttttatccttggtttggcctaagaccgcaccaacagcaaagtcacttgcatcacacataatttcgaagggcagagtccaatcaggaggttgaatgattggagcagagactagtgcctttttgagaattttaaaagatcttaggcacgcgtcattgaactcaaagggcgcatccttggctagcaaattagtcagcggcctggctattgtagaaaagtccttgatgaaccttctataaaagccggcatgtcctaagaaactgcagattcctttgatgttcacaggaggaggaagctgatctataacatcgattttagtacgatcaacttcgattcctcgttcggacactcgatgcccaagaactatccctttacagaccatgaagtgtcacttttcccaattaagcaccaggtacttttcttggcatcgttgtaagaatttgtctaaattctgcagacaatgaccgaaagtctttccatagaccgagaagtcatccatgaagacttccatgatgtcttcgatcatgtctgagaaaatagacatcatacatctttggaaagatgtaggagcattacacagtccgaaggacatcctacggtatgcataggtgccatacggacatgtgaacgtagtcttactctggtcctccagatggataggaatttaatgatacccgtaatacccatcaaggaaacagaaaaacgaatgatttgccagctgttccaacatttcatcaatgaagggtagcgggaaatgatccttttttgtagccttgttaagttttctgtaatcgatgcacatcctccatccggttacggttcgttgcggaataagttcgttttgagcatttgcaacgactgtcattcctcccttcttcggcacaactggactaggctaacccactcactatatggtacgggataaattgatcccggcatgcaggagtttcaagacctctttctttacaacctcttgcatttcattattgagccgtcgttgaggttccctggagggagtactcttggggtcaataggaatacgatgggtgcaaagcgcgagattaatccccctaagatcttgaagtgagtagccaagtacagaacgatgcttttccaatacggtaggaagacgttgagtctcgtctttagagagcttgtcacttattataacaggggcctctctgtcattgtgtaggaaagcatatcgtaggcctagaggtagaggtttaagctcaagcggaggttgaggtggcggttccatgattggcaggtcgagagtctcaccgggatctgcttcttccttgatgaaatcggggccctcatcttccagaagggcctcgggagactcatgaggaggaactgcggtaacctcttccactaactcaatttctgggagagggtcggtcaaggtgatccttgcccgtgaaaatggaattgagaattcattctctcccagtgttattttgaggctacctaaatgaggtgtgttgataagaagttgctcaatgggtagcctgattaggatgtcaaatcttggatttcaaagacgtggaaatccaagattgcctccctttcttcaaagtagacaagtacatcttgtacaatctcaaatccttaaatgatatttccgttcggatgtttgaagaatttgtttatcggggtcactgccttatcgcttaaataagcgaatgcaaaagactcagagacgaggttggccccgacagttggactatagagaataccgacatcgttcccttccagatggcaaggaatgattcggggagcgcatttatccgaattacttcggatgaaagctctacctcccttagccattcatcgctcattatggatgttaactcccggacagtttctcgtaggaacccgagttccataggattgggaggtgacaaaggaacgggtggtttccttttgctaaaatagttcagggtattgccgtagtctttgtcaaaaccgtccctgaacataattgtggcacaatccggaacctgaatttcttcattctcgacaaacggctgctcaggaaccttttcatcaatcgagctagcagaagtggatggttcagtgagtggctcgatcgttagaggttccactatcttggacagggatgccttcggctggggttcattgggctgcgtcatgaaggaagtattttctaggatgcgatccaaaattgttcttccttctgacggcgttttgtgcatgaacgaccctccaacggttatgtccagatagaatgcagattccttatccaaacccgtatggaaatattgcagaagcacatactcgggtaaggacagggttggtccggattgtactaaattagtgaatctggaccaagttgcaccgattgattcatttttgatctgcttgaaactaagaatttctactcgaaaggcagtaatacgagtaactggaaagaaggcaagacagaatctgtctcacaacttttcctagctaccgtttacacatccaacggtagaggtgtaccattgctttgctctctcttgaagagagaacgggaacaatttccaccgcacagtttcttgtctcatgccacgaatcttaaggcatgatcaaacttgttcaaagtctcgcagatgatggtagggattttctagatcaaagccagaaaaaggattttccctaaccgtactaattagttcaggacgaatttcatagccagttgtataaatgggcttcgatgaaggaggtggctcatagaattcgccccgaggagcagacatctcaaaacgaggttgctccatggtcgagaagagtttgacaggaatacttctctaggatagcaggggtgaaggtagactaaaaaagtaaaaaggatacaaggatgaactgggttcggaaatgatcagcaaccgttccccggcaacggcactaggaatgcttgttggtatttaatacggttacagataaaatctgccaccgcacggatataccgaggtagcacttcccctacggagtattccaagggtatcgaatccaaatgaacgtgtatggtcagatcttcctccggttcatccaaggacacaaagtaaatgataggccaggatagagaggatttactagtgagagacagtatctagggaaagcttaacttta

SEQ ID NO: 12023 - DNA, 672 bp, Oryza sativa
gccattactcaaaaaagcatactggatgggttgcgaataaggcatagggtataacaaatatatatataagtcttcaagtctattgataaatattatataaagctcacttggtgttaaacaaaatgtatatgtaattcattggaaattgttccttttatcttttggtacagctaaaccagcaaaggcaaggtgataaacttgaaaactatcccctggttcagttgaaaatgttagagcacgcagttacacacttacactagatgggcttgagtcattcaatataaaaaaaaaggaaaatgccaaacgggacaaagaaattcaggacaacacgattctttgaagaagctcccaatttccagaagaatttaattccaagcatcgacttttgacagaggagtgaagcaggaagtgaagtactaaaagattggcgttgcgcgaatagcaatgcagtggtcagtgtcgacctacaccatcctatgatcctatcctagcatcttcttaatgttagcaacaataagaagaaaatgaaacaatcctctatagattttacaatccatatagtatcttctaacaacgcggataaccaccctgcatcattaacgatgttacgatgcgataaaaagaagacacacaggacgcgtgtcgattaataaaagagagttgatatctctt

SEQ ID NO: 12024 - DNA, 633 bp, Oryza sativa
acatcattttttttatctcgtttaataattttattgcctttgaattacatactgtcttaggacatccacaatagcacaatgtacactaaaaagtaaccataagcaataaatgctgctatagtacaacacatttaacattgtggagtcagaccacaagtcatgcaataaaactagactttaagcttaaggtgtggccacaaagctacaaaatataatacttgtaatgtttttctgttcacaccaataaaatatacatgtcagttactacagatagtaactacttctactagccgttggtgctctttcatttgagttgctcatttgctttcctagccattggcttcttacaacattcttgtgctacctacgaaaggaggcacaagtgagatgaacaacatattgatccattcagttccctagatactaagtggagccttttgttaagccaaacaagtaagcaacaaatagtgatgtccaaaactccccattctacccaatttcccacaagttatccctaaaacttgagacctagttttctccaaaatttccatccttttggtcctctaagcaactaccaactatatggacacccttccatcttttaaggtgctcaccaacaagattattatgcgc

SEQ ID NO: 12025 - DNA, 619 bp, Oryza sativa
ttcctgcagcccggatgcggtcgctcgcagtcgaagttggggcgcttcaccaatcaccagtccctctcacagtagcagatcccgcctccgccctcctgcacatgggtgaggcacatgcgtcaaaactcgccaagaaaactaatgcaagaaacaaagaaagaaagactggcgcctctcctcttctttttcatccgtgtcaaaccgtcctcgcccaccatgatcgcctaccgtgctccctatgctcacgcgtgcagcagtgcggcgtcctcctcgagcagcctctcgatggacggagctcgcgagatgtaggaagcaggcgcgctgctgggaggggatctgcgccctgacctgctgccggagaaggaggaggaggaggactcgtcggagctctccctcgccggtgcttcttccacctcgattcacgtcaccggtggctgccccggatgctgcgctgcacgccccctctgggcccgagaggcgccggcggcagcggatccaccgctcccgcgcctggcagcggtggagaacgggatggccccgggggggcccccaaatttttgggggggcccccccgagcggcgaaaggggaggaagccggcgcggtgagcggcgcccggcg

SEQ ID NO: 12026 - DNA, 1943 bp, Oryza sativa
tactaaaaattgttgacaaatatagaattctgacaaaggcatgagtcttgaacaatgcttctctcttgggtgattgcttggctctgattcacattttattgatgatttggatgaaaaagaaacaactaaaagtttctggacaacaacttttgttcctacacttcattattattgtcctttattataagcatatttgctgttaatatgttgaattttgctcaagccaagctttagatattaaatttatgaaaacttaaatccaaattttattgttttccaacagactgctgttgaaggaaactctgttcctgtccaggaatcactgttaacactgtttctagggtgttcctgattgagctgaaccttttgttcttattaattatttagaaattcttcttttgcaggacactgcgaaatagtagagttgtttctttcaagaggagttgatgtggatttagattctatcactgggaccccattgctgacagctgcgatgaatggccaatatagcacgatgaagattttattggagcatcacgctgatgtaagacatcaattttttttgttgctccctcatctgtgcaaaagaaatgcctgacttgttaagcttttaaggatagtatcactgatttcagaccatgacacattagaattaataattgaaataattttcctccagcacctatgccccatcttttttttaattgtcaaacacacatctttattactcaattggctcagtggaatcatgagccaccaggcaatttacttactccgggaggggatcagtccaaacaacagactgacccgggtcccatcttaccgcaatttgagctagttcataagcagaagtattacaagaccgaggagcataggtgaaatctactttggcaaattcgctgaataagctgttggtctggagcaatgcacacaactaatgttggattataattggttctctcaatgcgcaacatcctcactttctcaggagtgctataaatgcaatttatttcctgtataagcacaccatgtactgatattaattttctttttttcccttttatttaaacaatttcaagatcttgattattccactttcgcagcctaacagggttgtcaatcataatggtaccccattgattatgtccatagtttctggatcattggaatgcgtgaagctattaatcaaagtcagttacctttttcttgatgttgatattcatgtttgtaaattgtagtaggctagtagcaccttgtttattttccttttcgtttcttggtggatgacaactgagatcaaacaacaatttcatttacacaggttggtgctgatgtgaattttagagatcccaatggtgttacttgtgtgatggtcgcagcaaatcatggctctcctgtcatcatgaagtgcttactagatgctggtgctaattcaaatattccagatgaagtgagtaatattctttcctctatagcctgtgactggatgttgttgcattaggctgtagtgatcttgagagattaggataatctgctcacttattctttttatcaagtgcgcaccaatggataagtctgcatcagaagaagacaaagacatatggctttagtgaagcatacttcatagtatgtgacacatgatggaaccattgcttccatgctgctttataggaatgcaattgttgagtgctcacattccactccaaagggtggatataagttttgattttcactactgtctgagcctgtttggcgatgcttaatacagggaatgatgagaaaatactaaggtttacggtttaccaatgtctgagtggagaaatatttaggtcccctataactgatcgaacaaactaatgtcctattctggatagccctttggctgggtaccctttgaaccttcatcctatcctgttgtgacaaatatcagtatgatataaaaa

SEQ ID NO: 12027 - DNA, 35642 bp, Oryza sativa
tgccaaagtagatttctcctatgctcctcagtattgcaatactgctcatgaactagctcaaaatggagccacccagatcagtctgttgtttggactgatcccctcccggagtctgtaaatcgcctggtggcttgtgattacactgagccaatcgagtaataaagaggcatgtttgacaataagaaaacaactttgactctagatggggcacaagtgttggaggacatttttttcattttttttttcattctaatgtgtcatagtccaaatcagtgatactatccttaaaagtttaataagtcaggcatttctttttgaaactgataggtcaggtgtttcttttgcacagatgagggagcaacaaagaaactgatgtcttacatcagcatgatgctccaataagatcttcatcgtgctatgttggccactaatcgcagctgccagcaatggggtcccagcgatagaatataaatccacatcaactccttttgaaagaaacaactctactatttcgcagtgtcctgcaaaagaataatttatacattactaacaagaacaaactagaaaacaatgtttatcataggtatagaggtcttcattggtagatatatgttgaaaatggacttggaacaaggttcagctcaatcaggaacagcctagaaacaattattaatagtgattcggaacagttatgttttcaaaaggagtctgttggataacagtaaaaattggattttaagttttcataattttattatctaaaaagcttagcttgaacaaaattcaacatattaacagcaaatatgcttataatcaggacaacaataacgaagtataggaactaaagttgttgtccagaaacatgtagttgtttctttttcatccaaatcatcaatcaaatgagaatcagagccatgcaaacacccaagagagaagcatcattcaagactgtgtcattgtcagaattctatattcgtcaacaattttaagtactccctccatcccaaaataagttaacctagtacgggatgtgtgcctgtccagattcatagtactaggatatgtcatatcccgtactaaattaacttattttgggacggagagagtaacaaactacaaaacaaacttactagtgacaaaatactgatgcaaggacttagtctctacgtgcaatttgccatttagttgaatagttgtgagaacttgttgcaatttttttcacgaaataacaaaaatccagagtcatgactataatatagtgatcagtattttatcacaaggagtgcctctcctgaaacaaccttgcacatgaggggaaaacattctctggtttcatctagctactggccaatagtctgtgcttatccattttaagttttgagttcaaacaatagttcaaattttgatagaaatgttagaagaaaataatggtgaatccaagtgaagaaagaattcacttgcatatgtatcaaatatattgttcaaaatatatgttggactctgtgtgcgcggtgtgtgagaaagagatagatagacctttcgttgcagcagcatgaaaaggtaacactgatttatcaatcgtaggatcagaaccgtgatcgagaagatatcttgtagcagcagctctcccatgaattgaagaaaggcacagtggtgtttcacctgccaagaaaaatatggcataaggaccatagggaacccgtatggtcatatggatcgagccttcaacaatacaaactacaaaggtgcataatgtaaaatggtattgtctaaacaaaaaaaaaaatctattttaccacttagacgtatgggagctcatctacttacaggctgtttagtttgactaaccaacacatctaggacgggttatcgatcacatgatcatcccacaaaatttgaaaatgactccattaattcttcatccaatagcttgggacattatgcagtgcaaacctggaaactactgtaggataaaaaagggacgtctgagatttgtccacgtcatcctcagagtgtgatagacaaatctcagatgtccatattttgatcctacgttagtttccaggtttgcactacatattttccccaatagcttagcatgtactttttagattgaggtggtgatggcccattccattcctcaaatcaaataatgtcatcaaggatcaagtggtgaattcatcatcatcccacttctcaaacctaggtcattaaccccttacgcctttaagtataaaatttggtaccgtatccctagtaggtattgaaagccatctaaaaaaacccctgagatgccaatataccaaatgacgtggagtcgcggacaacaatgtcgcgatggtctgcatcctaaaaatattttatgtggtgaatccactcatgcgagggtcaagtttatcttttgcttccaaagttaaatttatgtaccggcatgaaacattgttttaagaagtggggcattttattactgattttatattcatctgctaagtctcactactcactagtcatgttgtttaccgtggcaaaaccacctcagggattattttgacatcctatgccatcttcctatatagttggtacccactaaggggcatttactcctataaagcaagatatgccaaaagccacatcatcagcaattttaagccatcaaattgcattagtacaaagataatagccattggataaagaagctacttattatccatctaactcaatcatttattagtcgtccattcacctccctttgctccacctcaaaggcacacataacattgttacctacttttgcacataacaccatgttttttcctcccaagtcctgaaagataatgctaacttatttttttcgaatacaactcaaattattgtttaagatgtgagttttgttttattatgcatgcattagatagcatacaattattaggcatcattcccgaacccattttcatatgctttgagagaagtagagatgtgcaaacaatctaattgcaatgatacctagattgtgcatgaaaataatattcatatatcgtaaaaatacacaatgacgctttgaaaaataaagcatgaattgtatcataataccagaggatatatataaagccacattatcatatattctgtatatatgtagagttgcacccagccatttaaaattttgattttgtttgacgataaaactaacaaaacatgtggcacggcgcggggtaccgactagtttataagcatttcaggacgcatgataccggtttttcttctgcatgaggttaagtaggcttctccttttcaaaaaaaaaaagaaagaaagatggggtgcacctggcctcagtagttctaatgttagtaccagtgactccacatgattaatgattaccgtaaaaagtatggcatgcaaggaaataagaatgcacaattactgctcagaatacttccagttccaaggaacacattccaattccattgaagaggttgttgtatgccattaggaattggaattgacaattcaagtccaattatgagacaaggtactgtgtataaatatgaaaccagttatctgctgctacacaatcacggacgctgtaactcagttgaattccaacccacgtcaactctctcgcctctcacgcatctctgcaatggtaccactacttctccaactactgtatgtgcaagacctggcctccccagtcaccctaacaactcctctggtccacaaagtggcagcctccagcacacatgatgacaaggctctccgcattgcttaattaggtgatatatttggtctctctttctttgtgatgattgtggatttgtgggattgagtgggggtgaggggtcaagcaatttgtttcggttttggttaatctgttaattgttgtgacattttttctttcgcaagacatatatatagtttagtagggaccagggcttccaatatagatttcagccatttcggttctaccaaaattcctgaaattttggtattattggcacttttcggacttgaaattttaactgaatttgactaagttttgaccaaattcacagaaatttgagaaaaacccaaaaattcggccgagatagtaactccccccccccccccggtttcaaaattgcaataactgttagggaccgtcctatcgaatctttctgagtaataaaaaaatgatgttaccaaatttgatacttgggttcacgatagttttggagtgtgatttcaatgcaaactgtgggttttcaatgcactcagaaaaggagatatgcaatgcttgcacaatgactaaaattaggttatgttgactgagcttaaaccataactaattataccattttttgaacaaactagtagaataaatcaaactgaaaaaatagaacggaagagaggcaatgcaagacctttggcattgaactggttgacgctgaggtggaggtcctccacgaggtacctgaggacatccatgcttcctcgggcggccgccaggtggagagcgcggttcccgtcggccctgcccgccaccgccgccacgacggcagcctcgccctgcccggtgtccagccctcgcgccatctctatatcaacggaaagaacggtgagtttcgatcggaaaagcataataagcaattaaaccctaagagagaaagggctaggaaatatacgatacaatactcactcctgaggaggcggaggttgtcatcgtaggcggcctggaggagcatcttctcctgctcctgcttccccatcgatcaggctcgggggtgaagaaggcgagagagcgggagcggcagcctaggccctagctagcacttgactggaggagacgagacgaagacgatgcggcgccggcgtgggtttggtagagactgcggagtttggtttttggaagggagcggtagtgggatttggatgatgcgcgcgagtcacgctctgggcccccaacccaaccaggttaacaccattttcttttcctattctatcggtcatctgaattcgcacaagggagtacctatacatctttcgaaagatttttatgatcgtatcacacagatttttaatctttagattaaaatctgatagatataataaaaagcaaaaagcaattaagaaacaccataatggacactaaattaccatatcctcaagaaaaagaccaaatccaatacaaaatttaaaatttatatgcgaagatttaaaaattacagtataacttacaaagttacagtgtaagtttcataaattacactgtaacttacaagaaaatgcactgtaaatttgagtgagaaaatcgagtgagagataagaaaaaatctttcgtgtgagatatagcaaaatcgttcgcacaataatcataatttaaagagtagtaaaggtgaactgaattcgcacaataatataaagagtcggttcttaaatttaagcggaggtgttatataggtccgtaaacttgaaattttcacgttaaaattcataatcttgttttaatgaaccatagctagtccaaatgacgtttgactagagctgaacggctatgtggtactccatgtaggcaatagtttttacttatcccttgttgctacagtagtcatcgaaatccatcaaaatatcccaaacccctgcgtccctttgcatcccccagacgctttcgagggagaggcctgagtagggcgaggacgatgccgacgatcatcggtggtgcgaattgattgaggtgtcaatttggatgcgcgactagcagcgcttgataggcgatgcataatgcgccttcctcgccttcagtggagaagatgaatcggcgccccaaccgccattacctcgccgcctccggataccgccgttgtcatcgcaaccctagctgttgtttggaatgcaaagggatgaagggattttttttttggggggggggaggggaggggcgggggatttcagcgactactgtagcaacatggggttaagtataaaattaccaccatatatgtcaagatgtgaagggggcggatgcaaaatgctgcctaagtagagcaccatgttagcggtcagctccggtcaaatgcgcttggaccggctatattttattaaaataagatcatggaccttaatatataattttattaatttttaagtttattgacctaagtggcatcttcgctcaagttgaaggaccgtcaatgtatcttaatctaatctaaaacagttttcggaaacaccaaatcttaatctttctttgattttatctaatgaaattacctggatgttttttaattaagatctagattatttttttaatatttacgagtgccacgttactcacgcaatttctcacaattctaaggggcaagctttaaaacgcgtgatttgaaaaatgtagaaatagaaatagtaaacaacagatgtgtgaaaacacatatatagaaagagaagccctttaattacactgcataataaaataaataagcagagaaattttgcaagaggtataataaatattagtagagaaaatattcccaagaggtatacctcgtacttatttttcaaaaatataaccgcatgcttaattttctactaataatcgtgtacgtgcatatgaattaaatcaaacatacttcaccgcataggcagacaaagtgaaagctttttcagtttatcaaattgtacaaaatcacatccaacggtactatgttaaaataatccaacaaacaactagaaaaagccatttcacaatatcacaataatagaagagccatttcacaaatttaaaatggtgccaaaaggttatttttttctaatatgggagaaaataatctctaccattataaaaatataataagtatggtttccggtttttttccatccgtcatttagctttccgattttgtggaagatttctcatctgattgatcatagcgcataaaaaaaaagaagaagacaccccgtcattttttttaacgactcgcacaagacggtgtgaagttctattaatagaccagaaaaaaattacaagattacaaccctggaaagtcgtaactaggaaaaggaaaaaagtataccaccacccacacaccggcagcgccaacacacaggtccaagagaaggatagcaccggaccggccgttgctaagcgtgatcgatcgctgctaggctgacaacgaaacatggccgagatcgcccaaaacccaacccttacagtcaacacaaacccactctatccaagacttcaggagttagggagagagggtgagagagaagaatagaacacatctccccctaggccctccgacgtggccaacttgtagtgtctagcacaccgcaacaagaggatgaaatctagagcgagcttgcatcaattggttggggggtttcggctaagggatgtctaaacaacgtcttcaagaagagaagcgacggaaaataccaccgccgccgtccgtcaaggtttcaaagagaaccgagactgggctttcgcctgacatccacacttgagggatgagacggcatgacaacgcccttaggaggggaatgacgcttcgaacgtcatcgttgccgaccagggcgagaccaggctgggttttcacccgccactcaccacctgcgagtccacggctggcacgatgccccaccactgtcaaacttctgccggcacgtgggaccactgcaccggcgccctcaccagccagccttcttgcgccgtagaccaaaccgaacccaccggaagctcctcctcgtcgcaccgtgctcgcctcctccaccgccggcaacgcctcgtcgcgccttgcccgcctcctccgccaccaaccgcgccaagccggcctccagccaccggctgcacctcctcacgccaagccgacctccactgccgccggccgcgccacctcgcgtcgtaacgctccgctgctacctgtcacgcctcaaagcatcgtgccaacctctgacccctcctctagccgccgccatgccggccaagtgcggtcgtctgtcacgcctcctcggctaagcgcccgtcgtctgtcatcgcccgtttccagccgacgacatcgcgtccgcacccacacctagtcttctccttctccgctgcccgactccttgatgtgagcaatggttgtatccgtagtagccatggtcacatcatctccgtggcccgatctttcggtgagttgtagataactacactttgggagaaacgttgacgacccgactacaaccgtacaagacgttgttgtattgcgtcttagcgatcgatacacctctccgtgggttgttgatcttgccggtgcagatcaaccttattcctgtaagcaaatagaagaaacaagcaagaacaagataaaagcaatctgaattgcagataggaattcaatacaaatgataaattggggttccgtaacgagcaaaccgtcgatctaaccgatcacgggattacacggcaaagtagcgaagctaaactttaatctaaacaaaacccgagaaaccctgaagtggtacctagctatttatggatgtgggaggacgacctagggtgcctagggtcgtgctccacctggttggggcgcccccaacatgggtcccacatgggccggggttccaaacaaagttacaagcccaaaggcccatgacaggtgttacagcaccttgtttctttatttgcagatggctagggtggaatttggtgatgtggctagatccgttggaaagaggactccgagagctttccatcaagtactcacgggtcaaaaacggaggtcgtatgcagattcggtggctgtttgaagtcagcagtgtagcaggtggccgaattggatcctagcacttggaggacttgaacttgatatcttgttgttcatccatgatgtgaacaatggttgtatccgtagtagccatggtcacatcactccttccccgcctccacttgctgccgccggcaaccatctgcacgatgtcgccagccgctgccgcatccgccgacgtcgccagccgccagacgccgcctccaccgccaccttcattgccgcagccgacgtccgtcgctgccgccgtctcggtgtctccagccgtcgtcgccagccaccgccgccgcaatcacattcgctgcctcttcgccatccaccacctcagcagtcagcatccaccacaacaccgccaccatagccaccgccgccgtcgccagccgccatcgccaaccgctgccacatccgcgaccgccagccgctagccgccatccaggtccgaccgagttggcgcggatctgggggactccgccaccgtcgccgccaaaccccacgctgccacgtccgccaccaggcgtcgccgccgtcaccttcactccccgccgccagtgacccctccgccagatccggctgggcccggcctggatctggccaccaattctgccgctccgagcaacgcccctggccgctgagcgcgtggagggtgagacaaggccccgtcgccgctgtccttgcggccgcacggctttgccggcacccgctcatgcggcggcgaggcaggggaggaggaggaagttggcggtgtcgcctcccgagtcacctggggagggcgatgcgggaggaggagggaaacgtccttgtagtgttggccttggctaatgatttacgtaccccgtcatatattgtactacaccagatcggtttggactggttcatcaatgcatgcatgtcggtttcgtcatccagtcatcctttcccttcgcaagtcgttggtttggactattattagaacgaaatactccgaggatggtcggtgccgcatcccgcatggcgtcactgttgtcgtgcgatgaagacattgccgtctgctgtacatgacaacatgccgatacctgctcaggttcagtcttttcgccgagctcgcctcaccaagagctcgcctcactgtacatgacagcatgccgatacctgctcaggttaagtttcgcgcgttgacgtagccatgcactaagtgcttccatccagcgtatttcttgagccccattgccggagtacgtacaagtacaacgcgcgtgtgtacgcaaagcatgcattctataattaacaaagtaaaactcactagtacacaaaacattttcctggacagggacccatttaaattgcagacaaaccataactgatcgcatctgggaaaatcgttctcccattttatgtgcggaatcttaagagttttcgcgtgcgggcatcttaagaccaccgcacggaaaaataccctccctagctcctttttccctcacaacacttcaaaaaaaaaattccatcctcacatccttatcctcacctcacctctacctctctctctctcctctcctctcatcggcagcgcgcgggcgacgactctgctgccgccgccgccgccgaggtggccaagatccgacggcgcagcgcagcgcctctccgccgctcggatccggtcttccgccgcccggatccagcggcgccacccctctttcgccctcccccgcgcgacagcgacgatgacaaggtggccgggattcggcggcgcagcgcctctccaccgctcagatccggcggcggtgcccctctcccgccctccgccgcccggatccggcggcacgcccctcttccaccgtaccccacgcgacggcgacgacggcgacgatgacgaggtggctgggatccggcggcacgacgcctctccaccactcagattcggcggtggcgcccctctcccgccctccgttgcccggatccagtggcgctgtacctcttccgccatccgccacgcgacgacgacgatgaggtggctgggatctagcagcgcggcgcctctccgcctctccccgcagcgcgatggcgatggcgacgacgagacaagctgtggcggcggtgacggctacgtcggcgacagcggcgacgatgacgagctgcggcggcagctagggtttcgattttttttttgtgatttttattttcttttttggatttttattttcgcatgcgggcgacataaccgccccgcacgagaaaatgtgactttcgcgtgcgggtgtgcctcccgcacgtaaaaatcgcgatgttctcatacccctgcgtgcatgcgggccgcccacccgcacacgaaaacccattttcaccatatgggaaaatcctttttctagtagtgactttgatgcgccgatcataatgttgcaccgtaattaatctgatcagcatgtttggataatttaggttgtgacaaactgaaggattaattagttaacataagtgtaattgcacaagtgctaatcagacacgacacatgtatgtgtaaactattttcaaagttagtgtaagatcgccattccgtccagttccataattcttaatgttttgaataagattgaggccaaactttttgaataagattgaggccaaacttttataatctaacatcctagaaattcatgttaataaaaaccactaaaattcgattttcttaaaacttttgcatcatacactactggagaaaccatctttggtcggtcgaccaaattccacaataatcccggttgcaataaaaactaggactaaatatattctttagtcccggctcaaaaggttagagctactttttgatctatagtcccggttggtaacactaaagatcatttttagtcctggttaaaaaacggcaggtggtgtcagacacctctattatctctatgtatagtcctggttgcttaacaatcaggaaaaaagatcggcatgtgtggagaggatgaggcgtgcgcgcgagatcgatcaggaggaggtgcacacgatcagttactaagttctatctcctagcctccctcacatttatctcttccttctctcctctcctcactcaccccatctcttcctcttcctcctccagatccgccccctcccctctcctccccacttctcaggcggccgagcggcggccgggcggcggcgaaggtggcctcgtgcggcagatccgggaggggaggtggcaaggcggtggcggcggcctcgcacggagggccgtgcccggtggaggcaggcgacggccgacacggagaccagtgcagcgacaggcggtggaggccggtgcggctgcacggatttttttttcttttttctttaatgtgtgattcgatctgtgttgaatgattcgatctatgttgattagatctgtgttgaatgtgtgattcgatcactgttgagaatgaactatgttgttgtgaatgattttgagaatgcactatgttgctgtgaatgatttgggatgaactatattgttgtgaacgatttgggatgaactatgttgctgtgaatgatttgggatgaactatgttgctgtgaatgatttgagataatgggcgtgagatatacaaaatagaaaaaaaaactgggactaaagatagcgatcttttgtcccggattcttactccggttggaaaatcgggactataggaggttatcaaccgggagtaaaaagcatttctccaccagtgatacgccggatggatattgtggttgctagtgcttgccaaaccgtaaattgtcacaatgggggaaataaattaaagatgtacaatttacaaggatagattatttatcaatcatacaaccatctatgcaaaagacagaaagccaaataaagaaaaggttaattattaatttttgtaatataagttatagatcaaatattaagtaactgaaccatgtcgatagcttgatctcaggggaatacaaaaattaaatctaatttgcctagatatattttcataaaacccacccacatgaaataatagttgtcggtgatatgggcccgaggttacccacgttagggggaaggagcggaggagcccttcctcctagccacgtgtaagtagccgagagacgccccacgtccacctaggggcctcggggtaccccgtcgcacccctcggtcccgacgggttgcgccacctcgagacccccgctcagctgccactcggcggctaagtgggtggaggagggggcgccgctggcgtatttatgaacggcgtcccaaccacgcacgcgcatcggcgtggctggtcgtgcgacgccgcccaagtgattgacgtgcgtcaatcacttggaccggtctgtgaccggtggcagatggataggacgggtggcagcgcacccacgccccgccctatgtcaggcggcgtgagggcaggtttgccccgtcccatcagccattagggctcagcacgtacggccggtgcattcccagtagcatgtgcctacaaaagtcttcaaggtttaatgagggaatgacaggggatgtcccccgtgtcagatgggagacggtgctgggacccacctcggagcaagcagccatattgcttccggtctaaggcataagcgggagtagaacccgaggaagagggaccccctccaggaaagatgagacgaatagaggcggtgcatgtggtatccccttgaactataaaaggaagaccttacccaccaagcaaggggacaacttttgatagcctgaactctaagggaagtacagttaggttttcccaggagcccaagatctcttgtaagaacttaagcatagttccacacacagaagtagggtattacgcttccgagcggcccgaacctgtataatctctggtctcactcccggtcactctcgaccaccttggtcaaatcttcggctaaggttggctcttaatcactcgcgccctatcgcctggtcgaactcacaaaggggggtggtctcatgtcctcccgctagagagggttactcctcgacagctggcgcgccaggtagggggaaacccgcgcgtttgtgaaggagccgcttttcttccgccccaagtttccctccatcctcaacgaccatggttgaggtagtggaggaagaggtggtggcgtatactccctcaccttccggaagtgaggacggtagcgggagtcgcgaccctcgccaccaccgctggaactctccgacccctcctcgtcgatgtcccggacggcaggaggaccccaccggttcggaggattagccctttccccgctggcggacaggggcaggttacgccgcgccggggtgcgacgccgcctcaactacaatgatggcggcacaccccacggcacactctaggctgtgggggctctcctgcggcacccttcggtcgttctagagccggaaaccctagtccggcggtggctggatgacgtgacccacttggtcaccaccgccccgcgacagctggccgccgacgccggcgaccggcccgcgaccactggtacttcgcgtaccacctacaaccctctcctcatcggccaggaggagggcccgtcgttccgccatgatctcacggtggttgacggtcccgacgtcatcgaggcccacggagagccacgggcgtcacgacagtctgtacggggaacaggacgctcgcatcaacatcgagcgccgcagggacaagcaccgtgctacccgcgtggggaaggcacctcctcatcaggaatgtcgcgccaccccacacgaggtggccggccccccacgcccccgtccagtgaggcagggtgcaaggctttcatggcaagtctccggaatgtccggtggcccccgaagtttcgtccgaaccgcactgagaagtacgacggcaacgtcaacccctccgagttcctccaaatctacactacgatcatcgaggccgtggggggcgacgatcgggtcatggcaaattattttcccatggccctcaagggtcaggcacggatctggctcatgacccagccccctgactccatccactcctgggaggacctgtgccagcagttcgttacgaacttccagggtacgtaccctcgcccgggagaggaagcggacctgcacactagggatggcaacggggcggggtggggccgggttgggctagaacgcccgcccccgacccccgacttcaccccccgcccctggccccgattgttgatgcggggtcaaattatcccccgtccctgacctctccggggcccctcaactcgaccggggccccgcattgggtagcatctttatccaatcaacaccaaaaatacaagacaatcatcaatttggcaaaaacaaatattgcacataattgacacaccattaaaaatagcatgaatcgtcgaccgtcgcgcccttgcctgtctcgccggccgccgcaacctcgccggccaccgagcccttgccgcaacctcgccggccgctgcgtccttgccgcgtgaccgggcgtccaggcctgtgcgccgccccgtgcgtcgtttgcattgtcggagggagaggtggaggggacgagctcgggagtcgggaaggagaggtcgaggggacaggacgggagcccggaggggagaggaggggaggggaggggagaggccgaccggcgacggcgagatctagaggtgcgcagtgccccctgcgccgcgccgccgcctccgctcacttgtgtgcgtgatgcggacgggaggggagaccggtagatggggataggggaggctggggagaggataagattagggtttagtaattttgtttatatatctcagtttttgttgggttgggctgttttgggccttctatgggctatgtctcccccgtcccctcctcgcccaaatgcgggtccccggccctgactcccccatgggtcaaaaatcacacccgcccccacccctgtaggacgacgagtccctctgctcgtgcatacaacgtttctgccaggtccgcaacactatcccgtgcatcccggcccacgtggtcgtctatgcattcaggggcggcgtgcggcacaaccacatgctcgggaagattgcctccaaggagcccaagaccaccgccgagctcttccagctggcagacaaggtggtttgaggaggcgtgggcctggaacatctctggctcaggcgcagcggcttcggctgcccccgagccctcttcccgctctaagccgcgggacaagagaaagaggaggaagtcggcccgctccgatgatgagggccatgtccttgccgtggatggtgcctccaggcccctgcgtaaggagaaggccaccggcagcaagccgggcgccaccacccccgacgaaagccgttcagcggacaagtggtgctcgatccacaacacttaccggcacagtcttgctgattgccgcacggtcaagaacttggccgagcgcttcaggaagactgatgaggagaggcggcagaatcgccgagagggcaaagcccccgtgacctccgctggcaaccggcaaggggaggccaagaaaaaggcccccacgatgatgatgacgatagcgaggacctggagttccaggctcctcagcaaaccgtcgccacgctcgacggaggggcgtacgctcacgcctcccaccgcagctttaaggccatgaagcgagaacttctcgctgtggcgccaacccacgaggcggcccgccgggcacgctggtcggaggtgaaactcaccttcgaccagagcgatcaccccacggtgctcgcccgtggggggaagttggcattggtggtttcccccaccgtgtacaacgtcaagctgaagctcgtcctgatcgacggtggggcggctctgaacaacatctctccggcggcctttgaggccataaaggccccggggatgaagcttcagccgtcacttccgattatcagcgtgatgccaggacacacgtggcccctgggccacatcgagctcttggtcaccttcatcgaccgtaccaacttccgcaccgagcggctagactttgatgtggcgaatctcaatttgccctacaacgcggtcctgggaaggcccgcgttggtgaagttcatggccgccacccactacgcctacctccagatgaagatgtcgggccccaacggccccatcaccatctgcggcgacgtgaagatcgccctggtctgtgcggagcagcgcgctgacaccctggcggcggcctctcggccagaggaggacggcagagccccggaggcctccacatcatgtgcctccaagaagcggatcacctcgagcgacgaggtgcctgtcaaggagataccccttggcggtgacccgtccaagaccgccaaggttggcagttttctagtctcatcacgaggcatagaagctaatcccgagaagatatgtgcaatagagaggatgcgccccccccaaagcaaacttagggatgtgcagtgcgtcaccggatgcatggctgccctaagtcgcttcatctcgaggctgggagagagggcgctacccctgttcaagctcctcaaccgctccaggccgttcgtttggatggaggaggctgagcaagctctcaaccagctgaaagcttacctcacctcccctccggtcctagtggccccggggccagaggaaccactgctgctctacttggccgcgaccccccaagcggtgagtgcccccctcgtagtggagtgcgacaaagaccatccgtgaaccacaagcgacgagcccgatcatgggaagggactaggggccccattaatcggtgatggcccctcgtctcccgacggcccgagcctcgatgctcctggcccctaggcatgccccgacgccaccatgggggagcaggaggccctggcgggtggccccgaggtcccttgcgcggatgcgggaggaagccccctggggccccaagaattgactgccctgagactggcgcccctgacagcaaagatagaccccgccgaaaggtgcagcggcccgctattttgtcagcgaggcgcttgaaagtgtcaattaggcctagagggagaggggtgaataggctaattaaaaaaaacaactaaaagcggaagcagtaattttcggatatttccgaaatttttggatatatccgaaaattttcggagtcagcacaaacagcaaagtaaatcctagatctggttgcctacaacaagaatatgctagcacaaacagcaactagacctatagcggctcaaacaagaaaagctagtggagagggaggaagtgaagtcaccaaagatgaagctcacgaggttgttcccgaagttcgaatccttgaggggattctactctctgttgaggagctcactaagagccgggtcttagctaaccctttcctcaagaggttgcactaagcactcctccttccactaagggtatctcttccctttcggagataagatccgaccttcacaaacttctcccggccaaccacaagtagatcggtggctcgggagcgacacctagccgcctaggagtcctcaacctccaagagtaacaaatgaagcaaataactcccggagatgatgcaagtgctcacaaatcttcacgaagtcaacaacaagcactcacacaaacttgaatccacaactctcacacacacaccaaatccaaatcgaacacgggtgagaggggaaacaagaaagcaaggctcaaaagtgctagagagagagagcaagccaagggcacaaatgattggaatggaaccagcagccctcacaagtaaggggagggggctatttatagccacagcccagattctgcccgttgtgcacaataattgagattttcggacatgtccgaaaattccaactcagcaccaacagctatgtcaacgaaggatttttcggacattccgaaaacttttcggacaagtccgaaaatttccagtaccaacaacatcgttctggatgttctcggaaaagtccgaaaataactttcggacaagtccgaaaattgactctactaaagattttcagaaaaatccgaaaatcagtttcggacaagtctgaaaatatacagaaccacttttgccttcgcagtctttttcggaaagtccgaaaatcactttcggatatatccgaaaatttccagaagcgaaaatctggttctgtgtgttttcggaaagtctgaaaatgagtttcggaaaactccgaaaaaatccagaacacaccaaactgaggagaaacactttttaaaaatagattttgagcactttgatcactcctcgtatgtcaatgcatcatccctcttaatagtgcggctttcctagaactcaaggaaacgaaaacgtacaaaataccgtttgctcatttgccgtatcacatcacatcaacgtattcggcgggatatgcattacgctaactcattgaggacataacaaccttcacatctgcttaaataaaaatgttagtaatctttaatcgcattgtaattaatcaccaaaatcattaggggcctagatgcactttcagcgctacgggacgcaaaaacccgataccctcaagctcagaaaatgctttatgcagttctgatggcctcgaggaagctacgccattactttcaggcgcatcgggtttccgtggtaacgtcctaccctctcggtcgggcagatcctgcacaaccgagagggtactggacggactgtgaagtgggccatcgaactagcggagttcgatctgcacttcaaaccacgacacatgataaaaagtcaagtcctagctgactttgtcgctgagtggacaccaatggacgatcccgacctacccctcgacccttccccctccgaaggcggggaggacccgaacaccgacatcggggtaatgcactttgatggttctttgaaccttcaaggtgccggagccggagtcacactaacctcgccaagcagggacgtccttaagtacgtcattcctctcgatttccgagcaacgaataatatggcggaatacgatggactcctcgcgggattaagggcggcagcaagaatgggcatccgcggcctcctcgtcctgggcgattctcagctagtggtgaaccaggtctacaaggagtaccagtgcaccgacctgcagatggacgcctacgtccgtgaagtgtgacgcatggagcgccatttcgacggactcgagctccgacatgttcccaggcgcgacaacgcagtcgctgatgagctatcgtgtctcgtgtcagcgcgagccccactccccccaggagcctttgaagaaaggctcacgcagccgtcggcgcgctcggattccccgagggtgcctgatgccgaaatccccacccgacgcctcgcgagccatagtcctcggggcccgagggggtcaaccccgaccccccacgtcaggtcgcctagatggccgacatctgggcatacctcgacaatcgcactcttcctaaggatcacgcggaagccaaaaagctcgtgcgcatctccaagcgctatgtgctagtataagggaccctctacaggtgcggtgccaacggagtcctcttgaagtgtatctctcgggagcaaggcatcgagctcatcgccgacgcccatgagggagaatgcagggcccactcggcctcgcgcattttggtcgataaagcttttcggcaaggcttttactggccaaccgctctccaggatgcccaggactgcgtcaggcgatgcaaggcttgccagttccatgccaagcaaactcatcagccggcccaggctctgcagctcatccctctctcttggcctttcgtggtctggggtttggatatcctagggcccttcaaggcggcccgtggcgggtaccaacatctgtacgtcgccatcgtcaaattcaccaagtggcccgaagcttacccgatcatcaagatcgacaagcattcgaccctcaagttcatcagaggcatcacatcccgatttggagtgccgaaccgtatcattacggacaatggcacccagttcaccagtgaactattggtgactactacgacaacatgggcatcaagttatgcttcgcctcacccgcccaccccaagagcaacaaccaagtcgagcgcgccaacgccgagatcctcaaaggcctcaagaccaaaacatacaacgtcctcaagaagcacggggactcttggctagaagaactgcctgtggtgctgtgggccaatcggaccaccccgagtagtgcaacaggagaaacccctttcttcctgatatacggcgccgaggcggtcctactgtcggagctctccctaggctcggctcgagttgcgctgtacaatgaggcagatcaggatgggctccgtcgtgatgacctcgactatctggaagagcgaagaaggcgcgcggccctccgggtggcgtgctaccagcagagtctgcagcgctatcatcagcgccacgtccgggcccagttactgcaagtccatgacctcgtcctccgccgcgtccagtcgcgcttaggattgagcaaactctcaccaatgtgggagggagcatacaaagtgatcggcgtcccccgaccaggctcagttcgattggccacggaagacggcacagaactacctaacccctggaatatcgagcaccttcgccaattctacccgtgatgtcatgtgtcatttcttttgggctcgggccaacttccacacacccctcgggctgtgcgggcttggccgggggctaccaagtgtcaattcttgtatttcgacatcctttctagcaataaatctttctatttatttaaagccatcacgtgttttctcgttcccttcctgagttttatttcggcttgggagtggttcgtgcttactctcatccctaggcggcgtcgggcaacctgaaaagcgccggaggtagcccaaacgtgggccgtgccccgggccgcggcgaaccccgggggctctgaagggcacactcgatcgtccccgacccccggtcgccgcgactccggcttggccagtcccgctaagcggctcccccgaggtgacggctctgcccctcgccatcagggtcccgagtgctaagcgcgagctcctttccccatccgaacaaacccagggggaaacggaaatagcattccacccgctaagaaaataattggcgaacctcccgatttttccattgcaggcattcacagattgaaagagtgcaagcaagacgaggaaataagatttatgtacatactgggggcggcacgaaagcctaaagtcatcaagtgttcatcacaaagacacagcaaaaaagaagaaagggggcagtcatcgggtgcccgggcctccaagtcctgcgccgctgacgacctcgtcccagtcctcgccaccgccatcgctgccgctgtcttcgcccgagggtagtgcgaggttgaaccgaggggccgtccccatgaagatcgacacaatcacatcggccgcctcttgaacctgctcccgggccaccgcctcagtccccggagggaagtcttcaagcatgcaccaggggaggaactagggatcgtgggcttggtagctcgctaggatgagctccaccgcggcccgcgccagggaagccgacgacgacttgaggaccgtgtcaacctccccctgcaacttctccaggtcgaccgccatctcgtctagccagtgtgcgagcgctggactagtagatggtaacttcttgtcccagcacatcgagatgcccacccgtcgtcccgcgcgctccagccgttcgatggcgtcgtggaggaggccgggccccacgtcgttggtgagacgaagggccctgatctccctggcttggtcctgcatcaggcgttccagagcggcgagtgcgtcctgagccgtggcgagccggtcagctagatcggtgtcactgcgctgctcgcgcgacgccagcgccttctccctaacctccagctcggacgcccgcgctgccatcgctgcgcgctcggcccgggcgccttccaggtggcgagcctcgcggccggctacggcctcctcacgctacgtgggatggtcgcccagccgccgtgccgccacctcgcaacgggtgatctcagcctcgcgctcggcaagtgcggcatcacgctcccgccaagcctcctcccggaggcgcagttcctccgcgcgtcgcgcaaccgcggcctcggcggtggtggtggtgcgggcatgctcggcggcggcctcctcgcggaggcggagggtggactgcgcccagtccagctcctcctgctcgcggtgggtgcggtcgaggacctcgacccaccaccggatcgcggcctcagactcctagatggagcgagcgcgcctctccaggtcagacgcgcgttcgtccaaggtcctgccttgggccgccagcgcctcctcccgagtccgcagggaggccttgacctccgacgccggccattcctgggccgcgaccgtgttgaggaccccgcgggcggcctcagcccgctgcaccaagtcctcggcgtgggcctcatactgcaggcggatgtcgcccagcgcctcgtccagaatgctggaggcgacgagggccgcctgccactccacctccgtctcgcgcatgatggagtccagcgtctcctcgcgcgcctggatctcagccagctgagcctggtgcatcttgcgccctggctcgaccagggcatccacggtgcagcgcccctcctccactcgtgaacggtctgccgcgacctgcgcccactcggcctccagggccacacgctcatctgccagggcctgaacttggacgttgagcccctctcggacagtggagtcggcggcggcgaggacctgtagaaatggctccatgctcacgggaatcggagtagagaagggcggggtccaccctcgtgatgacggagtctagctggtcctcccacgggattgcgggctgcgctcggagcccctcctgcgtgtccgaatccgagggcgccccaagtgtagaggggtgtgggtgctctcagcaccctccacctcgggaccacgagccgactcggtctcagccttgggctcgcgctcgggctcagcctcgacctcggcctctgggccgcgctcctcctcgacctcgatttcagggccacccccgaggtcgatctcgggggcgcgtctggcatccccctcagcctcgctcctggagccgccccgagggggacctcagggccaccgccaccgacccccgatagcgtcctctcctccctcaccgggacggtctcagccatggtggactcagagtcggacctagtgtgaggccctcgggccctgctggagggtcgtgtggtgtccgcggtcccggtttggccggcctccggccaccccgacctttcaggcttagatccccggggagactcactgtcgagccccctcgggaggggatttcgctgcaataaaatcccaggggcgcctgttaaaaaaaacatagagagaaaggcaaagctagagtgaagagagataacggaatcggaaggcggcagatgtacctgcgggcggggagggggggcgtttgaaggtctactccggggctcgatgaagctcccccggcacggctccgtctgccccatcttccggagcctcttattcttccgctccggctccgccgcggcgggacgcttgtggctggtcggtggccggtcgactgtgcgctcggcgccgccgccgtgtggatgggaaggcggctcgaacccagaaaccttccgcttccctttcgggttggcggccgggcctctaccagccccgtggctcgggccaggcgccctggagccaccaccgccggaaccgccagcccgaccgccgcccgcggccacattgctgctcccagcgtcgtcgccgccgccgccgcccccagcggcacccctgcgggaccgacctccggcggtgccaaccgccatcatcacggctaggatactctctcggtcgcggtcgctgcagaggggaaggatcccatccgggatcagcatcggctcgacggtgtccaggctcagcacccgacgaaccaccgcccgcgcgtcttccttgccccaatccaagcattggcccacatgggtgcgcatcgggtcattgtacccagtgtaggcccacgcgccgcgggaccattcttgaaggggcgcgatgcggtggcggaagtagtcgccgaacaccatcgtcgccgtcagtcctttgctccgtaggcccctaaggcggtctaacactgtgtcgtattcctctccaagctccgagaccgccagccagccagcggatcgctcaggtgggccggtggggagccggagacggaggtggtcatgcagcgcggtgtagaaccaatccctcttccagtcgtcccacttcttgcggaggtgggtctcgatgtactgccccatcacccccgcgcggggctgaaagtagcatcctcccaccaccgcggactattgcagctgtgggatgaagaagtactggaataaccgcatggacggcctcaccccgatgaacatctcgcataggtgcgcgaagatgaccaggatcatcatggcattgggggcgaggtgcagggcgtggatctcgtagaagtccaagacctcgtggaagaagccagagaatggcgggattagtcccgccatggcaaaggacaggaggtgcacggaccgcttgtaagttcaagtgccttaatttggttttggtgattaatgacaaatctagttatatgagactaacatttttgtgagcttttgtttgactagtctcatttggatatgaaagtaaaaatgattagaggaatgtattaaacttcacatattctaacttggtctctcttgtggatccaaaatatagtgtgagctccctcattgatcttgattgattatgtgcatatgtgttcctttatatccatatgtatgcacatcttgaggaggaggttattctatattttgtttattataagatttctatcttgatttgaaatcatctttcatctcatctctctatattgtttatatcggattattatctatcacaaaagagagaaaagattgaaagatcttggattaaacaatttgtgtaattgttgctttggtgatagatgatataccgatgtttatgggattaacccctcttttacataagttttaaacaaggttatttcccgataatgagatgtggtagatatgcattctttggtgatggaccttaatcatgacaaggatgaaattcatggagataaagcgatatgtatcacttcttatctcctacttttgataggttcatatatatgatttccatgttattgttatataagtgtgagactaatgtttacttgagtcttatcttatttagtctcctttacattgagaacatggagatcatgaaggtatgtgttttttggtttatttttatcattgctacatgccttctccatgtgtataggataaaccccattggttcttcataacttatgcatacacttgcctctcttgtatatttatttgtatgcatatatttagggggagcaaatcctatacatttattgtgcatgttttagatccacgttgttcacctattatttatattggatctttacatttgagcttgcatacgagtatatgacacttgcgatgttaatgaatactgaacaaacatatccatatctttcatatgcaaccggttggtcaccaagtggaggatgacaaccgatttgttggtactaatgttcttctttgagatgtgcaaaggaataggtctaattgtgatgaggctaatggatgacaccttgggttgatggtcaccaagccaagggcatcgccgtgtcgacaagaatgaaatcaagcttgtgatgagaagaaagtcctgacaaatgatggtaaataccttggtataaacatggttgaatcaaatggtcacaagtgttgatctcgactcaagcttgaccccaagatggatggcgcaaggcaaaggtataatgtagctaagaatgttttcttagtcttttcccggtcttggtgtttggtgtagaccggatttgctagataggcggcgtactatcaagaggggtctatgaagcgagcttgcggatgatcttgtgccatattagctcatatgcatgtaggtgcatttggtgggcttgtctagccaagtgtgatgagttttctcaagtcctaaaccaagaaagaagtgggcatgtccaataggagtgagtgacatcttatgggtatgtccggtggatatcctttggagtgtgagccctttatccttgacttaagttgtgtttcttggatggttttttcatgggttggatggtcctttgaataagctttccatagagtccaagaacgccaaattccgagacccgagtcaagagatatcgccgttttactaacggtcggttgagctgaaaagtgacctgcggtctgaccgtgggccttaggccggtctgaccggacctgttagccggtctgaccggcgtggtaaggccggtctgaccgaccccactggtctgttgcactggtctggtttttggtggcgatacagagccgtggacggtctgaccggctactacactacggtcagaccggccaggttgagtgggctcaatgattgccctgtaacggctagttttctagctgttacaaagtagtccggtctgaccggccactctatggcggtctgaccggcggagcacagagttggggattttgactccaacggttagttttggttgttaggggtatatatacccactccccaacagcaagggcaaggttttggcactccattgcattatcttgaacccttgcaagagctctcacacccttgtgcacttagtttatctagtgaggtgttagagagtgagttgagccaatccaagtgcattgcttcattgttatagctagtgtggcacttgatcatcctcggcaagcatcctagacttgttactcttggaggttgccgcctcctagacggcttgtggtggtgttgcccggtgacctctccgaggagattgtggaggaggcccggcaccgtttgtgagtggtttggagttcaccaccttcggagtgaaggaagaactaccccgagtgatcgaggcttgggtagtcctctccgtgggccggctcccgccttgcccaccccttgacgaaggcgacgtgcggtggcttcgtggttgagcggtgaagttgggctcgcctcaatggggattaggaaaccggcgagtttccaaacctcggtgaaaaattccttgtctcttgtcttatttatttgttgcatttacatttgtgctatttacattcatagagacatatttgagcctatatcacttaggtttgcaaaacttaacttagttgcttagttaaccttgcacctcaccttacctagcaacttaggttagttttgtttaagtgccattaagttttaaaaccgcctattcacccccctctagtcggcctccttgatcctacaccgctccgggtaccgcagccgcggccacggctcctccgccctcacgacggcgtcctctggcatgaatttgcggacaaagctcatgtgcttccccgacatgatgcacgaggccggaagaatggcgttgccggcgtcttgtgccatggtgaccgaagagagtgaacaggggttggatgagagatgtggtggttgaggagagagatgtggtggttgaggagagagatgctgggggctgaggtgcaggaatgcgagagtgagaatggcgaaaggaagaagaaggggtctcctcctctcccccttttatactcgcctcgtctgggcctgcctcctcagttctctcagtcgctgctgccgcccccttgattctcgcgcccgctcgtcccactcgccccgctcgtcccactacgtccatgtcccgcattcaatgcggctgacagcggcgtaaccgacgtgaggcgcgcgatgatttcggatgtggctaggcgggcccaccgataatctcgtttcgcgcacctgacggacgcgcgaccgatgcgacgcgaagcgataattccggatgtggccaggcgggccctccattttcccagattgcacgcccccatgcgtggcgcgatcacccatgggcgacctgtcatcatggtgagcacttaaagctgcccacatcggtgaaggctgctcagattccccgcggggcccaccatcacaagacggaggttattaggcaccgcaccagaccgtcccaggtggggtgcggtcggacgtagtaccgggggctgctgtcggtgatatgggcccgggggtacccacgttagggggaaggagcggaggagcccttccccctagccacgtgtaagcagccgagaggcgccctgcgtccacctaggggcctcggggtaccccgtcgcacccctcgggcccaaggggttgtgccaccccgaggcccccgctcagctgccactcggcggctaagtgggtggaggagggggcgccgctggcgcatttatgaacggcgtcccaaccacccacgcaacgcacgtcaatcacttggaccggtctgtgaccggtagcagatagatgggacgggtggcagcgcacccacgccccgccctgtgtcaggcggcgtaggggcaggtatgccccatcccatcagccattagggctcagcacgcacgaccggtgcattcctggtagcatgagcccacaaaagtcttcaaggcttaatgagggaatgacaggggatgtcccccgtgtcagatgggagacggcgctgggacccaccacggagtaagcagccatattgcttccggtctaaggcataagcgggagcagaacctgaggaagagggaccccctccaagaaagataagacgaatagaggcggtgcatgtggtatcctcttgaactataaaaggaggaccttacccgccgagcaaggggacgacttttgatagcttgaactctaggggaagcacagttaggttttcccaggagcccaaaatctcttgtaagaacttaagcatagttccacacataggagtagggtattacgcttccgagcagcccgaacctgtataatctttggtctcactcctgatcactctcgacctcttgatcgctcgtgccctatcccctggccgaactcacaaagggggatctcacgtcctcccgctagatagctagggttactcctcgacaatagtcctttagtatgtgtcatgaaatataagtatacatgaaatgataaccgtgcaaataagttgagctctatctataatatctataaaatagttttattgggaatataattaatttgatatcacatatactgtaccgagtatcaaatattgtagggttccataaaaaccaatttaaaaaggatatgttaaatttaacttgaggattgaaattagatagaattaccctagtcacgtaaaggatgttccatcggaatatttaaaacatatcgtcaagtctctcaggacataaaattcaactcggcaaaataatttgccacacaaataaacggaggcaatgctttattgcctctataatggtcctagttgaatatttaaatcaatataaaaaagttatagcaagtccctgatttcattgggatcaaatctaaattaaattaaggcaaatcatttgtgggaagaaatcaataattcaaattcaagtgaaatatttgaattcctaataaaattttcaaatccaaaatgttttcaatccaaattcctagtctcaactatcaatttgcagtcaagtccctcccttttcgctctattattttccttctattcatctctcagccagcactgttcatggtccaccaaggcaccaacccgttcgatctgggtctacccaagaacgaactctctccccagagcaacccagccgcgccgatactgtacatctcctagcgtagcgtcacctccagaaaacccggcgatacgcacttgcccgcgcgagcgtcctgctcccgtcgcgccagggtcggcgccgcgaccgtccctaaccctagccgcgccgcacccatgtcggacccgcgtcgcactgcaccatgccgctcccgtgtgccgcgtcgcgtccactccgccgcgatcccgctcccctgattctctccggagaatcggcaccacgccgtcccgtcgcgccgcgcgcgttacctcgatcgcctcgtcacatcaccacagtcgcgtcgccatcacccatagcacatcgtacggccgccacgtcgcgccatcgtcaccatgctacgccgcgtttgctggttagaaccgcgcatccctaacccaagaaccctaaccacgccctacgccgcgacgtcgcccgtcaccctcaccatgaccccggcgccgtatgagaataccatcgctccgcgccgcctccgtcggataatgacgcgctctccgcaccagtctaacttctagcccagcatctagctcgactgcccatgtcctagccagtaacttttctatattttttttaaaagatcacattgtttattatttcgagaatattttcttcccactgtgcttgtctcaaacacaacctaatactccctccgtatgcagcaatgatttttcgtgtccaattttaattgtctgttttatttttaaaaaaaataaaaaataaaaatataagtagtcatgcataaagtactatttatattttatcatcccataacaatacaaatactaattataaaaaattttaaataagacaaataattaaagttggacacgaaaactcatgaatacacttaacgtgggacagagggagtattctgcatcgtctcactcggacagagatggcggagaagaaccatcaacttactatcacagtattggatttggaccggtctaaagaagcgtatttgtttaatttctgtcttgatttcaagatgccatcgcgagatgatatatccggaagaggtgctatgagctcttcgaccaaaaattaaaccgaaactactgtttcacgtggcgctgaaaatctaaagcgagcagctgttgtttcgacagaaaaacttaatttcgaagggtacttttgtattgccggtaccaggtttaagagtgagtaagctactacaaattattccccgtcagtataatcggtataaaattatagcgggagctaaaccaaaatgaccaagagcaactaagataaatttagggttgggttacgattttttaggccttcttagcctgttgggccttctaacaacctcaaacaaagtctacattagcccctcatctataaatatatggacccccgcccccacactgtctcagcccttgtgtggaagggaggagaaagaagagagacagagcagatatgtcgcgagtgaaagcgcaagatagaagggattaggtttggaactatagctatagtactctatacctagtacaaatagcaagtctaaaattagggtgcattctttttacggaattgctaaccttcagtcgacatgaaacccatctccaaatcttgcagattttgggccaccggatgagcttcgtgattcgtgccccaggccttctcctctaactccggcgacctcctcatcttctctggcgctgatgacaccctagactccgacagagaactctacggattagggtcccgggttggggtggtgatgggaggaggagagggaagaggggggagttcgccggctttagagggatggccgtaggaggtggcaacccggcggtgggcggtggcagcattatcaaagccgcggggtcgaaagctggcagtgcgccgatgtagatgccaggggcaaagcagaagggcgtgttaggaggaggcggccggtgttgtagccccgttgccggagacggggaagacggtggcgcgccgccgttggcttaaggaaagaagaggaggagagggaggggaaggagaaggggaggaggctggctgggagggggggcggcctcaccggcaccgttggcacctttgggccagccggcgtagtgggcggcagcgcgatggcggtgggggatcgggcggggcgagatggaacccgcgaggggagtggtagtggcggaatgcacgagcttgagaggaaagggaggagagagttagggttgaggttttgcacaaatcttaaaaagcatatctaacggtccaaaatttgaaagatggaaggtgggattttctatcaacatatatgtagacagtcacttctttttaaattatgggtttaggtgattagctgcacacaaaagtatgaaacaagaaacgtgattagcttatagttaattaagcattaattattaaaaatttaaaaaatgaactcattttttaaatcatcctctatatatatgaagttttttacggaacacaccatttatcaatttgaaaaacatgctaaaaaaaacgagaagtagctataagcttaattagctatttaaaacgcatcctagattctcaacgcagcttacaagccaagaagcagcaaatgaattgttggaagaaaagaaaactgatggtgttcaggaggcacgacgacttccacaaaccatgaaatagtttccacatatatagttaacatttaaactctctagtctctagacagagaacatactacgaaatgtgaagagtgcaattggagcttgttaattcgaccacgattaacacgagttgccatctgaagcttgcaagagcacaagcttgtccgttggcggccaaaatgtcctgggttgctgatgaaggacgaacttagctagcaacaaaatagaggctcaacataaggctgaactcaacctctgcgctccattttgtctttcttcatggcctcctcggcatccctgcaaggagaaaaaaaaaagcattgtactacagaaacagaaaaatctctacatgggtcccccttcccacttatagcacgaagcacaggaatcattcaaatggcatgcaagaaattttcccgaaacggtaactaggcacgcatgcacaaaggcaccagggagatcacaagatgctcctttcctgagaagcaaaaaaggcttgcatactaacccgattccacatttataatatacattcttttctactgaatctataatatagtgggctcttcacaggatgaagatccagaataattaccttaaagctttctttatatcttcatttgcagggtccaacttcaagccatctgcaaaagcttcacaagcttttccatagtcctatacacaaaagaacagatcaattttttgacaaataaaatcgaattttaaaaaaaatgctcttttagtcttttttacctttataaacatgaaagctgccccttgtcgatagcatgctttgggccaactgggccgcaacattctgcacatgttagcatcagcaatagccccaatgccggttgacaaacgcaaccagcataggctcctgtttgctagcagggttgccttatcatgagcacttgtgctaagttctattgcctacagtaaaagtacatgcaacttttagcaatacataaaatggaatgtattgtttgtctatattactcacctcaactgtaggtctgtagctattatcatgtcttgttaattaggtaatccaacaatgctagaggtagggatgaaaacggagcggatagtttccgcccgcttcggagaaaaacgaatacggatacctttcgtatcagataattcttagatagttcagatacggatacggatattttctccgtcggatacggataataattcggatatccacataagttatgagacatacccccatttttttataactctatgaccttcaatagacatttttagattttaattgtagttcatctcttatcactagtccacactattaatactatttaaatttttaaaaatatttataaatcatactacattttatataaaatgagctaattatatatgttgatatttgtttctattagaagttgagttggttttcgtgttatgagaaaaatttgtttccgtattcgtgtccgatcatattcgattattactcgtattagagataatctatatttgtttccatattcgagctgtctgtatttgtttccgtgtccggcaaaaaatatgaaaacgaacatggtatgagcattatccgctccgttttcattcctagttagaggtagtatactggtagtattgaaacaacttttttaagggtgaacagagagctacaatgttgacatgaattgtctccaaaaaaacaacacatttaggcactaaagatgtgttgcaatgtcttacgttagtgtagtgttgtactgcaagcgcataatcatttctctcgaaagcctctctagcttgtaatttcagttcagcacttttccttttagacagatcattatcctgagaacaaaggattatcagtaagaacatgcatgtataactaataccaatatgaagctgcatctatgaaacgattggttaacaaatatcacagtcaatgattcacatatcttgcataacctgtaaaatatccagtttgatattccagtactactgctttgaaatcagttactcaactacgaactagtaaatatctgtgcacagcgcataacaaaataacacatggaaagaactctctagctttctataaaagctgggccactcaggccttttatccaaaaaaaacacatgaaaataaatgttccatattactctaaaattgctttaactgttcacattcagtacaacaacaaatatatactgttgtgttgtgctcatcagcctcatcataaccataaccggccacgtcaaatgaagaaaaatacataaggaattaccataataactctcaggggaaacagaagggaagaaaaatacatgagaagctaagtttgcatttgaggtggtatgttactaatatccatgtttgtgatggcactagcctgattttccaaaataattgatggggaaatggacgaaaaagataacaaagctaaaagagttcaacaataatacaaggaaacagaaggtggcaaatgaattggcaagctcatcaaa

SEQ ID NO: 12028 - DNA, 2202 bp, Oryza sativa
agagtgatagattgctttctaaaccacttaatgtactacgataatgagaatgcgcaacattataattcgcagtttgctattcaagtaacaatgtcatgtgtttctgccgaacacattaacatcatgttgtgaaagataggtcccacgatcaaactaatgagcatattaatgtgaagttcatgctcatggatccacactacatagacttataacttaatttgaagtaagattatgttgctagccggtgcatatgaaaagtaatgcctttaacaaaatcctagatataggggcataagaattaattaacacccaataaaagtaagttaattcctaccaaggtattatgatgactataggtattgttgtcatagaagcattatgttgactgctataacacattgctttggtttactattttactaagattggactggttaggcttaacccatgcaggagcgacaactcacgtacgctaaaccattcccaaaaccccaagactaccaatcctaaggcgtgcttaaagggaacaaagggcgaatttccatcgccaatgcaacaccaccgtgttcctgtcactgctgatcccatcaccggcaacctactaccacaacaccaacgccgacaaataactaccggcaacctactatcacaacaccgacgccgacaaataactaagggcgacactaatggcttctccaaacaccggatagcacaccaccaaattccacatagtgatcatacatagcctaaaagttcatgattttaaaaattaactccagtagtagttctatccatcctcctaatatcctctcttgtaggatttctagagctgatcttactagccaaacactatcaggcaaactccatatcgcacaggagctagttcccactgaagtcagggttaggagttagaatcagtgagttagagccccttataaacaggatttgcatgtccaatttacagcaaggacggccacaaatccatcagatgatgtgggcatgtcacgcagagctatttaagcaggcaggaagaacaatgactaccaccccaactaagctgccacacttacaaactaagctacaagtggataggcgtaaaaaatattaaaatgggtaaataacactccagtttccgtgccaactttagttcacaaaagcacaagagttttcgtggcaaaaagatgtactggaactagcaacagagcagaagctcaacttctactgacaatataagccaagtcactgattattcttaacgcaccggtcattcttcacggcctgaagcgctgccctacaataaagaaaatgttttcagggtaagcattagacagcataatttatagacagcttttccagctttgtgcgggcaatgtttcatggagtattaaggaactatcacttcataataacaaggcaagcaacaagcagacgaaatactagcattccaaaaggatgtaacatttactattcatagaagcagcaaatattcctttactcaacccatcacagtgaagggtaacgagacttgccacaacgaaaataaagacaaggtactttagagcattctcaatatcaacattgcagggggggggtttccacagttttcaaatccatttgaaaaggcatcacaagcattaccatattcctatatgcacagagcaacaattaatcaattttatgatcaaaaaaatttgtgagtaatatgttctttaataacttaattattccttaaaaaaaccttaagaagcatgaaagttgctccttgccgatagcaggcttttatccaatgaggccggaacattctgcacatattagcatcagcaagagcttgttttccattttccaagcgcaaccagcagagactcctatttgccagcagagttgcagaatcatcaggactaggtccaagtcccagtgcgtacattacaccaggtatacagctttcagcaataaccaaaaaaacatcacacaaatgaagctatgaaagcgttccaaaaatcatttttaaaatcatcgccaatattaatactaaaaaacagtagtactgacagtaattatggacagtgtcagatagatgacttgtttatcttcttcatctctagtgtttgcaggtttgcataacttctttctgttgcatgcataatgttattgtattttttgaacacccgcatcgtgatggattttctaacgcaggctcaggtt

SEQ ID NO: 12029 - DNA, 1097 bp, Oryza sativa
ttagttcattcatgaaatatatcttttcaatatgaccaacaaattaaaaaaagtatattcatttttttagagataatctacatctgttcttgtttctcagacaaaaaaaaaataccatcagaatacccccatgcctcaaatccacccaagtttcatccaacagacagcggaacaaatcctaccagatgcaaggcacatgacattggccagaaagaaccttcaattaataggtgtgatttaaagacaatttacttggtacaaagaaatcaacaaattatctttatatacaataactttttgtaaatagtcaacagagctataaaattgatacaagtcatctccacacaaattaacaatccatttcaagacataaagatgttctgcaatgccttacacttgtatagagttgtgccgcaagtaaataatcctttctcttgaaagcctctttaccttctactttcatttgagctattttctttacacaaagatcttcaggctgagaacaaacttattgttagagcagcagtacatttaatgctgacatgaagatgcattcagaaaactacttcggcagtttcagtatatatggatgttgctttagattacacatgttaaaacttcaacaactttggcccctaatatacaagtagctgttcttgatcaaggaaaacattttttttttgcaaaaaaaaaaggtgaagtaaaaaaatggcaccatcatatcttcaagtccaagtccttgtgaacatcaggagcaattacaaaataaatgatcgagagtaataaagttggagaataacattatggaaatacaaggatggaaaaaaaaagataccaatggcttcgaaccaaagttttttgcatgggcaaagattccatcaatactccaatctggcaccgttgaaattggtgaagtcaaaggaaataacatctcaacaatttccctatggacttggagagcagcaacttcaattggaaaaacaccaaactgcaagatgaaaaaaaaaagttctttcataatatatcatgactagtacaaatgccaactataattgcaaagaatttgaaccaaattagaaatatttcgggctgcagga

SEQ ID NO: 12030 - DNA, 11572 bp, Oryza sativa
ttgacgcattccaatgatttagaagatatagccatatgcaatggggtatcatcaagattgaaaaccttatcaggctgttggaagtaaaatgatggaaataaggatcaatagagaactatcaatcatatgcatgcttgcaaagaaattagacagcatttacataaattctgagcaaataggcatctttatttcattcaaaccagttataatcaagtgttgatatagatggaccacatgtaccaaaggcaaaaacatataagttttctgttatacacctaagaaaggaacaaataaaatgaagaaaatattacatctgcatgatggtccaataatatcttcatggtgctacattgaccatgagcagcagccgtatgcaacggggtcccatagagagaatcaaaaacaataccaattcctcttgacagcagcaattctactatttcacagtgtcctggaagagaacatttgttaaataaaaaaaaaactaaattgcaacaaaatgtttatagtatctgcagaagcatatgatgcagacctaagaaatgtcacatttgattcaaatcaattcccctgtattcaaggaaaatattcaaaatagactcaggatcagggttcagtttaccaaccataaaccacttggtaaccagtaaatagggattacatttttaaaatggctggttggttatttgagttctttgtaattgttataggcatgagagacatccgtcatgttaggagcacatatgtctatacaacactaggaaaaaatatatccccactgcctgaaaaaaggggttggtgtttggtgctcgacagtcccctaccctttaccataaaagatgttttctggattgtataatgtgtgagttgatttttaaatcattggcaaaggattgagttattggcacatcagtatgtgccattggagatctgcataacttcattaagttatgacaccagattgtaacataactttattgtacttatttcacttccccatctcttttaagttgtaatctcgtccggtcttgggcttttgtctccgtagtgctacctctttagaagtacatataaactaagttgggtcatctcgaccttccattgagttctcaggacaaaaaaagaaagatagcattctccagtttcatttggctgctgctcaactaattatgtctttaacgctagaattgacagcctgcagcatttattatgttcaaatacttgctcaaattttgactgaaacggtgcaaattctggagccttgctgaggattttcagtttcgaaatgttttttgccgagcacgcgcaagcgcaccgggggggggggggggtgtcggtctgaaattcacgaaattattagaaaatttcctagtgttgacaaatttttgtgatttactagaataagtaccgaatttttttggccggaattattagaaaatttgacaaaatttgaatgaatttgaataaattgaccaaattcacaaaaaaattgcaaaatgccgaaaatttcaggcaagatatgtgcttgcggctggggggggacgaaatttcagaaataaattgcaatccctggccctgctcaggaaaactaatagagtagataatagaacaaattaaccgatggttaatctaaagtgacaaagtatttacacatatatatcaaacatatttttcaaaacatgcgtagtgtgagagagatacctttcccggcagccgcatgaagaggtgatcctgatttaccaacaatcattggatcagcaccatgatcaagcagatatcttgtagatgcagttctcccaaaaaacgcagaaaggaatagtggagtttcacctgataagaaaaggtagtgaatattaagagcttagggaactcatatggtcatataccattcttgccttcaacaatgcaaactacaaaggctcctgctccacaaggtaaaatatatctgcagttattgctgttaaaacaacaaaaatgtggatttatcttcagtgatcctaatgtaataccactgatttgaaaagaactaaagtgtccaactagtaatgcagaaattttgtgcaataaaatacgggaaaaaaaacatttatatgccaatgacattggccataattaatgatattgcaccccgtttggcacccatgaatttgctctagaatcatggaattggaattcaattcctatgacatgggagtttcgaggacagcaagaatcagattggaaattccagttcaattcttagtcagaatataataatagaaaccatcgccgctgcccaagagtcagttcctttggtaattgtttggtgggacctttctttcttgataaaatcattctgctaaattaaatatcgtctcgtctttaatagtataaaagcacagtggattggtgtgtgatctcatattaaaatatggatttgatgcacatagaaaatgaacatgacccctttttgaaaaagcacaacccgatagaatgcattggtattattgtttggaatcaaattcaaattccattaggatatatataaatttgggtccagctctagatataaacacaatgggggaggcactggtatagttgatatagtaataatcatttgatattccgcagcaattcaagctagaacctgaagtataaatttaaaatgcatacattgcattgcacagcatcaaaagttgcacaagcgtgcaaataacaccacaagctcatatagtacgtaaccagcatgaaaccaactgtcgcaggtgaggaatattaaactatatggacacgcatatcgatctcttccgtttccccgggtaggagcatccaggataagtgaacgattcgtacattagagcgaatggaaggggatcagagatcagaacctctgtcgttggtttggttgacgtcgaggcggaggtcctcgacgaggtacgtgaggacgtccatcctcccctcggtggccgccaggtgcagcgcgcggctcccgctgccgccgtccgccacggccgccaggacgtccgcctcgccgcggccgcgccccgtcgtgaccagcccgcgcgccatctctacgcccagcgataagaagggggaagaaaataggaattaatgggggaaaccctaggagggagagagagggttgggtgggtactgactcctgaggaggcgaaggttgccgtcgaaggcggcctggaggagcatcttctcccaccgctgcttccccatccccttctcctccatggcgatcgatcgagcgggcggcgcggagaaggcgaaacgtccagactccagactccataccgaagtgaagtagtagtagcagcctgcagcctgcaagtagagaagacgagcggcctgagcgggggcgatcgcgttgattctgttgcgacggagatgacgccgctgaccccgggcccatccttccacgtcatacggtgctttcttttccttccttcgcccaaaatactagagcaagtttaagtttaatagtatagccaactactagctccagttcatctatagccaatctagtagctcattcatacaatagttacatactacactattaatatctggtcccacctatcatacacacagtgtcttaaagtccgtgctacagcttgctacaaatctatagcccgttgctcttctctcacctcatttatctccttaaaatatatttgcagctggcttatagcctgctattgtacctgctcttagctgtaagcacatgtgaaatagagaagagaagagagagaaggaaaactgcagcacggactccaatatattgtgtgtatgagagatgagaccaaatattaatggtgtaatatatgtttataggtaactcgttatggttacggagaaggtatatcttctatcctatgacttatagaatatacgaatatgatatacctttgcgtacacaggttgcttccatatacgctaaggtaattcaacaaatattatggaaagtatccttacgagtcgggagactaacaaagtcccactcggaggaggtaaggtgtcttctatatcgtacggggtccgatattttcaagttctacatggaaatgattcacggtgtaaaagggacacctcgggaggggtttcgggtatcgaatttcaccaccaacacatcgaccatagcctacaaagccggagcacgtgaagccaagtcaccagaaaatctcgtcgaatccatcgactacgatctcgtcggtacagccgaatttgcctactcctattgtattatgtggttttccatattaatcccatataaactggactagctattagctgataaggggcttgaaccaatataatccttgtattttttcttgcttgatgtcgtatcgtgtagatcctcgtaccaacgtaccctagtactctactcatctggtctacgggtatcacccattgacataactattgtatgaataagctattagattggctatagataaattggagccaatagttggctatactattaaactcgctcttagctgtccaaaattattactccatgctataaagtgtttaatcacatattaaatagcaatattttgggatgaatgcagtaggaagaaatagaatatatagccacggtaagttttgttctatacttgaacttttaaattattcaaacaagaccttaaacatgatatcatgtttgtacatatgtagtccttccatgtatcatagggaaaaaaacaagaggaaaaaagaaattaaaaaaaaccaagtgattttgcatattaaatatttttcaactatgtacatggcatttatttagcatattagttacatatttagtgttggtagctaatttaacttcgtatcggcatattttgctttttcgaatcatcgttgcacctatatttctatatctatacttctatactaatataaaaaggaggagttgtcccccctccaatcctacaggtgaaatcatccggattaatctgcaccgtccatccgcgccgaatacttcgctcctcctcctccagccacgaagacatcgctccacacgcgaagacttcgcttctcctcctcgctcgctcctcctcctccccgcatgttctgccgccgtgccgccgcatcctcgctagagatcctccccgcgtggactgccgccgctagagctgctgattcttccctgccgccggagccggtgcttcttccccgcgtggactgccgtcgcatccccgccgccggagccgctgcttcttccccgccgcagccagttccgacctcggccccatccgccacggccggagctgactttccgccgccaccggcgccgacgtcctcctcatctgctgctgtgccaatcccttcgccgatcccctccatccccatcatctcttgccgctcacctccttctactctaccacacaacccggtgctctctctattgtcgcttgttcctctctccccttggttaacactgaggagtactaactaattttgttttggatgttatagattttataccagaagtccaaaacaacatccatcggtatggagacgagttgtttcagggtgttgaattgcttgccaatcccccttcaattttctgtatgaaatatactcagatcttgtgtcggttcctcatgtcgattcctgtgtgattttctgttgcggagtatagcttcatcaagccaaatttaatgttttctaatttctcctgttttattattcttacgtgatattacttgtagcagctaaaatcaagatgatgtgacttgggtaggttttcagttgtgtttgtatgcaactaaaagttgccaggctacactactaggtaagctggcgtgatttatgtttttttttgcagtgtcatccttttgagaagtgcttctatgctccttgaaaaaaaacctgcacggaaattaaagcacatcaatggttcggattaaaaggtgattactagggtaaaccgtcattagcaaggggcaatttcgaccaggaagtgaaagcccacatgcagcccaggccgatcgatccatcgatctgggaggtcgacacggcaacagggctagatggtgaagatcaccagatcggccgggcatgtgcgaggaatgggagggcgacgagctgtgagggctattgtcgacttgttgtcgttgcgctcggcgttgagacagattatacagtatgacgagatataggaccagttctcgaagggcagtgtggtgtggaagcggcagaccagatggagaatggccgcatcctctacggcggcggccatccatgatgactcaaactcctgcatggtagaatacccgcttcttgtacctagtgaaacctagatagaaatcccaacgattctcctgttttttgattcagtgattttcgtcctttacaaaagctaatccttttggccgcttgacatagatgatgcagatattatctgaatatcattccaggtgcgtcgcgagggaattgccgttgcgaatcgatcgatgagagatggctgggtatggggtgggtatggatatgaacttttgcgtccgggacgaaattgcccctcgctgatgaggtttaccctgttaatcgctttttaatccagaccattgatgtgctttaatttttgtgcaggttttttttattgaggagcatagaaacacttctcttgtatgaatcatatcttaatttggtaacattaaaattctttctgagttatctcctaatttcataccattaaaaacaatgacttttcaagaatcaagttcactgccatgatacaccgaatatagccatgtgagggagctcttgccatcatattttcatgtgccatttgatgaccgtaaatttggttttccaagatgtgcagcaggtaacactgtcgatgcggctgcctttggtggtgttctctgttcaacctgaactacaggagtaatcggtctgctaacacagacctggtctcaaggtgccatgcaactcgctgattccacaagcttatgactgagtagcaggtaaacattttgtccatccattatctgcaaatccacctgtgcaactctttgcttcccaaatttgattgcatgtgttgcatatttttactgatgcagaatcgaatggttttaatgttgtatgtgcagacactgtggcaacaaatctatcccaagtttcctgcggttttatttcatttgcactctgatttaaatgaattacatatgcagatgtcaatctgatttacctttgtacatgattcaagattcaactacagcaattgaaaatgttcttccctatagatcagaaagaatgaatttttaatggtgaggtataacaaagattctagattatgcataattttcttaccacaaaactgaaatgatgtttgatataattcataaattattctaaaaatttgttttgtagatcggtaaaattcactcggaatcctgagtggtagaatgacatcattggtcttatctgaagcaaagtattcaattccctcttaatttgctataggaagccgtttgatactttgtttatgttggtctattggctcatttggaagggaacgtactgcaagaatctttgatcagaagagaagcacagcagcccaactatttgctgacatcaaggatggaatctccatttggaaggaagctggtatgttttaaaacatcagtgagttgtaccgtgttttagtttggagcaagtttgttccatggccctgttaggcttcgacaacacgttctgttgatataatttatacggaattgctaagcatctatcgacagaaaatgcatacccaaatcttgcaaattttaaatcaccggatgtgcttcgcgattcgtgctccatgtgcttcttctccaactccggtaacctcctcttcttctccggcgccggcgaattagggtcccggggtggggtggggtggaggtgggaggggaagaagggggaggtggccgggctcagagggatggccatgagaggtggcagcccggtagtgagcggcggattttaaatttaaaaataaaccatctcgatacttatttctaaacctgaaccttcttgcccactccgcctcgcctcgcttggctaaacaatagtcacaccatccgcacttgctcatggaaaaaatattcatattcaaaaataagttttgggaaggtttatttttaaaactaaaaatgaaaaggttcaaaaaaattaaaaaatatatatctgtgattggtcatatattacatttttatctgttggacttcatatttctaacgagcacggagcctttcagtatgattagatcaattccctgttatactaccttggagttgtatgcttgtgtcatgctcaaacagctcgactattcagcccatccaattttcaaatgatcttaacgactgattgtcgcagggtagagacatacaaagaacaaacaataattttgtttttaaaatagctcaaaagaatatttagtgaaattttaccagggtgaatatgttgggatcatgagttcccaatcacaaattccctcgccgcaccaagtgtgccccttttcaatcaccggttcttaaaaatatgtttgtgtgttttgggtgacattacaggaaaatgcaataatattttagtgtttttatatgtcgaaaacgtgcattgcacgtgcacgattactagtcttagtataatctaaacatagcaagctaagggacctaaacaagtgctattagctttaaataggtgagtttatgccactatgctgctaattatgctcgttcttgctataaacaaggctgcaaaatgtttttttcatgaaaaaatccatttgctattttatatgtcaaggattgacgtgttccttttgttcatgtttagaaatggaattctgaacattgcgtgctcataggaagggctgcatgtgctcagaaaaaaaaattgggagggaacctcttttttttatagagctaatgttcattaaacacctaaaactcaacatgcaaacataatatttagagagaatcccttatatgccactagaatttgaccagttcccttatatgccactcaaaattggcttcttccttatatgccactagtttaagtttttccacccttttatgccactcccactactatagtgttagttgactgttagttaaaggttagtttttttttcataaatgaccaatatgccctctcaactaaaaaacgtgtaaacttcaaaaaatcataactaatttattttaaatcctttttgagtgaacaaaattttatcagaaccagcgaaaaatgctctttatattaaaaatattgttggaaaactgcatgtttcatgcttatattgaaaatttatttgtgatggtaatggctaaaattgcatgtgatgtagaaaaaatcaattttcatatgttgtatccagtagctatattaatctttttacaatgaagttaacggtcaactgacggcaatggcataaaaaggaggagaaacttgaaccggtggtataaaagggagaagccaatttgaagtggcatataagggagccggttaatttagagtggcatataagagattctctctaatatttattagcactcctaaaatctacaagcatgtcacatcaacccattaatcacataaagttcaacatgcaaatatatagtaattgtctacaatttatttcattctaaaactgaacacatacatgctaaatcatcattctcaaatcattttcataatatttcaatccaaatcatttctttgtttttccaatatctaatatatatcccgcaacagagtgtggggcgatgagagtgcactgtaacaaccaggactctagaaccgcttcaatctattatcagaaaaacaaattatcaacatctagctaggacaccaaactagttccattaaatttaacattaaatatattttgatataatgttgtttgtattgaaaatgttattatattttggtcaaacctaaagaagtctgattaagaaaaaaatcaaacgacttataatatgatggagggagtaggtccctaaactatcaaaatgcagattgaagttctagaatttgtcgaagtatgttatttcgatcccaaattgccacagtccctctgagatcctacgggggactaacgtaacatgccacacgaagataaacatggcatcatggctcactgacaaatagagatccacttaaaaattttcctttttctttatttgttatttttattctctttttttccatttcttctccttctcactacagttgtaggccaccgcggaatgcggcactcatctcgacaacctcaagtcatcgccaacaagggaagggggtgacggtggcctagatgtggctagccgcatggctgaggagatgtgggaagggggagggcctcagcgatggcggcccaggcgtatctagcctgtgagggaggagatgcgggaaatgggagggcctcaaagaaggtggctcaggtgaagcatgctggcatggtagagaagatggggaaatagcgcagcaaggggaaggtgaggggtcatcaacctcaagcttctgactcctctttattgttgctgccttctgtagggcggggttcatctggcatagcctcaccaagcttgagttggtgggcatggaccgggcacaagcccctcgatttgaatggtcttggtccattgttccaagcccgatgtcgacaccttctactcagatccaacaacatgcggcagtgagctccctttcagcctctccatgtgagcaggcaagttctagctttgctttcattttttccgtgccgctgacatcgcccctagttgcctctggtcaagctcaccttggcagctgccctcgagctctcacagtctcatcgtagtttgtacatctgaatgaagaagaagaaaacggaaaggaaaagaagtaaaatatttttttatgaataggccccacttatcagtcagtgtagaattgctgaatatgccatgtcatgatgtcaatgtctatatggaatgccacgtaggatcccagagggaccgtggcaatttaataccggaatgacacaatttgataagttttctggacctaggtgtacattttgagagattagggatctatacgacacacccatataagttgaaggactgtccatgtacttctactcttttggtttgagtagaagatgattgtgtgctgccaatgacgtgaggagaagaggtcggttagataactctccttagagcatgtctagtagtgcccctaccccgttcttattgggattactagcaaaaaaccaactccaatctatactttctatatagttggtacccactaacaattattagaagctaaagctcaacatgcaagcatgccacatcatcacccactagcaattactattctagcccatttaaaatcccatgcaagcatgccacatcttcactcactagcaattactattctagcctttttttaaaaaaattatattctagcctattttaaatcccatgtaaacatgatacatcatcaacaagaatgtgtcaaatcatctttctcacattattttctcaacatttcaactttcatcatctcaccaatatttaacatatactcatccataaatcccgcagca

SEQ ID NO: 12031 - DNA, 20948 bp, Oryza sativa
catccataaatcccgcagcaaagcgcggggtatcacctagcattttctcattttactgccaaaagtttggagttcccatccctttagttttcgctttgtgaggaacgtacaagcgggccttcctgatccgcttccaattgcgtgctcttgccgctcaagtcttgtacccgacaatcatgcaggaggaagaggaataaattgatttttatggttagtttcacatgaggccaacgttttctattttagggagtcaatttttggcaacctcttggagggatatttttttttttcacgcatcaaattatgtttagaatttgaaaaaaaccaaaattttagggatgagatttagccaatctcttggtgttgctcttaggtccattttgaaatagaggactggcaaaggaaggattcaattgcgaaagggcctatagtttactagttacaagagcctcagtaccatcataggtcctgggttcgactggtgacgtcgtgtcacgcctagaaattcacgaaccagaatttctaagctgaatgtgcattaaatccctgtccaggaccagccagggtacacaaacggcaattgttgacatacagatccacgtcttacaaaaatataaaagattacaaatgcagcggaaaagacaaaagcgagctaagcctgaagacttgactcctgcaatgaggtgactctattccacaggcatccttgacggcagtgacaaaaccaacttcttcgagacatctccaactgagaagaacttcaactctggggtgggggaaaagagagcaagactgagtactacccactgtactcagcaagtcataccggaagagaatgtatgatgcagggtataaccaaaggaggctagaggttcatttgcataaagctagcatttaaaagcagtagttgaaagcagtaaaacagttgtagcaattaatcaatattaaccaatcactgtccaatgctacaccaggttgcaacaggcccaaccaaccacctgaactataccagttcattaagctaaactaggggtgagactaatcacgatgaatctggtcgatcgcccataaccgcgggcacgactattcgaatagttttactctgatcagaggtgtacaactgtacccacaagacacagccccacgacacgttaccgtgcgccgacatgccaccacgacataccggaaagaggccgtgacaggatccttcgcataaccccctctaaccgatcgcaccacaccttagggttcgcccccgtcatcagcaggcaacgggcagcccccctttcatgccgcggtgaatccagaagccgatcaaccggacacctcggccgacccaactccatcacgcccaccctcgcctgggtacgtcggctagaggaaagctacactacactacaagcccagccgttgcccacgctggcttgtggtaagtacgataagttcttctagggcatcccgcgaaccgatccttaattgccatgggcacgactagcagaaccatgcacccacagcccaccatgtagtgtattttaattaactaacaccattgcagtggcactaatccaaagctatgccaataatcaaagtctatgcattaatgtgattccccttttgtgtactagttgaactaagcatggctaagcatttcctaagccaacatctaatcatttggatacccaagttatcaataacataaggtaaacaatatatggctgagtagttgggcccatcccacatgatattgtaaaacgatgcaacatttaatagaaatacaggacatttgtaaattgggtataatatgatcaatcgtaatgcatgacttgccttgctctcacactgatgagaccacagcaacgtcttcgagaaaccgcggatcgacgaagcggccgaaatctacgcgacaaacaaagcacacaaggaaaacatgctataagactactgaaacaggaaacaaaaccatttttaatggattctatgcatttttataaatttactgagacttgaatggacttaaacggagcttggatggattagatatgaattttagaagattatctgtgtttttactaataaagaaaagaccttaatagatttattgcgcaataaataaccccggatgacatcagcaaggggggcggcgccgacaagcgggccccgcatgtcagcggcacaagaggaggaggaggtggcctagcgggtgggtcccagcagacggtggctcaaaggggaggaggaaggcggcctggctcggctcggcttcaaggcggccggccggttatggtgagggcggctgcgcgagcgcgtcgtctgcgacgacaatcggcggcgagaggcggcggcgggcggtgcgaaaggcagcggcgaccggcgcgaagggcggcgacgcacggcgcagcccggcgctaggagggagaggaagggagaaaaagagggggagggaggcctcaccggggattcggccggcgtgggtgaagacgacggcggacggcggcggcaagcggcggatggcggggtgcgcggggtggacgaggcggctctcgacgtcgcgaggccgacgacgatgacggagtggctcgacgatggccctagcggcggctagcgacggatggaggcaacaatgggcggcggcgcgtggcttggcgtggggagagcggtgcgacggcggtaggggcaaccgagcggcggccgggatagctcccatgacggcgaagctagcagcggcgacggcgtggcgcagcggcggcggcgcatggccggaggcgtaggcaagcggcggtgctagtggcgagcggcgcgatggaggtaggaggcacgagagagcacggcgagtggggaaaaagagagagggggctcgggggaatgttttataggcgaagggggaggcggacgaggccgagaaggtggccgatttggccggcaacgtgggaggtggagagagagaggggggaggattcgaaatgaatcccatctccaagcgggtgtgtgcgcgtgcgggagtggtgggagagtgggcgggcgatagggacgcggagcacaggcggagtggggcacgggaggagcaggggaagcggcggcgtgggcggcggtttgcatagggcacggcggctggaggttaggggtgaacccgacaggtgggccccacctgtcggcgcccagggggagagggggaggaaggtagcacttcgggggaggggagaagtattgggccggcccggtaaggagggaggcacgggaggcgagttgggctggcggcccaaaagagaaaaagaaggaaaagaaaaaggaggaaaaagaaaaaggattttcctgggattatttattgtggtttaaagtttttaattggttaaaattatttattgagctctgaaaattccactaaaaatcctgttagcatattttgacatgtagaatccaagaaaaattccacatgccgattccaattattatttacatttattaatttagggattcatctctaggttaaattaaatcatttctttggacgatttattttatgaatttaaagcaaggtaggggaacttcagggcgtgacacgtcgtcaatctccagattgatttgctggcccaatcttcgaagctgctcataagggtagggtttgcgtgcgtgcgttcataggggtgagtgtgtgtgcgcgttgtgagtgtatgcgttgtaccgtgtaatttaaaaaaagaagaaggaaggattcaatttcctataggtccttttcaattcacagggggaagatctgttttttttataggattgtattcctatggtcaaacctcttggacagatatatagaaaaataagcacggcgttacgccttagttatattgtttatatagtgtaattaaatggcttctctttccatatctattttcacacatctagtactacgttaatttctatgttttttttctagagtgagtacgcaagtgcttcttaaactttgtgcagttgtatcatctgtgtcattaaactcttaaaatatatttttagatcccaaacttttttttggttgtcctacagctccaaacagactctaacccgattcatacattgacaaggcatgccaccgtggtgcatatgtgtagtgggacccacgtatcagtcatagggaaaaaataaaattaaaaacatattatctccttttttttaattttatcttttttatatgactgatatgtcattcccacttgcaggtcggccccaattgtgacattgtcacgtcagcatttagagtggattggtttccgtttggacctatataataatcaacataaatttggggatccgtaaatacatttcaagggtatagagaggtagatgacataaccacgtaagtttagtaaccgccagtggactttactttttttttctattcatatgtttttcttatatgcattttaaagcgccttaggctgagttcgttaggaacaaatctactggtgcacgggaaacggagtggtctattagcgcgtgattaattaagtattagctattttttaaaaaaaatggatcaatatgatttttaaagcaactttcgtatagaaactttttgcaacaaaatattccttttaatagtttaaaaagcatgcgcgcggaataaaagagagatgagttggaaaaacagagtgctgaacacagccttaaaatcgtgagaaactgcgcgtgtaaactgccaatattaaaaaatataatatatatcttatttaaaaaaactgtttgagtttagattattgtgcaaattggtgtgttttgcaagagcaagttcccaacactcccctctcgtttttcacgtgcacgcttttcaaactgctaaactgtgtatttttttttaaaaaaatagctaatacttaattgatcatacgttaataaaccgctccgttttccatgtatgggatggttcccaacaccaacctccaacttaaccatcgttaaaaagggagaaattgagtgttaaccttggttaaccatcatctatccagtatccacgacctaactatcgctgccttccccaccaactccgcagtctctacaaaactcactccgcatcgttcgtcttcttctcttccgcccctacgtcacctccagtcaagggctaatgcctagggcctaggcttctactagtagcgagtagcacactgcctgccgctaccgctctctcgccttctccacccccgagcgagcccgatcgatcctctctctctccatggaggaggagaaggggatgatggggaagcaagagaaggagaaggtgctcctccaggccgcctacgatggcaacctccgcctcctcaggagtgcgtatcctagccctttctcttaggcctcgttcggttcgagtgtaaaaggccgagatccccggccccttcggggaagcccaccacgcggggaaaaaatccctgtgctgacaaaaatcgcattcggttcggtccgggaaggtgggaatcccggcccattaccccccaaaccctagggatattgatccaccacccagaccggtggaaatccaccacgctccacccgagaggcgcaggcgccgtctctccccgtcgcgcgtcggtgcctcccgcgccgctctccttgtcccgtcgcgagccggcgcctcccaccgcatccaccggcgacggcgcctcccaccgcatcctcctgcgccgctgccttccaccgcatccgcccgcgtcgccgcctcctctcggctctcgctgtagacaccgccgccgcctcacatcggatctgccggagcagccacttgtagacgcatccgcggccgccactgacttccccggcgccgccttccttcctcccagtgcagacatcaggtgagccccttactcctctccctgtcgctgctcgtgtggatgaagaagcttatgttttgctgccatccctccatgcaagatccattggcaattacttctctgttcagtcacctctgtccggacaccgggtctttcccaacaagaacctcctcgaggagcatcttctgctacatcagctaggtatgtcaaacaccatccttcttctgaactccatcgacgattcaagatggcacatgcatgcttgtcaattatcagcattacagacaactagtagggtgcccgtgcgttgctacggggaattttgttgatcacgggggataaagccgtgaactccaggattccaacataatttaattagtgtttcagaactactcgctgactcaaatttaaggagcagcaacagtaatgctcaaactcgttacataaaatgacttgtacgttggcaacattaagagccataaactgcactgatcagaatgtaaccaattttatgaaagaaataacttcagtcttacagagaaactgcatagaggaataccacattacaaaatatcggtagggtttgccctccgtgccgcccgctcgtattctggccttcaaagtattcgtcatgatttggaggagacaatcattgaagtgaaaaaaaactaacttatttcaccagttctggaaatgttttattcagtttcctggtactatcaatgctaagagttgtttaccctggttatcactgatccagaaaaacatagtaccattaatcaactcaaaaggattgtgtgatattttactgaacaaatagaatgcgcttattacataattgatatttcaacctgtcggtgacatgggatcgggagtatcatgactagaggtttgaggcagacacaatcgcccacgtggcctggcaccctcgggggacgtcgggcccgagggtgatgtgttcgccctcctcttagcccccccgagggggtcgagccgcacccgcctcggccccgagggccgaggcgccccgacccctcgtgggttttcgctccgcgtgtatgggttaggtgggcacagtggggctcacctaaccatatttattgcggtttggctgagcgtgtcacgccgcatgtaacgcggtgcagtgcactcatttatccggtctgtgaccagtcacagaccggtcagatcgcgggttaggtggcgacaggcgatctgacgcacgcctcgccccatcccgtcaggacgagggcttctaggcactcgtccccagctggagctagcgtgttacctcccagagatggcacgttagtcctggtcagatatatgccaggcttcatcctaaccattacaggcaaaatgttgtgtgaagaagggccaacgtgcagattgctaagctgacgcgtggtggacaagaatgaccgatttgtgaccagtctgacaccggtcatgtcgtcagcagacagccatgattccgcgtcgcgcctgctcccggcgaaagtggaggtaggtgcgggccgtcccatcagaaggtgactcgaacggcaaccatgcaaatctccgtccatttatgaaaaggtagggtaagtccccacagagagggggggatggtgcatgtggtatccccttaagatataaaaggaggaccttgcccactgagagaagggaggtttttttttttggactggacttttccagattaggaacccagaataagggagaggctggctcatactttgtagctccttcacacacgaatccaccaaaacacaggagtagggtattacgcttctaagcggcccgaacctgtatacatcgccggcgtcttctgtgcttcctgtctggcgaaccttccacatacagattgggagcttagagtctcacctagggtccccggccgaaccggcaaaggggggcctgcgcggtctcccggtgaggacccccacgctccgtcatctggcgcgccaggtaggggactctgcgagtgatcttctgagctctcgcactccttcgtgtgcgccaagcattttcctgttcagcccaatggccgagccagcaaaggcgcgcgacctctccccgagtatgagcggtgacgacggggagccaaacccacgccgttgagctcgtactccaccgccccctccacgccaaagtcctaggcgggaaaaggcgctcgagagggctgaaggatccgcgacttcgacatccacaggaggtggagaagggcggcgagatggggagcgtcgtctcctcgtctacggcgacggcagcacgccccagggcgcgctccaagctgcaggcgcgctcctacgtcacccgcccgtcgcccatgaaccggagtctccagcccaacgttggctggacgatgtggccaaattggtcatgactgcacggcagcgcctagatgctggtgggcggtcctccgccaccaaggcctctggagctgctaccaccggctccgcgtcgtcaagacggagggcacgacgagcggcagccgctgttcgccattcggccgccactcctttgtcgactccttcgacccgggaagatctgcgtggggggccggacgcccgcaccagcatcgagcgccggcgtaatgaccgacgtgctgcccacgcaacggagggcgcttcctcgtccagagtgtcacctcaacacggacgcggggaccagccctccgtgcccccggttggtggtgtcggctgtagagcctttgtggcgagccttcggaatgtccgttgccccccaaggttccggcccaccatcgccgaaaaatatgacgggagcgtcaaccccgccgagtttctctaggtctacacgaccgggatcgaggccgccgggggtgacgacagggtcatggcgaatttctttcccatggccctgaaaggacatgcacggggttggctaatgaacttgccacccgcgtctgtccactcttgggaggatttgtgccaacagttcaccatgaacttccaaggcacatatccgcgccccggtgaggaagcggacttgcacgcagtacagcgaagggacgatgagtcacttcgatcgtacattcagcggttctgtcaagtccgcaacaccataccatgcatccctgcacacgcggtgatttacgcgttcagggggggtgtgcggcacaaccgtatgctcgaaaagatcgcctccaaagagccccagactaccgcggagctttttcagctcgcggaccgagtggctcgtaaggaggaggcatggacctggaacccctccggttccggtgtggcagcttcggccgcccccggatccgctgctcagacagggcggcgtgacaggaggaggaagaagaggtcagcccataccgacgatgagggtcatgtcctcgccgtcgagggcgctccgcgggccacccgaaaggggaggcctggggagacaaaaagaaggaggccggcgctcccagcagggagcgcccgaccggcaagtggtgcaccgtccacaacacttcccttcacgacctcgcggactgccgtgcagtcaaaagtttggctgagcggacgaggaagtgggaggaggagaggaggcaggagcgccgagagggcaagtccccggcggttccttccggcaatcggcgaagtgaggccaagcagaaggcccccgccgaggacatcgatgacagcgatgatgacctaggtttccaagagcctggggccatcgttgccactgtcgatgggggagcgtgtgctcacgtttctcgccggaacctcaaggccatgaagcgagagcttctggccgcggcccctactcatgaggcgacgcgccgggcgcggtggtcggaggttgccctcaccttcgaccagaccgaccacccaccgtgcgttgcccggggaggacagatcgcaatggtggtttcccccactgtttgcaacgtgaagctggggcgtgtcctcattgatggaggagcagccctcaacatcctttcccccgcagcctttgacgccatcaaggccccggggatgatgctccggccgtcccagccgatcatcggtgtgacgccggggcacacttggccgctaggtcatatcgacctcccggtcaccttcggtggacccgccaacttccgcacggagcgggtgaactttgatgtgacggacctcagtctgccctacaacgcggtcttggggaggcccgcgttggtaaagttcatggcggcggtccactacgcctacctccagatgaagatgccgggccccgatggccccatctctgtccatggcgacctcaaagtcgcgctcgcttgtatggagcagcgcgcggaccgcctcgccgtcgtgtccaagcccgagggtggcgacgagaggcttggcacatccgcccccgccgccccgaggcagcggatagtcacgtgcgatgaggtcccggtcaaggaggttgccctgggcgacggcccgtccaagaccacacggatcggtggtcttctggacggcaaataggaagacgcgctcgtctctttcctgcgggcaaacgctgacgtcttcgcatggagaccggcggatatgcccggggtccccagggaggtgattgagcaccgtctcgccgtacggccgggcgcaaggccggtccggcagaaagtgcggcgccaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccacagcggggtgcgaccttttgtgttttctagatgcatactctggttaccatcagattcgcatggctagggaggatgaggaaaaaactgcgttcattacccccataggaacttattgttatacaacaatgcccttcgggttaaaaaatgcaggtcctacttttcaacgtactactcgaatttctttgggtagccaaataggacgtaatgttgaggcttatgtcgatgacttggttgtaaagacgcgcaaccaagagaccttactctcggatctagcggaaacttttgagagtctccgctccgcccgcataaaactgaaccccgataagtgcgtgttcgttatacctgcgggcaagcttctcgggtacttggtctctgcccgaggcatcgaggccaaccccgagaatatacgagctatagagcggatgcgccccccagcaagcttagggatgtgcaatgcgtcaccggttgcatggccgccctaagtcggttcatatcgaggctgggagggaaggcgctacccttatttaagctcctcaaacgctccgggccgtttacttggacggaggaagctgaacgtgccctcactcagttgaaggcgtatctcagctctcccccagttctggtcgccccggagccaaatgaacccttgctactctacttagcggcgaccccgcaagtggttagtgcggcgttggttgtggagcgcgatgaggacaatcctcattccgcgcacccccaccctgtgctggcttggcccgggagagagcagggaggagaggcccccgagccggacggtggcccaaggcccccgacgaccggagcaggccctctccccgcttgtcagacggtgccaggtgcccccgacccccaggacggccccgaggccactgcgggaaggccgcacctatcgccctctgaccccgaggctaaccctgtaccgattcgacccgggagagagcagggagaagaggcccccgagccgaacggtggcctaaggcccctgacgaccggagttggccctttgcccgcttgtccgacgacgccaggagcccccgacccccaggacggccccgaggccactgtgggaaggccgcccctgtcgtcctccgaccccgaggtcgtcggcacagaagacgagtgcgccccgcgaggccgcttgggtgaagagcgccccagggatgcagcccctagcgaagaggatcggccccaccgaaaggtgcagcggcccgtctactttgttagtgaggccctccgggatgccaagacccgataccctcaggcccagaaaatgctttacgctattctgatggcctcgaggaaactgcgccattatttccaggcgcatcgggttacggtggttacgtcttaccccctcggccaaatcttgcataatcgagagggtactggacgggtggtgaaatgggcaatcgaactttctgagtttgatttgcactttgaaccacgcaacgctatcaagagccaagccctcgccgactttgtggcagaatggaccccggctcccgagctcgtctcggtccccgaagcaaactcgggcccctcgcagctgcctcacaccgcccactgggtgatgcagttcgacggctccctgtctcttcagggcgtcggtgcgggggtcacgttgacctctccgagtggagacgtcctcagatacttggtccgcctcgactttcgagtgaccaataatatggcagagtacgagggactccttgccggactcagagtggcagctggactggggatccgccgcctcctggtgttaggcgactcccagctggtcgttaaccaagtctgtaaggagtaccggtgctctgacccgcagatggacgcctacgtgcgccaagtacggcgtatggagcaccattttgacgggattgagcttcggcacgtgcccagacgggataacatgatggccgacgaactctcacggctcgcgtcctcacgagcccagaccccaccgggcgcctttgaagaaaggcttgcccagccgtcggcgcgacccgaccccttaggggagacggatgcgcctgaccggcccccgaggcccgtcggagtccaggcctcgggacccgaggggagtgctcccagctcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaaggcattgtgcttcttgccaatatccatgaaggcgaatgcggagcccactccgcctcgcgcaccttggttggtaaagcttttcgccaaggtttctattggtcgacagctctcaatgatgcggtcgacctggtccggcgatgtagagcgtgtcaattccacgccaagcaaatccatcagccggcctaggccctgcagaccataccactttcgtggccatttgctgtctggggactcgatatcctgggaccgtttaggcgggccccgggcgggtttgagtatctgtatgtcgcgatcgacaagttcactaagtggcccgaggcttatctggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgctaatgcggaaatcctcaaaggccttaaaaccaagaccttcaacatactcaagaagcatggcgattcatggatcgaggagttgccagcagtgctctgggcaaaccgaactacaccaagccaagcaaccggggaaacgcctttcttcctcgtctacggcgcggaagcagttctcccatccgagctcaccctgaggtctcctcgggccaccatgtactgcgaggctgatcaagatcagcttcgcagagatgacctcgactacttggaagagcgaaggcggcgcgcggccctccgagccgcgcgctaccagcagagcctgcggcgctaccatcagcgtcacgtccgggcccgatcactctgcgtcgacgacctcgtcctacgccgcgtccaaacgcgtgctggattgagcaagctttcaccaatgtaggagggtccgtatcgagtggtcggcgtcccccggccgggctccatacggctggccacgggcgacggcactgagctgcctaacccgtggaacattgaacaccttcgtcgcttctacccctgaggggggggtcgggtgtcaggtttcgggctcgggccaaccccgcaccccctcgggcgtgcaaggttggccgggggctgccacacatgcacattcttatttctttttttttcagtatttcaataaaagcagtttcaatttcctaaaggctgtgtctgtgctgttttttccttttgaagaatcttgacttgaaataggtcactcgtgctcaatcctgccctcgggggctcgggtcggctaaattcgccaaacggggcccagaaccgagccgtgccctggggcgtggtgaactccgggggggaatcggtaaaaacccacaatcgggtcacccataaccctcggtcaccacgttcccggcctggccagtctcgacatgtggatctccccaggcactagccccgacccgcgccttttgaggactgggacctgggcacgaacccttaatcaagctaagacacaaaaggaccacggcacagatcatcctcatctcatacacacagcaagatgaaattgacacaaaaatttcttcatttttgattacagattaagttgatctatacaaaaaagaggcccgaaggccttagaagaaagaaaagaagaaaaaactgaagaatggcgggggtctgggggctcaatccgatgcgcccgggtcgccggcctcgtcgtcactgttgtctgcaccaccggcattgccctcctcgtcggagttgggggcgaacgcgagccgaggggccgagccctcgaagctgtcgacgatatggtcggcggcatcccggacttgcgcgcgcgcgcggtcctcggtcccgggagggaactcttccagcgccatccatggagagaaattggggtccctggtctggtaactcgccaggacgagctccaccgctccttgggcgaggtccctcgaggatgacttaattgtcttctcgagctcctcggggagccgttggagagccccggccatcttcgagaggcgctgggcgagacctccctggttggcggcgtactttacggtccgccctctccagaggcccacttgccgaccggcgcaatctaggcgggagacggcgtcccaaagcatgccgggcccaacctcgcctgccaagcggagggcttcgacctccccggcggacgagtccagcgcgccctgcagatcggcgatggtgtgttcggcagctgcgaggcgggcggctaagtcgctttcgcccgcggccgccccgccgctgcgcgccctcgcgtccagctccttcgcccgcgcctcgagctcagcggcccgttggttcagtgcggccctctcggcgcgggcaccttccagattacggcgcgcttgctcctcctgcgctgcctcgcggagggacaggctgtccgccagctgttgcgccgcggcctcggccccctcgagagctcgctcccgctcggtgagcgcgtcctcgcggaggcggagcgcgagctcttcttcggcgcaggcagcctcgtgcgccgccagcgttgcttcccggatggtgacggcggcctcgcggtccgccagatccctctccacgacgcaggcgcgctcttccagcgccatggcgcgcgcctcaagggcctcttcgcgccgccgggacgccgcttcggtctccgccgcccgctgttctcgggcagcggcagcgtcaagcaccccctgggcggcgtcgagcttcttccctagctccgcctcccagctcccgtattgaaggcggagggtgtcctgcgcctcgttcatcacggtggtggcaatgagggcagccccccgctcctcctccacttccttggcgatctccgctagcaccttcttacgggtttcaagctccgagatgtgccggcggtgagccttacagcccacctccaccatggcctccaccgagcgtcgcccctcttcgacacgcgcccaagcggcatcgagctccgcccgctctgcctgcagggcctccacctgggcacttaacccgtccaacaccgtggtgtttgcggcggccaaggcttgcagaaggggctctgcgctcagtagggcagcagaagggcgtggggaaaagccgcctcggagaagatgccacgcggctcggcccgccgatggacgtgccaaacgcggggatgtcctccggacctggttgggcctgagcgtcgcccgagggagtgggcccaagtgacgcgcccgcagcctcgtcgccagctaccccggaagttgtcgcctgagcgtcgcccgagggagtgggcccgagcgacgcgcccgcggcctcgtcgcgagctgcctcggaagtcgccatcgcctcgtcctagcgaaatccggcttcctcccgagcggcttcctcggccttgtgggctcggacagcctcctcccgagcggcttcctcggcctggtgggctcgggcggcctcctcccgagcagcttcctcggcctggcgggcccgggcggctccctcccgagcggtttcctcggcctggcgagcccgggcggcctcctagacggcctcctcggcttcccgtaggcgatccgcggcctctcgccggtcagattcccgcctccgggcctctgcggccgccggatcctcggcctcaggctggccggacttggaatggcgggagggacgcgacgggatctcgctgaaacaaaagaaaagaccagaagacgaacgagatgggtgagtgaaaactcgcgttgagagaatgaatacaaccacgatgggtgagagacgaacctgcgagggggtcggttaaacgaccactttagggggggggaaatgaggtttccccgagatggttctgtctcccccatcttgcggggccgcttcttcttgcgctccccctcgggctgcgatgttggcgcggccccctccgggcgcctgctgctggcacgcgccgccccgccccctcggggagatgggggaggtgttcctccctgcttcctcttcccccgggcgtcggcagggcggctgctccccgggcccctgtcgcgggacccagaagcacgaccccctctcggggtagattgttccccccggcggctcccgcctgcgccgtcgtggccctttggagctcgctcctctgaggccccgaccgccatcataatggtcaggatggaggcgcggtctggatcgctgcagagggggaggattccttggggaatgagggccgcctccacggagttgagattcagcacccgttggaccaatatcttgaagtcctcaggagcccagtcccatctcactccctggtgagtcctcatgaagtcttcggacccggtgtactcccaggcgccccgagcgcgccgctggagcggcgcaatccgacgacggaggtagtcgccgtacaccatggcccctgtgagcccctgggatcgcaggcccgccaggcggtcgaggacggcgtcatagctatcccccagatctaccggcgcccgccagctggaggcctgagccgggggctggctcggaagtcggaggcgcacttcgtcggcaaggggggtgtagaaccagtcgctcttccagtcgtcccacttcttgcggagggcgcaggggatgtagcggttcggcaccggcccccgtggctggaagtagcagccaccaactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggcggaaccagccctgccattgcaaaagggagaaagaagacggaccgccccgggtagtctggcgccgggcgtccctcgcccagcgtgactatctcccggccggtggcagattccggcatgaagcggcgcggcagcccagcctgcctctcgctcacgatgcgggagggcggcagcacgctaccatcgagcagagcggagccccgtgccatggcgccggaaggaagagaagattaagagcgagcgcgtgtggcgaaggtagggcacaggaaagaaggagttagggcgcaagcggcgaagacaaggggaataatggcgaaaggaaggaaacaaatcccttcctcagtgcctttatactcttgccaacgctgtgcccggctcctcgcttctcgcgcccactatttcgccccctcgtttctcgcgcccacgcttccactaatcccattcgcccgcttgcggtgcatgaggtggatatgcggttgtggcggtcgagatagatcatatcgtgcgcgcgttaattacgctcgccgaccgaagcgacgttaccatatctccagatgaaacgaatcgccatgtccagattcgtgtgctactcgagtaatgtggcagtcttgaagagaccgctcattattgacaaccgagttaccattgccgatgtgcgtgatttttgaccgttgggtttctgcccaattgtggagaccggtcccacctgtcaccaggccttaggagtggcgtcacgcccgaccgcttcccttaaggagggcgatcgccctggcataacgccgggggctactgtcggtgacatgggatcgggagtatcatgactagaggtttgaggcagacacaatcgcccacgtggcctggcaccctcgggggacgtcgggcccgagggtgatgtgttcgccctcctcttagcccccccgagggggtcgagccgcacccgcctcggccccgagggtcgaggcgccccgacccctcgtgggttttcgctccgcgtgtatgggttaggtgggcacagtggggctcacctaaccacatttattgcggtttggctgagcgtgtcacgccgcatgtaacgcggtgcagtgtactcatttatccggtctgtgaccaatcacagaccggtcagatcgcgagttaggtggcgacaggcgatctgacgcacgcctcgccccatcccgtcaggacgagggcttctaggcactcgtccccagctggagctagcgtgttacctcccagagatggcacgttagtcctggtcagatatatgccaggcttcatcctaaccattacaggcaaaatattgtgtgaagaagggccaacgtgcagattgctaagctgacgcgtggtggacaagaatgaccgatttgtgaccagtctgacaccggtcatgtcgtcagcagacagccatgattccgcgtcgcgcctgctcccggcgaaagtggaggtatgtgcgggccgtcccatcagaaggtgactcgaacggcaaccatgcaaatctccgtccatttatgaaaaggtagggtaagtccccacagagaggggggatggtgcatgtggtatccccttaagatataaaaggaggaccttgcccactgagagaagggaggttttttttttggacttttccagattaggaacccagaataagggagaggctggctcatactttgtagctccttcacacacgaatccaccaaaacacaggagtagggtattacgcttctaagcggcccgaacctgtatacatcgccggcgtcttctgtgcttcctgtctggcgaaccttccacatacagattgggagcttagagtctcacctagggtccccggccgaaccggcaaaggggggcctgcgcggtctcccggtgaggagccccacgctccgtcacaaccaaatggaccgacaaattttactgaacaaatagaacgctcttgctcagtgcagcatgcattgtgctttggtttttgtatcaacatgctctgcaatgtcaccccattttgcttgcaaaattactaaagcttccaaaagaagcaaggtctcctggtcagtccagctagtaccaccaaagcctggaatttctgcagattccataatgatgaaatcagtttgtgacatgcctgcatccaaatttcctttgtcatagtctgcgtggaaaggtttaagagaaaacaatcagcattcagctaaataaatcatcagacctaagaactatgcttcagtacttttgttaggtaaaaaaattaaagaagaagaaaaaagaaccatatagaagtatcatcagctccatattgaccttaccatgaagctacctaagcaagaaaccaggtgggatcaggtgaagggatgtgaatcaaatggttttgcagttgatggttgttttccagagtcaggtaatagactaataatagagtgttgtaaatagatttgttgtcaatgtcagccaccaggttagataaagcagagttcaggcactggataacttgtccgctagcatcctgcatccaaactcgtagagttgtaggacacaacgacaatgcaaaaatcttcgatttttcatttcctagtataagtagcacataaaaaacctgcagttgatcacaatacctgtaatggtgtatataggccttgccaaaatcccaccgaaagtaatgtttactactgtccaagaaaaaaaacacacgaaatgtttgacttggaatataaaaattacagaaagaatggaatttaagcaagcatattgtggatggttaattagtcgcataatataccttttctaatctgtgaggacctctctatacacaatattttttgtgtatgttgcagcctgtttagacaattcctttcctttcttctcattgtccttcacgccagtacacttagactttttcttttgtttcttgtcttctaccggcatcgatagtatttttatgtttgttctagaggttgctctagacaacgcgacgtataattgaccatgagagaagacaggctccggtaagtagacgcctgcatttggaattgtttgactctgcgccttattgatggtcaatgcaaagctcaatctaaccggaaattgcttcctcttgaagcgaaacgggaacatatcatcatcagacggacatagaggtatacgaggaaggaaaactctgttcgcaactgctattgtgcatcgcagggctgc

SEQ ID NO: 12032 - DNA, 4728 bp, Oryza sativa
gtgcatcgcatccatgggcagaccgaatagactggcacctaaatacatctgttcgcaactgagcatgcaagctccaacctgtttggttctataatgactataagtggtactttcagattcagcatatgcagagacttataacagcaggctagtatcggtctgaaattcatttcctattgatccccaacgagcagaaaagagcaggctggtactttcagattcagcatatgcagagacttaaacgctacgacggtggctgcgagcggagaagggtagtcggcgatgaggggctcgaccccgtcgcaactcctcccgagcggcacgaagggcggagacggagcagcggcggcaggcgtagttcatatatgatatggctcagcgaggattaaaacctaagtgatttccctgaacatcacaactgtaacgtctaagcaagcattttgtcgaacaccttttgggcatggggagcattagcgtattacctgcagcttgcatttatttgcatttatgtagttgcatcgggctagcgagggagctccagtggaagagggcgggatcggcgacgaggtggagtcccgagctgtgccaacgagcacggcggcctcaatcccgagcaccgcggagtagcgcagcgtggcgatgggggcgccggcggtggaggcgtggcggggcgcggcgaagaggtgggaggagtggcgtcggcggttggatagcgagcgcgagcgatgcgggggaggaaagcggagggagcgaccgagggagggggctgcggcgacgtggatcgaggggttgaggaggggagatgcggagggagcgaccgagagagggggaagacgcgtgcgctgatgcggcggcgtgtggagggcgcgacgagtggtggaggcgcgatggcacggcgtaggggtacggaggcggaggcggcggcggggtgggggtgtgcgagagagagagagagagaggaggggcacaacgacggggcgattggggggcgccatttttctcgtctactgcggatccggagaagcgtccgatctctgatcccacggttgataggtcacacgtctacgttggcttcaccatcaccactacggattattttttaagtagtagagattagcttcaagatacatttgtggcgtgtctaaggtctaaagttgcggctgttaagtgttaatccccccaacaagcagcataatttaacccaacctgaagcctttatacctggcaaaacactaaacaaacctacccttctaatttcacactgttaattaggctagttttggctaattaattagcttaaaagctagctaacattgctatcttcagctttcaatgcaagccctgcagtgtagtaagtagctcacacgaattttcagagcgtgttgtcttaactggttttcttgtattgacagggttgatatacatgagattgggtgcttttgtgaggtatgttctgcctagagtttctattgtttatgtcctgcctaaattaattgttcttgagtttcgataatgttctgttaaacagtgctcagatttatatagtactacctctgtcccaaaatacttgtcgctttgagtttttgtttgtaacttttgatcattcgtcttattcaaaaaattatagaattattatttattttgtttgtaacttgctttattatcaaaaatactttacgtatgacttatccgtttttatatttgcactaatttttcaaataagacaaatggtcaaacattgcaagaaaagagccaaaatgaccactaatttgggacagaggtagtactaagttttaagttttactactgtccctgggtgctcagatttgctctgcattagttctagagaatggcatatatgcatttgtaatagagaatgacatgtgtttgttcagagtcattagctgaaataggacagcaagtatattctagtcagttagcatagaatctggtattgttctgattttgtttctgttttgtttttttccctttaattctggtagtttgagtgtctatcaactgctttggccattggatttgttaatacaacacgtgttccacgaaagatgaagatgattattgattcccatgaccctgtaattctgtaaaggatgccatcatttttaggaatttaggatgccccttgtgaaatgcgtccttcactgtggaaatggatcaaaggaatatcacatctccctcttaacagcttcccaggaatatgcaattcttttggttttaaaaacaaacaagagtaggaacatcaattccatctatacactctgaatgtgcttgtgtttcttacccactgactgcattagtgcagtgtatatgttggggacctgctgaaattgagctcaattctgaattctaaaattctgaaattatggttcaggttgctgaaatttagctagaaaattcagtctcagatcatgtgcaggtttgggagtttcagttctctgaaactgattttttttactttgatgaagagtacaactgtagattgtgccatttttcctttcaatgtgctttttttgattaattcatagaccaacaccagatctttagaagtgtataaatagagaaatcatgcagttgatgttattcccgtaattagacactttttaggtgcctgtcatgcagttgatgttttcgatatatgaattgtctattggacgtagtttttattaacctgtagcttctgttgactgctgctagttaagctatttcaatggggcttaaacatgtggtttagcaactattggttataggagtagctattatatgttgttgttgtgacacaatattcttcttttttgtacataatacatcaacatgtgtataccatagactgatctgtatagtgaggatgatgtattctttcccttttgcaggtaattggaaatgttcacagtgaaacctgaattattcatggaacttattgaacctctggaactaaataacctaaaactttctcgttattggaaatatgtggctgttgaccatataggggcatattgatcagctatttttcggcctttgaattgtgcagttttctttcaagtgataatccgtctcatatgttttttcagggacttctgtttgctgcaccaagaatgttattgtgatgtacctgagaaatatgctgttctgttaattgaggaactttacaagtagatattaatgatttagcttcaatttatgtaatttaatccctgctacttattactgtaatagagatctacatgtgtgaatctataatcttagtgtgcactaatattctaatatgaattgacatttttttctagactttgtaataatcacgacataaattgtacagccagtcttcgttattttcccttttttgtttttttttctcattttttctcatttttagatttttttgggtggtgttttgaattttctgcaattttgttggtgacaatttaaaatttatgtaatgaaatctttaaaccttagtccaaataaatcaatcccaccaatcccttacctgtccaaacaaaccaaatgataatcccgtggtgaaagggattgggtgggggattgggtggtgggaggggatgaacccaatcccctccggtgaccgttttacctgggtataattatcccttggtgccgaacgaggcctgagtttaaatgctgattgtgcttctccgatcgatgctcacccgttgatatagagatggcgcgagggctggacaccgggcagggcgaggcggctgtcgtggcgccggtggagggcaacggcttcgggcaccgcgctctgcacatggcggcctctggagggagcgtggacgtcctcaggtacctcgtggaggacctctgcctcggcgtcaaccagttcaatggcaaaggtcttgcgctctttgccttgcctctcttccgttctatttttcagctcgctcttatacgaatcaagatgcattgagtattctttttctcaagaatgatacaataattcatgctttgaatagtcctcgtgcaagcattgaacatcccctcttttgtgtacattgaaaaaccacaatttagattgatatcaaactccaaattcggtggcttcaatttattattaagaaagattatttaataggacagtccctactgaactatctcgtggaaaaaacttgtcatagcaattaacaaattaaccaaaaatgaaacaaattgctcaacccctcaccccattcaaccacacaatcatcacacagaacgagaacccaaaacatatcacgtaattaagcaacgcggagagtcttgtcaatgtgggtgctggaggtcaccactttgtggaccagaagctggcatggaggagcaatggtaggagaagagctgtaatgtgtttgagaagtagggtgactggggaggccatgtcttgcacagacagcagttgcagaagtggtggtaccgtggtggagatgcgtgacagcgtgagaggctagagagttgacatgggttgggtttgactgtgtgagggtgttcgtgattgtgtaacaccgcagataactggtttcctgtttatatataccttctctgagatttggacttgaattgtcaattccaatccctgatggcagacaacaaccttgtcaatggaattggaatgtgttccttggacttggaagtattctgagcagtaattgtgcattctaatttcctattttccttgcttcccatacttttcacggtaatcatttatcacaaggagtc

SEQ ID NO: 12033 - DNA, 5839 bp, Oryza sativa
  unsure (1)..(5839): unsure at all n locations
tcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatatatatgcttgataaccctttgagttctttgccaaactacaagttgtctcacttcagagtactgagtactaaaattcagtcatccagtatttcaatggcccaaggagacaatggcaagaaggcaatgccacaggcagaaaacaaagagattgctgctaaggatgcacaggacataagaagacaagcagatgaatttaactcttgggtaaataaaatcatagtaatgggtgatatatattgtcttcaattttaataataattatatttatgctttattttagcttttgcaggaatagatttagcatttttctagaggctgtacacagtggctgtaaatttctggcagatgagcatgcaattaactagctagactcttatcatttgtagacttgtatcatataatcaattgttcttgattcagttggacaggatggaagctatggacagccaagagctgaagcagtacaaagaacaaaacaaggacatgtttaacagccagaagaaagctgcgataaacaaggtttggatggcttttatgaaaattatgtgtactaaattcctggttccttggcgtatatcagaatatatctggttgtaaacctttgcagattcagcagaaggagaagaagaagagaaagagaactgtgctgagcccaatcttgggcgctgtgatgaaatttcatagagacaatgatgtggacccttctgcttcaggaccggctgcataaaagatggtggtgtgaccgatcatgcatcgaacaagaatctgtcgtcaattatatacttggataagtaaatgatggcttcatttgttgaaatctaaatcttctactgtgtacttgtttggtcatgtgagctttgcaatatgttgtacttgacttgtgtgatgtgtggtaatctcaaaattaaatatattattaatgttcagtgtttgatattgagataatgcttttcttttgtcaaattgctacagaaaccactaagttcacaagtattttttttctgggtcggtcaaaaataatgccaaccaaattttattaagattaggagaagttacaatatacatcgacagaagttctgtcaccaaatctgggatgcagctggaacaatccgttcacgcattttcgtagtgaaattctttttaggaagtacataaaagatttgcacgtctttgtattaagatgttgtttaacattcagctaagaaagtgccaacaaaagaaaaatacacggattcctcccaaccattttgtgcgaccttgcggaaaaaccgtgtttagtgataatgagtattgcggggcagttgtgcttgtgcattgtggtagcgaatgttttggggagaacctttgtaaatatgtccatgatgaccatttcaccagtagaggaatgatgatttcccacaattgcaatgacttcacttccccttggtcttcgggtatagtcattcatttgcatttccaaattatctagtaagtccaatcgggtgtctaaagcatcatcgctctagctaagattatatattatggttccatacttccatctacaatagtccatgacagaggagtcactggccggcattggcgatgcttgtcctcgatccagtgcatcatagtccagtagtacgtctcgagcgcgtgcttgctttctatgcacattcatgcaacattggggattggagtccacttttgtcacagcgaactcggcccaggctaactccagaccgaaaatggcagtcaccgaaaaaaaaatcaaaacctctttatctactactccaccccaaaatatagctatcaaaaactaactcacctctctcattttccacgcacacgtttcccaaactactatacggtacgtattttgcaaaaaataattctataggaaagttttttaaaaaattcatattaatccattttcaagtttattttagctaatgcttaataaatcatgcactaaccgctctctgttttgcttgttgggagtgagggttccgaactcagcctaagaagagaagtaaaaaatctatactactattcaataattacactagttggtggtgggaggtggatgagagttgtcagataagtggtatctttgaatatttaatgactataaacatcccttggtattctataggcaattatattttgggttaatttgatccatgccactgcaaatttagctattcagaaaaatgacattgcaattcatctattcttaaccgtgccactgaaattttgtaaaactaaaaccgtgccattgacgtcacattttccatccattctcttccttttccgtcttcttccttccttctcccatcttcttcccggagtcaagccggagagggagctcgccggcaaggtgaacgaacccaacctcgagtgcggttggcgtggtcggcgaatccggcggtggcggcgtcggacaatggtggcatcgggactcgggcggaaccagctgaggcctaggctgggtgtcgagcgtgatcgacgacggtgactctcttcttccgcgttgctgctcaacctcggctcccgctctggcctccgggtcggtgagcccaccctcatgccggccgctctccctcgcggcagtgctctccccgcactactcatccttggacctctccgagactccaaccgcctcctcgtcgcccgccatgagctccgcaagtagctggagcacctcgccgccgtcttcgagtcttcatcgcctctgttgggtctgctcgcgccatgcagcgccagatctaccgttgtttccatcgacgttggctcccccgccgacaccgtcgaagctcgctgcggccatggatggatggacgaccgccgttggcatcgccgccgctgctcccgcacgagatctcgcccacttggctccgggaagaaatgggagaaagaaggagccgctgccgcctgccatggttgggtcgctggcaagctccctctcctccgagctcgccggcatgactccgagaagaaataggagaaagaaccgggaagaaatgggagaaagaaggaagaagacggaaaaggcaggggatggatggaaaacgtgacggcagtggcacggttctaattttgtaaaattctagtggcacggttacgaatagacgaattgtaatggcatttttcttaatagacaaatttgcagtggcatagatcaaattaaccctaatattttaggacaaaatttaaatataaagtcgctgcgatgggaatatatttgatgatgactaatgtttagtgccatgcatgaccctaaactaaagctgaacttcagcaaagaattaaggcctggtttagttcccaactttttcttcaaacttccaacttttccatcaaatcaaaactttcctacacacaaacttctaacttttctatcacatcgctccaatttcaatcaaacttacaattttggcgtgaactgattaaacacaccctaaacagaaacaatcgattttagtttcattgccatcacctgatgacagacttctctgtaatcactgttgagtcgttaacttcatgttctggtgccgtgagcatgagttaccatcatcatgaggaaacatagcctttatcgctacaattgctcttttgtttttctatttttatcacagaagatcattgatgcttattggggaaaaatgatgcaacctcggtctagtaagctgtagtttattttgcttctgaagtaattgccagtggtttggctatactgtcgaccactcttaattttgggatgaaattcttaaaccatactgcatgccccgttacatgatatcatgccacagattctgcctacattgtagatgatacaataatcgtctacatggagcttttccatgaaatagctctcccacaagagtgaaaatataacctgaagtggatttcttagtacctaagcaccctacaaagtcaatatctgaatagtctaatatcacaagcttatcagacctcttatatgtgagcatataatgcttagttccttacaaataatggaggaccttcttaactcctttccagtggtccaatccaagattagataaaaatctaccaagcatcctagtaacgaacgccaaatctgatttcgacagtcaaagcatgcggtttcgtcttcatttctttagtttctaagtcatttgttgggctttagaattaaccaaatttatcaccttttattattggggcaggtgtcgtagagcatttgctcatattatatctttccaacactctggaaatatatgattcttgagataatcctagcaatcctttggacctatctatttgaatttccatgcccaaaacataagatgcttaaccaagatatttcatatcaaatttagatgacagattttctttactttctcgcagcaaattcttatcgctgcttgctaacaaaatgtcatcaacatagagtactagtatgatgaattttccacttttattcttcatataaatgtagttgtccatcacattttcctttaatccaaaaatttttaattacttcatcgaatttaaggtaccattgtctggatgcctccttaagtccataaatggatttatttaatttgcatgctaaatggtctttccttccacaacaaaaccttctggttttgccatgtagacattctcatttaaatcaccatttagaaatgcagtctatgcatccatctgatgaagttctaagttatggtgagctactaaagccctgacaattataaatgagtctttcttagatataggagaaaatatatctaaatgagtctttcttagagacaggagaaaatgtatcattataatcaattccttatctacgcaaaaaaaaacatttatcaacaagccttgctttgaatcgttcgatgttccctttagagtccagcttagttttgtaggcccatttgcagcctattgttttgcctccttaggaacttctactgatcccacactttaattcatcttccatttcttcaaaccacttggatgagtttttactgcttatggcttctttaaatgaggtagggccatctaccttccctatatcttcactcatataaacttcatgataatcgggaatggcaaatttccttacctgttgtgatcttcttaattgctgattttcatcgttgttcacatgtcgttgagcatcttcttttggatatttcttcttcattctatgtcgcataattctattgatgctcattactttcatcattattttcatcaacactttcttcaacatcagttgtagggccagagggtccagaattactcgttgttggcgcactacattctatggcacaagtttgataaatggaatattattctcttggattttcataattggaacattagttttaatttcctcaagattaatctccttatgttgtgagctctccacttcattattttctaagaagacaacgtgtctagtctccacaaacttagcgatat

SEQ ID NO: 12034 - DNA, 728 bp, Oryza sativa
gggggtaaatatagtcataacgggaataatcatatctgaatggaacgatcattattttttgtggacttgtgctccgagtggcccctttctttattgtattggtgaatttccccttaatgcaatctatgcaatgatctgcgtaggaaaaatctaagtagaggagtatttcttctttaatgatacgttcaattctccccctagaaatgtggcctaaaaaatagtgccataattttgatgatgtctcagctttatcattacagacatttgtagcattcatcacagtgtcatccaaagagaagaaatagagtttgtctcgcacgaaggcaagacccataactttattatcaaactaaatgtaacatgttctctttttaaaatgacactcataatctgtctttgcaatgaaataaggtttctcttaatagagggagcaaacacagcattattcaaaattaaattgtaaccgctagggagtctaagtgtgaggtctctaacagccgtcacatcaatctctgccctatcagctactcttaggttttgctccccttttgctaccttccgcacggtactgaatccctgtaatgagttggaaacgtgcaccatggtacctgagtcaacccaccaagtattaagggaaaattcagtgtaaaaggattcatccacattagatatttcttcagaattagtattacctttcttagctaactatgctttaaccatgagcaatt

SEQ ID NO: 12035 - DNA, 9146 bp, Oryza sativa
cctattggacttcacccaagcggctactttttcttcatgagaccacttgagattttcatattttcctcctcgcccatgtcgagttcttcagctgatttgagttcctcaggaggatcctctcttatggccaagtcgtaatccaacaaagctaagttaagacgcatagtcacccttttttcaatatttttgttttcccctctttggtttttagtctgatttacgtgaagtaatacatgtatgcttcatcaattgtccagatctagtagaaatgatgttgttttatttagttgggtagttgggagttggtatcttgtggatgttttttcatcatgttgttcaatatattattatgtaataattttgctagatagatctagttctttttcaagtttgtaggtctgaatatgtgttggatctgtcgtctcttgtggttggatgcatggtatatggttgtgcttgttgcattccacgttttgacaatgtataatgcatattataaatttgctatttgcatagatggtagatatacgtcataacgttagatcctaatggctaaagctgctggtttagttgttacaatgtgtgcctacatgattttcattatgaggagagctaggcaacgccatcactaggattttctatgggccattgatggaaagggacttaattagacaaaccaacccattttttggctgtcatttgttgcgccaaagagagctactgtgggactcttgttaacaatgaaatttggtaagccccaaagtcatcatcggcctagtgtcactatcggcttcagagtcatggaatccaccgatgggaattatcaagttgtcaatagtaggattcttattatatttggttaaggaaattaatatattaaagaaagcttatccagaagtggccgagttcaaggaggatgtggccgagttcaaagaaattaatatattaattaggaagaatctgttagtttccttttatctttaggaaagggtatttagtgttcaataaggattttatgttttacttttatctttaggaaagtttctttcttgtccgagaaggactactatctacccatgggtataaatatgtacacccggagtcattgtaaactatctcacgaataaatacaactactctcggtgatcgccaccctctttaccgaggtttttacttatcatccggcgaaacttagcacctgatgcggggttgcatcggcttttgatatccgcgaagggtaagtcctacgttccgccggccctggcaattgtattggcttcatcggcgtcgttcaaggctgcatcagcacatccgacctcttggattgctatggttcggttgatatatttgcctacctatttatcatatatcttagttaatctagtcttaatatttcaatttagccgtatcggccgattctcgctttagggtttatgccggtatcggctaaatcgctttaccagattatattagctaaggtatctaccaccctgaaaatcagccaaaggctttattgtctagatattatgtttcttttcatacttagtgctgcatcagttaagtttgatcacttcgcgcttagaaccgtaatctttagcctacttcttgattgccaataagggtttcatcggggtttcagccgatgagttatctagacattacatcggcttacaaggattgcatacaagttagatttagccgattgcaacaaaggtttcagtgtttatctaatcttgtggattttatgacatcggatattcagccgatgtatgttttaacttacggatcagtgcttattctatcatatcattgttagccgattggtttctactggatattattatcgttttattacattaccattatccgattgtctttatattgttatctacattggacatatagttgattgctcaaaaccctattgacatcggggagtatcgacatcggctggaattactccatcggcttgtctaccgatcggctcaatgatctgttatttgtatatcttgtcagttgtaggatcaaactgactggcatgctcgcatctcaacaacttttggacctgcactagagctaaacagatctcccaggccgttgtgttcgtcgacttagttcgcgccaacacagacctagcaccatcagccgagcgcggacttttcatcaacaactccattcacagctcactggaggaacaggttgccatgttccttctagttgttgaccacaatgttagatttaaggctttacaacccatttttagaaggtcaactgagacagttagtaagtacttcggagaggtattgtatgctgttggtgagctgagaaatgatttggtcaaaccaccttcaagtgatattcctcgaacaattcttggcaatagaagattcaacccatattataaggtaaaacaaatattatccacaagttacgtttttttcccacaacctatcctaacatttttcatgccaattgggattgtattggtgcaataaatggaacccatcttctatgtcagcagcgtttaggggtagaaagtgtgttactacccataatgtaatggctgcggtggattttgatcttaaatttacatatgtacttgttggctgggaagggtctgcacatgatgccctcatacttgcatatgccttagagagatgatggccttagtgtcaataatttagagtgtcaataatttagatcttcaggattttttttttgtcatctggtaatgattgagcacattttatcacatgttaggcctcactactgggaacccatttttactactggttcggcaaccccttttagtctcggttgtacaaccaggacgcacaatccggaactaaagatggtaattttaggcccggttatttcagtcaggattaaaaatcgatctataccaaccgatactaaagatggtagcgactagtggctagtgctaccatttttagtactggttggatctatttgcttttttttaatgttttttttgttgcttgctgcttttttatacatatgcatatatggtgcttgctgcccatatggtgcttgccttcaggcttagccaatggctctgtttacaaacgtggcccttctgctcacatggcaattagcaaggcacaactaatttgcttggatagagtagaaaactcttagggcatgtataacggtctttattagtggtctctctctattgatgcaagtaaatttaatgacatggaagaaagagaaaggagtatggttgttatgcatgacaacggctcagagtcgactcttagaatttattagagcaaatttcgttgtatggtggtgaaagaaaggaaagaagagcaagaaaaagtattttaatacattaatgattagagaccatattgtctctaactgttataggatgctagtctctaaataacgtagagctcgtaactaactctacctttgtgcatgaccttatgtcacaactgtttcatgtattatgtgttcccttgtgtaccttctgtttaccattatttatggtacttccgagcgcagatttttcgatatcctgtgacagtttaaatgctgcctgtaagtgaatatgatatgtcatcgtccttagccgcgaaagtaagaatctgtagttcttgtttgagaagtttggtagcctaagttttagtccctggcagtttaaggagtcccccgcgtcgccccccgcgtcgggcgactcgggcggcgcaacccttgccgccgccgccgcccttccccgccccttcctctgccttgccgccgcctgagcgagcggccagcaaagccggcggctcccaaggacggcggcggcggggctcacggcggccatctcccgagctcctggcgcgggcggacgcagaggcggtggccgaccggagcggcgccggcgtcgaggtgcatggtggcagatccagcgtcgccaccactagatctggcgcacccgcagctagatccggtcgcggaggcgccggcacggcgtcggcgaggcgtgggcgcaggcggccacgacaggcggtggcaggcgtgccggcggcgcaaaaggcgcgggcggtcgggcggcagcgtcaggcgcggacagccgcgttagtcggcggcaggcgcgacggcggcgcaggcgcgggcggccgcagcaggctcggaggcgcggctgctttggccggcggctcgatgcctggcggcgacggcagtggtgcccccagatccgtgcctctcggccggatctggagggtgggagcagtcggcgacgatagcgacggtgtggcgacggcggcggcggcagttggcgacggcggtctcggccggatctggacgccggcggtagttggcgatgacggcggcggtgtggtgatgacggtggcggcggcagtgggccggtgacagttggcgacggtggtggcggtcgcggctgtggtggctgccgtgtcatctggcgatggcggcggaagacatggcgtcgggctgctagctgctcggtggtggagggtgacagcacagcggcgatttgcggaggcggtggttggcgtcggtggcagcggcgacggcggctgtgactctggaggcggtggcgacgtcggcggtggggaaggagtcaggggcgaggtggctgggtgttcggcaaccaaggctgtggtggtggtgaccgtgtatacggtcaccggaggcatggcggtctcggttgactagccaagggcgtgggagacggctgcagctggccggcgcggcatcgttcggtggaggggtcggaaaccggcttggcacaaagaagcgcagccgatggcagcagaggccggctcggcgcgagatgcgcgagcggcggaaatggaggccggcttggcgcgagaggcgcggccgatggagggaggctggattgacacgagaggcgcggccggtggagaaggccggcttggcgcagagaggcggggccggcggtggaggaggcgacctaggtgtgaggaggagctgccggtgggtgtggcgcggtctttggcgcaagaaggctggccggcgggggacgccggtgaaggggtcccacatgtcagcaaagcttgtggagtggtggagcatcggtgcgccagccgtgcctttgttggtctagtggcggtcggccacgcttagcggcggccgatccggtactagccttctcctgggcttgtgtattggcgatatcgtcgtgtgggtggtggtattttttttcttttcctggttacgattctccagggttgtaatcttttattttttttcctgctctgttaatagaacttcgtaccgtctcgtgcgagtcgttcaaaaaaaaaagtccctggcagtttgatgtctggtccagagatgttcatccattgcagcttcgtgcactgcacgaaacatgaaattgatcgatgcatgtatataagagtgggaaaaaaggttgtttggaatcttccattccttatttctcgcttcgcttctctactcctacgtgaatctaaaaaccaatttattttggaattggacggactagatgtgtgtgtaaaaaatcgttaacttaccatttcttaggtgttcatttttgtctaaaattacaaatgcaaatacgtttggtccctgtttgacttatatttgacccgttgactactcggcctatgtattttcttttctcattttaattgtaataacaaagagcaaaacattttttcttactatttaaattcgtccaaaaaagcctatttccagaaaaagctttccatcaatagtagaagccccctaaaacttgaaggagaaggtggaaaataaaagatgaaactaacatgttgtgggagcaagagacgatcgcagccgtccatccgggaaccgcgccgatctccagccgtcgatcgggctccacgaccgtttccccccacgccgcccgggcccaccacccccgtcctccttccgttccccgtttcctccctttctctcccggtctcccctcacctctttattacgctctctcctcctccccgacgacgaggcaacccagcgcgaggcgagccgcggcgactagggtttcgtcgcgccttcctcctccttctcctcctcccccaccgccgccggcgacgacaaggtatgcccgcaagcgcgcctctctctctctgtcccacttaggatcccccgcgggtgtctcctgctacgtggcggtgttggatggccgggtggtgtccccgatgctctggatttcgtgcgaatcctagctagtaatattagaggtttttttttttgttattgttggtgatgatgctcatatgctgtagaggggggttggggtgtgctccatgcttcgcggattgctggctctggatgcttcctttttttttcgtgtgtaatgcatcgtttgcttagttgatcgagttgtggtgtgccctgtcgccagacattgccctaatttctcagcccggctgtatgataaatctgaaatgaaggtgtctaatatgtaggggtgtcaccaggaagtgaactcctcgttttgttcaagttgcattatatattttggaaccttatggtagctctatttttgtgctggagtgcggatgtggaatacacgtgtgccctgttataaactattctattatgatgattaggctgttattggttgaagttgggtgatagatttggaactcaacgcgataggttgttataaactattctattatggttccagctacagtttgcagttgttccctaattgttgaccctttttttttcatctgaattatagattgcactgttctggaactaaaattgatgtggactgtggggtcatctttactaagtgctaatcatactaaaatgttttataatcccaattccaagatttagttttctggatggcaacttttttttgatcaagcagtatgagatcagtttttggttgttgcaatactttgtctaggacctgatacacttgagacatagtactgtggcaaacttttatatggtggtctgtgactttgtgtgctgtaacttatacagaaaaccaactattatgtgacagaagaaaaggacaaggagatatctcagctagttatttctcattagttgataatatttttgtactgcctttttggttgactgatcctcatagtaggtatgttgtatggaacaagttaatttctcagcagaatttggtagacatgaaatgatgaatgctcacaatttgtacacatttttaccaagatttctttgcacatttgaaaggtctactggagcgcaaacaatggagcggtcttctcagttgaatccaaatgccactccctttgtgcctcccccaaggtcttcgtttgaagaaagcttgagcggaaggaaggcctctgagaagcaagtaggtgattcagaaaaggatgagactgctgacaagtcttctgaatatgagctcccagattccctttctttggacgactatggtgaaagcctaggaaagctcaacatttctgcagaatcttcatcaaaaggagctgctagtaccgcgcttgatccatcgcactacgaggaaaatggtgttgataatcatcttgctgtggtagaatctctctcgaagatgttcccagatgtgtctgctgacttcattgttgaagcactgagggcccatgattttgatacagaactaactattgatatgcttgctgatctggtatgtaaattcctatttcgatcctctgtttatggcacttctagttattatcaccaagtgttacatcactaatgttgtccgcacaccttacaaataccatgaaactgcatgctgactgccacttttgttgttgacattatttctggcgatatatatttattccaagggaaacatttctaacaatctttcttgttgaattttccacttcagtgtgaaggtgatgattaggggaaatctgctgaagtgtcaggaaagtagcagcagcagtatcgctcttcatccaccttggcagaacaattactcttcagctacatgttattgaagtcaatcttcgtgacaatcaagactgaatttcgtggcgtacatcttattgctgctgctctaaagaattcagtattgtttaggagccaaagcaacaatgaccgtgttttgggtttttagttccgggtggaacagctattttttcagtattagagtctgcttcatgttgatggtttcacccagcagtttatcgtgtgatctgttgcaacccttttggtgtagctgaacctccccctagctaagcatttaggagtcagcaatagtgtgcaatttttgctgcaatgctgtgctcttaccatgtacattctggtcttgctgcattctgtgtagggagatgaaccattccagattctgttatgatgcattatttgaacagaacagatatgcgcatgaagagatatctatctcattgcagttactgaatggagaattggagaccatatggtcatggttatgacttatgaaacctcaacgttatcttatggatatcgtattgctctcgctttttatgcaagttgttgtcgtcaatatttgtatttcgagacgatgtatatatatgtgcagataacctccctctcccgtttcgatgcagataacctctccatcttccatatcgatgcagatagacgcacgctgcacatgtaatgttgttccatgaggatgcgtgacaatgaagcggcaacctttctgctatattggagacccaggggggttggatcgtgccgattatgttattgtgtacatagtagagcagattgtttagcagatttttgagaaaattaactttcacctatgtatgagaaattcgaaacatattcaggccttataatcaagacaaattttgctacaagacaaacatctgctaaacaatataggtcaaagtaattaaagtaattgcgggtcaaacatatgacaaacatcagcaaatatccaataatgtcaaaaatggatatttgctgatggacatcgctcgcattaaagtaataatttccggttgaataggaaagagaaatcgcgtttttgaaatgtcaaaaatgcccttgtgcccacatgttagctcttctatctcttttctctctctatcccacatgtcagctatgacggcaggcaggggaggtctggcggtggtggtgggagggcgaggacggagcggctgcgatgacaggagagtgacggc

SEQ ID NO: 12036 - DNA, 10449 bp, Oryza sativa
tcctgcagccccacacgcagttgccaccgccgaacctcgcctgttggccagcctgcgctgctgcccgggcgcaccgctggctggcgccggcgctcctccgcgcgtcactggtcgcatccgctttgccctcgccctcggccactccaccctcgccggcccaccgccgccgccgaacctcgcctgcctaccaacgtcacagacatgtgggatagagagagaagagaaggaggggatagagaggtaggagagttgacatgtgggcccaagggcatttttgacatttcacacgatttctctctcctctctaaccggaaattattactttaatgtgtgcagtgactaccaccaaatatctaacttttggaagtgttttcccccaaaaatcacttcgtgcagtgccctacagctaaaaccacgaagtcacggtgtcatgtagcaaaatttgcctataatcatcatgtattaattttaaatcaagtaaacagcaaaaatcctaaggttagtattgtccatcctcccaatctttcatcaagtaaaaaacaaaaatcctaacggtagtacttgttggttgatctctgaccaccgagccagaaaggagagcgatgggctcagcccaccaacgcccacgcgatctctaacgttgaagagcgagtcccacgcatcctcatgcatgtttctctccttaacgctatgatcggatacaccgttttcctcaagaaagaatcacccccgatccccacaagatacatataaagggaatcttaaccctgtgcacgagtgacgagacacgtacgctaagccattcccaaaaccttgagactaccgatcctaaggcgtgttgaaggggatcgaagggcgaatttctacaagaaacttgttaatccatgacggattttcggtgacggatttatagatcgtcactgacaaacgtaatcgtgacgattttttgtttttcgtcacggatgagcccagtggatattcacggcctgctaactcgtgacagttttatcaagactgtcacaatgtatgattttaaattcgtcatactctagttagcccaaagcaataaaaaataaaacatatttagcgcaaagaaaaataaaaaatgtgattgcaagaagaatcaaacgcaaaatacggtttgttaaatttgaacaaaataattttattaatttgttacatgtatatgatgcataatatggcaaactaaaaaaatatggtgcgcatgggtaaaaatctgcagcatgtgggatttgaacccacaacttagctagaaggtaggaatgtgtcttaccctttgaaccacttgttctagatgtcccaatgtgcacttaaatatttttatttgtcccaatgtcactcgagttggcccagcaactcagagttggcgtttcaaagaaggaaaaaataactcataacgtgcgcccaacgagaatagaacccatgacctctagttgaagataacccatcctaccactgcgctagttgcctggtgtgttctaataggattctataatgtattatagttgaagaaaacgtcatatatttatatatagcattactagaaaaatatattaaagattaaagcaatttaatcaaatgaattaacgaggaaactaaaatttttctttaaaaatcattgctggaatttttttttaatattctacgtggtctaaattattttctgaaattttccataaattttcagagcgcaataactaattttaatatcacaaagttcatttaacctattaaaataaataaaaaaacaaattaaaattcatctctctatacttgggcctttttcggcccaagtattactctctccctccctcagcccgcagcctccctctccctcctcctccctcttcgggccgccagccctttttgctcctcccttgccgagaagtccattttacatccctcctctcaactcaaataatttttcgggaataaatgatttcaaatgaaaaaattgtcaacaacaaaattgtataacttgtcaaaatcgaaaacttttgttttggtcattttgctatatgactttgtttcaataatttaaatttgaatttcaaattaaatttcaaattatgataacttcaaccaatatttttaaatagtaaatgatttcaactaaaaaagtcatcaacaaaaaagttgtataactcattaatatctataacttttattttggtcattccttcatccgacaaagtgatagtaacattgtttacaaaatatacacatctctcttataatttatgaaaccatattggagatatgtaaaatttatgaacaatgttaaaattactttgtcggatgaataaatgaccaaaataaaatttgtagatctagatgaattatacaactttattgttgatgagtttttcagctgaagccgttcactaataaaaaattctatttgaagttctcaaactttgaacttcaaatttcaaattgttcaaatagagtcagatgaagaaatgaccaaaataaaaactttacatcttgatgagttctacatctttggttttggtgacttttctatttaaaatcatttattaaccccaatttttattcgaagttgtcaaattctgaaaattcaaaattgaaattgttcaaatgaacttatttgtagaaaggaccaatacaatagttgtagatttcgatgagttctacaattttgttatttatgattttttcatttgaaatacaaaaatcagtctaaaattaaatttaaagttctcataaattaaaattaaaaattaccataagatctttagtttttttttgccaaaaataaacatactgcaagggccaaaattttccggccaggtttgcatcgcggtgccactgcgcgcggtcaagccaaaattgacgtgaaatgtccaaatagtgtcagaagctagtacatgcaccaaggctattcttgtaaaatcgcatccgttgttgcttcatacccatgttccccaaccctagccgatccaaaatcaaacgaagcaatccccaaccctagccgccgccaagtccccatctgaatccgcaacctcttcctcctcaacctccggcggagatggtttggcggcgagtacgccctgttcgacgcggaggtatgcctccttctcccgccgccagcggtatcgatggtggaggtggcgccgtcgaggctgcgagcgaggaaggaggaggtggggaagagtagttcatagatcggatccggcactgacaggcagatgtagaggaggaggcgagggtagccatgcgtggcgtacgtggaccactccttctccatctccgatgaggacgaccttgtcggcggcgccgtgggcgggcccggggcacgtccatcatggagatcgccttcgcggccgctctcctcgtgttcggggtgctcggcgccatcgggggcgcatcctcatggccgccaaccgcttcggcagcgaccgcgagagatatcctccggcagcagcagcagtgaggagggctcgacggtgtgcggcggtgaggaggaggtgagcggcggtggtgtggtgcaccggcgctaggcggcgaggaggcgagcgatggcggcagatccatcccacggtacccccatcctcctcccccttctttctcttatttcaaatagattgaattagtgcaaatagaagcacgtcctgcctgcctcccatccgtcctggccgtcgtcatccacttcctcgtcatagttgcagcggtcttcccgtctttacagttccatcccagacgtgtatctactactgaatttgtttttttttttttactttcagattgaaatcagttctatgaatgcactgaagttttcaatttgacaacatggtcgatgcacttcattatatctgaaatgagttaggaacttgctatcaaccccttgtttatggctgtaaatttgcaaaagataataattttggctagtaagtacaagtatttggtgatgtatatccttgctcattttcttaatctgcaaataaaccaagtagatttgtttgatgtatatacttgataactttcttaagctgcaaaaggagccaaactagcagtgtcgttttatggctgtaaatgccatttttggttttgcttccatgatgagcaggtctagtcagtagaatttgtctgtgtatatctctaaccactttagttgtttgtgaatctatctatagtttggtggatgggaattatctgcttggccgtgaatgccaagttgttcattcaaatagcattctgaactcagaacaactctgaactagttgtgcactgccttgatttttagtttcttgtacagaggtttttgtcagtacgtgatatgtagagctattcctgaagtaagatgtttaaagattaattgtacataacacaaatctttgatagttctgttttgttgcgtttctttgcttcagaaactgtggatttcttgctctgtcctgcaaaaggaccacatttattttctccttcaatctatagcatcagttgcttgcttgcttggccaatgaaatgaggtagatggggacattgagttttgttagtgcaatgtattatgggacataagattggtgttgcaaagtagccctatcattcaaaaactaatatcgtatcggtagattgtttcttcttgtttctctagagcataaaaaaataatctaacacatggtattgtactatcaggttgctgggctcaaacatatgcgactttgatggagtggccaaaatgctttggtggctgttgggtattgtcatgtgcttttgaacaggttttaattatgttgtatgagatatgctaaaaaattatgttgtatgagatgtgaaggttgtaatgtgtttttagaatatttatgtgctgatcaataactattttgttactgatgatgagagaatgttaattgatcggtaattaattttgctaaaattatggacgaaatatttgtattttgctaaatttagcagcaactgaattttagttgggctaaaatctagctgtagcccaatttgaactgggctgaatgatgactaaaaggccgaaaaaacactccaaaaaaaaaccggcccaaaacaaaaaaaaatcatcaggtcataaatgggccgaaagctccttggaaaaagaattgggccacaaaacacgtgggctaagtcctacatggcatcgatgacacatcagcgtccaccttggcgaacacatggcacatacgtggtgattcaaatccttgacggaaaaatatcctatgtggcagctaatctgtgacagaaaaatatcctacgtggcagctatccatgacggttatttttcatcacaggaaatgggcttggttggactaactagaccatggtctccatcatgacggtttaaaaccatcaccgattctgttaatctgtgatggttttcgacaaaccgtcacgcagatcaatccatgatgctcaatccgtgatgatttctgaaaccatcacagatgttgtttggtgacggttttttagtgatatgtgacagaaatttttcatcacggattaataggattcttgtagtgttccatcgccattgccacaccgcagcggtcctgtcactactgccgcacggtgatcctatcaccggtgtcctactatcacaacgccgaatggcttctcccaataccggtcagtacaccaaatttctcgtaagcttaatgaggtgatcaagcatagcctaagttcatgattttaagaattaactccaatattctggtataagagccttcttaggactatgcatgttccatcactccagtgattgaagccaaaggttgcatcaagttttccctaagtgtcagcttcttaaagttttaaggtttatgttcagtgtatgtttttttgttcatgttgaaattaagtcaaatttattattcatgttctgttgatcacaattagagctaagttttagtgtattaattagattgctattactaatcaagttcaacttgggtagcaattagaaggagccaaggaggggactcagatcattcaattccctaaatcatgacgaattcccaaattaagtgcaacccaaccggtaaatcccaactcaatcagaaaccccaaggatttgggagtaagaagactcacggtttgggctcaggttgccagagttcgccatatgcggcatgagtccgtcgtgcgcgatcgttccgagttctccatcgtcttcatgtgaatggcacacgacttcactgccgctatgcatcccctaagccgtcgcctcggaccggcctcatgcccgcatcagtcctccgcttgaggtcgaggcttgtctcggcgtggtcttgcaccgcgctggagaggagaactgaagctggaagaagggattacgcgcggtattagtccgccacacaccatgagtccatgacctgccttcacactatgtcaccagccttagctcgcatgggcacttattacggccacggcaacccactggaccccgccagagacgtgctcagcatcaacctctctgcgcacgggcgtctcaacgtcaccactccgccggcatccctgccgctgcgtgcgctccttgcgtcggtgaaatcagggagagagagggtaatggttagggttagggttttggaaaccggtggtgcttttgttccgggtacgtttgagctgagtcgtctgatcggaattggacggtcgacgctgcacctacaccgcatcaaccagccctgggtgatcatgtccatcgattagatccaaccgagcctgctcatgggcctgtgggcaagctaggccacacatgtgcgatcttgatctccctcatgggctgtacgggcctccgcgcacgataatgggtcggccggatgcaattttgggctatggccagcacttgggccaaattagtttattcttatattttagcccgaatcaatgttattctaattacatgaatgcatttttaatcagcttaagccataatttgatgccataaaattgcattataagtatccttatgcaaataagatcatgtctagctaaatggaaccaactagaaatttggctagaatatttaatttattgcctttattgtttcaacctgttacaccctaaaaattccaaatatataaattgttgtctaaattggaattattagaatttattttaaaagcctagaagagaagatctagttttaattaataaattccaatataaaatggggtcagataaaatttcattaaatactttgcttaattctataatttctagatttttctgggatttatttgagctagggaagtatttttaataaatggaattgcatttaatgaataatttaaattgaaaaaggtttttaaaatcctcttttggctttgggccgaaagtcggcccaaaaccttctctctctccacggcccaagctggcccagtccgcccgcagcagccgcgtgcgcgcgccctcggacgctgacaggtggggcccgcctgtcaggtcgtcgtctacctccggccgcccgccgctcgagccctagcgtcgcgccgccgccatctccttccaaatccgcccgcccctttccgttttcaatgaaattaatagaggggaaatgatccccgggatcccctctatcttttctcttatggaatcgttggctaatttcgtttggaaatccgtggattcgatttcgaatcggattcgtctctctccccgaaccctagaccttccttcgccgtcaccggttgccgtgggcctccgacgccgcctcctagcccctataaaaggacccccggtgtctccgctacccaccgccaccctcgccttcgcctctcgtcgcccgtagagccctagccccgtgcagcctagcgtcgccgtcgtcgccgtcgctccagccgtgcgccgccgtcgcttcggtcgtcgccgtcgctcggggaggtcaccatcgtggtcgccaagtcgtcgcagtcctcgtccgtccctccgccgtcgctgtcgaccgccggaacaccgtcgccgtcgtcaagccgaagagcgccgccgcttcttcctcgtcgccgacgtcattcggtcaccgtccgtcgccgtttaggtcatcggtgagttcgccacgtcgcccgcatcattttggtgctctccgttcgcgccgccgcgccgtcgttcgccggcgggcatgcgtgcccgagtcgtcgccggtgatgacgtcaccgctgacgtcatcgtcgtcgttccccgtggcccggtcatggaccgatggatcttggccgtccattttggatgaatcgatctcggccgttcgtttccgtgagccgccgccgtgcacccggttcaccgcgaaccctagccgctgacgcaataaacccctttttccttttcaaaaataattcattattgcgtcataattcaattaaaatctaaataaatgatttaatctgatttaatctttgaaaattcataactaattcatcttagctcggatttagttggttcaagtctctaaatttttctaaaattgagatctacatgttaaaaatatccacatatactgttcatgcttgtttatgtgctgtttggtgattttgctcctttctgtttagattccgacgtttccggagagtccgttttcgcaggagaagaatttgaagtgttccaaggccagcaaggcaagtcacacagatcccaaacaatcctttgagcatgttgatcctatatttaaattctctatttatttcaactgtgcatttattttcgaatgtcaccgagtggtgtggacctgttcctttgttatgaccactttgcattgcttactctattctttgataccttgggtgataatttgactagtttagctttatatattggttcagctagatgttagacataattgcttagccatgcttagaaacattagcacactattgggataacttatgattcactattatttaatgatggcttaatgatagttcacgatggtcaatcgtgattggttaattaattaaattgccaactaaaacttgataatggtgggttgtgagcacatggttttgatggtcgtgctcatgacaattaaggaccggttcacgagtttcggttgtgaaacattaaccgtgccaaccacaagccagcgtgggcaatggctttaccttttgtataacatggttcattgcggagcaccagactgagaagtggcggagataagcccacgggggtcgctggggagtccatgccttgtttataaaggggtgattatgatctaggaacggtgcactgtggtggattgtgttgtgcgaggggtactgtcacagctcctttccaaggtaccgtggtggtattgaggcacatggtgacatgttgtggggctgtgtcttgtgggtacagtggtacacctctggccagagtaaaactattcgaatagccgtgcccgcggttatgggcgggtctaacaatgtctttcgtgattagtctcacatttctcatcataataaaagatgctataactggtaataatttgattagctcctggtttggaatggttaattcctggtttggagatagaactgtgcagccaggatggttgttcagaatggttgggcctatgcaacagggtatgttgtatagcgttggattaatattgtttaattattacttaactattttattaaattctgaaatgtttattaaatgctgtttatgcaaatgaaaccctactatgccatcctttgttatcctgtgcacttgcatatttgcttcgtggcttgctgagtatgtcatatactcaccttgcaatcattcatcaaaggaggagttctacagtgatgctgatggtgtggaggattaggtgtagccctggtcaagctgcctgtggagtggagtcatctgcgccgtttatcttattttttccgctgcttacctctgtaatgatattttattcgcttattaattagagtaataattgtactctattatcaatttgttattgtgtgcctcggctgattcctggacgagggttcacacacatgtaagcgtttagaattttggatagaaattccgggcgtgacacaacccaacggaaattacgatataggattttccattattaagatactaatgttaattttgcttcattttcgctcaatagtatcattaagtagaattttgtgtttgtattaatcttggtgacattttttacatgtagcctctcatttcttgccctatggtgagataaattaaaaatcttatgtaattgtgcgcgtcaattgtcatttcatgtcctaatatgattttatcccatcttgccttatggcattatggggtagaattttatttatgtgcgtattttacctcaatcatgtcgtttcactctattttggcccaacggtattgtagagtggaacattatgtttatgcacattaatgtcttggcatttttatttcattttacctaagtgatgcaatggagtaaaagccttatgtaattatgtgtacaattaa

SEQ ID NO: 12037 - DNA, 480 bp, Oryza sativa
gcgggcaaggcgcgacgaggcgttgccggcggtggaggaggcgagcacggtgcgacgaggaggagcttccggtgggttcggtttggtctacggcgcatgaatgctgtgctggtggagggccggtgcagtggtcccacgtgccggcagaagtttgacagtggtggggcatcgtgccagccgtggactcgcaggtggtgagtggcgggtgaaaacccagcttggtctcgccctggtgggcatcgatgacgttcgaagggtcattcccctcctaaaggcggtgtcatgccgtctcatccctcaagtgtggatgtcaggcgaaagcccagtctcggttctctttgaaaccttgacggacggcggcggtggtattttccgtcgcttctttttttgaaacgttgtttagacatccctagccgaaaccccccaaccaattgatgcaagtcgctctagatttcatcctcttgttgcggtgtgctagac

SEQ ID NO: 12038 - DNA, 723 bp, Oryza sativa
gcagcccagaacaattcatttatacaggttggtgctgacatgaattttagagactccaatggcgttacttgtgtaatggttgcagcaaatcatggctcttctgtcatcatgaagtgcttactagatgctggtgctaatccaaacattccagatgaagtgagtaatattctttcctctatagcctgtgactggatgttgttgcgacaggctgtatggtcttgagagattaggataatctactcacttattctttttatcaactgtaccaatggataagtctgcatgagaagaaggcagtgcttctatgctgctctaaaggaatgcaattgttgaaatgtcatctcaaaggaaattgctcacattccactccaaagggtggatatatggtttgattttcattactgtttgatgctgcttgatatagggatgatgagaaaatactaaggtttaccaatctacgagtgggaaaatatttagtgccccagtaagtgatcattggacaaactaatgtcctgggttgtaccctttgaaccttcatcctatcctgttttgacaaatcatgatataaaaacttgtttttgtgaaccttgggttatccttactatattatttaacctgatgtttattttacaatcttagctcagacaattttacagccttatgtttctaacatgggatcctagttggtagtgctgaagttgttaaaattatttgcaatatctg

SEQ ID NO: 12039 - DNA, 278 bp, Oryza sativa
taaggcacttgaacttacaagcggtccgtgcacctcctgtcctttgccatggcgggactaatcccgccattctctggcttcttccacgaggtcttggacttctacgagatccacgccctgcacctcgcccccaatgccatgatgatcctggtcatcttcgcgcacctatgcgagatgttcatcggggtgaggccgtccatgcggttattccagtacttcttcatcccacagctgcaatagtccgcggtggtgggaggatgctactttcagccccgcgc

SEQ ID NO: 12040 - DNA, 5270 bp, Oryza sativa
  unsure (1)..(5270): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttggcaaggcgccattagctgctcaaaagcctccgaccgaattcacattgggcatgccattggtcggtgacgatgccttattcaagatggaccctgcatgcaaggagttgcacgggtactacatggggaagtccaacgcaaggaggaagaatagagagacctccatgttgggctagcatgatagtcagccgttcctcgggcctactgccttcatcaccgtaaacttcaaagatctatgggacctctacagggtgcgagcgatcgataccaacctccttgagtgctactccttgtaagtatttctggctaccgatatggtagtaactgtccataaattacgcttaccctgactcttgtctttctcgtaggttaacctggaagcatgtccatcataaagcaccccatgttgccttactcgatccagctgtcgtcaatgagacaacgctgaaaaacgatcgagccaacattgtggactatatcaaggactgcttatttgcccgtcaaagacaaggacttcattatgtgtgcctacaatcaacagtaagcatgtaccccctacttatactcaaatgcgcgacgcgtacagctgtagtatgtaactagcaatttattaatttcgtaggcgtcattggattcttctggtaataacgccgaagtggagtttggtacactaccttaactccaatatcaatccaaaaatatacgattggtcggccatcgaatctgccttgaacgaggcatgggaccaatacgtggcaagaggcgggaggcataaggatgggcatcccaaactcggtcacaagaaagacttcctaatacgttaacaagttggcaaccagtgcaggttccatgtctgccataacatgaggagcttcgcagacaaggtgagattgctcgaccctgaggtgtgtccttcaattgtttatacacacataggacgacaatttacaagtatgtaaactaacttggcgccgaacatgcaggaaaaaatttcaacgattccggaaatcaacttcgatatcattagagaggagataacacaattcatactagatgatctcttgtcaccgaaagggatgtttaaagtgaagtcctaggtagctcgtctcggaatggcagaacatttgcaatgcatatgcgacaaacatttgatttttgtaaatattctttgtaatacaattaaattctttagagtaaagtcctaggtagctcgtctctatatatacttgtatttctaattacatataaaattgttccaatttataacttagttttacaagttttgatgcatgtcggcggtttggagaaaaaatggttgtgaatgacatatacttcctccgtttcacaatgtaagactttctagcattgccacattcatttaaatgttaatgaatctagacatatgtatgtgtctagattcattaacatctatatgtatgtgatcaatgctagaaagccttacattgtgaaacgaagggagtatatgtgatgtgaatgcatgtgttgtgatgggacataaatgtgaatgagttgtgatttggctgtgaatgcatgtgttgtgatggaatgtaaatgttgtgatgctgagaatataaatgctatgaattggctatgaatgctgtgatgctagcaatggggttgctgggaatgggactatatatatatgtgcttctgtcacgtttttgcagcgagcatggctagcaaaggcctgaggctagccaaattataaaattttatttttttgttccaaactcatccctgacgggcattttagtaatgcccgaaagagatatgtcattttgttaacgaccaaatttggcgagttttggacctgcactggagttaagcagatctcccaggcctcgtgttttctgtcaacacatccgtgacgggcttttagagtaaacccgatagagataagtcatccgaaccgggactcgtttgactcaacacgtggggttaaaccaatcggtgatgggctctatctaaatgcccgattgagatgactactcatccgtgacgggcttagtggtgtgcccgattgagattagtcatccatgacgggctcctaactacgctggtttgactggtcatactcatctgtgacgggctttgttttcggcccgattgagataacatccatccgtgacgggcttttgctcgattgagatttttttctcacatcagtgacctttgcctagtgacggaggccttacccgatagtgatgaggctttcagcctatcacagatatgcaatcccgttctagtggcatgcattccattggagatgtgtggaactttaattttgcatttatataggtgtaaacacgaaaatacggtgacaaaaaaaacacattttagcaattcgatcattttgtacatctttacatatcatcaaaaagtcagaaatgctagaaaacaaatgatgtgttgtactcaaaaggatgtatctcattgtgttgtattcatacattgtccctccctgttgatggcatgtactattttcgtgcattttttcccataagaattttttatggttacttccttacaatcagacaatttttttaaccattatgatatgatgatgcttacataaaaaaaaagagagaaatcatacttcataattcattgtgcatgtcaacttgcatatatatataagacttaccagcaatgtggagcattgagccctgagcaacttcaacataaaaaaattggacaattacggttttatgtttctacatctttttacttagctccatatttaatttcttttacaacgtatactttgtgaatctctactctctaacaatatgaaaaaatggacatagctaagggggtgtcttggtaaaaaaagatgttacagctgaaataaacacgatagatataattctttctaattgatatcaagaaaaacaggctggggacatactatcactgttatcgttggctgagatcatcaggattgttgtaaatactgagtccctagagctgagagacacagtggcggatccaggatttcaacacgtggggagcaacttaccgagtaataatataaatgatattgcccatatagttattttcagatagaggtagtatataatatttacagttttgtacttccctccctaaattatagtaatttcacattaatatacacatgtttttgagaatttaacaatatagtagactcgtgttcagccgcgcatatcatttggcaacataaagttttatcatggtgaactaggtaaagcaaggataacttagtagtaatcgaaatgttttgatgcgactgttgaatgcacatccatagggactagacagctagcacaaactccacggtaccaatggcctaaatctcagaggactaaccttaatgcttatttaatcctatgattagttagatgtaattaggaacatatgtaccgcagactagtaattaacttacttatactccacaccaagtgttcattggttcccttgtagtatatttgaagatcaaggatctttttagcctttttaatttacttaatcatagttcagagattaggtcagttatggagaaaccagagatctagtgtgactgaagaaataattaaaaccgtatggtgtgctcaggcagaatgcatggaacgttgcacgtacgtacgatcgacgtgcgcttattttaatttaactcacaaagacaactaacccatgagcaaaaacatgggcttagtctcactattatgttcttcatcacctcacctaataaaaatgctcgatgcctgagagaaaggaagaccagcactccaacagccacgtggatatatacatttcataaaactcattggtaatttggtacacatgcaccgtcatgcagctctggagtgcacaagcagcatagagcaagaccagtgcaaaccaacagcaaaacatacacaaacaactccatgggtattaatctgcccattgaacccagcagtctgtggaatggtgacccaacacttgcgacaaatttccaagggagaggaaaaaaaatgatttcttggacggcttgctcatgtatacttttaatttggaatgtatggaaggagcgcaatatgagaacttttttaataatatgtatcaaactgttagacatatgtgcagatataaagtacataatagagagagtgctttgagagcatagcctttcataggttggggcctaaggccaagtcccacctaagatggcatgagttaaacttatatagtttagcatttgaagatttatgttcatagatttactatgagaaatgctttcataatacatataattcgcatgttttaaaactatataaatattaagaaattgatggttaaagttagaaaaatttgatgtaaaacttaaaacaaaggaagtaaaactagtccctactcgatctatgcataacttgaagtaaaaaaaaaatcacgataatttatgtcttcgcttattgcatgatttggttatatatgttctccaatacatatatatcttcaatcctacttcctccgtttcatattataagactttctagcattgcccacattcatatatgttaatgaatctatacatatatatatatatatatatatatatatatatatatatatatatatgtgtgtgtgtgtgtgtgtgttaaatttattaacaactatatgaatgtgggcagcgctagaaagtcttataataggaaacgaagcgagtgtcttataatttcttagatcaattttagtcatcaacaagtctataattttgatgatcaagtttaccggtgaaaattagaaaaccccatatgccaatctgtttgtggtacgatagagaattaatatagacgatatcagttcatcccaatgactgattgactgcatacaagttttatgtcaaaacatccaactggagcttcaaaagggagtacctatacatctttcgaaagatttttataatcgtatcacacagatttttaatctttatattaaaatccgatagatataataaaaagcaaaaagcaattaagcaac

SEQ ID NO: 12041 - DNA, 6456 bp, Oryza sativa
  unsure (1)..(6456): unsure at all n locations
gacatatgtactttgcaaagaaatgtaaagtgcaaactctttatgtcaattttttagaattcaaaagttaaattcatggtttaactttagttacatagttttactattgaaattacagtttttcttctatgtaaatgtaacacaaatgtactataagggcctcttcagattacagtatttttaaaggatttttggaggaatactgttcacagggatttttttcctttcctatcattcggaaggcacaaacaggtcataggaaaatctaaggaaatattcctttgctgctgattacaaagaaaaaacacaggaaaaataacatccactccgaccacatttttgttttcctttgcgtaagaccgaggtaatcaagcagtaaacaagaacttttacgaatacaagcaaagcaactgagccagaactctgaaggataggaataagaagcaatccaattagaaaacaacaaggggaagaagcaactcgaggttgccagctgctcgagcttgtgatggccatggcggcagctcgttcctgcctctagaagattggggaaaaggatgatgcggtgaagaggataaggctttcctgtctagagagtactcgagaatagtgactagatagaaaatagtattctattgcttaattagattataatctacgcggttactcttgatcgtaaaattcccgtgttgtatatattcctgtattccgaatgctttctatcatcaaattccttagtttttcaatcctccgttttccatatgaaatcctatgctattcctattcctgcatttttcctatcctgtgttccgaataagccctaaatttacttttcatgtactggaatgtgtttgtgtagtaaacttcaatgagaatattcaattaaaaacaaatagttaaaatcaaaattgaataatcatgtacctttcaattttttccagattgaaattccttatcttcaaccatcggtagaatgtttaatattcctgtgtacaaaatattatcaaatcattcctactttgaaaaaagactgttgttgattccaattcaaatgtatttttttattaaagacattgttgtttgtgtcttctttacaaacagttattttctcatgaaaggcatttgttctttattttttctttttgtgaatagtttgttctactgtcctcaatttgtgttttgtttatgtaatcgtactgctgaattgctttatgatcgaaaagataggtatagagtcaattactgcaaagttatattggaaatacagaaaaaattttatgtaatttgattataaagttataaatagaactcacagagagaattatctaatcatttctacaactattaaattgataatcaattttgtgtacctaattgcttgtaatgctactgttcaagattaagacttaatttttggtttaagtgttcctgttcataactttttgattaatctgatttgtaacaacttatatacacaaattatactagaaatgtaatcagttgttgatatcactgttgttacaaatagaatctgattaatttattttgattgcatttttactgagtaatgttgagatcgccgcaatctgaatttgttttcattttaactgaataatgttgacctcgctgtggttatacgaattatactacatgttcagcaactatactgcctttgagtttgatcagatgttttatttattaactttgtgtttgatttttgaaatgttaactgaactgcagctgtaatctcaatactgaatgtgatttgttgaataagtaatctggactctctgactcaacatatctaattttgtagtgactacatggatctaaattgcaagattcagaagaagaaaacgatgaagaagaagaatcagaagatcaaatcagaagaaaacgattactacatggatctgagtttgcttgtgtgactttgctgtttccagaattgatatctgatcacgtgcttttgtcagccatcttcttggcaaacatgttttctgatgggtcacgtgaagaaatcaccaaattgggcttttcactttagaatcatttcggtttgggctttggtttggatttgggccacgataaataggccctgaaaaattgtccatactttattttgctgtttgtatagcccatttctttttttatatttttttgctgaaaaaaatgtgagctgttagattgaaatcgtatggtgacaaaatttgacagattctagatgctattttctgtcgacaggctatacacggtcccaaaaataaaacgaattcccataatagggggtttctaaaatatatgggtttttttttgcaatggaatatttcagtttaatgtaacattaaatctatacatagtgaaacattataagtacactaggtgaaacattttttgtaaaaaaaaaaaaaccaaattcccataataaaggggttccaaaatatgtgtgatttgttgcaatagtagataggagcatagatacggtaggacaaggcctgcatgcagcgtgggggaggggcgtcgcggtgcggtcccccgcgccggtcgtgcgggttagagcattcgcgatatttagggtcctagcactgcggattttctattttgccgacttaaacaaaccacaacggggaagaccagtactctcattgccgtggtccacgcgtcgcacgactgagtaccgtgccgtgacttccttctcctatcgaccagggacggacgcagcaagttataaacagtaaggctcaactatctaattctatgcattttgggcaaatctcatctgaaatttagtgttttttctttgaatttgtttatgccacgtgagctgcctaacacgtgtcacaccgcgccgaccgcagccagagagaaaacaagctcgcggacagccgcaacataaaaaggcaaaaaaaaaaaacaaaatctgttactacgccgaaaccctctaatcaccagttcacaatccccccataaaaggcggcccgcctcatatttcggcacgcccccaaatacacccgtccaatggccgccgccgccgtccacgagccgcttctcgcggcggcgccgccaacgcccggcaaggccgccgacggcgacggtccggaggaggggcgccggctcgcctccgcggaggcgaagcggctgctgcggctggccgggccgatcgtggccagctgcatcctgcagtgcgtggtgaacatggtgtccgtcatgttcgtcggccacctcggtgagctccccctcgccggcgcctccctcgccacctccctcgccaacgtcaccggctacagcctcctcgtacgcccgcacgcacgcacgcccgctagaaatttgaatcgtggatagattgtttgggattctccatcgaattgatctttcaaattctcctctcgcagacgggcatggcgacggcgatggacacgctgtgcgggcaggcgtacggggcgaggcagtaccacctgctgggcgtgtacaagcagcgcgccatggtggtgctcgcggcggcgtgcgtccccatcgcgctggtctgggcgtccgcggggcggatcctgctgctcctcggccaggacgcgggcatcgccgccgaggccggcgcgtacgcgcggtggatgctcccgtcgctcgccgcctacgtgccgctccagtgccacatccggttcctgcagacgcagaccgtcgtgctccccgtcacggcgagctccgccgccaccgcgctcctccacccgctcgtgtgctggctgctcgtgttcagggccggcatggggagcaagggagccgcgctcgccaacgccatctcctacgccgtcaacctcgccatactcgccgtctacgtcagggcgtccaacacctgcaagggcaggtggagcggcttctccggcgaggccttcaaggagctccgccagttcgccgcgctcgccatgccctccgccatgatgatctggtgagagatgggaccatcgatgtagagttgactctgaaaatacatatcttatttcaaatattcagtttgtgatcgaaaagagtgatcatatctgcagcttagaacatatcttatttcaaaaattcagtttctcatcgacaaaggtgtaggagtaattttttaagctatgcttcaaccaaaccgtttaattttctagacaattttcttttgcagcttggagtggtggtcatttgaaatccttgtgctgctctctggacttctgcctaatcctcagcttgagacatcagtgctgtcaatatggtaaccacacagttctacttttagtggttcagattttgttttaaaggcacattttgttcttaactccagctaacagttttcaatattcagcttgaacactggggctctgctgtacatggtaccattgggtctatgctcttctataaggtgcaagttgtcaacatgaaactccacagtttatagtgttcatgtaataatttccttgtcgatttcatgtttttttcttctctgtcttcctgcagcacgcgtgtttcgaacgaaattggagccgggcagcctcaagcagcgaagcgagcaacgcgagtggtgatgtatatggctttgtccgaaggattggtgataagctttaccatgttcttgcttcgcaatgtctgggggtacatgtacagcaacgagcaggaagttgtgacatacattgctaggatgctgccgattctcgacatatctttcttcatagatgggcttcacagttctctgtcaggtagaattaaaatgcattgcacatgacaaaaatctgaatcacaagttcacaaccacctaataagcaagttatcctgtacatcatttttaagagttaaaatgagttgttcttgcactttgcaggcgtgctcacgggttgtggcaagcagaaaattggtgcagccgtgaacctcggggcattctaccttgtaggcattccgggtggctgttctgcttgcattctacctccatctgaatggaatggtacttacctctgctgaatttttcccccatgtaaaaaatgacctgtagaatcaacatggatgcatctgaattcttaaactgatgtgctttcaacagggcctgtggcttggcatcgtctgcggcagcatcatcaaactactggtgcttataattgtctcgtgttgcatagactgggaaaagtaggtaagcacactaaacgaattctttcaggataatgattaggaccttctgctgttaaatctggacaacaatatgatgtcttttttgatgtatccaatttcaggcgatcttggcaaaggacagggtcttcagctcatctcttccagtagcatgaaaatgtagtgtgccacatctcacatgcagtgcaccaggcaattaataggatgcaaaattggtctatagcacatcagcatcaatcatcattataaaaagcatacgaattgatcatcgttcggaaaagcatacgaattgatctgcaagaggagaataggagccgtcttgtaacttctattgggatttagaagaagtgcaaggaaaaacgtagttgaggactgcatcaatcacaatatgattgaggccatgtcagcaattttggacttcgggtgttgtgtatgactattgtttttgctaacagtgtacaactgagctctagttaggataggtatagaaacagtgagagtatgtacgtagtatgaattttgatgaattttgatgtctctgtcagtgacattgtaatgagcagggcacaacatctcggaatgaacaaattataactttgaccctttttgtctctganatattgggcagtgacaagaaagcacaatcctcacctgttttgatcaaaggagtttacatggtaaatcataaatgacttcagatcaatccattaatcattattggtattattattatgtgcattatagtagactgtctagcaaaagccacattataaaattgatgatgatactccctttgggctgataatatttatcttttggacagaacacggtctcaaacaacaactttgaccactatttttcattataatataaatagaaatatcaataaatatatgattttactggaatactttttaaaaccaacctatgcatatgttctccataattttaagatagatattttagaaattattcatagtcaaagattttaaaatttaacatcaaccttatccaaaacgataagtattatcaacatgaagagaataatgagtttccaacacaaagaattatcatcactgaatccataaaagcatcacttatgttgccatccacgtggattgggcaatatactagctcaaaacatgctttccaatgaaaatgcaaccacaaaatttataattatgatctatcaattaataccacaaaatcaaatcgaccccatgtttcatccatagaaaatcgaaatcgaagtcttattaaaaatccattcacattattcacaatcgcctataccatccataaatctatgcaatggcg

SEQ ID NO: 12042 - DNA, 2837 bp, Oryza sativa
cagcgctcgtaggttaaactcctcctgtttgtcctcgtcccacacggggacaccttccttcttccacaatagtttaagatcttcgaccagtggtcttaggtacacatcgatgtcattaccaggttgcttggggccttgaaaaataatcggcatcattatgtacttcctcttcatgcatagccaaggggggaggttgtagatacacatcgtaacgggccaagtgctatggccgctgctcatctctccaaaaggattcatgccatccgtacttaaaccaaaccgtatgtttcgttcgtcctttccaaagtctttaaattttctgtcgatgttttgccactgcgaaccatcggcggggtgtctcagcatcccgtcctgttgacgctcttcagcgtgccatcgcatcattctagcattccccttgttcctgaacaaacgccttagccgtggtattatagggaaataccacatcaccttagcaggaattctcttctttgttagttgcccgtcaacttctcctggatcatctcgtctaatcttgtatcgtagtgctttgcaaacagggcatgcttctaggttctcgtactcctcaccgcgatataggatacaatcattcggacatgcgtgaatcttctgaacttccagtcctagaggtgcagactatcttcttagcctcgtacattgtctcgggcaatttgtttccctctagaagaatgttcttgacgagtttcaataaatcgccaaatgccttgtcactaacaccattttttgccttccattgcaaatactccagagtggtatccaactttttgtgcccctgctcgcaacctgggtacaacgacgttctgtggtcctctaacatcttgtccaatttatgggcccccttttcactttcgcagtcctccttggcatcctgcaacatctaaccaagatcatccgcaccgtcgttaccatcagcatccctttcctcctcgcctgtttgatttccttcaaatccagcgtattgagcaaagtccggaatattgtcgtcttccacttcatcttcttccatttcaacaccttgctctccatgggatgtccaacaattatagcttggcatgaaccccgactcaaacaagtggaaatgaatagtcctggatgtagaatactccttctgattcttacacttattgcatagacaacaaataaaacccttttgcctgttagcttcggccactctaaaaaaataatgcacgccgtcaataaactctttggaccgcccgtcagcgtacatccattgccgatccatctacatgacatgaaaaaaaatcgtatacaaataattattcgtacaataatgacagtcatacaataattataaaataattacaaactctttcaacagtcatacaataatgatatatcattattcatacaaaaattatgaaatattacaccaaataattcttatttactatttctaaagttttaaactaatattaatgtgttgtacttcttttaattttcattttagtttgttttctattattcaagattaactttcactatattttccttctcaactattttataaaaccttctttagcaaataaattaaatttctatatattctttcttccccacacaaattttctctctcatcaacttacaacaaaattttggaagcacaaaaaagtgtgcaaaacatagcctccgaatgtaatatgcaaaaaaaacattggaggattaagttgctaaccttttaggcacctccaatttgtatataatcaccaaaataaattcactagaaattttggcatgacctcccctctttttttaagaaattttgaagcttgctcgggctggaggaggaagaagacatatatatataggggtgggactttagtcccggttggtgttatgaaccggtgctaaagatcgccgggatctttagtcccggttggtaaagatcccgggggagcctgacaagccctgacagcatttgaaccgggactaaagacggttggtgttaccaaccaggtctaaagatcaaatatgcccgttaccctttttaaccggaactaaagatcatctttagtaccggtttttgttgtaacagggactattgtggaattaggccgaccgacgaaagatggtttctccaccagtgtattttaactgtgggaagttagctgttatggaaagcagtgtgaagattcttgtgtttttgtctaattaagccgtgcttaagcgtgcggcttccaagttgttggagatcggatcgtagagaacatccaagttatctgattcagactatttagattgcgttctgatgagaccatcaaagttccatctatctctatcgatgcttctacatgtttgcataatagctcatctaggagtattgttcaggttggatctttcttttgtaccgtgcaacaacgaaagaaaggagaaggcctagctgcgagcagtacttttataggttaattaaggtaagtgctattagcggcatcgttaccattaatcacataattagattactttttatttgtttgtttgggcctgctcgagtaggactctgatcctgtattgcctgcgtgcaatataaaagcccaacgtggcctgtaatcagtggcggatccagaaaatcgattcgttggtgtcataacgtgtatattggtgtcatagtatgttaattatgtttagatcataatgttataacatatggataaacagttttgctataggttttgccgacaccgcttcagtggccaatctaggatgaaaatagagggggtgcttctaatatcctatgtacaacccacaatgcaatgaaaacatactaaaacatgcctcag

SEQ ID NO: 12043 - DNA, 3349 bp, Oryza sativa
ctgcagccctgcgacacgctggatcggcaacaatttcactaggtatctaaaacatgcctcggcatgttgttctcatttgttagattccttcgtgggtaaaaattatgcaatgtttgattctccatccttgcaaattaactgtcctatgtgtgcttaaaataaataattgatttactgaaatttactgcagtgatgataaaataaactgaaactgaagagactagtgttagagtagagagcaaatagattgatttacctgtactggttgtggctggttgtggcgttgtgctggccagccgggcagcagatgatgagatcgttgtaggctgcaactgcaagcaactcgtcgactcgtcgtcccgtgatccgtcctgcaggacctccgcggtggcgcgatcgttgctgccgccggcgctgtcgcctgacgcagtgacgcctcgactccttctgtatcgcgcctccttctgcgtggcgctgtgacggcttgctttctcggtcgccaacccaatgggccaggcccagcttgcgagggaggggagggggggggggggtgctgtcgggtgaagctggggctccagccccaacagtacatccgcccctggcccctgcctgtaatgagagttagtttttgcttttggtgaagtcgtctagggtttattcctgtcgaactggaggatggcgatcccatcttgttgatttgccgctgccgccgtgaggtgtggagggagcacacgtccaggatacttctccagggagtgttgcttggagtcaggtttggttccatcttctctaatcgtgtgtattgccacacgggtggagttgcagatcgttgatatgtatcagtgctttaaaactactatctgttattgctgtttgttttgagagacaaaatcaattcactgcgacgctcatatacatactgccggttaatattgttcttactgctttgatctactcatttgtttaagttggaaaaataatcgggactgtctagtgcactgtcgacagatttttggacctccgatcttgtcaatttttttaaccaacagatctatatccaacagctaatattatttgacaaataaaaattaaaaatacataaatgaacaaacacaaataggtttggaagcccattttcaaagggctcaacacaacccgacccaatcaaatagcctagattgagcccgaatacaaaatttacatcaaatgaaagcccaaattaactttgtagtcaatttaaaggcccaaatcaaagaacaacggctcagaaaggatttagagggagaaaaaaaattctttgaaccttcttgatatgaatcttcatcagaataaatcacaaaacttaactcaaatcttctgatattgatctacatttctgtcgaatgagattgaactgtaaaaattaaacaacaagttaaagtcactctgaggacccttctaatgcagcacaccacaactcaaattagataaccaaaatgtagagttgcagacacattactgtaaaaatgtagaaattcagagaacagaccacaagtcaatcagaaatagaggagtcaaacacattattgcagagctaattaattaacaacaaatttagaattaagcccacaagtcaatcagtaattcggaatacagacatattactgcacagcaacaaaaatgtcagaaaatttagaatttaggacacacctcaaatcagaaatcagaaatgttcaattggtgatatattaagtagattgacttcagactgttcacagatcgaaatatttgagtgtttagcttcggattttcatatgaatctccatcaaaaaacttcacaaagcttcatcactccaaaaaaatatcttcttgagttatgggtctacattttatacataaatcttcatctgtcaaaattaatcaccagttaaattcataacaaaaaaaattcttgacttaaaactttacagaaacatcacagaactttacaaaacaaattaatggtaggaatttatgtactcatatgtattagttcagaataagaaaattagatgcaatacctctattaggcaaaacaaacatatagctgcaaataaacagatgttagagtatttagataatcaaatcaaacttcaaaactaaaaattataatataaaactaaattaaaattgctcctagttgtcataaaccattcacatcatgcacaatgcttcataaattgagaatattcagcagcattctaatttttttcttaaattacagttattttgtacaggaattacataaaacaaacattgtaattttaataatataaagatgtaactgacatcttgtagactaaagactttatataaacatcacatatcatattatcttagaattcaattgttatgtgtattcttaggttgcacaacataatgacatatgacttttgcattgcatattttctggtcatattagaactcatgcaaatatgtactgcatatgtactgtattcagaaccgaacttatatcaaaatttggatttcagagaatttatattacatccaaagtcaacagcaaatatgtcaaaaaaatcagagtatatcagatttaggcatgtatctagaaactgcacaaagtatatctatatatcagagaatttatattacttatgtaccaactgcacaaagttcatggaaaccagatttcagatgaagcatatcagatttcatatactttgcaagtaaagttgcaggtacaagaaaagtcaaaggatcaaattcaggagcaaaagcggatcacgaacaatgcatagggggaaagagttgaagtcaaaattcaagcacttaataaatctgaagttacatttaccactttttgaatcttgttttgaatcttcttctgaatctgaatccagtggcatgttcatttgtttcttgatcttcaaattgcgtctaaaatccagaattcggaccacacctcaaacttttagaatcttcttttggttttttgatttggatgttgatgtacaaagtacttcgactctgctatcaaatggaaacaaaatgaaacattcagtcaaattggtagacggaaaattaacatatgaaaataccagtgcagaaatcaacaatgaaagcgtcttgctcgattttttgtttcagtgttgtttcaggctaatatgcaagataacttatcaaaaattagtatactatgaatcttgcatactaaattgttttagtttcaatctttgcagcataagattactgactaaatcaaatcatcagatactatacttgcaattttcaaattgacaggattaagtttcagaatttggcacaccaatcaagatacattattttcatagctgaccaaccaactccatct

SEQ ID NO: 12044 - DNA, 1164 bp, Oryza sativa
aaaaattgcacaggtttgcagataacatatattttgcttaattattttgaaaacaagtgtattgagcacacacacacacacacacacacacacacacacacacacacacagatatatatatatatatatatatatatatatatatatatatatatatatatatcaaaagtgatttctggaatattccatttgaaggtattaaagatgggaattttcaagatagtcaagaaacatagacaaagtacatgtatgagccatctttataaaattacagtatttttatatcaaatttacagttataaaaacctgtaattttagattcaatttcatgtaaatgatacaaaatcaaatattatggtcacaaaaatcaaacctgcagatataacaaagctcccctgtcagtgtagcaaaatattttagtttcaatatggctgcaccatagccgacaacaatcacccgcatcaacaaaacatcttcaaggttcagagttcttaattctagtcaggattaggtgcaaaatggtatacacacatgaaatggagtaaaagttcatttttttttatgatagtttgatacttgccgatatgattctgagcaactttgttcaggtaggagatgcagcgcttacttaactgattaagactttctccaccaccctaaacatcatctgaaacagtgataaacttttcaaagttatatagtactacagctacaaaatgttatacacttattccattttttatttaacagacctagacaaagttacatttctgggttataattgttccaaagaaaaaatacggtttggaacttaccggcaattcttggtttctgccatcaaagtacaaaccatttttaacttcaaaattagcaaagcctttgaaaacgcctgggcttttattcacagtgtcatcccacgtcaaaccttgcagatatcccatgtgcctttctcttagtgattcagtcaacactaactgaaacaaattattggtgttactcatagaggaacaggcaggacaaaagtaggctagaactcacatttgatacatcacaggctttctctatgatttctgcagtctcagcagcacgcttcaaatcagacgattatacaacaattggcctagcttctcttgccagacgatgagccaccttacaagtttgcat

SEQ ID NO: 12045 - DNA, 1983 bp, Oryza sativa
aaaataacaacaaaaaacaatgaaaataggggcaaaagcaacaaaaactcaaaagcttcaaccacacacacggccaaatcagggaagaagcaaatcactgaagaaaaaaggttgacgaacagatccgccgtctcctcgcaaaaatagagattaaaactcaaaatcacaacagcggtgatacgcaaccgttgatgaattctcgacagcgaacaatgaagaagagaacaaatccacataaaaagttaaggaaaagagcaaaaaaaatggatccatataaatcaacaaaataagacgactcatcatatttaactcgtagaaggagatctagattgctgcaaaacacagagaaaaccctataataaaaaaaaataaaaacacaaattagttgaacaaatcgatgcaatcaccaccttacttggcactgaggcacgcaagcacggcacggcggtgatacgcaaacattgatgaaaacttagcggcgaacagtgaagaagagagcaatacacaaataaagtaggggaaaagagcaaaacgtagcagaatgcaagcacaaatgctaatgaaaagaggaacaagcaaaccacaagagacaagccggcgagacgccggcgagaagccagcaacgagaagattcgccaggctaatagcctcgacggagacgacgagagataagaaggaaaagatagatatttcgcctcactctctccccgtgtcataaggaatcagaaagcaggcgcggatttcaaaattgaccagtaaaggcaggacccactaagcccaatccaatctagataacccaatccagcacacagagcaaacccagactatgcacgaatcacagaacaaaacgaatggaccaaaaaacgacagattgagcagtcaataatctgttgacagagatgtagcaattccgaaaataatctggttggtttattcagttgttggtaccgtgaaagagaggaaaaatccgggcattcactgccgggtgctcatcatctattatctttattctagaataaacaaacctactactccctccgtattttagtgtatacgtcgttgactttttatttgaccattcgtattattcaaaaatgttatgcaaatataaaaatatttatgtcgtgcttaaggaacatttgatgataaatcaagtcacaataaaataaataataattatataatttttttaataaaacgaatggtcaaacgttggttaaaaagtcaatggcgtcatacattaaaatttaaaatacagaaagagtataaaataacacatcataatactatgaatcatagaaaggccacaaacgaaggcaaccttactctaacagctccacagcttaattattagtgataaaaaagcaacatatagataaaacttttatacatgtgttatcaagtgacttaaaagccaatattaaaaaataaaatactttaaaattatcctaaaaccaactttaaaatttaaaatttacaatttgacagtgattccatatagaaaaaacaatgagactgtgaaaagcacgtgtagaattgtcaatacctaacctgtcagcaatcttgtccgagaaacagggatccaagccaaaatcgcagtgggtcagtttgttttttttttaagtgaaacggtggatcagtttgtgacgaggacatcccttccaacgatacaaccacgcctattgcacagcaaggaccaatgactagagctcgagctcatgaacttaattatcaggtaaagtcattcctagctaatcatacaagttcttctcagaattgggtgctactaaatggttgttgtgatctacttgttgttaggaatatgggagaggaaccaaatcgcaagcagcactagcagcgctgatttgatgaagtcaatgctcttcactccggagggcaaacggggcaaatgagtacttgttggaaagatctcgtcgtctactcttcagctatgtgtggcctcaccatcaagtttgacccagg

SEQ ID NO: 12046 - DNA, 2728 bp, Oryza sativa
caccatattcaccacgaaatccacctccaaccccaccaaatttcgtccaccacaaccagcagcaccctcatcaccacatcagccacccccaaatgcatttattgctgcctccaccagcagccaacccttttgcaactttttgaagtgaatcagcccttcccaagaaagcatttaagtgctctcacttttgacttgttggctgaatcatgtaactagccaaccaacccatcattacttcttgtttcgatttgttggctgaagcttgtgaaatttcgaaaatgtttgagaaaaggttattttgctaaggcttgttttgacttgttggctgaagctttgagcttgctgtacaaaaaaaaaagaaagaaaacaaaaaataagaaagaaaaaaaatcagaagtgaagagaaggaaaaaaaaaggaagggaagagaggaagttgttgttgttgctgttttgtttgtgttattttcgtgctattttgagtggctacgcttgtgactaggctcgcgtctctaaagggttttgcctaggaccagcacaataccatcgttgaatgattattcaacttgctttgattaatgtggttctagctgtaccttgatattacttgcagccacctatagctccacaaatttttatctactatatcacaggatcgtgcttgttgtcggctccggtactactaaccgttgttgctgttcttgctgtttgccaacgccttttacataacaaagtaagaacatgtaagaactcgtttgcacaagtttggtagaagtggagatggacaacacctagctccaatagttgataggacatatttcttgtgaattgtttcttcccattaaccatgacaggaggatcgggggagcaccctcaacattcaccacgtacaaggggcatcatacaacattttgagcgccaagtgagggagcatgctgaaggccttgatgaggatgttagggtcgccaatgatcgccttggtcaattggaggctgctcaaattgacaccaactccaagctttcttcattggagaggtcccttgtggctgtgaatacttctctagcaggtatcttgaatacgttggagagaatgggccaagatggtcatgatggatcgcttaggcgctaccacaatggccatgatgctaatagcagcatcgcagcaagggaagaactggagtacgctgctgacactgagcatgatgaggaggtacttggtcgtccacaaagacaacagcgccggcagcgccatggcatgggcgctccaccacggcaggaggtacgtgataatgatgattctttaggcaagatcaagtttaccattccttgctttgatgaaaaatatgaccctgatgcatatcttacttgggagttagccattgatcagaaatttgcttgccatgattttcctgagaataaacgtgttagggctgctactagtgagttcactgattttgcatccatttggtggagtgaatttgttcgttccaatccaaataacactccccaaacctgggatgcaatgaaaagagtcatgcgagctagatttgttccttcatatcatgcacgtgatttgctgcacaaattgcaacaacttagacagggaaacaaatctgtagaggagtattatcaagctttgcaaacaggaatgcttcgttgtggattggtagaaaatgatgatgctggtatggctagattcatgggtgggctgaaccgagaaattcaggacattctagcctacaaagaatataattcaattaatcgtttatttcatcttgcttgtaaagctgaaagggaagtacagggacgaagagctagctttaggactaacatttctgcaggtcgtgctagctcttggacatcttccaacgttgctgcaccgtcaactcgagcagcagcaccatcgtcctcaaacaacaagctgcgcccctctacaacaaactctacaccatgcccgagtgaaccaacaagaggggttgctgctacaccttccaagagctcatcatcagtagcttcatcaggaaggacaagagatattcagtgcctacgctgcaagggctatggtcacgtgcgcaaggactgcccaagcactcgtgtaatgatcgtgagagctgatggtgggtactcctccgctagtgatttagatgaagaaacctatgctttgcttgcaactaacaatgcagggaaaggtgacgcgccccaccaagatgaggaacacattggggctgaagctgcagagcactatgagagcctcgtggtgcagcgagtgctaagcgcacaaatggaaagggctgaacagaatcagcgccacaccttgtttcaaaccaagtgtgtgatcaaggaacgctcttgccgcgtgatcatagatagaggaagctgcaataatttggctagtgctgaaatggtggagaaacttgcattgagcacacagccacatccgcagccctactatattcaatggcttaatagcagcggcaaggtaaaggtaacacgattggtaagagtacattttgccattggttcttatcatgattcaatcaactgtgatgttgtgcctatgcaagcatgttctattttcttaggtaggccatggcagtttgataaagattctttacactttggcaaatccaatcaatactcctttgtgcataatggaaaaaaacttgtgttacatcctatgtctcctgaagttatcctaaaggatgaacttgctagagctagcaaacaaa

SEQ ID NO: 12047 - DNA, 10383 bp, Oryza sativa
accttatttccaattgaggatactcctatttctttgcctcctccggtcactaatcttttgcaggagtatgctgatattttcccaaaggaggttccaccggggctgccaccaattcgagggattgagcaccaaattgacctcattcctggggcctctctgccaaaccgtgcgccatataggaccaacccagaggaaacaaaggagattcagcgtcaagtgcaagagttactcgacaaggggtatgtacgtgagtctcttagtccttgttctatccccgtgcttttagttcctaagaaagatggctcatggcgcatgtgtgtggattgtagagcaattaacaacatcacaatcagatatcgtcatcctatccctaggctagatgatatgcttgatgaattgagtggttcacttgtgttctctaaaattgatttgcgtagtggttaccaccagattcgcatgaagttaggagatgaatggaaaacagcttttaaaactaaattcggcctatatgagtggttagtcatgccctttggtctcactaatgcacccagtactttcataagattaatgaatgaagttttacgtgctttcattggcagatttgtggtggtatattttgatgacattctcatatatagcagatcaatagaggatcatcatggtcatttgcgtgctgtttttgatgctctacgagatgaacgtttatttggtaaccttgagaagtgcacattttgcacagatcgagtctcttttcttggctatgttgtgactccgcagggaattgaagtagatcaagccaaggttgaagccatacatagctggccggttccaacaacgatcacccaagtgagaagctttctaggacttgctgggttctaccgccgctttgtgaaggattttagcaccattgcagccccattacatgagcttaccaagagaaatgtcacattcacttgggctgcagcacaaaggaatgcattcgacactttgaaagataagttaacacacgctcctttactccaacttcctgatttcaacaaaacttttgagcttgaatgtgatgctagtgggattggattgggtggtgtgttgttacaagaaggcaaacctatagaatatttcagcgagaaattgagtgggcctagtttgaattattctacttatgataaggaattgtttgctctagtgcgaacattggaaacatggcagcattatttatggcccaaagaatttgttatacactctgatcatgaatctttgaaacacattcgaagtcaagcaaaacttaaccgtaggcatgctaaatgggttgaatttattgaatcttttccatatgtcatcaaacataagaagggaaaagaaaatgtcattgctgatgctttgtctagacgttacgcaatgctatcccaacttgacttcaaaatttttggcttaaaaacaataaaagagcaatatgcgcacgatgatgattttaaagatgtgttgtttgaattgcaaagagggaaggacttggaacaaattcgttctcaccaatgggtttgtgtttaaaagctaataagttatgcattccagctagctccgtgcgtatgctattattgcaggaagcgcatggtggagggttgatgggacactttggtgtgaagaagacggaggatatccttgctgatcatttcttttggcctaagatgaggagagacgtggagaggttcgttgctcgctgcacaacatgccaaaaagctaagttacgccttaaccctcatggtttgtatatgcctttgcctgttcctagtgtgccttgggaggatatttctatggactttgttttagggctgcctagaacaaagaaggggagggacagtatctttgttgttgtagatagattttctaagatggcgcatttcataccttgtcataagagtgatgatgctacacatgttgctgatttgttctttcgtgagattgttcgcttgcatggagtgccaaacaccatagtttctgatcgcgatacaaaattccttagtcatttttggagaaccttgtgggctaagttggggactaaacttttattttctactacatgtcatccccaaactgatggacaaactgaggtggtgaatagaacattatctacaatgcttagggctgttttgaaaaagaatattaaaatgtgggaagaatgtttgcctcatgttgagtttgcttataatcgttcacaacattctactactaagaagtgcccttttgagattgtttatggccttctaccccgtgctccaattgatcttttgcccctcccaacttcagagagagtgaactttgatgcaaaatatcacgctgaattgatgttaaaactgcatgagaccactaaggagaacatagagcgcatgaatataaagtataaacttgctgggagcaaaggaaagaaacatgttgcttttgaacctggtgatttggtttggttgcatttgagaaaggataggttccctaatttgagaaaatctaagttgctacctagagctgatggtcctttcaaagtgctacaaaagattaatgacaatacatacaagcttgagctacctgccgattttggggttagccccacgtttaacattgcagatttaaagccatatttgggagaagaagatgagttagagtcgaggacgactcaaatgcaagaaggggaggatgatgaggacatcccttccaacgatacaaccacgcctattgcacagcaaggaccaatgactagagctcgagctcgtgaacttaattatcaggtaaagtcattcctagctaatcatacaagttcttctcagaattgggtgctactaaatggttgttgtgatctacttgttgttaggaatatgggagaggaaccaaatcgcaagcagcactagcagcgctgatttgatgaagtcaatgctcttcactccggagggcaaacggggcaaatgagtacttgttggaaagatctcgtcgtctactttcagctatgtgtggcctcaccatcaagtttgacccaggctgctcagaatgacgaaaatagttctttacatcagaaacttgggcttgggccttgtatcattacagcccattaggggtccacaaaacctagggtttgctcccacctcctctcctggtcattcctccacctatataaactcctagcagccaccattttgcactttgggttttgttttgatgtaagtttagctgcagctacttccttgtactcgcgtgtgtcggctagaccacccggatacttgtattcagaaccccattttggtttgtttaagtttcatcatttgacaagtgccgtgagctgtttccttgtcaacttgttcttgcttgttcttcgattgcttgcaggttcaaggttgttcttggcacggcaagaacagcaacaacgtggagtcggtgtaccggttgctaaggcgcagcacccctgtggcagttgtagtcggaccgccaacgtcgtatccttccccaaatcaaagtttatcctcctctcatcgaacgatcaggaacccccgttgctgcatcagtttgtcgagcaggcataatagaagcagtttgtatgtgttctacttcttactctctccattctcgagaacttgcatatcgaactccattatagtctgacaaatttacttgattgtaatggaaaatgaactagtataatcagttcaaatcccgtagagaatggaaaagttcacatgtttgaagcaagtcaaatttactccgaaatttcaacgaaattccaataatccaaaatacactggtattaactactcataccctccaaaagcccaaatttgtggttaagtacaatttctaaatttctatattcaatatatctaaagaatatcactataaatgtccaaaaaaaaatattagcatcatatctacataaataaatactagggcgaaagggcctgtagcccagtggttacaacagcctcactgcctcagtagcacttgaggtcctgggttcgactccccatgggagcgaattttttaggatttaacaacgttgtgctttcagtggtaggcggcgtacccatggacagcgaggcgcctgtggtgacttcgtcaatctctccaggatttgccggcccagtcttcgaagatactcatagaggtagggtttacgtgcgtgtgttcataggggtgagtgcgcgtgcgttgtgagtgtttgtattgtactgtgcaattcttaaaaaaaatactaggataagtattctctagtttctactctctactgacagccaataaattaatttccctcaatccggtatgttggtcacagataggaaaagtatcaaagcttagtgaactagtagtagctggattcagatctctgatagtctgacaaacgacaactaattaaaattactacttttttctataatggaaatgattttaatctccgacctctaccataagacacataagatgatggggcagaccttcaactttctataaataagttcaacctaaaaatactttccaaaatcaataaattctagcacgtcactccgtaagtactacaccatctaaaataaaacaaaagactcttagctatggatgccaagagttacttcgcaaaaaaaaaaaaacaattactactaagatttggcagccaagccgtgtgacctcacctgcggacacaacacagaaaaagccaatcaatcaacggctacttgtatgtaatctccacgcattccaatggcggctgcctcccacaattcggtggtcactcgtcagtcgtgtcgtctgctcacgctcgccaagaaagattggccatggagaagccggcggcgagcgtggaggagccgctgcttgttggcgctggcgagaagaagggcgagagcgcggccgcggcggagctgaagcggctgctccggctggcggggccgctggtggcgagcggcgtgctgcggaacgtggtgcagatggtgtccgtcatgttcgtcggccacctcggcgagctccccctcgccggcgcctccctcgccacctccctcgccaacgtcaccggcttcagcctgctcgtaagcatcggtcgaacaccttgcgcgcacgcaaagaactgcttgatccctgtcgatttattggtcggatttgtgaatgctttcttggttggtcgatttcgatcgtcagttcggcatggcgagcgcgctggacacgctgtgcgggcaggcgtacggcgcgcgccagcaccacctcctcggcgtctacaagcagcgcgccatgctggtgctcgccgtggccgccgtgcccatcgcgctcgtctgggccagcgccggcgagatcctcctcctgttcggccaggacccggccatcgccgccgaggccggcgcgtacgcgcggtggctgatcccgtcgctcgtcccgttcgtgccgctggtgtgccacatccggttcctgcaggcgcagagcgccgtgctgccggtgatggcgagctgcggcgtcacggcggcgagccacgtggccgtgtgctgggcgctggtgcgcaaggccggcatgggcagcaggggcgccgcgctggcgaacgccgtctcctatggcgtcaacctcaccataatgtctctctatgtcaggctgtcgcgctcctgcgagaagacatggactggcttctccatggaggccttcagggagctccgccagtatgcggagctcgccatccccgcggcaatgatggtctggtaaggacaacatcatgtacttcattagaaattttgtagtccttgagaaagcaacgggaggtaccatgattttacgctagaaattttggtacctcaagatgcttagtatctagatgtactaaattttacactagaaaatgtggtacgacacattttcaaggatggtaaaatttgcagagatcgaaaactgcttacattgtctaaaattatatttatagcttgactaatgttggattaatttcttgattacgcagtttggagtggtggtcatttgaatttcttgtgatgctctctggtcttctgcccaatcctaaacttgaaacctcagtgttgtcgatatggtaatcaatcacaagattatgtctctgatacaaatttaataaattaacatgaatgaaacgaagtatgtttactaaattgtttgctggattctgcagtctcaacactggtgctctgctggtcatggttccaattggtctcagcacagctataaggtcttgagattctgcaataaaatgttcagatatgatactctgctattttgatccttttttctgcttagagtctggctgatttctttcttttctactgcctagcacgcgtgtttggaacgaactaggtgccggcaatccccaggcagcgaagctggcaactcgagtggtcatatgtatggccatgaccgaaggctcggtggttgcgtttacgatgattctgttgcgcaattcctggggtcacatgtacagtgatgaggctgaagttgtcacctacattgctcgtatgatacctgttctagccatatcattcttcattgatgggatgcacagcgctctttcaggtaaaaacctcctgcatggatgatgtcagtgacactgccacattataagcatgtaaatgaagttacctgatgcataagtcaggaacagaatgatcagaagatcattgtctgaatatttttcaggagtgctcactggatgtggcaagcagaagatcggcgcacgggtaaatcttggcgcattttacttggcaggcattcctatggccgtctttcttgcatttgtgctacatctgaatggaatggtactgctatttgtctgaatattccctttcgttttttaaaaaatagctgcagattcacatctagcacttcgcacatgtttcagtataaacaacatggatgtatctctgaaagactgaaaattttgtgctttcattagggcctttggcttggcatcgtttgcgggagcctcagcaagcttatcttgctcttttggatcacaatgagtataaactgggagaaggaagtaagttatctgaggatgcctaccattttatatcagggtagctaccaattttcctttcattgtaaaatgtgtcatatgctcatgtttgcaatttcatttcagtcaaccagggcgaaagaattggtgttcagttcatctcttcctgtagcatgaagaaaaacaatgcatcagaatttcatgatatggtgcaattgttattgtgaaagcaacacagaaccaaatgttatgaagctcgcctttcatctttaagcacccagtttattaacatttgtaacatgaatttttgttcttgtgataacacctatttaatattttttttcttgttcagattgtactctgtaaactaaggatatatcttatatgcatcgattaattgaaaatctaagaagcatattataggaaattaaacggttctaccagttctacataaaacggtgtgtgagctataatcactctgatcttatcttagtcgtctgttcaaaggtactagtaggtctctactagcctccaagatataccccctcattctctaaatgtttaatgccgttgacttttttaaacgtgtttgaccgttcgtcttattcaaaaacttttgtgaaatatgtaaaactatatgtatacataaaagtatatttaacaataaatcaaatgataggaaaagaattaataattacttaaattttttaaataagatgaatggtcaaactttttaaaaaagtcaacggcgtcaaacattttgggatggatggagtactaacgtttggttgcaatgtctgtgtacacgaaaattttcattgcatggactaactctgcagaaatttgcaaacaatgacgaagcattttggaaccttcgctaactttttctgaagaaatattgaaaatccataggacattctatgaaatttcgaatcatgctgaaaccttcataggagccatgagtgtaaaatattatcagagcacaaaggttgtgataagtccttgtttgtcagatttatcaacctggtgcttcatctcttctgatcgtattacactgactgattgagaagtggtcagatttgtttgaaaatttgaaacaaaaacagtggacgcaaagtgacttttgaaacattgcgtgccggatcatgtacagtacttccatgataagacggtgtatcagaaggcatgaaactacttctgtacctattacagatctgcaatgtagctgtgcattttccagttcagattttgtacaactccctctgaaaaatatagcgtgaatgttattttgaaaaagtattgagcaaacaatcaatttctgcagaacaaacattgtatgaaagccatttgaaatatgaatatgttgatgtaacttacacacactaaatatatttgtagtttaagtaattgatggtcaaatgatcttataaagttgaccttttcagaacactagcatgcactattaattggctcaacattttctttaaagcataatggtaatctttatttaacttagcctattacatcaaggtgagaatatttctgatctctgcataactaaaacacacaccgatattaattggtcaatataaaagaacactgtctgggacgacgctctacaagtgccgagcaaggccacctgagcttctcacacctccatggatgccacaggattctacaaaatgcaaattccacaaaacattctaccaagcatagcagcatacatacaaaaaacattttttaaagtgcaattacgtagcatcgatttaacttgttgtgtgctcaagtcaatgcacacatcaaaagacgcgctgtttacaggtcatacttcttgggagttgggaaattaacatgagcatttggacacatctgtcttggctatttctgcagctgtgatgatccataagcacaaataatagtcgaatacctcttcttgcaaacatttccctgcaaataaaaataaccttccatgaccaccagtaaaaaactattctcactagttattcggcacagttaaaactcaactgtaaaatcatcggtgttgcacaaagtgtaggaatccctcactcacacaaagtgaagtccaaactgtcttaaacttgctgcaccgtgtttatccaaaactctacctgttgtctgtttccttgaccatcgtcatgcctgacgtcctcttatatacacggtaataattgaagacatatgagtgttgctgacaaatacatggattgatgatactatcaccatcgaaaaggttcaagcgtattacttttcttcacccatcccgcaggtaacgaagaccacgaaactgaacccatgcaatcttcgctgcaaaataaaaaatacaatctccttatttaagtctcggaggtatggaaactataaatatgataatctcatttagaaaacaagaaaatgaaatattccaacttttggttgaaaaaagagtattatatatgagagcaattttatggtccttgaggaggtactatgaggtaccactttttctattgtaaaattggtacctcttgatacttaggtactatatgaggtaaaaaaaatagtgtaaaatttggtacctaatgatacctcctcaaggaccgtaaaattactctatatataaagcatgcacggatggggtccactatatatctcggtgacaatgagttgatggtgatgtggtttaaagtgttacatatgatcctttcacctgactttgaccatcggacaattacaattagacaataatttttttatgtaaatatgtaggagagtgtgtatatattgatataataaataatttatggagttacatatgtacaatgaagttgctttagatagttccagcatcgaagtgcattcaaactacttgctatagtgaacggcaaagctcttgccttatccctcaaaaatgatattctggtgaccggtattaacatccgaagaattcactaggtatgtgtgaataatgaaagattctcaggccccagagtcaactagctctgatgtacccatacgtcagaaccgcttactcttatgcccaccagtgatgggctgaagagctcgtcacggatggcctcacctttatgggtccattgcagcccgtaacagataggcatccggtcacggcttgtcataggtggtcacctatgcgggctgaatctgacacccgttaaagtgatacctctatcggatgctagttccagcccgtcaaaggtaaacacgtacctgtgatgggccataaagatatagcccgtcagagatggccttcactcatctcaaacgggctctagccctaactcgtttgaggtgagttgcggcctatttatacccccaacctaccaaccactttccatcccaacccagtatactgttcatttttcgggtaggagagcaagggg

SEQ ID NO: 12048 - DNA, 322 bp, Oryza sativa
tggtcaacaaaagttctacataacttcttgagttgttgaaggacttattgccagaggggaacaaaatcctgtagatgacatatgaagcaaagcaagtcctatgcccattgggtctggaggtcagaagacttcatgcttgtcggaacaactgcatattgtattacaaacagtatgccgacttggatgcttgccctatttgtgaggcttctagatataagtgagacttaagtgaaggtgaaggtcgtaagtcaaataggggtggctccgcaaaggtggtgtggtatcttccaattgccgagcgcatgaacataatgtttgcaaa

SEQ ID NO: 12049 - DNA, 785 bp, Oryza sativa
catcagatctccgctacaaacaccaaatcgaaatcatagatccagaaaatacctacagaacaaacacaatacaaatcaaaactctaaaaaggaggagaaaatacaacccaacaaaaatcaacaagagcaccaggagcacgtaggcatcaaagcaggaacagtcaccggagcaaggaaacggcatttcgccggcgagacggcgtcgacagccaaaatccccacctcgttgcctccaccttggcgaggagaaaaggtaagcttcctctctcctttctgtatctctctcttctctccctcactctctcgaagcaacgagaaaaccaaagcagggttggctttcaaaatgaacagtgtaagtgggtcccacgtaagcccaagcaaaagcccaatccaaccaagaaacccaaacgaaaactagctaagcctgatccagcattgcactaatctcaaagaaatatcaacggcctagaaaacgaatgatttagccatcttttttctgtcgacagccatatagcggtttttattttttgttctaccgaaaaatatttcacctagtgtactcacaatgtttcactatgtatagatctaatgttgcagtgaactgaaatattccattgcaacaaaaaacccacatattttggaaaccccttattaagggaattcattttattttttgttcccccgaaaaatgtttacctagtgtacttataatgtttcactatgtatggatgaaatgttgcagtgaactgaacattctttcactatttactgaaacattgtttttt

SEQ ID NO: 12050 - DNA, 1884 bp, Oryza sativa
aatgctgttgtccaactcatcgaaactgagctgattggttgataactctaaactcccagacatgtagatagaatctcaaacttgatacttgaaaattttggagtagattgtggcagcgtggagaagccaaaattgccggtgaaatcattggagctgctgaagtagaacacttgctctgaagcgaagacaaaacttataactcccgaagtagattccatagaactcgttggctgatttcagagtcttgtatttgtgtagcccccgactctttggttagttggaaaacaactgaacatagagtcgagaactgtagcttcttgtcgtcgagtagtcattgcaatcaaaagtgaagatgcatgttgaagatgtccgagtaaaaatattgaagatttgaacaccacttgttataataacatgacatcatatttagtgacgcatgccaaaatgtcgaggctcatgtagacgtcgtggttggtgaagtagcaaaactcgcgaagtagcagcaatagagtttgccggtgccgaagataataaagatgaagtcactccaccatgatgacaaagttgcatagtcgtgatgaagtgaacatgagtcggcggcaacataaccagtcggcgatggaataagtagaatgatgacgaaaacgaagacgtccttgaacggcagcaaaataggccagccatgaaagtgaagacaccatgggcggcggcaaaggcaatccgatgatgatgatgatgccagtcaatgttgacgaaaacacgtagccatagaggcgaacaagccagtcggcgtcagacaaggcggccagcaatgaagacgatgacgtccatcaatagtggtagcggtatataccagccgtagaggcgagggcactagtcagcagcagacgaaacgaccggcggcgaagatgataaggccaatcaacagtattagaatcctgcagccatgaaagtgaagaaaccagtcgtagacatagacaacttgagttgaaggtgatgacgcatatttgtggtggcggcgacgtggccagccatgaagacgatagcatcaattagcgtcatacgaagcggccggtcggtgaagatgtaggcgtcaacgacggcagcataataggccagccgtgtaggcggagacaccagtcggcggcggcgaaggcggctggtttgtgaaggtgtatacgcccaacaacggcggcataataggccagccgtgcaggcggaaacaccagtcggcggcggacgaggcgaccgatcggtgaagacgtagacgcccaacaacggcggcataataggccagccgtgcaggcggaaacaccagtcggcggcggacgaggcggccggtcggtgaagacgtagacgcccaacaacagcggcataataggccagccgtgcaggcggtgatagcagtcggcggcggcgaaagcacgctggccagacgctcaacaacggtggtgtgaccaaccaaccgtataggcgaaaacaccagtcggcggcgacgaaggtaagccggttggtgaagacgtagacgcccaacaacggcggcataataggccagccgtgcaggcgaagacagtcagcggcggcgaagacaagccagtggtgatattctgactgatccattcctgaatcgtaggagataagtttaaagctatgaaccccttttatgcatatctggatctggatcttacagaacaaacatataagatgagtagtatctgatgtaaatataatactcgaggaaaattcaagtattttaaaatgtttataatatgtatttctcttcttgtcaattttgatttccccgagcagatgactccgtacgtttaaacactctgcctaactagtcatagcccccaagcatcgagagtcggccaaggcactttc

SEQ ID NO: 12051 - DNA, 4016 bp, Oryza sativa
  unsure (1)..(4016): unsure at all n locations
gagggaaacactccgtagggccaaaaacacaccgcaacacacaaaaaacactccgtaatcaggttactcagtgccacactccgcaattttcaccagggagtgatgttgtcttcccgtgcatcgtagcggtgtgtttttatgcatacactccgtaaccatccgaaagttacgtagtgccgtagaaactcggtaaccttttcagcacaccgtccaccggaactgaacagcaacaaggaacgggagacggagcgtttgcacatgatagcacacgttaactttacagggtgtgcgcaaacacaccgtaagttttccctggttacgggtgcagattagtggcactctgtaacattttaggttgttaccgggtgcctcagcattttgatatttgaggggcaaattaataggaatatacagcttcatttctattaattatctatagcagaattccagcatccatacacatcacatgcagttacacataaaacacaataatggatttaaatgcatttgacatgcatgttcattcaattaatcaatatgacaacaatctgatatgaaataataacaatacaaatctcagaaacagctacaactgagatgaaattgagcactatcttcaaccagtataagcatgggcaaccaaaaggccgtgcaaccagaaaaaaagcttagacgaacagcattgccggcagtctggaaaaagaaaaggacttaataaccatcaatcattgtctgtttttcatcctgggatagcttcatcactctaaaatggatgccactatcgccatcagccatgatgtaaccccagcttttaccattagctatagtgtgcttcctagttttccatgaaattgccaattgcttagctcaactaatgaagtccatatgactgcagcatcaggaggtgaaggatctgatgattcacaaaacaaattcaacatcaaaatcccatacatcaatactatgttctgatattaagaaagaagtatacattgttacttagttctggtatgtctttctagtgcttacctttgccaggagcctagaactaaagcagtgtaggtcacattaattgttccaaaggtacaaattagttcttacaaagacacccaatagtattcatgctaaagagagcaattagacatagcctagatagatgaatttactaagacaaccagagagtaacttcaaaaaatttcagaaaacctcggcttgaaccagtgaaatgctaatgatctagtgctaactagctatatgtaaacaaataacataaacactacctttacaaaaatcttaggtattgttcaatgaagaattgtactatgcaaactactatttgtaatggtattgacgaactgtaatatcggaaacattagtgtaagcacatcaccaattatgatttctaacctggaaaaaaatgtaaagggacgaagagattacacttaaatcgttcctgcaacatcattgtcagaagtaattgtgatatgacctccattacatcctatcagaatttccttacctgcatatattttaaacaaaaggttagtacacttgtgaacttataattctgatcagcaactgcagataatttatggattggttgcaccatgtatgctacctatcatattgcagtcctctgagactcggatgtcttcacgaccaatggttgatgtctacacaaagaagaaaaatataatataccaaatcgactttagaattggatcgatgttgttccaggttgtctaaaatatctgtaaggatccttgcatatcttgatgtagctgctcagtcagtagtaaagcttagaagcataactttaatactgatatacatacacccagccctacaggccaaagatgcaagacttcaattactgagatacatacacaaaggcctagggcaaaaatatggtatttgattacagaaagacatgagctgaagcataagcaagcatcctctaggaaaaaaagattcttgtggaaccaatgcagacaaaatctgtcattagaatcaccactgaagaagcgaattttaaaatactaaatcccgctacaaacatcactaagcaaaaatcatgtgcatctacattctacaattttattattctctattttcagaatatgcactgcatcacgaactaatcagccactaaatctcacatcacatccattcactgtcatcagatctgaacaaacacaagatttggcctctacctccaccccacaagactacatcccctttgccccatcagcaaagaacagccaggagcccatcccaacccctctccccatccccttagcccctatcagcaagatgcaaaagaagaagaggaaacattaggagaggggaagaggaaggaggggaggggcaagacgacctcgtactgttgcttccttgaggctgtaccgcttgtgactgccgttgcagctgccgcagagcacgtagcgctcgccaccgcaccggctgcaggcggcgagggcggttgcgccggcgccggctacaacgcgtcggagctcgccggactcgtggaggcggcggacctcctcggcgccgccgaggtggcggccgccgacgaacacctgagggagggtgacaccgcgcgcgcgggggaggagcgcgccgagctcctggaggtagcgggggtccatggcgaggaggggtcgacggctgtcaacggagaggagaggagaggatagaaggggaagattaggttggtcaaagtgaaagtgaaaatatcaggaggggagagagaagaggagatgagatgaaaacatttgaagccaggaggaaggaaaaaaatattaattttaaaatattaaaatttcgaatcgaattttattatactaaatgaactcatgtgtaaaagttgtcaaaaataaagttgtagaactcgttgaaatctaccatttttcttttggtcatttttccatccgactttgattaaactatataaaatttaaattttaaaatataagaaattcaaataatttttcgagtagtaaatgattttaaatgaaaaaaattgtcaacatcaaaattgtaaaacacatcaatatctacaacttttgttttggttatttttctatatgactttgtttcaatagtttgaatttgaatttcaaattatgacaacttcaaacaacgttttcaaatagtaaatgatttcaactgaaaaggtcatcaacaataaagtggtataactcatcaagatctgtgacttttattttgatcatttcttcatccgataaagcgatttgtaacattgttcataaaatgtacatatctcttatatagttttataaactatcagagagatatgtaaattttttgaaaaatgttactatcactttgtcggatgaagaaataacaaaaataaaagttatagatcttaatgagttatataattttgttgttgatgactttttcagctgaaatcatttactgcttcaaaatattatttgaagtttagaaattcaaatttttaattaataaaacaaagtcacaagaaaaaaaaagccaaaaaaataatagcagtaagaatataataacatgatagaacatgattttagaaacatttagaaaaaagaatcatccaatttggagtttatatgagtgagataaattgagaaaatatgtagtgcaaaccacatatacagtggaaacttggaaactaccgttggatcgagaaatggacgtccgagattcgtccacatcaccatgagttaaaattcaactcccggtaaaattttaactcatgagtgaatctgcgagttaaattttaacttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12052 - DNA, 1595 bp, Oryza sativa
tgtgtgtggctggatcaataacgataaagacgggcggaaaaattgacggaagtgctaaaaatggaaatagggtgaactttggatgctattaaagtgaaccggtaactttcggtgctataaaacgaaaaagtgaactttcgatgctatataaccaattttgcctttttataaccctccagctaaacatgtggcccccaccactatctgctccgttatactacgttacggttaccgtgtgtgttatgcaatagttcaccgtaagtatcaggtgccgtcatattttctgctattgttctgttcccgcccaaggttttcgttcccgcgccattcccgcaacagaaaatgcatgtgcgccaaaaggaacagccgtgcgcgccaacgaaatatgtcggtgctgaaggatgcggggcccacgttccctggtgtaataatattatagcactctgtattttccctgtgttccccagtgtttggactgaacgctacgtgatagaacttgttgcgtagtgtttctctaatccacccggtaatttacagagtgctaaatgaaacactacgtaactttttgctcacactcgggagtgtctcccgtcctggtagtgactactcgggtacttttgcaattcttaagagcagaaaataaattatcttatctctatgtttttgacttttcccaagtaatacttagcaccttgcgttactcggtctatccaacgagcctccaggtgctaggaatcggcctaaaggcaattatccatcgacaaaccaaacggaaagcataggaagatagaactccataactcgataggcacttttgtactcaaattatatcacaagcaatcaagataaatattatgaaaattgttgaaaatataatataacatctgtagcccccaactcactagtcaacggcgaaccaattgatgtagtgaggcaaaggaaaaggaaaatatcatctaaagaaaattaacgatgacttagctttataatattccccttggtgatggcagaggtggccaatgtaggaacaaagtcatccatcaatggcaatgaaaacaccagccatagaagcagcttgaggcgactgatgatgaaaacgaagacgcccatcaacagcggcaaagtccgccaactgtataggcagaaacaccagtcggcggcaatgaaggcgagccggcggtgaagatgtagacgcccaacaatggtggtgtgaccaaataaccgtataagcaaggacaccagtcggcggcgacggaggcaggccggcggtgaagacgtggatgcccatggacggtggtgtgaccaaccaaccgtataggcgaggacaccagtcggcggcgacggaggcaggccggcggtgaagtagtagacgcccaacaacggcggcataataggccagccgtgtaggcggagacaccagtcgacggcggtgaaggcaagccggttggtgaagacgtggatgcccataaacggtggtgtgaccaaccaaccgtataggcgaggacaccagttggcggcgacggaggcaggccggcagtgaagtagtagatgaacaacaacggcaggcataataggccagccgcgtaggcggagac

SEQ ID NO: 12053 - DNA, 6635 bp, Oryza sativa
catatacatatatataaatatatataacagctgtatgtgcatatataaaaagattgatctctgctttgccatgagtgtatataaagcttctccctgttgcttgatgtgcttcaagtcagcatgtgttccttctggaggctcgccagtgtccatcaataggcaccacatgccatcggctcggttggcatttagggtcacacaagcacgagaaaagtttcgtcgcttgaggacacgccagaaaacttcgcctccctctcagccgaccaacccatgaacacaagaaaataccagaaagttattctggaattaaaaatcaatctaaaaataataatagattgaaacaacaaacctggtgatatcgaaaattggttccatcgcacttgttgacgggaaactcgacgcacccctacctggcgtgccaactgtcgaaacatgaattcggcaataataaaagcgggtagcgcacgagacctaaaagtggatggatgcggagacaaggatttagacaggttcaggccctctcaatgggaggtaatatcctactcctgtttggggatttgaatccaccgggtgtagtatagatctgatgatcaggtgtgtcatgccccctagagggcctcctgcccaccttatataggatggggagcaggattataagatagaaaccttaaccaatacggtatcggtttcctaaatctattttacaatattatcaaatcaggactttaggccgctccataatataaaaggaaacgtaatacccaagtcatgatctgttacatattccatagatataagttatcccctatgactagtcggataaccatgccgtgtgggtatggggtacccataatctccacaccacctgttagtgaccacgtcgggggaagttcatgtcagaggatctgcttccgtgggattgctaggagggttggcgagtagatgatctgcggttctggttgatctcctgttaatcttctcgtataaatggcaagatggacaataaactgaacggccgaacttttgagccgccaccgcaggagtgcaggacgactgatggtttggcaaaagtgatggaattgccaccacatctgtgcgctgtgttttgcattttgctgggatgtgctccctccctggggcagtttggactccttatctgcttttagtttctttattagccttctgaactatgtagtgaacctgtggtagtttgcatttcgttaatgaaatgggggagcaatgctctctttctcaaaaaaaaaaaagaaaatctaccaactcactttgctatgtcaatcgatccactgtgttctgataatttaagagatacttcgatggatttccattgatatgctgatacttaatatctagttaggtcaagctgtcaactgttgaatgctgggtacggctagaacgaccaatgtacgctgatgttttctagtggcacatgcagcctacatgtggtatacacaggttgtgtttagtttctgaaatcggagagaagtttggggaaagttggtagtttggaaaaaaagttgagagtttatgtgagtagaaaagttttagatgtgatgtgatgtgatggaaagttgggagtttggggaaagtttggtgtgaactaaacagggccacagtgaatttaatcattgacaccctccgctgtcgcgcctgtcgatcctccgctgctcggccacactccggtgcccatcaatccttcggtatggtactgcacccattggggctacacagcagcgcccatcgatcctccgccgcgtgtcctctcgcttgttggcgcccgatgaccccccccatcgccacctgtcaagcttcacctctttgccgattcatcaccgtgcgcctgttagattgtagttgatggctgccaccaagctttaatttgcatctgtttcatatccaaaaaagaggagctcgccggtgctatgggccgccgtctgctacacaaagacaccactggaaaaagcattttcgctgatgttgggtatttttttcgcagacgggtatgacaatcagagtaaaatccccaccagcgaaaatgagtaccggggaggagttggccgttcgccaacgaagatagattattgcaagcggaccacataagggagccgcatgcaaaaatcatctttgcaggcggcacacatatggacccgccggcaatattcacatgcaggcgggctccttaggcggcgccttatgtggtccgcctgcaaaaatagccctataaagtcttcttcttccttgagccttgttcatttcattcgaggtttctttctcctctaacaccaaaaatatatgggagaaggttttgaagttcaaatcttcgggggatttttctatggtagttagatctacacctttccactcttgttatgcattttcttttaataatttcagacctctctttgtgatggatctatgcatgcaaaattgtgaagaaaagctcaacgcttttttcttttcattttttgttactttcctttgatatgtttgtgcttgatgtgtgtacactacttgatgtctcatcctctagtgatttaatgtgctaatataaagtcccaaaattttttattttgccctcacatccatcttctagatttagataggagagagaacaaaaatgtccatctcttaatatggtccatgttaaaaatggattttgctcccatctattccctcttctttcatgtacattttcccacttttgttggactttcctattatattaatttggtatgtctctatataccaaaaataaatataatttgtccatgaaaaatatataataattattaatagttctctatcatttttagtgaaatgaaatttggtatggctatgtaaaaaattaaatgtactatgttttcaaatatttgttgttcattttttgtaatatagcttgtacatgaaatttttgtagatatatggataggaaccaatggatatatcattcgttgaggtttttggctccatatatggattaagtgtctaaatttattggtattgccaaggaacacgctgagcagggcaatatggcggggattctttgtccatgtgttgattgtatgaatgaaaaagcgtgggaagatgttgcaaaagtaacggagcacttagtaacttgtggatttatagaaaagtacgaaatatggacacatcatggcgaacatcaagtggatcggcccgaaaaaagaagttccgccagaagttgaagacatggagtacgccgatggttgtggtgaagacaaaatcgatttggaggaaatgttacgtcatgcagatcctgaggtgctcattgggtcggctagaggtttagataattttgatgctttatagaaggcagcgaaggatgttttgtacgatgagataaagggctgtgacagtgagttctcaacattacggtcagttcttgaacttatgaggttaaaggtgagatatggatggtctgatagtagtttcgacggtctgcttgaactattgaagaaaatgattccgaggtctaactcattaccatccaacacatatcaagcgaagaaacacatatgtcccctttcacttggtgtggaaaagattcatgcatgcgtaaatcactacatactctacaggaaagagtatgcttcattggataaatgcccaacatgtggtgctagccggtacacatcaaataccaatacttgtctagaagagtctgacacatttgagggaactaagagaaaaatcctgcagcttgtgatgtggtatcttcttgtcaaaggctgcattaaacggttgttctcaaatccgcaagatgcggaactaatgcgctggcatcaagaagggcacaagaaagatgggatgctctgacacccggtgaatgctcgtcagtggatgcatctagaaaagaatgtgtttgacaacgtaattggaacattgttggacatagcaaagaagactaaggatggtctgcaagcgtagcttgacctagtcgagatgggaattagggaagagttacaccctcaagaaggagagaagaatggcaaagtatatcttccaccaacttgtttcacactaacacccgaggagaaaaaggcattttgcaaatcactccacgatgtgaaagtgcccataggtttctcatcaaacatcagtcgactagtctccatgaaagatttgttggtatctggttataattcgcatgtttgtcatgtcttgctcaccgtgtttcttgccattgcaatacaggacataaaaccagaacatttaaaggttgctatcgcaaggttgtgctactttttcaatgcagtctcatagaaggtcatcagttaggaagagttatcacttcttcgtacattcgcacatgagacacagtgccaacttgagatatgtttccctctagcattttttgatacgatggagcacctcatcgttcacatagtgccccagataattgcgcttggcccgttgtacctccatcaaatgtggtcatatgagcgttacatggctattttgaagggctacgtccggaattgcacccatccaaagggatcaatggttgagagttacaatacagaagaggttgtcgagtgctttatcgattacctcaacaatggaaagacaattggaatacatgtacctcgacacgagggtgaattgactggtagggggaccaaaggaaagaagagattcgtcgcccatgattacaaaacacttcgagaagctcacttcagcgttcttcatcagcttgctattgttgagccttacatcgatcaaaacatcaaactactaagatctaacaatacgggacgcacaaccaagtggatcatgaaagaacacaagcgtctcttcatagaatggagaaccaccgaggaaataactatgaaaaggttggcatgtggtccatcaagtatagtcaattattgggagggatatgacattaatggatacacgtttagtacaagagctcgagatagtaagaccgtcactcaaaacagcggtgtacgtgtggaggaaattgattccctaggagaaaaactatcatacttgggtttattgaagaaatctgggaaattgactatggactcatagtgcaattccccatatttaagtgccagtgggtaaaatacccaaacggtgtcattagtgacaagtttggtcttactgttgttgaccttgagaatgtgggtcacaaggatgacccttgggtactcgccaatcgcatggcccaggtgttctatgtgacagaccctacaaatttgaagaaagaaatagttccatcaggaaaacaaaagatcttgggagtggacggagtcgttgatgtcgaagattacaaccagtacgatagtatggcactgtatactcaatttgtacaaaagattaagcttttggcggcatctactgagaagaccgtgaagccttacatacgcaaggatggtgtggggaaaaatgtgaaagagtaacgtttgtacatgtttgcaatgattactatgcctttaagtaattgtttggtatgtaatgatgatatgttttaattgacaaacaatttattatgtagtccaatttacattttttgaattcatttacattttatatatgttttttaaaatcaattacattttttaaaaataatttacatttatttaaaatcatttacattttttaaatgttttttaaaaccatttacattttatatatgttttataaaattaatcacattttttgaaatgattttatattttttaaaatcatttacatttatttaaaatcatttactttttttactgatttttaaaatcatttacttttttaaatcaattacattttttatatgctttttttagatgtttttaaacatcatttacatttttttttacaaatttttagtacttttccaacttcttattttccttctgaaatcatttttgccggcggggtgtccgcttgcaacaatgacaaaactgattatgttttatcatcttcatcggcgggctgcccgcctgcgaagatcgcgtgcctatataaggggtttatacaggttcaggccgctgagaagcgtaataccctactcctgtgcttagctgatcttgcaagagattataagatctccttgttggaatagaaggtgttgatgatgaggggcagaaggtgctctaggaaaaaaaaagggcttgtcccccctcgcagtaggcctggacctccttttatacctcaaggggttaccacatgggcccaaaaacctaacttaggggagatggattacaaactatgcattaaaatgcaagtcttgtttcttcacttggaaagccatacgcacgtcgtcttggtcatggggcccatcaaaccacgccgcctgacacggggggcgcccctgccagtcgccatctaatgggtgatgacttctgggatcccgttggcaccgggaaacaggagcctcgcattgactagagcggatgaaccgactccggccatgacacgatttgacgggatagggcaggctgcacgccgcctgacacacgtggtagtgtgcaggcacattaccctggtcccatcagtcattcgacctgtcactgatcggtcacagaccggtcaggcgcactgcatgccacattaaatgcagcgtggtgcgccgcttaggtcgccttaaatgc

SEQ ID NO: 12054 - DNA, 8960 bp, Oryza sativa
ggtggagacatgagcgccacccgtaacacaaaacctttgtgaaaaccaaaaacctaataaaacaaaatgattttgactggggcggcatgaatagaatatgggtggttctggaaacggcaagtcaccgaccctggttaattaaggaccgagtcaagaagctatgtaggaaacgaaccgagtacaaccacatttcttaaatgggtatagactcggcggactaagaaatccttgtggggcggcacctcagtcatggtaggttctggatgcttgatgattgtgatgaggaagtgttgtgatcagttaatgacatcaaaaacctaaaacgcaccctataagtatatatattatatatctccctgaacccgggaatgccaggactcccctcactgccggctcgaggtggtatgttttgttaggagtgcaatggggacccatagtccttggggcaggtgccacaatacgagggtgactgaaacaccgggtcgtgacgagtttcatgtgttgggattaggctcatatgttgggcaagtcacggagtgcgggattaaaagcgtacatccactgtagtgtgaggaaaactaatctattcgaatagtcgttgtcgtgattaaagagcatcgggacttacactactcttgactagcctcatagattgttaatcttgcttagattaggaaaagatgtgtgaccttgcccgatgagtgggaaggatgtagtgaaggagaatgtgggaaaaactggttgcgagggtaaaccggaccaagcgaggattggggaaggtggatgaaccctcatggattaacgacaacttcaacaataatgttgttttcagttaaaactgctaagtcataggtttgtgaaatgatttgtgaaatctagctttatgcaaacgaaccaaggcatccttgaaatatccctgtgagcactatatgcattatgtagtggtggcttgctgagtacggttggtattcacccttgcttaattaaatattttagaaggagaagttggagccgatttgtacgtgtgccatgctgatgaagagatgtcgaatacggtggagtagggacctaggttcaccagtcgctgcctgtggaataagatggaccgtcgctgcttcgcttccgctaccgtatctacttcattggatatttggtcttatagatgacaatgcttggtctatttgggtgccactccagcaacccttgtattattaatgtattataaagcctgtataacgatatcggctttgtgatatacaacgttgccatgtgtataccatctactgatccagggaatggtattgtaatcacatgaggtttccagtgtacaaaaccgggggccgacacctcaccacagggtggataacttgttcatcatccagaatttctacaatggtgtaagcatggccatggtaaggctgtccatgtcggtgtggcccgtggccccccgtagtgcagcggagggtggtcttggtggtgcccgagccgacgtcgaatgtgtgcgtgcagcagtcggcctcgatgaggtggacggtggcaagatcctcctcggtggtgtgcaggtagcgcaacacctctagggtgggcatgtagcagaagtagcagatcaagaaccccacaagggctttcagcaaccgccgacgccatcacgttagccgcaggcgggaggcggctgacgacgttggtgacaatgttggatacgggatccaggggcccaaagtagaggttgctgtcgaggatggcgggtagcagcgctggcatctcatcgatggggaggcgcacgatagccgcagcgtagaacccatggatgagtcgtttcagcatcgatttgtcaccgcggtgtgcatacggagttgggccttgcctggtcctcctctcactcttccatgttgctgcacacatggcgcctatctttagctagctatggttgtctatctttcacctcctccgtcttcttacgtacatcgctggttgcgaaaattaatgatcgtccatgcaaaatcacctcctctggttgcttcatgcatttccctgcacaattattgtcccttcaccaccccccaccctccccggcaagcaaatatgtcggcagcaattttcctttttgttcttttttttatgaattcggtcaaagttttttcatatttagttacattttgttaaaaaaatcaaataactttgtgcaaaaagtgacaccaaaattccaaaatttcagtccaacaggaaatagaaaaccctggaaatgtattcactgattaagatccattcagtggatgtccctttgtatatattttctttatcaaattcagtcaaatgactgaatttttgattgatggtatagagtatagtgacatctctgactttacaattcagttatagttgtcgattaatagggaagtgatttcgaaatttttgagatgaacctcaattaagctattttgaggcaggaaattttttcgcgagcgagagagctaatagttctgttttatgctagataaccgcttgcaacacgctgacccttattaaagaaccacgttgaatacatcttcattggagaatactacaccaacatttctcgaattcttcatcgagttggaagacttgaactgaagaccctttcttttgccatgatagcctgaaaattggacaacgaaacacagttaactgaagttccactgaatacataatactaaccgaagtgtttgtagggtgaaggttttcgcacttcttttccccaatctgtacgcagtgtgatgaagaggagcatccctactttactgatactgccacacacaaggccaagccaaagaccctgttttatggaaacagctagcagtttcagtcatcatcatacaaaggtacaccaaaacatttctatgaatcaacaaaaaaacaatctgcactgcatatttttttcaaaagagattgagagagtagtgctacctctccattgagatggaggacaaatgcaagcagcacagccgtcggaataccaaccaagtaaaacgcagcaagattcacatgagcgccaatgttctgcttaccacatcctgtcaaaactcctgaaacatttggaggtccaagtaattttattactactgatcgacttaattgtatgaatcaatcagttcacccgaaaagctcgccgacaatgagaaaaaaaatgtacagctgaaatattttgatgattgatcacaagtagaaatatggtatggatttgtacctgaaagagcaccattgatgccatctatgaagaaggagaccgcaaggacggggagcatacttgcaatatatgccaccacttcctcctcgctgctataggcatttccccagacattgcgcagaaaaatcatggctatcactagcacgaggcatacaagcacggtcatggctatggcgactcgcgctgccatccttgctgctcgaggatgcccgccacctagttcgttcgagacgcgcgtgctgcgcaagtgcaaaattggtggaactaatcagttctaaatatctaatccaatgacatgtaaactgaaggaagaaagcatgcttgccatgtaaataaaataagggtaaactgaatttggtcaaaacttatttaaatttcatatattgtcgttcagaaattttcgggaatttccccccaaaaaaaaagaagaagcagaatagaaaatgttccaaacgaatttgcaaaccctgtaagagaacaacacagtagggcactgttctaaaagatgacacttgtatgaagaaatggattttagactttagagtcgaaacaaaccttaaagatgagccaatgccacgtggcaccatgaacaggagagaagaagtgctcaagctgcaaatcaaattggagttaacaaaatacccatgggaaggaggagagctgatttgtatctgtgttgcttgtgatcaaattaccagattgacagaacagaagtttcaagctgaggattcggcagaatgcccgagagcagcacaagtatctcaaacgaccaccactccaagctgcacacaaccaaatcaaccagttaatcaatcctcacataaaaaatttcccaaaatttgttcaagcaagctcgatttgctctctcgatcacaaaacatgttccaagatttgctcaagcaagcaagaaaccagcaatggtgtcaggactaagacgtgtcactgaccagaccatcatggcggacggcacggcgagctcggtgaaccggcggagctcgcggaaggcgtctatggagaacccggtccacgtcgtctcgcaggcgccggacagccgcacgtagagagcgaggacggcgaggttggtccagtacgtgacggcgccgctcagcgcggcgcccttgctccccatgccggccttgtgcaccagcgcccagcacacggcgacgtggccgaccgccgccacgccggagctcgccatcaccggcacgacgatgccctgcgcctgcaggaaccggagggcgcaggcgagcggcacgtaggccgcgagcgacgggatcatccaccgcgcgtacgcgccggcctcggcggcgatggccgggtcctgcccgaagaggaggaggatctcgccggcgctggcccagacgagcgcgatggggacggcggccgccgcgagcaccagcatggcgcgctgcgcgtagacgccgagcagccggtgctgccccgcgccgtacgcctgcccgcacagcgtgtccagcgcgctcgacatgccgaactgatcagatcatcccaccgagaaatcagtcacaaatttgaccaagaaatcggagagatgaagcagttcttgcatgcgagcaaggtgttcgacgacaggtgcgtacgagaaagctgaagccggtgacgttggcgagcgacgcggcgagggaggagccggcgagctggagctcgccgaggtggccgacgaacatgacggacaccatctggaccgagttccgcagcacgaagctggccatcagaggcccggcgagacgcagcaacctcttcacctccgccgcggccgccgccgccgtcgacgccatggcttcgtcctcgccatctccgccgcgtcggatggcgagcagtggctcctccacggttggctcgtccatgtcgatcgaatcaccaactgtgagacgtttcttgggctgatgctaggctgaaaatggtggattcgttgtccaacttatacggagcataataagttggtgtgttgacgagtttgtgacggtcaaatcggagaggtgtgattcattttaccctccacatgctgggcttccattatttaagagtaaattctatcacacttattatatggtccaagttatataaattataggaattttagcacgtgaaacataacctcgaatattatggttataaagtttcacaaaaccacgccgttaactattttagacatactccattactcctatatgaaaattttgaaaaacggaagtaacatttgcttgatcaaaatcaaaatggctaactgtttggttttctaaaactctagtgaacataatacttgagattacgtgccacaatatataatagacagggttttataaaatagtaaattttgtaacatcctaatacattattgttgactaagatggtacatataccgtagtcacgagtatcaacataatcaaaatggcaacaaatatagtgtcaaatcatcaaattttatgggcaataatggaacagtagctgcgaaggtttgtgtggggaaaatgtattccagtgtgtgtgcactggaaatcacgaaagaatattcaaaagagaaacaagctttagttggaaagaaataaaaaaagtaggattactttgtgaaggcacttctgaaaagtgaaaatgatggttttgaatgtaacttaatcattgtgtaataatactgaaaaccaaaaacttaatttagcaatgagcgggaaaatactggggacgtttcttgggctgatgtttgcaatctagggctgaagaaagtggattagttgttcaacttatagggagttaatttaatgttaatttaattaaagtggaatttggaatgtgtttggacggattcgattcgatcagtggaaggggcctctagcaactcactactgaaaattctttcgtttagttactcagttgacgtgttgacttgttttgtttgtaccgcccaattcttggatgccaaggcacaaatacctaatgtgatttgcatcctaattcattatttgtaggcgtcagtttaaaaagtaagacgtggtgttgtccggtccgagatcagtcagcaattttgactcggaagaaagatgactttctaaaacttgggatgcaagtctaaatctccaacaaaattgtaaggtttggaatgaaacaggacaaagctgaaagcaacccttttttacgacccacacggtataggaggaaaaagaatagaagattaccgtcctcgaaggctataatcaggaaaaagaaaaaaaaatcaccacgtgctagcgactccttagtccttacacaccccaagagaagcactagcaccaaattgaccgccggcgccgctatgcgagaccgatcaccgctaatcctacacagggttgcaaacgcccctccgagtagggctccaaaccaggagatcatcgatgggctcccgatcatcatcaggtagaaggcctgaggagggagagggcgagagagaagatctactcgtccctcacacaaacctgatgataatgactcgagagaacgccgattacccaaaggatcgaagctcatcaggcaaggaaacaaaacctcgtgaacgatgcctccaaggaggtcgttcgcttcctgttgatgaaaaaaacatgggggtctgggagttatgcttagctccagtgcagatccaaatctcgctttcgagttcaggacgtgccaattggtttgaccctacaacaaacaagaataaacaagaaaatcaagttaaattacgatagccggtcggcttatgagctgataacgtatcatgtaaacctagccgatgcaatttgtccgaattggttgtaaggtgtaggatgaataaaataagacaaatctaaaatatgttccatcggctgtagatacaatcagacatgttccatgattcaacctttctatgagatgtaagcaaatagtatagattgaatgagatagtgtagattgctcgtaaatcagatcaaacaaattaaagattaaatgtagtttatatcatagccgatgatatgatacttttggttaagataggtaccgtatcggctaatactccaatatagccttatgcaagaatatcaatctaaataaatatttcaagagcaagcttgatatatttaaatagtgtgatacacttgtatgagggacagatacaacatgaaaaacatgattaaaggatttaaacaaagctaaaaaattatatcatgtaagatcggttgaaaccccgattctatccctattagcaatcaagaagcaggttagtttctataattctaagcatgactaaggctgatgcagcacaaagtatgaaaagaagcataaagtctaaacaatcatgccttgactgattttcagggtggtggatatgttagctaatccaaaccgacaaaacaaattagccgatgccggcaaaaccgtaaataagacatggccgatatagctaatcgagtcatcaggttagattaactaagacatataataaccagcgatcgaataggatagattagaacatctaaaacaacgccctaatccaccaacgcaagccactgtgacaagccattgctctcgtcagaagatcgaagccgatgccctaactcgaagcaagaactcgtcgaaaaagtagaaaagtaaaagggtggcgatgcgccgagagtatatgaatggttgttgtttttttagaagaccctaggcatatatttatgcacgtagtacaaaacctatccatatcgggcacgacacaaactttgaaaaaaaaaaacacaccagcccattacggactctaacatagactcctaaaacacctaaaggaaaactgacttttatcctaattaatagatgcaattatctccttggcggactcgatctttgcttggcaatattaccaaccccttcctccgaatccgataggaacacaacttgctactatcggcaacactcagccgatatggtcctgtcgatacttgttaggcgatccaatccctgtttggccaaacaaaattacgccgttaatttttcccatcccttattcctttttcaatggaatataccaaattttaccattaacacattcccctaattctggagtatggatagacatgcttcggaattcatccgtcacaggacatttaacaccagcccattagggtttataatggcccaaatagcccatctcagcctttaacaccgtaatttataaatagcaacggtcacctctgccatcatcgtgctgccactttatttcttcgtttcctacaccaacaagctctaatttcctctcttctcaactccggcaaccaaaacgaaactatcaaaccccctctggcgaactccaccattcattcaaatggcgacgactagcgacatcctagaggtaatatccgtaaaactctcctttttcctctttatttaccgcactaaatccataaatccctcattctctggttttcgcctcgtgttctttgttgtcatctcttttttactactcatttcactgtagcaaatgagagatcaaatagtgattcctctagtcgatcaaccattatattattttctcggactgatggggcaatgaggatcccattgaatttattaacgcggagaccaatcgaattcctttcaagctatctagcccctgcatttccgattggaatttaagattcagatcttggccctccaaggttcccagctagagaaactagtatcggagtatgctggaagccaagcacaaagtctggtccaatataggcataactcagtgcatcgctctatc

SEQ ID NO: 12055 - DNA, 2974 bp, Oryza sativa
tcaaaatcactggagtgcacgtcactgaatcaagatttctggcttatttcgcagaaggtgatgaaaaatctcttcccagatgcacgtcacttggcgaagcagcaatcatctatcttagcagcaaccttacgcttgaaaatgtcatgctctggttcaataggttctacactggtttccctagggctgcaccagaaactggttcccttatgaagaattcgaaggctatgaacttccatcggacttcaatctgaacaacattaactctgatgaagcaagccgagagatatttataacggctatcaccccttgcattcttcagaccggcatttctatgggacaccactctcatatctcgtatgaattctatcacccattagtggtggcccatcaacttggtttcggccaagtccctatcaaagtttacttcatcaaaaagatacaaactcggggaacgatcacaagtgcacttaagtgcgattgtctcccaaacctcaatggtccaaatcttggtcccttcattgactgggacagccgtactatcggcagtagaccatggatcaaatggtggggtgaatggaagcgtcaccttttcaacctccagtctacaacttcctcgctttacttgatcctaaattcgttcctgatgatgctgaggtaaaatctttgtgcactcaattcttcctctatttcaagcactgatcatctgtccatttatatgcaggaagacgatgacactcccatgaccagctttagtgctctgccgataaattatgttcccttatcggtatcgtcaagacttggtgcaggtgcccctcccacatcttgcttacttcaagaggctatgagggagccgataccaagtctgaagactaagcgcaagaagccggccatgtggcacaaaagcaagacgcgtgttggtatttcttaatgacattactagcaacataattctcagcaatggcgcagaaataattctggtatattatggttacacatttcatccgcaagcgcacggatataccattgtagcatttcaaccgagagtattccaagggtatcgtatttattttatcccgtgggaagatcatgtagagagaactcaactaataatttatatattacttgtgataatcatattctaagcaggggttaagataatccaagggtagagtgacacacaagcattactactcatcctcataataatttatctaagctaggtggaaataagagaaaagaaatctattcctatacttctagtataattctagctaaccgatatactagctaataccctctatccgatgctctcctggtacttcgagaagccaactctgactgccgagctctttacgacagcccgtcatgaccatccaaccggggctaaatatggaggaataccctccccaggaaattaacttaggattatatataggcgtggaggaatacctgtactgagctgtcatcttcagcggccctactctcatccgcaatatataaccccaaataatgatatcttgtaatctagacaccacgtctaaactaccagatactactctaatatcatcgtcatgacatatagtaattgtataagcaaacactatacccgcatcaaagcatctcctagataagctagccgtatatttagtataacaaggacataatgtaaagttggtactcatatactcggaaagtatttcaataccataaatgtatatagaagagtattctaataaaagtacaaagcttacaaaagaggaaaggaaagctgctagagccatacccgaactcttccgaaggcttccgaactcctgattcctcttctaattctattccaccagctagatactactaaactaaacttgagaggaatgagagagctcttgcttgaggtgtgtgagtgaagtgagaatggcaactccttttatagcctcccaatgacggttgtggcggttggaatggtcggaaatgccctccaactgccatttggggctaatccacaccgtccaggcgaagccctggatcggatggcgctaaggagggttcggcttgatccagcccaatttcggctggcggcctcgtctgttgcttctcttcacagacttgtcaattttggcccagtttgtcgtgtcaattctgagttcttggcccattcatgcataagtctggttctcaacatcgtctaattgatttatcgttggtgttgatgtcgattctcctcctttttatgatcattctctgcaaaaggttagtaaacctaacactagtggaatattattattctaaaaaatatatgtattgcaagcatcactagttctctcctgttttagtaatattgatggtcgaaactgatcgataacgaccgtcaataacgcgcaaaactggcttgtcctcaccatgggatggataaatggctcatcatccagaacctctacaacgagctgacgcagttggcctaagatcatattgatgctgctgctggaggagccttcttgtcactcattgttgctcgcacatcagaactaattgagtagatggtctctaaccaagggtggagcaaagaacgactccaacctcattagtggggcatgcatacagtcaaggagatggacatgctcgccgctaagatggacctcctcatgaaacgcttggacgaatgtgctcgtgacaaggcagaaatgaatggtactacccaaaccttggacatcccaatgacgtgccagacttgtggcagcactgggtattcagggaatgactacccgtttctgtggacagaagaccggcgatcttgcgtaacctcaaggagagcgtaagcatggccgtggtgaggctgtccatgttagcatggcccggtccccccgtggcacagctgggggaggtcttcgtggtgccagagccaacgccaaatgttcgcgtgcaacaatcaacctcgatgaggtggacaatggtgaggatatccgcctcggtggagcat

SEQ ID NO: 12056 - DNA, 19873 bp, Oryza sativa
aaaattccagaaacttcaatccaacaggaaattgaaaaccctggaaacggattccctgattaagatccattgagtggatgtccttttgtatacattttctcttttttcaaattcaattcaaatgactgaaattatgtttgatagtatagagtatagtgacatctgtgactttacaattcaactataatagtcgattaatagagaattgatttcgaaattttgaagatgaagaacctcaattcagctattttgaggcaggaaatttgttcgcgagcgagagagctaataattcttttttatgctagataaccgcttgcaacacacttactcttattaaagaactacgttgagtacatcttcattggagaaatctacacctacatttctcgaattcttcatcgagttggaatacttgaaccgaagaccctttctttcgccatgataacctgaaaattggacaaatgaaacaaaattaaaccgaagttccactgaatacatgatacaaaccgaagtgggattccctaattaagatccattgagtggatgtccttttgtatacattttctttttttcaaattcaattcaaatgactgaaattatgtttgatagtatagagtatagtgacatctatgactttacaattcaactataatagtcgattaatagagaattgatttcgaaatttttaagatgaagaacctcaattcagctattttgaggcaggaaatttgttcgcgagcgagagagctaataattcttttttatgctagataaccgcttgcaacacactgactcttattaaagaaccgcgttgagtacatcttcattgcagaatactacacctacatttctcgaattcttcatcgagttggaatacttgaactgaagaccctttctttcggcatgataacctgaaaattggacaaacgaaacaaaattaaaccgaagttccactgaatacatgatacaaaccgaagtgtttgcagggtgaagctttttgcacttcttttccccaatctgtatgcagtgtgatgaagaggagcatccctactttactgatactgccacacacaatgccaagccaaagaccctgttttatggaaacagctagcaggttcaatcatctggtttcacaatgcatcatcatcatacaaagctacaccggaacttttctatgaatcagcaaaaaaacaatctgcactgcatattttgcataagggattgagggagtagtgctacctctccatttagatggaggacaaatgcaagaagcacagccgtcggaataccaaccaagtaaaacgcgccaagattcacatgagcgccaatcttctgcttaccacatcctgtcaaaactcctgaaatgttccgaggtccacgcaattttattactactgatcgacttaacgatatgaactatccgaaaaactcatcgatcgataatgagaaaaaaaagtacagctaaaatgttttgataattgatcgcaagtagaaatatggtatggatttgcacctgaaagagcaccattgatgccatctacgaagaaggagaccgcgaggatggggagcatacttgcaatgtatgccaccacttcctcctcgttgctgtaggcgtatccccagacattgcgcagcagaatcatggctatcactagcacgaggcatacaagcactgtcatggctgtggccactcgcactgccatccttgctgctcgaggatgcccgccacctagttcgttcgagacgcgtgtgctgcgaaagtgcaaaattggtggaactaatcagttcattgtctaatccaatgacatgaaagctgaaggaagaaaagcatgtttgccatgtaaataaaacttaagtagtacaagggtaaactgaatttggtcaaaacttatttaaactaagaaggcagcccgggcatatgtgcgggctttccattttaatgttctgtaaaacaaatattagagtaaagttaatattcaatttcgaatgggttttagttgagatgatattttattttattttattttaaacttcagagatctctcaaaaaggtatttgggattgctttcaacattggttatgactgcattgcaattactgtaggaacacgtggattgtaaactaaaattacttgaaactgtgaaatctttattttatggaatttttaccactactacatgctacgaacttatgggtacgcatagcacatatcctgtcaccattaccacaaccacttctaggacacttgggtgagcaagtccctcattctccatcgccacgctttataaactgctaaacaatgcatttcgtgcaaaaatctttctatatagaagtttctttaaacagataaaacaaatatacaatggttagtagttacgtaatcactcgctaatgacctttgtagattttgtgccatggaaaatctcacctgagttgttgaaatgaaagtgtccttaaacaatgcaccatactatatgctacaaacggtggtaaggtgttacacataagctatttctatgataccaaaggcaagacatgctttgtacgaccccgatatgatgctcggatcatcatctatcctttattcattatttgactaaagactatagtgaatttaaaaggatggatgagggaacatggtcggattcataaaaataatggcacaaccaattcgtgcataaggcatctcaatattgaagtcaactgactatgtgtaatttcatggtaaaagagagaactttgttaagtttttttaaaagacattagatatataaccatgtataataattgttctataccgatttatgtaaaaaaaaggaagccagatgtttttcttctcttatactaagaatttataggatttccaattttgttggaagtatcaagagaagttctagatgtcttaggagggattagagtgtgtttaatggacattgaggagattttctcgaaattctagggagttggccgcttacttggatgaccatccttttgaatgttattgcaaaattattttaaaaattggacatgtaaattaaggataaattgaaggtcggatgatttctcttttaaataaatgcctgtaattctctttctcaacaaacaccaaaaaactttcatcgtctattagataaaagatagattatataagtacaaacatacatcatatatattagtcatgctagaaacatttgtgtggatggatgttttcatttataccagcctactctttaatcctttttcctatatagttggtacccactacaagttattcatgctataaagctcaaattctgtgaggccacatcatcaagattatattgattattatatcatctcgcgtctatgcaaatcaaccgttaaatcaagttcttctcagccaatggcatgtgagaggaccaatgctttttgtcttcctcttaattacctcatgcatatcattatatctccctttattactaaccactaaacaatacatctcccacaggaagcctacaccactacatttgtgtctacctctttcttattccctttaatttttctattgcatctactagccatatctaggctgatgcaatggattttcttggaatatttatgcttgaacatgcttcctcagtcatctaaggaggaaatgtcaatggtccaatgaaattttggtttgccactgtcatagatgacatcgaaaatttattgggacatattacaacactcgatgatctttacaaattgcaaggatatctatatatgtctatctcctatggtgattggtttttggtattctatcatgatcttgcttcttttcatatctgatttcttcgtttatcaccaagcttcatatgtcaatgtatcacaactatggtaacttaaagtattgagggattggtccactctttgtgttaaaaggctgattaaaaggctgtgccaaatctttgtgtttttcagacttgcgatcactgaatttgtttctccacaattcctcccatttactcataggtgaacatgctgtttcttgaaattactagattcatgcacccaatatgtttttttaagatcatataccaacatatgtatgcaacattatccatattttctctttgttttctcaaaaaagaaatatttcattagttgtttaatatatctgagtgagatcttaagccaatttagtacataataaaaatagtgtcatgtttgcttactatttatggttcttcaaaataggagtatcttaattggaatcatgtcatttctattcatatagcaatacaatgtacagatagaacgttcaagcatgttgatcatgcaattatgataaatttacaactatatgttcccttctatgtaatgatactataccaataatcaaaagttctagaattacatcttacaaattcacgatatagctatcccgcagcaacgtgcagggtatcaactaattggtacttatgcttactcctactttcttagtatctatacacatgacatgcaagatgcataagatgttaaatttgtgcaaagtaagaaatatcggtgttcttttgcgattaattagaacatcgttatttaggcacatgacgtagtgatgaccaaattaaagatgaaattatgggagggtttttttttccctttatcagaattccaacattaattttcatatttttacctcagtttttttttaaaaaaatctatgggttttggatttataagcaaacccattgaaaaaatctagatggatagatttgtggagctacgaatatccagttaaaaaaaatcatgaatccaaaacaatattaaacatgcctttttttcagccttaacctattagcatctaatgggcagttgtgactcagttgctccatacatatggatatatacatggcactaatatttgggggtatagtagactgagccctacatattaatggttttatcggaagaatataactaattataaagagtagaggatattcgataaatatttatggtatagtagaatattctattttttataatccttaaaaaatggattttgataggaaaaaaatacttcccataaatttaaactgttattttttttccaaattttctatatttttctccttttttagactctctactaaagggtctctcatagacttttagggatcagtagcacaaggtttttttatccgtgttagaatatatttttattaccattggaacatggccaaattgcattctgtaggacgcttgttcctttcaaaagggagcgaacagaaatacactaatcggacagaacaaaaggttaggagtagaaagataccgatgagttctgatttctctgatgaacgagaaaaggtaaagtgaacagctgtgacgctacggagataataaaacccagttaatcgtgaactatatatatacgtacattcatctagaggactgcaattttgctcccatcgtgaactatataactgcagattgtttggaaacttggagaagctgtggtgccagcactgaattaacgtgagtactagctgatagcctgatatacctcgtgtacagatgggagcaccatgccggtcaaccggtgcaggcccacatcattatacacgatggtttcgattttacttaaagcggagaaataagaggagaggatgcagggtggccgtgcccatagtaagggggtgtttagggcaatagcagtataagctatggggcccttacccctagcccaaagtcacagctcaaagacacacatcccacagtgcaagtacccatatatgtgtggctaaatgggatgaaggtactatatatggaaagaaacccagcccacagtgggcgttacccgaggcgagtggtcatgaggagcggaacgaattaattcctaacctacccttccagcgactcctctcccagcccttcccctccccccaatccgccgcacccgccgctcctcgtcctcccaatccgccacacccaccgctcctcctcctcgtctactgtggcgctccgctccggccgcctcttctcccgtcgacggcgccgcctcgtcccggtcagccgcgccgcctcgtctcccgtcgaccacgccgcctcgcctcccggttgaccgcgccgcctcgccgaccggcaagggcaagggggaggaggaggatgaggaggtgggggagtagatccagcgagcggcgaggaagagggccgacggttcttgttcagccgcgcgagcggccgccggttcttggcggcgggaggcgtcccggctgccgcgggcccgtggcggcgtcggccaccacagcccgcgccgccgctcctcctcccggtccgccgcgcctcctcgcctcccacgccgcggggaggagggagcaagaaggcgtcgccacccactgcacgcggcggcggcgagaaggaggaggagtaggaggtggggcagtagatctggcggtcggccaccaccaccggcctcgccgctgcccaccgccgatcctgaccctgccggcgccgccgctgtcagctccgtcaagaaatcaagaagcgaatcactgttcttaatatttttgcatgttctgttctccagttcttgatgagaaaaatcaagaactgctctcctgttcttatctttgcttgtcatgtgtatcttcagttcttgtgatgtttgttcctgtgatcctactcctatctatacttgcttgtcatgttcttatcttcggttcttcgtttttcttgctttttcttgattcggtggcgggaggaagaatggttgtggcgggaggggaaatcgctggggcgggatggggtttttcgtgggcgaatcaggaatttcttcactggatgcggcatgaggtcacgacgcggcaaagaaccgaagcccacagcgcaggctcctctcgtttttttggccgcgcgtggactcgagcaaacaagttctgcgtcgctcagtatggacgcgaagagcctaacttggtcgcgggcactcgtttcacatcggacaaaatcctccgtggcaccccatagcaccggtcctaggtggagcactgtgaaaggcccttagatccaggggatataaagtattggtgtgtcacatcagatattatatagggtgtcatatggggtgttcggaccctaataaaaaaataattgcagtatccgtcattaaaccacgagacgaatttattaagcctaattaatccgtcggtaccacatgtttactgtagcaccacatttttaaatcatggagcaataaagcttaatagattcgtctcgcaaagtagtcgcaatatgtgtaattagttatttttttagcctatatttgatacttcatacaggtgttcaaacattcgatgtgacagggtgtaaaattttgggtaagaatctaaacaagctctaagatagaggggatcggaatttgttttcatattttagggataacatcaagtggttaaaaataacaggtccaccaatataagtgacaattaatggtaagatttttttcttcttcttagaatttttaattagtatttttttttgtaatttattaaaatgacatgtggtggtttaggaacgtttgtaggaatcccacgtgacggcatgagagcgtttgtaggaaatttaatgaacctttagtatataatagataatagataggtagattgatagatttcaaatatcgtcgttcagaaattttggggaatttagaagatttcaaaaatctcagtcccacaaccccacaaaaaaaatacaaaaagtgcaagacaaaattgcgaaccctgtatgagaacaactcagtagggcactgttctaaaagatgataatgaagtaatggagtttagaggcgatacagaccttaaagatgagccaatgccacgtggcaccatgatcaggagagaagcagtgctcaagctgcaaattaaattggagttaacaaattacccatgggaaggaggagagctgatttgtatgtgtgttgcttatgatcaaattacctgattgacagaacagcagtttcaagctgaggattcggcagaatgccagagagcagcacaagtatctcaaacgacgaccactccaagctgcacacaaccaaatcaaccagctaatcctcacaaaaatattcccaaaatttgttcaagcaagattaatttgctctctcgatcacaaaacatgttccaagatttgctcaagcaagcaagaaaccagcgatggtgttgaaagattccaaacaatctgcaagcaagcaaacaagatttcctcggcttgtttggtaattcgagggaaggggattgggagtttatacgagagaattgatgattagattaagatggaaatttgatttttaatcccaatatcttgtttggtagaggtgatgaaaattggtagggagtttagttagagattaggtcattaataaaaacggatagctgagatttgcttagagaaagtaaaggaggaattctctcacaattacctgcccctacgcgggtattgaaaaggagagagttccttcctcaattctccatccccatcccactaaaattcccatgtctctcaactaaacaaaacacttaatagcctcatccctctaaactcacaatctcttctaaaaactccatccaagaaagcagagagacacttgatgggtacatagggctccttgaccaggtcaaagccaccacggagagtgctggacgtggtgctgccgtattgctactgttgctaatgttgtgcatcatttttgtttcttcccgttcaaagaacgagtttgcatcgcccaccgccttatcgacatctgcacgtctccgacatcggcatcgactccaactttctcttcatcatctagccccacgcaactttggcttgatcatccgttcaaacgcctggctacgacgagatcttgctgccgatcatctacgagcaagtctactacgctatcaaactccgggttgccactgcgttgccccctcgggctacagtgccaccgccccgtgatctacctgtactggttgttacagtgctaagagacgccctttttagcatggctttatcaccagtggacttctcgccgttgcatcgatatggagctgcagctatatgttgtcctcttggacaacagcttcaccgctttcgtcgtcttcattgccgttcgagcatcaacaatttcgtgttcgcactggtcatcgccagctactcgggttcttttttgtctacttcgagcatagccaccgtgtctctaagttgccaccgtcgccgctctaagccggtggtccaactacttctaaatggctggcatgcaattaaataaaaattacaacctacttctattccacaccagaggcttgagggggcccttacgtgagggggagtgttggaatataaagtgaattgcccatcattcttcatcagcttaagcttttaggttgaactagtcagtgcatacaactcaataaatggtgtcaggcgtgccactgaccagaccatcatggcggacggcacggcgagctcggtgaaccggcggagctccctgaaggcgttcatggagaacccggtccacgtcgtcttgcaggcgccggacagccgcgcgtagaaggcgaggacggcgaagttggtccagtacgtcacggcaccgctcagcgcagcgcccttgctccccatgccggccttgtgcaccagcgcccagcacacggcaacgtgggcgaccgccgccacgccggagctcgccatcaccggcacgacgatgccctgcgcctgcaggaaccggagggcgcaggcgagcggcacgtaggccgcgagcgacgggatcatccaccgcgcgtacgcgccagcctcggccgcgatggccgggtcctgcccgaagaggaggaggatctcgccggcgctggcccagacgagcgcgatggggacggcggccgccgcgagcaccagcatggcgcgctgcgcgtagacgccgagcagccggtgctgccccgcgccgtacgcctgcccgcacagcgtgtccagcgcgctcgacatgccggactgatcagatcatcccaccgagaaatcagttacaaattcgaccaagaaatcggagagacaatgcagttattgcgtgcaagcaaggtgttcaaagggtgcgtacaaggaggcttaaaccggtgacgctggcgagcgactcggcgagggaggaaccggcgagctggagctcgccgaggtggccgacgaacatgacggacaccatctggaccgagttccgcagcacgaagccggccatcagaggcccagcgagacgcagcagcctcttcacctccgccgccgtcgacgccatggctccgtcctcgccatctccgccgcgtcggacggcgagcagtggctcctccacggttgactcgtccatgtcgatcgaatcaccaactgtgagacgtttattgggctgaaaatggtggattcgttgaatcgttgtccaacttatagggatgagcatataagttagtgtgttcatgggtttgatatgtttcgtttgtggcggtcaaatcggagaggagtgattctttttaccctccacatgcaggcattccatcattgtttaagagtaaatcttatcacacttattttatggtgcaagttacataaattaattataggatttttttagtccaagttacataaattatacgaattttggtacgtgactataaaattttagtaaaccacaccgttaactattttagacatattcctatatgaaaattttaaaaatagatgtagcatttgtttgatcaaaataaaaatgactaactgtgtatttatgtgaaactttagaaacataatacgtattatcatgtgctacatatcaaaatcattgtggttttatacagcttggatcataatagattcggttttatgaaatttactctcgaagagaaaattttatttaacatcataatacattatcgttgactaagatggtctcatataccatggtcacgagtgttaatgtaatcaaaatggcaagaaatatagtgtgaaatcatcaaattttacgggcaataatggaacagtggctgccagggtttgtgtgtggaaaaggtagtccagtatttgtggaccagaaatcaggaaagaatattcaaaggggaaaagttttagtttgagagaaatagaatagtgggattactttgtgagagcgcttttcaaaagtgacaaagatggttttgtatgtgacttaattatcaaaatgactaactgtgtggttttgtgaaactttagaaacataatacttgacattgtgtcacatatcaaaattattatggttttatgcagcttggaccatgatagattcggttttttgaaatttatactcttgaagagtaaattttatttaacatcataatgcattatcattgactaatatggtttcttataccatggtcaggagtgctaatataatcaaaatggcagcaaatatatagtgtgaaatcatcaaattttatgggcaatgatggaacagtggtgccagggtttgggtgtggaaaattaaggtagtcgcgatccagtgtatggaaaattactgaaaatcaggaaagaatattcaaaggggaaaaattttattttgagagaaacagagcagtgggattactttgtgagaacacttcagaagtgaccaagatggttttgaatgtaacttaatcattgtgtgatatctaaaaaccgaaaaactggtcagagtgttaattagtaatgagcgggaaaatactggggatgttccttgggctgatgtttgcaagctgaggctgaagactgaagagagtggatatttgtccaacctatagggagttaattaattaattaattaattaaagtggaactcggaatgtgtttggacggattcgattcgatccgtggaagggacctagaaacgcactactgaagattcttgcgtttagtcactcagttgacgtgttgacttgttttgtttgtaccgctcaaatcgtggttgccaaggcacaataccgctctgatgtcgtttgcatgctaattaatcatttgtaggtctcattataataaatacgacatgtgtgttgtttggtcttagatcagtccgcaattttgactcaaaagaaagtttgactttctatcttggggtgcaagtctgaatctccagcaaaattgtagtaggacttgggaatgaaacaggacaaaacagaaagcacctgcataacatattttgcgtatgaccgattattccgatagtgttgttgtgagtagacatgtgaagctcatagcccccagggaactggctcatagcctcgtagcctcacggaactgtctatatatcactccaaagatttttttttaaaaaaaaagaaatcacgagtataattacaatgtaataacaatgtaattttactataattgaaccagttgtatgcaaattaaaacaagatcactcgctggtttgcagatgcgcaatgacctcaactgagaggcacacatctcaacgcaaattatacggtccagaaatcaagtggtagctaaaaaatatattgtttcgaataatatatagcaaaatcaaaacctcaaaggtgaaatgaataaaactagactgcgattttttatcacctccatcacatcctaaatatataagtgatcatgcccctctctgatgtgaccatggctactatagatataaccgtcgttcacatcaaaatcaagccgtccaagttctgcaatccagttcggccacctgctacagtgtctacttcaaacggccgccaaaaatgcatgcgagctccgttttgggtccatgagtacttgctggaaagctctcggagtcatctttccaatggatccagcttcatcgccaaattccatcctagtcggccgaaatcacaaaaagaaggtgctgcgtcacctataatgggcctatgggcttgtaacttcgtctgggaccccggcccaagtggggtgcgccccaaccaggtggagcatgaccctagggttcccttaggtcgtcctcccacctccttaaatagttaggtacccctttagagtttcttgggttttgtttagatgaaagtttagccattgctacttcgcttgcagcgcgtgtgtcggctagaccgtccgtctgcttgtattcgaaaccccaacttatcgtgtgtattcattcctatttgcaattcagattgtttttatcttgttcttgcttgtttctttgatttgcttgcaggaataaggttgatctgcaccggcaagatcaacaacccacggagaggtgtatcgatcgctaaggcgcaacacaacgtctcgtacggttgtagtcggatcgtcaacgtttctcccaaatcgtagttatcacaactcaccgaaagatcaggccaacaacagccttgagtgtcgagaggaactcagggttcatcactctccattcgttttcaaatacaagcggctttgatatcccgttagtacgcctgtgataatcttgtttacacccaaatttggcacctaggagtaagataggaaaaattgccaaattttagaaatctgccggtttcctccgagtaggccagtctgaccgccgtgtgttggccggtcagaccgccggttgagggccggtcagaccagcggcatgtggatggtctgaccggcaggtccgagtccgagtgtgtgtttcgccgggtctcgaagttttcttgcttgaaaaggcatgtttcaggtttcctttggattctatcccgagatggacggggaggagagcctatagagggcaagaccaacccctatataagggacatggccggttcaattataacagatcaatctacaatcaatcaatcgaatcgtttttcatattgcttttagtttttgctttagttcatccatctttgtcgatttgcgctgtaaatcgttcgccggcgctgcgagagtgcgacatctctttgtaggtttgtcctgaaaatcttcaattttgcccacgagacgggtagttatctaaaaatcggctccgctagccggtttagttatcaaaacccatcttggtctagtttttgctagattaaggtggttggcgactctaggattaccgcaaggcgttaagtgctgcgatcgtggttgtcaacttgtcacaaaaaattaccaactatttctacagatatctaaagataggctagttgctcagccatttacaaaacaggttttggccgactgcaaggacagttcctgtagtagtggatctaactgacaaatatggtttacaacatatttttccacgaagtttgattcgtttagtttattttgctcttcatgtttgtcggtctatcatcgctggctatttcgtcctcaatgatgatctaagaagacttgtttgggttaaaaagaataaaaaggaaggtagtttgtgtatatcttattgatcagtgtgttgccgtatttaattatagtccgagtcaccgatttgtttggtgatgccgctttgatgatttctcaaaaatggaacgaagatgggtggctgatccttcttttcatttacttttgcgcgagccaaaattggctaggttcgtggctatgctcgtctgctggcataacggagtatttatgaaaaatcctgaaattttcaataaaatcaaccatatctctctaagaaaaacattaccatcacatcacatcagatattatagttggcctataattctatacttggcaagcaagttccaccacgtgcaaaacagtaaattgattttttttaaagagaataaaatatctttagaactcgcgaccggctgcctgcttgcgtggaactttccaaaacatttcactgcagctgaaccctataaacagacttccggacgtcctgtcatcttctcaacttcactgtttcatcacaatctttagacttgagaattagggcctatttagttccgaaacaaaattttcacagtgtcatattgaatgttttgacacatgcatgaattattaaatgtagacaaaaaaaacaaattatatagttcgtcaggaaattgtgagaaatcttttaagcctaattacgtcataatttgataatatggtgctacagtaaacatttgctaatgacggattaattaggcttaaaaaattcgtttcgcagtttcatggtggaatttataatttgttttgttattagactacgttcaatacttgaaatgtgtgtccgtatatccgatgtaacatgtgtgagcaaatttttttccaactgaacaagcccttagcggaatacttaggctgtgtttgtttccttcttttcccaacccacgtctctcattttccacacccactcttttttagaccgctaaacggtgtattttataaaaattttgtacacgaaagttgcttaaaaaattatattaatatatttgttttaaaaaaatagctaatatttaattagttatacgttgagtcactccgttttacgtattagagggatcagttcccatgtctagcctctaggaaacttagttgatatatagcctgatacagataggctgatacgcatggacaagccactaagccagccgccgaggcggaggcgccgctgctcggcgcgctcgccaatcacaagcaacgcgagagcaccgcggcagcggaggccaagagactggtgagcctggcggcgccgctggtggcgagctgcatgctgtagaacatcatccagatggtgcccccgtcatgttcgtcggccggcccgcctcctcgcctcgtcgctcaccaacttcaccggcttccgccttctcgtaagtattggtcgaacaccttgctcgcgtacaagaagtgtctaatctctgcaattttcttggtcgattttgatcatcagttcggcgtatggcgagcgcgctggacacgcgccgaacgcgctggacacgcgctgtgcgggcaggcgttcggcgccgggcggcattgccttctcggtgtccacactccacaattcaggcccatatgtgttctgaatgactgtttaaattcatcagtaagtgtgtttgtaatagacttactgagatagctggagatgtcattttcccaacccatactgcttttatacctggaaggctgtgtgattatacatgaggtgctccatgagatgaaaagaaagaatctggaaggaattattttgaaaattgatttcgaaaaagcatacgacaaggtgagttgggacttcttgatagaggtgatggttagaaaaggcttccctagcaagtgggttaactggattaaaacctgtgtcatgggtggtagaatgtgtattaacattaatggagagaggactgatttctttaggacctttagagggacttagacaaggtgaccccctctccccgcttctctttaacttggttagtgatgccctagctgcaatgttggatagtgccaaaagggaaggggtcctcagtggcttagtttctgatatttttcctaggggtatcacccacctccaatataccgatgatactgttctctttgttgctaatgatgataagcaaatagtggctacaaaattcattctctactgctttgaagagatggctggcctaaaggttaattaccacaagagtgagatttttaccttgggtctgtctgacaatgatactaacagagttgccatgatgtttaattgtccggtgggtcagttcccaataaagtaccttggtttacctattggccctgacaaaatcctaaaccttggttttgatttcctgggccaaaaacttgagaagagattgaattcttgggggaataatctgtcccatgctggaagagctgttcaaattaatgcctgtctctcttcaatcccttcctatgccatgggtttctaccaacttcctgagggagtccaccaaaaatttgatagcattagagggagatattattgggctggaaacaaactgaaggggaaataccatatggtaaagtgggaggatctggctttcccctaagattatggtggcctgggtttcactgagactaggagaatgaacattgccctcttggccaagtggatcatgaaaattgaatttgaagatgatagcctctgtatagagttattgagaaggaaatacctgcatgatggggggttcttccaatgtaaagagagatatgcttcccaattctggaaaggtttgctaaatattagaagatggctgagcctggggtctgtgtggcaagtgggagacggctcacacatcagcttctggagagatgtctggtggggcaataccctctgaggatcctgtttcctgcaatttttgctgtttgcaatcaacaggagattttagtgtctcaggtcaaagaggggggtctggattgcttgtcttgtaggaggtccttttgtcctgaggagatttcagagattgaaaggacctatgaaagaagtcataggaaatattgaaacttctgattccagagattgtttaggttggggcctgtcagctaataaaacctacaccaccaaatccctcaatagagccctgacttttagaggtattagagaggtaaacactgagatttggagatgcccttgccctatgaagattaaacatttcctctggttagctctcaaagatagaattcaggctgctgagcaactgaaaaagagaggttgggatggatcagagttctgccagctctgtgatgttttggaaacaactaatcacattctttttaactgtgatatggctagatttgtttagtgtttttgccgagatgtcctcaattggaataccattcctagaaactttgatgatttcttttctctttgcaatggggtttcagaccatactcaacttagaatcatttttagtctgttagctgctatttgttggaatctctggattacaagaaataacatggtgtttagagagaaactggtctattctccactaactattccttttcaaattatttctaatcttttgcagtggagaaaactctttcgttctgaggaagaatgcaagctggacgcgctggtggaaaggatccgccagcgcgtctgggccaacgacggcgagatccgccagcgcgtcgaccaggacgcggacatcgccgccgaggccggcgccaacgcgcgctggaccatcctatcgctcgtacgtcccctaccacatccggttcctgcaggtgcagagcgtcgtcgtgccggtgatggccagctccgccgccacggcgatctgccacgtcgccgtgtgctgggcactggtgttcaaggccgggatggggagcaggggcgccgcgggcgctgagcattgccatcttgtactgcatgtctgcatcaacctcgctatgcttgctctctatgtcaggctcccagctgcagggagacatggacggggttctccatggatgcgttcagggagctccggcgattcaccgagcttgccataccatcggccatgatggtttggagtggtttggattattccaggtgttgtttcgatgggcctcaatctcgatccattcacatgtgtgggccgggaatgtgaactaagttccaaacccatatatgtcgatggcaatgggcttgaatagaaaatgatatagagaccgagcgcttgctcgggtggcaagcgtcgccggtgggcacgctgcccgcgagcgttcgaacttcgaacaccaggttcgacactcgtgctcgcccgggggaatttttcccctctttccccgggtctaacttcggttggacccggctaggtaatagggtacacacacgtgtgcgcgtttagtgggactgcacgtttcccatgcactgaggcccagtgcctccaatctcatttctagcgtgtgttagggacacgcacgcgtgtgtatgagtgtggtgtgtgtaagtgtgtattcccttctaaaaaaaagaatagaaaataatataagttgagttttcacaatgcaatctttggttacttgatttatgaacaagtctttttttttgtgtgtgcagcatggagtggtggtcatttgaattagttgtgctgctctctgggcttcttcccaatcctaagcttgaaacctcagcgttgtcaatatggtatgcgatgaaccctaagattattaattgcatataccataaaggaactaattatcgaaatacatcttcctcttttctactttctcacttgttaattatgtagtctcaacaccggttctctgatgtttatggtgccatttggtctctgcacagccataaggtatgaaattctcactcagttctgaatattcatttaaatatatgttccatgtttcactcaatcaattctgaatatccatttacatatgttccaaatttttctgtacatagtctgattgatttcctttttaaattttcattggtagcacgcgtgtgtcgaacgaacttggagcagggaagccttaagctgcaacgctgggaacaagagttgtcatttgtatggccttgtcttaagggtttatcatcacctgcacgatgattttgctacgcaatttgtggggatatatgtacagcaatgaggctgaagttgtcaaatactttgctcgttctcacgatatcctttttcatgatttctactgtgtaagtagagaataccggagcgtaactctaattgagaacaccacttcgtctgagttttatcagcatctctttaagaaagttaaaacgaataatatcttccaatacaaatcaaattagttacggcaagtccttcagatgaaatccaagttactatattaccgacacataaatcaagtccaaatgtccaatggcacaaatatagtcaaatcgagcatctgtgacaaggtttttttttttgtaacggaattgctaaagctctatcaacagaaaatccaacctcaaatcttgcaaattttggatcactggatgtggttcacgattcgtgctcttcttctccaactccggcaaccacctctt

SEQ ID NO: 12057 - DNA, 2320 bp, Oryza sativa
gcggcgcatcgggcgggcggcgaggcgacggcggcgccgccgaagccgcagggtcaggagcaggcggcgggagcaaagcggaaagagtggtaggaggaggcggcgggtggtggcacgccgcagccggaaacggggaagacgacggacagctcaccgcagccggcttgaggcaaaggagaggagaagcaggaggaaggggagggggagggggccggccggggtggcctcgccggcactgttgacacctttcggccagccggcgaggccgggcggcagcacgctggggtgacggcggcggtggcggaggtggggggaagcactaaggagcggcggcgtgaagaatcgggaatggagagaggagagaggatttttagggtttggttgcctgcacgaatcttaaagcaatcggatgctccaaaatttgcaagatttgtaagggggttttctgtcaaatgatctatagacaatcccttttcgtaatggattatagtccgaaactctgtgagatgatgtagaagacaatgaagtaattgtatcactggaggagaaaccgtttgtagtcccgggtggtaaccccctttagtcccggttgtccaaccgggactacgaatccgggactaaagataaaaataaccgggactaaagattgatctttagtcccggttcgtattaccaaccgggactaaagatcggtcagccacgtggccggccaaaccatctttagtcccggtttgtgttaccaaccgggactaaagatcggtgcaccatttttttatttgcatggccctgtttgctgcatggttgattttatatatatatatatatatatatatatatatatttatatatatatatatgtgtgtgtgtatgcatatgtgtatatgtataaatcatatattacacacatatgtataatttaaagcacttaacattttatgtgcatatatgttaccaaaatatatattaacactaaagtaaatgtgtacatatataaatatatatatacatgcatatatagtacaattcatttgctcggtagctatagctacgacttcgacgccggcgttatgtcagaagaggaaggaccggcgttatgaattgtcaatccatcgtagtagaattcaccatcaggattaaggacttcttcgttgatgaatcccatcagttgttcttgaacagccgtgataaaatccttgtgtgggagattatccctcatgtgaatacgctatcattcgaaaaataatgacatatcaatatatgaaattaataaacaacttaacaaatcgatacgcaatgaaattttgaatggtttatgtatacgtacatcgagctctcgtgttgtgcacatttggtttgataggcagtgggcatactcagtagccgcataagttagttccctggtcctgctttgcacactacatgagaaacgatgagagatttaatatactctttatattaactgtaattagagattcaattcaatataattttggatcatgcatgtactcactggaaaatgaaacctccgtccaagtttttctttctaagtcccgcagaccaattgacggaaccgatcccaagccctacatatgcagttgtaagctatgattaattaattattacccgagatcaatataatagcaatagattccccgcgactttggaatagatgacattatattacatgtctatcagttggaagaccttgtcaaaaatcgtctcctctttattcattgagtcgtacatagtggctctgcatgcgtccaagttgaagaataacaggacccggtggaatctggaatatgcgtgagatgagatatatatgaaaatatacatgctatatgtatgggaacgaaatttgtttgaacgacaataaaaactcactctatgttgtacggcagtagtatgtacgtcttgaaatgctgctgcgttaggagatggacgagattgtcctctgtgtctttcttgtacttgtcgatcatttcggtgttgattttccaaggatcgatgaacccagtatcgtagaccctccgccgtcgggccctttgaatctccattctacaacgttgaaaggaaattattattgcttacatatatgccaggagctaattattgaacgaaacaaattgaactcaaagatactcacaaaatccatgcgctcagaagagagacgtcgagagcgtccagatggtacagatcgaagagatccttgaaatggatccagagaacatcttctccttgcaagaagtcagggtttctgatcctcgctccgaacatctctctacccttggcgctcatttccatgtaccgttcatggaat

SEQ ID NO: 12058 - DNA, 7415 bp, Oryza sativa
atcagctgatccacagttagaccggtgtctgaaatgaattctgttatgccaaaatcttcgccggtcaccaacggctcgacctcttggtttggttgttctccaagctgagggactggtttggacttcttgtgatagggctctctgaagtgttcggtcatagtccgatatctgtaaagcctccttgtttgttgcggacattcacttgaagaagttcttctcgctcgggtcaatatgtatcttcttttcaagactccgaggcttgagttgcctcttcacttctcctgccacataagcatcaagctcctcttgactgcaatcgtacagtggctccttgttttggtggcgtcaactttcgccttcttcgttgcccttgtgcgggcaggcggtggagcttggcgagaccttgtctgggaggtgcaggcggacacggtggaggcggaggaggcggaggagctggaggagccggaggagatggtgcaagaggaggtggcggaggagccggaggagatggtgcaggaggacgtggcggaggaactggaggagatggtgcaggaggagatggcggagccggaggagatggtgcacgagacgccgcttgtcacccagggaggatgatgtaccgcttgtgccatagtataatggcgtggcttgtgtctcgtagatacgtctcaacgtctcctcctgggtagtccaactcgaggtcctcgtacgcggcttccaccagctcaacttcgaccctcgagtatcctgctggaatcggcctgcagtggtaagtcccagaagggtccgttgggatggccattcccgacgccacctttacgtgatgagaggttatctattagtaatcaacctaagcagtaacttgcggaatgtacaagtcaaaaatcatcaaactacgagcataccttgattgataagttcttgaagggaatatgcagctcacatggtgtccgctgcgtgatctcatcaatggggcaggtggtttcatcctgggtttgcatggcgtctatgctctgtgatcctacttgccccgttgaggcgcagctactacgattgcctgatgggctgaccattgcaggaggaatgtacggttggggatcctgggacagatgtgcggccatacgttcatccaccttcctcttgcatgctgagctcgtagctcaataccctgtactcaagatctgcaatcttcacctcggtatctttcttgctcctcatccgactcctgtacgtgtggatgtcctccttaaatccaatcttccagggaatcacgcctttccctcgtgttcgtcctggatgctcgggagtctgtagggcgagtaacagctcgtccttctctctgtcgggtcggaatgtgccctgagaagaggcttccactgcgtccgttagtcgactggcagcctcgcgtatctgatcgctgaagacaagggagccatcaactgggttaagcgttccaccgtgagcatagtaccagaacttcgatcgatccggccatttagcggtggccggttcgttacccctctcaatcaaacttgcctccatctcctcccacttcggcattgcgacgctatatccgcctgaccccaagtggtgatggtacttcttcttggcggcattttctttgtttctggccatcatcgcttgcccttgttgccctgtcttgtaagcaacgaactcgtcccaatgatcccttagctttgggaatacgtcgaagtttggtgttagtctcttcaggatgtatttcttgtagagatctcccttgaatctctggaactgttctgccatttttctttagagtccactgtttcactatgttctccgtacctgtgggtagcgtgaacgtctcgagcattgtggtccacagcatctctttctctgagtccgggacaaagctgtcattatccccgcgtgcccttgttctgtgccagtacaccgtgctgacaggcacgttgtccctcacaacccaaccgctgtggcgtacaaaattcttggctgcttctgctgggccactaggtcggccatcttcgtccacctcagttatgatgtgccgaccctctatcttcttcgcagcacctcgttgtccgcgtgccctcttctgtccagcggagggatgacttccactggcctcctcatcgttcccctcctcgttcccctccgcatccctctccacgttcccctcctcgttcaagtactggtttggatcctcgttcccctcttcttcgttctagtactggctgcttccctctgcgattatatcatacagtatatgttcctcatcgctatcagccatctgtgcatcaaaaaatatttgttagatctataggtcatatttgctaaccgtaatattaaaactctactaatcttatattaaatctctaataatcttatattaaaattgtaataatcatatatgctaagtctaacaatcttatactaaatcggtactaatctcatattaaaattgtaataatcatatatatatatgctaagtataacaatcttatattaaatcgctactaattttatattaaatctctactaatctcatattaaatcgccactaatcttatattaaaattgtaataatcatatatatatgctaagtctaacaatcttatataaatctctaacaatcttatattaaaattgtaataatcatatatgctaagtctaataatcttatattaaattgctactaatctcatattaaaattgtaataatcatatatatatgctaagtataacaatcttatattaaatcgctactaatcttatattaaatctctactaatctcatattaaatcgctactattcttatattaaaattgtaataatcatatatatatatgctaattctaacaatcttatattaaattgctaataatcttatattgaaaatgtaataatcaaatatgctaagtctaacatacttatattaaatcgctacaaatcttatattaaaattgtaataatcatatatgctaagtctaacaatcttatattaaatctctaataatcacttctttacatcacttgcctgcgcgaattccttcgatggctagctaccacttcggcttgaggaacgacgacgtcgtcttctctgcaacattaccaggaaaatgtattagtctaaacgggccaagttacatatatataatcatatatgtattaccaggaaaatgtattagtctaaacgcgttcgttctcacacttttagtacaagtgcattcacgatcgtaagcatttcgttcacgttcgttcacgctcgttccagttcgttaacgtttcgttcacgttcgtttgcatttcgttcacgttcgttaacgtttcgttcgcgttcgttcgcgttcgttcacgttcgttaagcgttcgttcacggtcgtccacgtatcgttcacgttcgttcgcgttcgttcacgttcgttcgcgttcggtcacgtttcaatcacgttcgttcatgttcagcaatgttgggcacgcgcggcagtggtgtggcggcgcggcggcggcgtcggggagccgtgggccggcccggcggcgtgcgggcgcggcggcggcatgccacggcgatggcgtgggggtccggcggcgtgggggcgcggcggcggcgtggagtcgcggcggcatggcgtagcggcccggcggcgtggcgagctcgaggcgggggcagcggcatggcagtggcgacggcgtcgtcggcggtgacggccgcgtcgaagtcggtcgtcggcggtggcggttgaccgcggtgtggcaatggcgtcaccaacgagctaggcggtttatagagagagagagatcgagaacgagagagagagagaggcagcggcggctctcacccaagagatgtggcggcggtgtctgcggcagaggcggcgaggaccgccaagcgacgacgagagacgacggcggcaagatagagcaagaatgattacaaccacagtactcagcaagtctcatcgggagatgcatgattaatgcaaaggagtacaaggggtaataatataggggttaggttttgcagtaaagagcatttaaaagacacttagttgcccaaagctattttataaacacgattctagagctacacaatattattaatcaaggccgtggaccctcacgaacctgccttaacccaaggcctacgatgattcggaccgaactggcaacccgacctgggtcccagctcgtcccaagccaacccaggccaaccattccacattttagttgttaagcaagttttaagaattaaaccactaacttggatacattgctaagcttgcccataaccgagcgcgaggctattcgaatagatttactctgatcagaggtgtacatctttacccacaagacacatctttacttcgcattccatggccttggaacccgttgtaaacatgtgacataacccttcacccatcctagccgtgaacaaaagtaccgacccaaccctgcctacggccggtatcccggacaagtaggccaggattgagcccctagcaacaggatctagaccgggtgcgccacacacattggggtgagaccacccgcgtactagtccagtgccatggcatctcgactaacgggcaccaacccatgtagccttcatttgcctagacatctcgattaccgagccgcagctcgtgtagccttcatttgcctcagagatatccatcatcgcaacgacttcatccacctctatccgtgtccttttgttcaggactagactgagcaccgagttaagccttacccattagacatgtggttagtatagtagtgctttgcaacagaggcccgaagaccggtccttatgatagccgaggtgctcctagcaaaaccatgcacctcgagcctagcctaaaaccattttggaagttttgaatagaggggggaggtgtgtgtcaattccatcacaagtcaaccatttcacaatgtcaaaatgatatgagaactcccaaagtctaaagttatgaaaccacctagtgttgcctaattaatcagcgaagcatctacataaattcatactagtggaaccatgaatagattacccactagttggggttttattttcctagggtgaacaaggtgataaataacaatagcaataataataaggtcataacaaaggttaataggcatggctaaataaaacaatgataacgcgggaatttaaataaagcgataattcattaatttaaatcaaaataattttataaactgggattcaatatgctcaaggataatgcgacttgccgtgctcagagagaacagccttccgaaccttcggcgatgaccgcgaacctcgctaaccgccggaacgacagaagctacgcggagaacacaagcaaagctacaagcctataaagaagcaataacaatacataaaaagaaagcgcagggttctttaggttataacaaacattaaaagacttgaactggtcgattcggagttcgtatgaccaaggcatggtcatctgaagcttaatgctgttatatggagatttgtggattattataattaggttttgcaactataaaaaatgtgtaagcgctagcctaaaaaagacaggaaggctgcgctgttgacatgcggaccccacatgtcatcctaaggaaccacgatagaccgagtacacagagacggtccatgggtcgacggaagcagaccccgtgtgtcaaccgaggcgagtggccgacaaatggactccactagacaccacgcgggctgcacacgtggaaaccatgcggctaccgagcgggcacactaacacggtcaccacacgcacacacgaacgactaccgacactggtacacgggtaccggggtcgataaccgcacaacgggcaaggggcaacaccgaaaagacgaggacggggcagcgggagaacggacccttaccaccacgtgatgaggcgtgggaacgacgacgacgaatggctcggtagagacggacggaaacgacggagatgaacggacgacactttggcggcgatccttggatgaaggcgagacgcggccgacgcaacgcttgacgacgcggagccgaggacgaagacaacgacggggctgcgacgcactcttgacgaaacgcgggcgacgaatgagcacggcttgacgaagggagggccgacgacgagcgggaacgacgagaagacgacgagggcagccggcagcagctgcacggagacgaggacggcgtggaacgcgccactgcgttgtcgacgatggaggcggcgccacgggacgacgagccgacggagaggaacggccgaccggaggagacgttggcgaggacgaccggcgcggtggcctccgggcaaagacgggcagcggtcggggtagaggacgacgcggcgacattgtggtaggatggcgacgatgacagccgctgcactggtgaggcggcacaggcggctggaggcggtggagtggtggcgacaccactggtcattggcgaggacgcgtctccggtggtttccccgcgaaacggaggcgatgccggggaagaggatgcacctgcgaggccgagggtggcgacggcgcacggtcgtggtgggaggtgcggctggaggttggccggcgccggagagagagaaggagaaggcggggagaggcggggcggccacgggagagcgcgggagggggctaaaactggagaacggaccgagggggttccattttataggatgggggagggagccgggcacgggagaggtgggaacggcagcggaaaagtcggccggtggccatggaaagcggccgggattggcgcgggcgttccgggtgattaaaagcacgaatcaagggggaaatatgggggaaagagagaggaataaatgggtattacttccccctatttaattttggaatctccggtttgaatgaggtggatttggaggagggaacgagctagggttcacgggagagagtgaggaggccgggcggctggaggaaggagacgacgaccggcgcgtgggccccacgcgggcgcgcggtcagcgcgcgtgcaacgcgggaggggagcggcttgggccaagagaaggagggagagaaggaaagggagagaaaaagagggaggaagggaggaagggaggagggggattatttttagtttttctttttagtaaactttgatagttgttgttgttgcttagtaattatttccggtgttctgaaaattcaaataaaatttgagggctccttttagaccaaggagaatttaacgaaaattcttcgggccacattcgaatttttcttgtacgcattttaatgtttgccaatttcttttcaaattttaattaattctattattccttttagagaatgatttttatttcgggatgaatttatcaggacgtgacaatgagggcgcaccaggaatatatatacccccagatctttagtcccagttggt

SEQ ID NO: 12059 - DNA, 2158 bp, Oryza sativa
caccaaccgggagtaaagatcttttcctgctatttccaaattctttttaaacccggttagggttaagaaccgggactaaagataatagcactgaattttgaatttcattacatatgtgtttctaaaatagtaaataatacattacaattatttaaagtcgaacaattaatgacaaaaccttcgaaaaattattgttgtatgtcgtagaataagtggataatatataataagcacatgaatgatttaaaattgttaaaaattctaataatcatatatatttagcatatgcatgatattaaattgttaaaaattctaattaacatatgtaaatagcatgcatgatttaaaatttataaaaattctaataatcatatataattagcatatcatgatattaaattgttaaaaattctaattaacatatgtaaataccatgtgcatgatttaaaacttttaaaaattctaataatcatatataactagcatatggattatatcaatttgataaaaattctaataatcatacataattaacatatgccatacaacaattgatttgtatggatattcaatacatccaaaatagtttacatcgtgtacacaacaattacggcaatacatcggcggtgacggttgacagcacgtactttctcctcactattgttccttccttgtgatcgctacgtgagtaaggggtgtcttcatttgataggaggatgctagggtcaatcatcaccgtgaaagggggttgcccatcaaactgattataatcctcgtcagtcttgtcctctactccgacgatttttctttttcctgggagaaccacgtggcgcttcggctcgtcaggccctttgcccttttttcctttgctagacatgtccttgacgtaaaaaacttgcgttacatcattggcaatgacaaaaggttcgtccgagtatcaaaccttgttaaggtcaaccgttgtcatcccactgtcatcaatcgttacgcctccaccagttaacctaacccattggcaccggaacagagggaccttgagaggtccatagtgaagttcccatatgtcctcgatggcaccgtaatacatgccagttgtaccatcgtgtcccatggcactattctggttcgtgctcttcatgtcttgggccctcgtgtagaatgtgtacccattgatttcatatccctggaatgtcgtgatcgagccagatggtcctctcaccaggaaggctagtttttagttaatcgtctcgttacccatgagatgttgtcgcagccacgcggagaaagtattgatgtgatgccgtgtaatccatgcatcggacttaccgatgtttctggcgtgaactagagcaagtgctcctcgatgtagagagccaccaatgaagattgttgcagaaccatgaaatgggctttacgaataaattgttgtctaccgtcattattgctttcgttccgagagtcccctttccccgtagtctcccttcatggcgtgattcaagtaccccgattgggcgaaggtcttcgataaattctacgcagaattcaatgacctcctctgttccataccccttggcgatgcttgcctctggacgagcacggttacgaacatactttttcagaatgcccatgtacctctcgaaaggaaacatgttgtgtaggtacacaggaccgagaacaccgatctctttgacaaggtgacaaagcagatgcgtcattatattgaaaaatgaaggtggaaatatcaactcaaagctgacaagacattgcaccacatcattctgcagggctgctaatctatccggatcaatgaccttctgcgaaattgcgttcatgaaagcacatagctttgttattgttgcccggacattgtctgggaggataccccttattacaactggtagcagctgtgtcatcaacacgtgacagtcatgagactttaggtttgtgaattttttctccttcgtgcttattattcgctttatattcgtggagtatccagacggtaccttgatgctctccaagcattcaaacatactttccttttctgccttaataagagtgtagtggctggactcaagtaatggcttcctttctcaattggttccgggtgaagatagccgggttgttccatatgcttcagaccatgacatgggggatc

SEQ ID NO: 12060 - DNA, 727 bp, Oryza sativa
ataacatgccaatcatgtagttctagcagtgcaaagtaaaaatggtttaaaacaatgttggcaaagacaacatggataattataaatcgaagtagcagttaactatatcatgaaaatattccaagtaaacatggaaataataaaataaattgtctttaaactcactcaggggaagtgatttagtttttagtcatgaaaactaatgaatttattctaaacagaaagaaagaatggaaatactagtaaattgcaaaagggcattattaaaagtactttgagggatggttgtggcatacaaaacttttagcaacaaaagatgtagtggagggtgaaaataaagtgcacaattacaaacatttgcaccatagtcactctttacaactttagtcttgcgcatgggtaactgggggtatctaccatcaacaaatgcaataagaattccaaaaaagcattacttctgcgctatttacctgaggaagagggatcgttgcaagtaggtcaataaagaaatctgttctgagatatctccgttgaatcttctttaagtccaagacaagctctcccttcccaagtactctggactttggatctacatatgcagtatggaacttgaccatgatgttcagcatgtaaaacaagtccgcaaatgtcctaagaacagtgatagttatgctcaatcgccggtccttgggaatgcatgaacaggtggtactttcatctaatacat

SEQ ID NO: 12061 - DNA, 6391 bp, Oryza sativa
ctttaatcttctcagtagtctttgcatctatcctgtttaccccaaatctgtcagcccgtgcagcttgaaacggtagcttaaactggtcctgtctctcatcaggaaagatcctacacatagaaacaacccagtaaggaaaaataaactgcaaaaatgttatctctgaatgtgtattatcttttgtgcaaatattgggtggttccaatcagaaagggtaacaattagaccagaattgcatattgacaacatatcgcctcctgtgtccacctgttcgcaactgcggatcaagctactacattaaaaggggcaaactaaatctgccgtataaattgaaactttcctccttacatatgcttgaaagaaccgaaaagaattcctcttctgcatcaagagacgaaaaggaagctacaggattaaagaatcacaagctggcagcacgcacctgttggtagtcctcctctgcatctccacctcatcctggactcgggacccaaacatggcggctgctccccttccccccggaccaaatcttgctgtgtcaactgaggaggccgatcagaggagcagacggcgagcccgatgcttcttcccgccccaaatcaacaccatggcaagtcctcctcctgcttgagaagacttgccaaggactaggatggaacggacacagaaatttttcttcccctttttcgttttcttttcttttcttttcctttcgggagaggcgaggaagaagaagagggagttggaccaattactccctgccttcctgcttgttagcttgagccacacagagagtccacacgaatttgtaccatgtaactgacatgtggacccacgacaaacagccttggaagtatctaaaaaatcgccccgtagtttttttagtcaaaacctttcgcatgtaatataatggaattgaagtgtaattatattgtaacttagctttaactatactgtagctacgatataacttatataaaacttatattcaaatatggtttggtttgttagtgctaggatcttgcacatgagatgtgtaaaaatttctttcgagcaaattttcttcttcatacataaatcttgagttctcaacacgattctatagtcacaaatatgaaagttttaggggtaaaaaaacttatgaaagttttctagcaaatctgaacagccttttctgttttttccctattttttaccggtggaaacggagagagaggtatcagtaggggttcgaatcacgataaattcacgaaaataataaaataaaaatggtagtatcgtttttaacgtttttgtttctagctaaaaataaattttaccttttatttatatcaacatcgtaatacatgaatatatataaaaaaaatctcgaccgtgtagataaattcagggatgtggagtcattagagggcaattaaatgggatctggtttcactatctgataaagtgataagtatgctggatcaaacaaagtcggatgagatcttggaataccacattacagcataaaagtaaacgacagtgtaagttccaaccattttaatcctgcaattaacacggccaaagccatattatcaacgcaataaaatatcccgcaagaatcttatcgttggatgttgcttcagaaaacacttcgcaacaatgagatagtagaataatgatacatttggctgtgtatataattcgtgatttggctgtgtatatcatttgtggatctagaggccggattaatgaaaatccattatctaaaaaaagtagaatgatacatacgatggctgtcagtcaaaaaatattaacaaaaggaactcaacaactttcttcaggctagttactgattctaaaactgcttctataatcccccactgaatggggacaatcatatcatttattgcattttacttttacagctaactatctcttcgtacatggtgaagtcggatcaatcaaagacatacatttggtgcacaagaacaccaaaaactacaagcctgctttctggattctggacgatcggttggtgtttcaatcaccctgaacctgaaattcataagcccaaaagtcagaagaactgctcacagcgaaacaagatgaaatagaaagtgtaaacatcattcaacatgtttgattacaatgaaaaccgcgctttcagttggcacttccaagcaacttaaaagaagatcaaaaaagataatttttgagatgtatttgaagatggaagcatttaaaagttcagaaattcagatcggtttcaacttgagggcataaatgctaatccttgaattgtttggtgtgctaaccttgccttttatcaatacaaagtaaacataattgcactagcacaaaccaatacttagccctgatagtactggtacatgatcacttgatgattgattctgaatatatgctaagctgaacagatttagcaacctgtgtcgattttctcataatctaatttcctcttatgcatgaaaaggcttacatggtccattttgataagatatggaatattagcgtattcaatcaaatcagataaatatatgcacagatgcacttaaacacatccataggctgatccagtattttttttctccagaatatttgtaagttcaatttgtatagattatggtagcattatacagtcagaatcactttcaacaagcatgcaattgctctttcatttttatgaattggacacctctagggttatacgaattttggattcgcttttgaaggagagtaggagaacatagcaaaattttgtctattcatggcttaacccagtaggagtatttttatagcatgccatcagcacagttgattatattttcattacaattttattacttagcggttgtatacaatctttttaatgtaaggtctgatcatttaggtaattcaggtaacatgtgtttgcaacatggaagatcgctctgctgaggtcgcacgtaattgtactttttgcagatcgcaatttagtctatgcactcctacaatcaaaatcttgtactaacgaaacatcatgtgtttgcactataccacacatgcaatcaagccgttctgtatttcagaacatgcactcagaaaatatcagcttctatcgatatagttgtaccgaactccaaaaatttggaactcaaagactatgtagcgcataattacactagacaaaactcaacaggctggaacttcctaatctattagtgaactccagatatagcaaatgccaagtaggagtacttaacttcaaattgcatggaatgtttgatagctatggaatgtaaagaacaacatatacccctattaagttagttaactacaaccagtttattcgcaaattgtcatgttgatactaaccattttctcctttcttggcatggttgtccacttcagctgttacagatgagctaccaccagtcttgctgctgcactccttcaatctctttgcgaaaagcttagcgatctgcaagtgcgtctttgccataatctctgtcctcttgagctccatctcacccttcttaatctcagcctcaaccctcatcctctttgtttccctgtacaggtccattcttgcgcgctcaatcttcaagaatgagcttgccagcaactcgatgctcttcgcgatatcaaactccgtgttcttcctcttcttggacatgtcccataccttgtccacctcctcggcatcctcgttcgcctccttgatcctcggagagctcacattgacatcactctctgcagctctcccctcaacatgcccactgttctcaaccttgtccaatttctcttgaatcgagccgtttgcatatgcactcaccaattcagaaagtgcacccggccctgcatcagctaactgactgacgaaatctgcatcgacatcgacctcaacctttgcaggaggaggagctcgcaggtctatgctgttgctcaactccgcctgcggctggccggagccggcggggcctttgagcaagccgtccatgcgggcgaagaaccgccacgacgggccagcaccggcggcggcggggccggcgcgcgccgccgcggcggactccgccctgtaccgcttcttcatggactcgatcttgttcttgcactggttgggcgtcttggccgtgctgctcccgggcttccccgtggcggcggcgttctccatggcgcagtgggcggacacctcgtgggcaatgtcgacccagtcgctccacttgagcttggcgcggttccgcagcagccacttggcctcgtacgcctccagcagccgcacaatgccgctctcgctccactcgtcgcgcttctgcggcggcgccgccgccgccgccaactgcgccgcgtcggcggcgtcaggaagggcatccatggcggcaccacggaggaagcttaaaattctgcagctcaggcggaagaaccggacccgaattgcggtgtcatccgctcgcctctgacatgggggatctctcttgggcaacgaagctatcaacagagactgaattagctgaaaagagatcgccgcgaagcacaaagctttgctaatttagtgatgagacagaaagatcaaaaggaggagacccttttgttccaaagacccaacaaaaaaaagtgtatttttggagacgacgacttgctagatcaaaaaggggaagctcctcccctcccctccctccactgttgatgcgtgcgtccggcggaatcgctcccagaccggcaccggcctgaccgactaactgaccgaagaaaaattcagcagcagcagcagcagcagcaagaagaagaagaagacggcaagtaggaggcgaaacagaggcaagaagcagcaaggtcgtcaagaacactgaagactgaagacctcgaaagaggagagagacagacggagagagagagagaagtcagaagaggatccgagctgggaaatgcgagagggagttgggggaagggaaggatcgggcgcgcggggggagaaaggtgggagagggagaagagaaggagaacgatggtggtggggaagaggcggaaagtgggagaccgtcgcggacaactccgtccgtccaccaccaccagcagcaggtggcccccgtgggtcagcgaggcgaggcgcggtggaccgggcgcatgcgggatcggaggaggaggtggtggtggcgcgcgtcggatcgcattaggcggaggaggaggcaagggcggaaggagagggagtggagggtgacgccagcgctgaccggacggatccaacacccgcgccacggccacgccaaggtgtggtgggagccaacagccaagcagccgcgcggcggatcgggcggatgctgcggggggctggagtggccgagtgggaaatgcgctgccgccgcgcagagagagtactggctgttgctgcgactgcgcgcggtggccggcggggcccgcgcctgggttgggttcccgttccctcgttttccacggcaggcacgagacagcaaggcaggcagtcgcggcgcccgcggttggtgaccactgaccacgcctcgccctggatttcttctgttttaccccctttctataaacttattttacatatatagacaccatcagcaaagctttatttcaagtttagactttgggaaagatgaggtccaacgtcacagcgccggagtctttggtgctaataaatcctggtcactgattcggcacggcagcggccacaaccagatggactgtcatgaacaactcaactgtggtgcgtgtccacgcaaccatagctcacttcaccataccgaggatcaaggctagagatcttaacaatcgccaaaatgccggtccgcgtgctcacacaaagtgacaaggtgtcaactccctcgacgccattgacttcagcatagcgttggacctaggtgcaaaagtaaaataagtttctaagggttcatttataagagtttttttaaaaggttcattcgtaaaataagtttttagggaagggctgaaatgtaagaaaatacaggcgcctcgcttgcctcggcgccaacggccatccaccaaaggcgcgcgccgtcgctttcggttggggtttggggcttccacttgtccgcggttggtgggtggcggcagccgcctgcagcggcatcttttttccttttctttgccctcgcatcgcaggcagccaactcccaactccagcctgcgctgcactcaactgcaccgagtactgcctcttctccgttaaaaaaaaataataataacccaaaaggaagtaccatgaatctgaataaagaattattcagatttgcagtactaaaaagatagattgagtttttttaacagagataatactctctccgttccctaatataaagtattttgatattttacatactatgtttgaccactcgtcttattaaaaaaattatgtaaatataaaaaatga

SEQ ID NO: 12062 - DNA, 749 bp, Oryza sativa
aattttggatatgatgtgatgtgatggaagttggaagttggaggtgaactaaacacggcctttatctatgtgtgatatctgcaaaatcttagatcatgtcatagttactatccagcccaagcatccaaattggcaaattctctagatgaaggatgatgaatcaactgatgaccacattttcaaacccatatgcattgccctaacggaaaggactttaaagttgcatggagaatatgccatccaagtcagtggtgagcacaaaagagtgtactcatcctccaaatcctacctaggattatgatggtgagtggtgcccactgatcaatccacaaacatggagcagaggagacgtccaggtcaagctcctcttgaatcttgatgatgagcaagcagcagcagcagcagcagtagagggacacttgccgacctgccgaccactctgctgctgtctgctccatgtttaaccacacgtttcccattcactgccagcgtgaggagccatgaaatagtaacccggcacttaaccagacatttctctcactgaaactatagacgcagtcatgttgctgctcatgttcgggagaacgtattttttccgtcaaaaaaaaccattttcacttgtcgggattcattccaagaagctttttttttttttttggatagagggacttcagttaagaagatgcaaaagaatttgacgatactgtttccccagggaagaaaaaagaatttgacaataccagctggta

SEQ ID NO: 12063 - DNA, 1333 bp, Oryza sativa
attcctgcagcccgccctaataactttatgcccagtctatgaacaaagatctggaatgtagatgccagctagttagagggaaacttgtatattgccacaacatttcccggttagcaccttgcacagttgcacgttaatgtgaactgtaaggcattgctggttgctaaagagaagaaacactaatccaataagagaaaaagataaaatattccaagtgtttatacatactaacctccccaactccatagctgaccatctgaagtcagagccatagtgaaaaaaccaccacaagccacagcagcaactgaaacaggcagagcgttcaccttggaaggaacactgagagatccagcttcaccaggaccacctccacttccaagccccaacctaccatcgccttcatcacgaccccaagtgtagagctcacctgttcacaaaagccacaagatcagggctgaggcggtctgacaatcacaaaatgccaatattccaaagcattcaattgtgaaaggcagtggaagattatccacaatgtctttcaccctttcaggtttcagcaatcagcattaaccatgaactggaccaacctgagtcagtgattgccgcagtatgtgctccactggtagcaatgtgtgatatcttcccttcccaaggaccattcactttccttggcaacaattccctatggtaaacataatgccccaaagcaccaaatccaccataacccctgcagactacagtaaactgagtgatgcagcagccaaatccaataaatttgcaatgcattcttcttgcagttcatccagcgagcactcactcactcaagcatctattattattattattattattatctaatcacaccaaaaggaatttcaaatgagcaatgtggtggtggtttcctcaccaggtgaagacttccccggaggcggtcagggcggcggagtggatgccgccgagcgcgaggacgcggagctcgctgaggttggggttgtggcgcgggacgaaggcggaggactcgtccccgaggccgaggcggcccccgtcgcccttgccccacacccaggcgccgccgtcgacgacgaccgcggagtggaacagcccgcaggagatccccacctccacgccccccgctgccgtccccgcggcggcggcgtcagggaggcgtccgggcgtgggggagagcaccggcgcggggtcggggagggagaggtgcgcgacgggggacgggtagaggcggcgctcctccttgccgccgccgagctgccccgacgcgccgcggccccaggacaggatggacaccggggtggtgccgctcgaatagagggttggc

SEQ ID NO: 12064 - DNA, 1531 bp, Oryza sativa
ccctgtgctggatccctccggcgatcgcgatggccgccgcggccgccgccgccacgacgtcctccggggggcggaggtcgctgctcgggttcgtggaggcgcaggggaactcctcctaccggtgctccccatccgggccctgcgtcccctgccaatactccgagaaggtcagccggttctatgctctgactcttgtcattcgatcttggggctcaccgtggaggggggaatcgatcttgggagggtgaaacaagagggacgatgttgcagtcctgcaattggattggatttgggatttttcaggactatattcctaatttatttttcgatgtagcttatgaataatccgtgttcttggattgctacaactgaagaagtgtgcacattaagaaacgatcggatcttgattaaagttaggcccgttttgcttcaaatctgagtttcttctttgactttcgttttggtttgcgtggtaatagttagtcttcggatggcacatatcactatatcaattatcaggtccaagttcttgatgccatttattagttggagtgtcattgatatggtattgattattgaagaagataatccttttacagtaggatttatttagctggtgatgtttagttcatctccttaatcactgtatcggtttgcacaataaagatatggccaagtgataatggattcagcgaacttgcttcatgtgtaatatgattgaggggttgctaccatgtgtgagcttgctggctttgttggaataaattcaaataaaggactttgttgctctttcaagctgttgatgattctataataaatagcatttctaacataatgaaatttagttctttcatgcaaagatttataggaaagttgagtcttattcagccttttagtgattatagaatcgtaactttgtggtttgtgctctagctgatgcattaaaggtgcaatattgtatgttagagtgtatcaaaaaagaaaggggcaaattttatgggttgagggaaatacatatattatgtttttaagttacctcaacgatttctttgtttctcatctttatgttattcatgatcttaggtgtatatcttgaagatacataaacagagttttctacttttccattgagtgggagatgaaccttttatagttatatgtccttttgtgcatatcatagaatgtcaacggggcattaatagtttaggaaaaagccttacatataaatgattccatttatgttatgcccaaaatcaccaacctacaaatattgattgaataacaaatggaatttatattacagcctgatggggcaggccaacagggtttgtaagaacaaggatgtctcgcacagtgcactttatctttattggtcagaatcgacacccattaactcttatccccagtccccacccccgcaactccttatactgtcctatcaagtaattaacttcctattaccacgtttcctggccttttagaagatgtgatctgaaaattgctggactgtgctgattattagtagcttttg

SEQ ID NO: 12065 - DNA, 7946 bp, Oryza sativa
aagcttagaagctacttatgttgggattttgctgtcgtgcagatgactctactaggaaacctaatttgtatagttatattcgcaaatacatgtgccagagtctttgtgcactgtgctttccctgaccaccaatagatatgcctgctttcagctgctgctcatttttgctttttccttcatatttgtaatggagttgaatactttgtttgtgttgagtcagggctgaaaatatcaaattacctctgttgaagacaactatcaactattgaaatggcatgctgacatacaatttcattttcatttttgttagagcgatgagaagtactgttgcagtgaaaccggctaccgcttgccattgaaatgtgtagaagtacaaaatgttaccaaagaaggaaataatactaagcaacggaaggtgctggacgatgcatccacgtcaggtggttcaaagcattacacaacttacaggagttgtgtaccattggaggatgaagagaagttatctgttcttggttttgaggtattaaatcatagaacttctctctgttcatattgctataaagattatgcctgtctggctgtctgccatcaatttattccctccagcataaatttttgattacattaaaactgtggaagtagatagtgtaaagccagaaactgtgaaatatttatctatttttttaagaacgttgggacgagatttaacctatcacacttaaacaggagcaaacacatgaaccacccttttttctgtcagtatgtgcctgtctggagctttaatttctggttgattcagttgtgagtattgtcttgtttttttcttgtgaaaatactatctatacttgtgtaccctatgaagcaaagtgtacgtttctgacaaaactttattctgttaaggttatatatgtgtgatcagtgtgtcaagggttttagtcttgtcctgtattgtgtacaatttatatgttctttgagcctaatccaaaatatctatttcattcctcattttcctgttcttcctaaattaaacatcttcatggctcttaatcatatcatgattatctatgacaggtttttattctttcttatagcatggtaatttaaggaagtttatggtctttacaggttatgatggctggaatgctgctaataagtggcccatttgtatactatcggaaaagacgaacagctataatgcagggggcttcaaggatcccaacaagccctcctaggttttaagtatgcaatgatgaatcggctgctcaagctgatttggtgtaccattttgatgatttttcccccctatcaatgtactgtatttacacgtgctattgttgaagaagtcaaagtgttgggtagttcttacaggattagaaaagcacagttgctagtctcattgtgctttgttttcttgaatcaaatctttgtaatgtttatatgtaacaaattactttcgattttgttaccccaatgaagttgccctgacaaaggagactctgttgttggcaatcaactatttgtctcgcagtgttatctgattcactgcagaagtttgagtctctacgcaaggaaaggtgtcctcatatcacaatggtcatcaaaaattgttttggaataactctttgccttttggcttcgagatattatcttttgagcatgggtagttcagtaaggattttgtttagtttgcggccgcatgttgcctggtggtgtcatacctaaagtataaactatcttgtgatatgaggacaacttacagtgatatggggttattatttggtttgtgaccatcataagttaccttacagtgccattgtttggtcaaaataaccattcttatggttctttatcatacttgtgataaaatgtcttcttcatcacaaaggtttcacgtctcggtctcaatgacaaaatatactgccccgttctaacatgagcaaaattcctgatattttagaacggagatagtaacaaatttggtctcttcctagcaaggtgttgttagagtttcaaattgtaaaccaaatcctaaacggtttggtggtctccgaggctctaaaagctaaatttataacctataataaggggtgaaaatggttttttaatggacgatcctttagaatggagctatagtattacaattgtggtcaattgatttcgatggcatctggcaaaatctgtggtaaatatgcataggcaatagacatggtactatgtatcacataagattagtgtattacgatataggtgacaccgttctttcagttttatggattcaattctcctagcgatatgagagtccgattgtctctttacaactcagatgctaatagtcgatagataataaaatagatagatccgttcttacttttgtggtcaacaagacaaaagaagttcctgtataaatggagggatttttaccggtcaaaagattcacaaagatcaatagaattagtcataaaatagcaaatatcgtaacagttgtgtcatgattataacttcatcaaacagatgatccatcatgatcaaccaagtttcgcaaatgatatccctttttccccaaacacgaaaactcttttgtgtcattactgcctctattgtctaggattaaattcgaattctagcagtaacaattttgagagttttctttacattctttttttttaacttctctattaaagtagttatagaatgtaattttgcgaaattagcagggactccagtgcaaaaaagggtgtccacaacacaatccccaattcccccgtcaggctcaacaccacactcgcatcgcatcccgatctgattgaatccgagcagcacaagcggcggcggcgatgggcggcgaccatggcgggcacggccacggaggcggcgacttccggcagaaggtatggagcatgacgggcgggccctactgccggcccgtgcactggcgccgcaacaccgccatcgccatgttcggcgtcttcctcgtctgcatccccatcgccatgaagtccgccgagctcgaggtacgtctccccgccatccaaaccctaccacgtagtactagtcacgcgccatgcttgtcctttccgcgtatctggtcgagctgatccgaaatcgctagccgggagatgtgatccgtggggaatggaaatgaggagcaaacaatagatagggtggcagaaacatttttgttggggtcattacgaatatgaacaagatttacgttgttgtgcatatcaggaactcggtgtgcagaagaagaaatggtaatagctctattgggaacctatggaatacgcttaactcaaacctggatgaaatgtttgagtaatattttcgtgtaatacctttgagttgctctgggtagtaaagtgcaatagaatgttgaattgttgatttttcttgttagaggagaagacattagatagggcaactgggagaaatgctagatataaaacaaaaaatgtcgtgcaattttccagttaatctagacaaaacttgaaatgaaattacttgttcccgttgtaaagcacatttgttctatgcacgtgacaggcatgcctgttcagttagttttgtactattgtgcaaacaaatgctaatatgttctagtggtagctgaatctattcaatggagttctgtaatcagttcttgaataccagtttctaccatataccatatggtggttaagattattattcctcgcttattagacaaactacgataaaggccaactttgtcagtaaatacataatttcatgagtcatttagtaattcttcttgatttcctcaaaacaatgagaaaagcttctttctgaaccccctacttggaaagggatttattccatgttcctggctgcattatgaccattcagtagtaggtgtgctactggtgggatgaagccatctaggataccctgtttttgttttgcaactagatctcaggaggtttgttgctaagagatcttgtagtggtatatgcgctgatgttcatttccaaataaatttgtggattgtccacaggaacttgcacgataaagtacagatgatctagtgtttacatttggtagatggtcttgataataattcggtttttcatgtcatgtgtttcaaagttgtcttcatcaaaaaattatacaagcactgggatgatgttgtcgacttgccatcagctgattattacaattattcttgtttttctgtacatcaatgtgtaactttttttggggatagtgtttgctttctgttggtgaagagtaaatgaattcatctgaatcaaaaatcataggcaaaacataagcatttgcatatcattgttttgtaaagcttgacgtgtatcatgtcaacaccaatgcatgccaactgtatatctcattttcctctacttatcacaaaacatgaaatcttgctagtaggtttcctccccccgtacattcattggaatatatgttttcacacataataatttccattaagtaaggttgcagttgttaatgatcttatccgttcttttagttgtggaaagatgtgctgacagatctaatgttttgcagcaacgcccacatcacccggtccggccgatcccatctcaactttggtgcaaaaactttggcaagaaagagtattgaaggatgtctgaacttgcaaggaggactcctgtttttatcttgttttgtcataatttgttctcagcgatcaatgcttgaagaagtatgctcctacgagtatgcacttgatgcttcatgtaactctttcgacttatattatgtcatacaaggagtttgcctgttggtaactcaaaataaactcgtgacgcataagcctctgatggatttactttagggtttaatgctctgtttggatgattcctatttcatgcatttttctgaagaaatgctaacgtctcaatgatgaatttacttgatttttaaacgcattttgtttgcaagtagacttgggaatatgagtaacctggtgacgttgtctcctatgtagtatgaaccaagtattctcaaaggaaatacaagagactgttagtgttctgaaaagaaggtaaaattgctggtgtttctatcttaaatttgttcagtgaattacagaataattgtatacatttgagacgttgcccaagcaggagctatacaatgccttttcctagtgaaaggcgtaaagatatgagctgtgttgctaagcgaagccggcgatcagttgtagaagtggaactcggtggcggcgtcgccgggcttcttgccgacgacggcgaggtatcccttgtcgaagtcgtccgccgtcacggcgccccgcctgtcgcgcacggcctgcatgccggccttgcggcacacggcggcgatctcggcggcgctgagcttgtcgcgccgcgccgccagggcgtcgaggtcgacgtcgccgtccaggctcatccccgccgtgcacgtctgcagcaccagccgcttctcctccgggctctcgggcgccgtgaactcgaccttgcggtccagccgccccggccggagcagcgccgggtccaggtcgtcggcgcggttcgtcgccatgatcacccgcacgttggtggactcgtcgaagccgtccatctgggtgagcagctcaatcagcacgcgctgcacgtggcgcctggcaccgccgtcgtcgtcgtcgccgccttgccgcgccgccgcgatcgcgtccacctcgtcgatgaagacgatggccggcgccatgtccctggcgagccggaacaggtcgcgcaccaccctcggcccgtcgtgccgcgcgagctcggcggcgttcacgcggaagaacgccgccgaggtctcccgcgcgacggccttggcgagcatggtcttcccggtgcccagcgggccgtgcaggagcacgccgcgcggcgggtcgacgccggcggcggcgaagagctccgggtgcgtcaacggacagttcacggcctcgcgcacctcccgcttctgcgcctcgcacccgccgatgtcgtcgtaggcgacgcccggcttgtcggcgtccgcgacgaggaaccgcgcggccgagcaggcggcgacgtcggaggggggcacgccgacgagcgcgagcgaccggccgttcagcgcgacgttcgccgagggcttgaggaggccgcggtcgagcgagccggcgacgccgacgcacatcttcctctcgcatccgtcgcccagcgtcacgacggcgtggtgctcgtcgacgacctcgtcgagctgggcgacgacgaggggggtgaccgccgtcagccgcctgacgagctcctcgcggaagcgcaccgtctcttccagcacgtgaatctggaacagcgcgttgtcccgctgctcatccagcaggcagaactcccgctccagcgactccagcttctcgcgcagctggcgtccctcctcgtcgtcggcgtcgaggaagatgagctcgtcgtcctcctcctgcaggtccagcaactcgagcttctgttccggggaagtcttggcgttgccggcgccgtcgacgtcgtgctgccgctgctgcacgccggccggacacggccgcggtggtcggagcgccatcacggacgacgtccttggctgcgaatctgcgacgttgtccttgtgtcaaagaacgcatgcaatgcaagcaagcggtggcgcgtgaattataggaggagagctagtacaaatccgagtcggagactcggattccgattaatacatgtgagactcggattccgattaatacatgccaactattttttttctcccttgtaggtttgcaggggatgaagatgcaacatactgccattggcacttgtgtgttcaaggaacagtgcaaatcaactcgctcaggtaactaactgttcaaacgctaggtctttgattctctcgtcaatcctgataattgcagattttgcaaaatttcatcagatgatcagctggtgcagaattgtaagggttgaacttcagtttaccctcataccctgtctggtggcattaagggggcatcccagtggagaaggcctcgaacttgtgcaaacgaagaacagtgtcgaggccatggagattggagagggttcaatttattgagaacgggacgataaaagaccatggccagtggggtgctcaaaagatgaacctggtgaggattgtggcctgtggctgtgataattcatattggctttcagacaaaggtgtcaaacatccctgaactttctgctgcagattgttatccaccacctatttctgaacccccttgtttatctgtattccagacctgaaagaacaacatgagaaacaaattaacatgtatgtctaattatgttctgtgagttatatacatacattgggtgccactctaaacacaccttgctggaataagaaaacgtccacatacaacggtcgatctgtacaagctatttttctacagcaatttaccagtcatgtattaccttcacaatgcttgagcactgcagaagtggatttcctcatatggaagcacgctgctgtacaattaacatacgtattgtaacacagttaacacttgatatgagccccaaaactagacaccttcgcttgattgtatatctgtctcaagtgatcttcctactcccaggtactcttcagcaaaaagttcatcattttttgcaagcatgtctgtcagactgcagtctatctttctactctgaagtacacaaaaccgcggctttatcctcccttccagtgaataactgaagtaccttggatattctacaacagctttaagtggcttcttcatggttcttaacagaaattcaagctttggtttcataacaagttcaatactgtaacccagaagtgaagagaatctatagatcatcgagcacacattttttttagacaatcccatatccaagaggtagttgattctgtaaacattggaatactgttacatgcattgaacatatttggtagagtatcacatcattagccggtaagtccat

SEQ ID NO: 12066 - DNA, 8110 bp, Oryza sativa
ggatactgactgcagggagtcaagaactccagaagatttcaggaaaaaaaatcagcaataattgcaccaataacacattgcatcttgcagaagaattggaagtagcataacataactaagaagcacatagcgttgccaatgtcgtgctgcattttccacttaagcctatcatggcacaacagatcatatgaaacatgtcatattctaatgcatagtaatgtgctaacgacacactttcttggtcaatactagtgatagccaacatgttgaagtttgaacctgtcagttctggttgggtttaagtgcccagtaaacttatcaatttttggtccttatgtttgaaggagtatttgtgaaactatgtgtttaagggcaagagatgcataagattttcccaagcataggtgaaaattatgagggccccaacagatatacattacattacccaagggttttgtagctcggctgaccagtataaactacttaccatagatgagttaaagtcagttacatgttcacaagaactataaagtataaacatgtaataagccatttgtagtaaataattatagaaggagctgcagtcatacctggggagcattgtgcgatttatgtccaacaataaaagctccggatacttcctaatgatgcgagggagataatgcttgggaacaccaaagtcaataagaaagtttattttcttcttaagggtattctccacacttgaagcaaatatttctggagaacgacacaaaatctttgccactgttttcttatcaagacccatatctttgaaaaagagaataatctgagatacaaggaagaatagtcagttccagttttctaaaacaaagtaatatagcttctccattccagtggagtttatacattagaagaaatcataagaacaggtacaacctgcataacctcatttggttttctcagcaacaactgtggacttgatgtaacaactggaaccaacattttcttactgatacccagatcatcaaacagctccacaattgagttcattctttttgttgagcaacccagaatatggggccaacttctcatcgcaacaccaaggactgtactggaaatctgaaaacaagaacctcattaccatttcaggtaacaacaaacacaatggacagtgtcctcaaatgaacaggatcttaagccaagttagtaggagaactcttttgtcagttacctttcttctttggaagaacattaacatttggccatagttttctagcacacatgttgaaagaatccatggatacttcagcaacatcctaccaatatattcttgttcaatgccaacctagaaaattttggaatgtggtaatattgtatgactcacttattatcaggtcaacacctataccgcaggctccaaaagataagacaaacataatatatcctctaggtataccttttcccatgcattaatccttggtttgatatcattttcaacatcagaaaggatgataggaggaaatgacagcagcacagatgcaatccttggcttgggaattccaatgtactgaagaaaatcaattaatggtttaagatgattgttctctgagcagagaagaagcattggaaatgattcaatgagatagggaaacgacacatctccatgtcccaacatattaagaccgccatacctggcctccatctgcaataaaagatgcaatttttgtaggtgcttaagatgcaaggaagctggtgcaagaaacaactaatagggctgtgatacttactttttcgaaaaatgataaagtactttggagtgactcatctgcaggtattgataagtgcatcatcatgcgtttagcatttctacttattaatgtttcatagacattgcttgaaaatagaatttccttcaaaaacttgatctgtatataaacaaaccataagcaatgaatacagttagtcagatacctagtgaactatctagcgaaatgacaactgttaaaaacataaataccgctatcctgggaaaaaatatcacatatatttttgacatcatcacattttagagttaagtgttcaatgataaattcctgtgtgtatccctatgtcaattatcagtaagttaccctgtaaatactttgccataacgtaaaaagagatgaaagtactcttgtggtttgtggcaagaatgaagagaggtaggagtagttcacatgcttgagatcaagctcttcactcttctaaaagtttgctgaactaagatgcaggattacagctaaggactatactatttgagcaattaaactagagtgaaaggcaagagctagagtgcattgtctggccaatcacatccaaaacgattcagtcatgtcagtaaaggtaatgtcaccgaatttcaccactcatactatgcagtttgtactgggcagaaatgatcatcaaatgcactcacacaaaaatttattgaagcaaattgagctcaaaatgaagtggtagatctcaccctatcgatcagcaccgggagaccagccgccgaaacatacggcgcgatgagcttcgcggaggagagccgcaccccgacgctctcgagcagcggcaccacgccgcggtcgcgcctgctcttcgccttccccatgtagtacaccttcctcccgaacccgagcccggccatctccacctcgcggcccgcccccgccccggagctccacgactcccagagcccgagctcgtcgagctcgcggacgccgtcggcgagcatggcggcgtaccccggcgcgcgcgcggcgatggaagccgcatcagccggggaggcgccgtgctcgcggaggagctccgcgacggcgcgctcggcctccagcgcgtcgtaggaacgcgaggtggaggcggtctctgcatcggcggtgggtgcgcaggcggcgacggggtcgcggcggcgcaggagaggacgcggagacagacgccgccgctggcgtatcgggcggaggaaaggctgcttgaggagaatggcgcggagtggaggaggaggaggaggggtcggggaggcggggagcggaggagagaggagcgcgagcgcggcggtggcggtggcggtggccatggccgcggcggatgaggggagaaggggatggccggaggagatgaagatgaggagagcggagagcccgagcctttcccgcgagccattccttctctatgggccttctctatgggccgtcaaggcccattatcgtgtaagcccatttcccaacgacaatcggcccatagatagggtggcccgttcaagtttgcagcccattcgagtttgcagcccattcgaaacgggattatggtctaggtgcggcccatatacattgtgccggagccgtgtcgtgtccaagttctaagcaagaaagtttgtttattctccctcttcctgtcctgtctgtcccccgagctttcaaggacgcttgtactgcgccgctagggttcgtgctgtcgaggtcgtcgagtggcgtcgccggcgtcaatctccctgtaagcatccgccttctgcctctcgtattctacaccgacttagcgctgttgacttagatcaaattgtcacgttggataaaaccacccgctattataccatcattacctatattgcaccggttttgacacttgaataattcattgtatctggtatttcggttgaagggtaaaaattgaaatcgctgttaagttaaaggccatgtaagttggccatgcatatagctgatatcgagatacaatgtgacatggcacctacagggtttacaaaatcgtgaggttatcatgattatcacatgcaataaccttctcggtttttgaaattgcagtatacatcacgataactatatggtttttatggtaaatatgataaccgtcaaattattaggtgacgataacttagctaatgtggtgtttggatccagggacttaactttagtccctatatttagacactaatttatagtattaaatatagactacttataaaactaattacataaatgaaagctaattcacgagacaatttttttaagcctaattaatccataattagagaatgtttactgtagcatcacataggctaatcatggattaattaggctcaatagattcgtctcgcgaattagtccaagattatggatgagttttattaatagtctacgtttaatatttataattaatttctaaacatccaatgtgatagggacttaaaaattttagccccatctatacagggcctaagcctcttcccgcggtcccgcccagttcgttggcgtgtaccacttcaaaaatgtgtcgctttgacgtgggcccgcgtcatccacatacgccaagcccgcaaggctcctgcacctggacggtagcaagagcgtgggccaatgcattccggcccacatgtcaatttcatggtgtgcgtgcgaatatccggcaaggtcgtcggagcgtaacagtgtgggtgcgtcagattcaaactgacacgccgacggcgtgcgtggtttgtccatccgacggcgcgtagatcaacgcctggccccgatccaagccgtcgaaattcgaatcccggcacccaaaagcgcctcaagatgcaatgtgggcccacctacctttcgttaatccactcaccaactacacactgactgacatgtggtcccggtggggccggtacggcaaggcgtggacaccgctttgaaaacgtcgtggtcagagagggagcaaagacttgtactactactcgcagttgcctcggaattggcgctctcggcgtcctcctctcctcggcgtggagagagaaggtagggaggagtaaaagaaaaaaaaaagctgccattttactccccccacttgttcacctcaagttgcgattcgaattcaaaatctctctacttcttccaggagcagatcgctctcccctctggataggcgaggcgaggagaggaggcgacggccgcgagcgcgaggcgaggcttccgactcgagcaaggagatcccactgctccaaccgtacgtacagttcgttcgcgagccctctggtgtttttggttcatgtttgaattgagctttgctcgttggttcgtttattacttcttttttgggtttgtttttatgtgtgtgctaatgtgctctgtgatgtgggagttgggagggaaggggaggattcgaattttatggcattttcggtggttgttcgatttgttttcgtgcaaattttttatttggtggtgagaacgcgtcgggtgattatgttaatttgctccaaaattatatgctccgttagccagtagctttggagctcggcggaggggtttgggttgcgcaccgatgtctagggtttaactgttcaaatgatcatagtgcgatgcgtctaattaagtataagcttgagattgatgcgtgaaagccttgccgcaatagctattcatctcgaatttggtgcattatttggtttcccttgattgatttgggctaagttcatttcctcctgatttggttagctttctgaatcttactgtgtacgatttcaaaattttgacagctccaaatttctcattctaatattgattgctccaatttcaaatttgttcatcaactgtatgtggttccttcattcacattcatgtacgtgttctttcagagatcaggtgatgggtggggaatctacaggaaacacgacctccattccccaatgggagaagccactgttcccctcagtatccatgttactctgagctactgagctctctgctaagttggtgcctcagctgtgtatcttgcagcaagagtgttctagccttctaggctgccaagatgaagtccaatgcggttacctccaaaggcaaggccgtgttcgagctgaagcacaggctggtccaggccatcaacaagattgcagacagggacacctaccagattggattggatgagcttgagaaggccgctgacaccttgcctcctgacatggttggtcccttcttgtcttgcgtggttgacaccgatgccgagcagaagagtgcggtgaggaaggagtgcatcaaggtgattggcacattggctcggtcccatggaagcctagtggcacctcacatgacgaagatggtgaccagcattgtcaagcgcctcaaggatgctgactctgttgtgagggacgcctgtgttgatacctgtggtaccctcgcattgtgtgctagaggctatggggatggtggcgctgcattggttgcgttggtgcggcccttgtttgaatcacttggtgagcagaataggtatgttcaggctggggcagcgtcttgcttggccaaggttattgacgagagcaattacttccctggccctgttctgccgcagatgcttgttcgtgttgttaaactgctcaagaatccccatttcatggcaaagcctgcagtgattgagttgatcagaagtattattcaggtctgaattttgctcttgcatcatcaacaccattcgcttcaagcttatctagtagtacctaattaatgtgctttcagtattttaaggtgattgcattccatgcttatctctggtggttgtttaagtagcttagcataagtaattgcaatggagtaattagtataatgagccaggagtactttattatatgactgctcagtcagtttcacataaaaaaaggaggtttaaaaagtcgagtgtctatttttatttccaacttctagttcatcttgagactgttaataaggcggtctccttttatggattttcagccatacaattgtcaggataattgtgttagctatgttcatccctttggtgtcatagatcaaattttccttcttggaagtagattagtcatattcatcctttgatttcgtcctacaagtgttagccaaaacaggagattgatcttttataacatttcttatttttctgctgtcccacttttcaggctgaaggtgcttctacagagcagtctttaacatctgctctaacaagtattatggatgccctgaagagtagtgattggactacaaggaaagcagcttcaatagctctatctagtattgctctcagttctggatatctggttgcctcctttagaacttcctgccttcgctcccttgaacgttctaaatttgacaaggtcagcatactaaacattcatgctgtaatattttcttgcatatgctacacttatttttctgacttctgtcacaggtcaaaccagtgcgtgatgcaattacccaagccattcagttgtggaaggttattccagggtctgatactcccgagccatcagaagctggatcatccacaaaaggtattacaatccttataagtagatttttggcctggtgtgatcttctgacttctgcaaattaaaagaagagattggatactactttctgaagcttgttgacaatactaatccctttgttttttttagcaatttgtactctcataatactttttagtttcttgagaactagtgcattgaccccaaaagataaggggtttatcaatgatttgctattcaatgttgcttgttgcatgccaagtctatctactgcttaggtctgtccaaggatcaggatttttttccccagatttccagatctctatggtctcttttcttaaattttcttgttagtcctttacgagcttaacatagaatctgtttgaagtttacagcagccacataaatttctcccttttttgtttattgatttcatttatggcagaaaacttctttggtgaccatcatgatggtagaagtataaatgatggtggatcacgagacacttctttcaggagagttgatcctgcatcttctgtttctgcaatcagtggcaattctattacttcatcaaagaagagatctcctctgtctatcaataaaatagccctgaataatgctgcaaatcagcaacgctcgaagttgagcgattggcatgttgagatatctgttcctaagcagaatatgataccattagttgattttgaagaaaaggtgtctggcaatggttccatgctaaagggttcaaatagaagtccatatgaaatcgtagacaatgacagcaagtatgagtatgaccccatgaatgataaacaagattgctcctctatgtcagaagtagcc

SEQ ID NO: 12067 - DNA, 1203 bp, Oryza sativa
agcgctagctgaatgtatgagctctgtaacgcaagcatggtattggtgacacaacatagctaacaactcttgtgtatttttcgtgtcaactttaattactactcactcgcagtgaccatatgattcatatgccgcaattctgatgcgaccggttctggccttctgggtaacaaatgcatgcacatatgtcaccgacgcaagtgaaaggataagcataattaagcatgtcactttttaaaaagtttgtaagctgttggtaatcgacacgtcgaagctattaggagagatgaacaactgaagtactatatatgcatcaatcaatggagcttttcagtcggtcaatgttgggtttgcagtggagatgtactcagcagcattggctactgccggcaccatgcttcattgacctgacaaaacttgttccttacctccaactggtagaatgacaggttacatgtatatatcgccccattattttagaacaatcttggggggctcagagcatccatatatatttatatatggcagagaaaaaaatcgcaactaaactagaacaagtgcagattgataagttatagcgatgtctcaggtgataaatggcaaatgcctgttttatttgggttcagtctcagaaatcacagcaatgtatgcatgatttcttgatcaaataattaaacaactaaataggctgcagtcctatatatgaatatgaatatatatataaatatatatatatatatatgtttaaacaatcttactatgattcatacagatctgataaatactacagcccatgtataattcctaccaccacagcctgcaatcaggtactattttctccaatgtaatttaggtgtttcactaactccctacagaacgcatactgttgtatttatggaagtattacattttggcagagacacaagggtggatttgcgaggatggcttgtcaccagacatctctcaagtatctcccttccatctgcaagctctttacatagctttctgtgtttgagttgtccaaagaaccctgaaaattcaaggtaacattcagcaaagtggagatgaaagcaaagctactgttaaactctaaagagctttcatggcacttcacataattactcataatgcctgctccgaaccaggctaggctaggtgataaatactaagggacagagttctggatttgttttgacctcaatc

SEQ ID NO: 12068 - DNA, 24586 bp, Oryza sativa
cgatttctgcacccaaagaataggacggcatggcctagttccacaccagtctcttttagagctaatctttcctgccagtgccaaatgcataatataatcaattgaattataagagtcaatatttgaggaaagggggaggaaaaacaaacctgtaagaagcccctaaaaggtgcaagaccagttccaggacctatcattataataggcacagtaggatcagtaggcagtttgaagtttgactgcctaacaaaaattggagcccagctacattcttggctctcttccaagggaatcgagttctgcatacacaatcatcagattaaaatgtttactggtcagcacgaccatcacatacttcaaacaaagtttttatgcttgaccaaatgtatgaccattgttttcaaagtgtactccttccaaaatataaactctcattatatatgaaacaaatcgacaactacagaatatatgtatcaagaacttttcgaagtctttcatattgctgagggaaagatgcactccctccgtttcatattacaagtcactttgacttttttttctagtcaaactaacttctttaggtttaactaaggttacagaaaaaattagcaccatatccacccccaattagtttcatcaaatgtaacatcgaatatattttgataatatgtttttctgttggaaatgttgctatattttcttaaaaaattggtcaaacttaaaaaaaggttggactaagaaaaaagtcaaaacgacttataatatgaaacggatggagttactatataactatagaattttcagggagtgatacaaggttgagttactgaatagaatgagttgtttagtgttattggcaaggccatcacggtaagttcatcatgagaactgttaacctgacactttgtccatacatcaagaaacttgagaaattatgattcacgtggagtttttaaagtgggtaagaaacaggttcacttaaccagttaaagttggacacatgtaatgaagactggatcttgatatataagcatcaaagcgagctatgacggtcatattcaattatctaccaatcatccaaaagaaatgcagaaagcacagtgactataatatagaaacagagtgccctttcactatgatagaacaagggcttaccttcatccaagtagaacaaactcctttatggatccttccagtaggggtttgcccatacactagcgcacatgttacatgaattcttgttggagtcatcctgcagcaatgtgaatggttttaaatagataggtcaatttgctcaggttagaagggtattattcctgaccaaggtacctcggtgaggaagatatcgagtagtatctcggctgcagtcgaggagcaatggctgcaaagaagacaccaagtggaggctttgctgatgggaactctgtcataacttccaagagactccgttgacttgaaactatccattgagaatactccttctgccaaatgaagctcatgtgaagccaaaactaacatccaaaagcataaacttatattaaaaaccaacctttccagcaggagatgctagatgtcttagcctctcagcatctttgggatcagatgcatgggaagccaaagcaattaaagcactctgcatcaacaaattaaaaaatattaacatcaatacaaatatccagaaaaaatgcatatagaatgtaacaagatagatctgcaaaagttcaccttcttaggaaaactcagaaggtcagcatatctggcaagtgcagtccccacagtacagggggacgggaaaggaggtggcaaaaaacccccaaaaagtggagtgccatcctttggtcagcatgaattgagaataaggtatctggtgaataacctaacagattttctacctcctctacagtctctgtgcagttttctgcatatacaccaacatgatctccagtctcatatctgttaagaaaatgggggtcatcagcagtctaaacaccagtaagaaaaccgtgcctgcaattttgtcaaccaactactaaatttggaaagtaacaaattcagatacttacgtaagaccagtccctgaaatatcaaactctaaatgaatgcaggaccggtaagaagccggcgtgtgaagctcccgccgcacagccacatttgctctgcaaggaaagcatgatcagaatttgttcagaccacacccagtgtcccagtgcagtcaaattaaagaaataatctcatacctgcaaggatgctgaatgtcatatacagcatgaccattactgagactaaaggatttgttgatatgcatggcttcctctggcttgaccaatacaactctatattcaggaatagcagctgtgtagggagttggtgctgccgatttatcatcttcaacacggagcaatttatccaattctggccatagaagttccttcctttagttgaacaaccaaagcattagcttttgttttatgtctcaaagtctaaagttgatatcaatgtttaaaaagtgtgcacaaatagaatcagtgtcaaaatgatgcctgagttcaaagttgagacaaagactaagctaattacggtacgtaccatgcattgaagtcatcctcaatgcattgatcatcatctccaagaccaagaggaacaatgcgttttccacctaaaagagatgtggagaaaagttaaccaccaccaaatgatacagaacacgacagacaggaaaatcatgtgaccagaatgttgcaaagatcaacaatatctcactgaattattacatggtaaacctgttgttcagatctatcggagacaagtccgatttgatttagttgcacacttacactacattaatactagctccccttctgagtctaaaacactctacagaatatcggtagacagaaaaggatgagacaaaaaaggcacagcattaaagtcttaaagcatatgatcctagtagcaaaccaccctgataaaattatgatgctttccagagcacgttactaactacctacataaaaagattagataagttgtatcccttatcctgtactcttctcatacagtataatttctgacaatgtttagtggcatacaattcttaggtgagcatgaacagtacaggcaaagttatgcctttgtaatatagatgaaaaaaatagtgcattgtagttattcgaacgatggttaccttgttcagcgaggagttggtcaaccacctttccaaccttcagtttaaaaagacaatgtaagtatacaaattgggctctatataaaagcacaatatcaatgtagaagcaccagcaaaccttgttaaaatgctcgtactgcctatttccgagggccaagaccccaaaccgaagattactcaaccattcacctctctcattcccctgcactccagccaaacaaacaggccgtcaacagaaaatacaacgctcacccatgaaagggccatatgaactgtggatttgagagcaaacctctccaaaccatttatagaacctcgccgcattgtcagttggttccccatccccataccttcaacgagaacaagaatgcaactcagatattcattggaatcaaaattcaaccattctagtttctcctgaattaatcaatatcccgtcagaagtatagtaaaaagtggagatggcacctacgttgccacgaagaacaaggcgatgatctccttcttaagcttctgctcatactcctcatcatccgcagcatactcatcctgaaccccagaacgaaacaggcatgaatcaatcaatacatagaatgcaaaagcacatgaaattctgaagcagcgttagtggcaaatcgtggcggcttaccagatcgagcaccttgaagacggccttgtcgtacctcgacttggcctcctccgcaagcgcttgcgaatccgcaaccaattaagacccagggttttgctgcacgagaggtgacagacagagagcgagaaaatctatccaaccttggcgaagccctcggcggtgccggtctgcgtgccgaagaagacggcgaccctctgcctgccgtcgtcggggtcaggctcggcctcctgcttcctcttcgcgggggcgggggcccgcggctgcggttcttgccccctcacggcgggcgcggagatggaggagcggcggacgagcagcgcgacgccgcagccgacgaggacggcgagggaggtggtgagcaggacgatgaggtggcggttctcggcgagcgagggcggccacccctcctcctccggtcgtccccgccccgtgagcagcgccgccaccaggtccagcgccgacggcctcagcgccccgccgccgccgccgccgccggagtccatagcgcgcgatgggatcgaggcgaggcggaggcggaggcggcggcgcgcgcgtgcggggtggtggccctagtacgtgggagaatttgggcgaaatattttttgggtttttgtggagttgagcgaaacggacggtgatgtgcgatcgatcggtacgtggtgtggtctgtggtggcgcggtgtgagtgtgtgacacgtcccgtcgggttgaggagagcgatgcacgtttcggcgcggccgcgacgtttggtggtgcgagtgcgagtgcgagtgcgagtggctcgtgcgccgcatggtttcactgttttactatagaacgccctcgaagcctctcgccataaccatcgccgtcaacaacaacgtacaacaaccacaaccctgcgaacgccttccagttgctcgtcaccatcgtcttgattctcgagccgtcgagcgtgttcgatcctaccaaattttgatggggggaaaaaactgaacatgttcttaccaatgctattctgttaaattttgctaattctaaaagttttcgctcttcagaactatacaaaattttgataagatttcgaatcaaatatattcaacactacttaaatttgataatatcaaaatgtacctaaatttaatattatcaaatattggtttggttgaaagctcctataaagtaaacaagaccactatctctagattcttgttggcgctgacagtaagtacactaaagcattggtaggccgcgttgctcggtgagaccaatatgattatcacagtcacctcttgttcgggcaaaattccctccacatggagtctttgctttcagcccattgcaacccaaaagtctaacaaatatgagccattgatttatgccttgatcaatgatggaaattgtctcatctctttatgatggaaagaaaaaccctaccttccattgggggagagatagtagcggcgattggggtgaagaagaaactagcaaaacacaagagagggaaaggagaggggagaagatgtgcagtttgttcagcttgggagctcttaccctatcttcatcaagttagcgattagaggctcgaacgtggttggattggcactaaacttggtaagtttgtttctcactttgagcacttcaatctggtcgatttgtataaggatgggttgaatatagcaccggatttgagtggtggtttgtcagctcgagttactgcagttacagcttgcgcaacaattggtagaatgtcagtttgaggggtcaaacagtgtccggttggactgtttttttggatagcttggaagggactcgtataccatcatttctgccaagtttcgtgtaatttgcatctgtggtttgggagaactcacctgagaaccgaagatggcctcttgttagctttgatggttaatgttgatgatgccaagtgtgtaacttaatgttatagctgctgttataatatgcctctagatttttcagagaagactccatgtatatcctaattgattatagttgaagcttggagtggaccgttggttccgtggtttttttatcctcacaccgaggaggtttttccacataaatcattgtgtctttatgtgcatgtgtttattattgttccgctgctgatctgctagtcgaaaccatcctcaaagtttatggcaagataagggtttgattgtgtgaaatatgtttatcagttggtgaattgtaatttgcacattgaagagatgtggttgagctccaacacctcacacattaacacaacccattcgttgttatttgtagcctctcagttaagtaaaagcagatatcttaatttcacatcttgactttatgtttttatttttacgttatttgcaacctctcggttaattaaaagcaaaggccttaattcaacattttaaattagtttttaactttattgttttttctttattatttgactcccccacaatacgagaattcactattgccaaaaggttgggttttttttttcaagttcttgtggtaaccatagatgtgtcgtggttatattcatgccacccagcatgaataatgaactgttccaaaattactttaaatgcatgttgaataaagcatgctcgcaatgcacctgtgttgcaccaacctggccgtactcttttttttttttttaaaaaaacatggctgtactcagccgaacaaacttgtgctgtctgagtatattttcgcttggttttcctttgaaaactctgaaataataaactgctaaaaaaatcgaattgcatgtgtatgtccatgctgaataatactcctacatggtagtgattccaatcaaatcaaagagatttaattaagagtcgtgtttaactagaggaggagacctcggccaggtcggtctcgaacgctttgacgaggttcccaaagtattgccgcgtcaccctggtgagcccggcgagcttctccctgtacgccctgtacttgtcgaagtcgacggcggccttgtcgtcggcgccggcggcgaagagctccctcctctccctctcggcgcagccgtgcagccgctccagcgacgcgttggcgtcctcctgcaggtactcgaacagctgccgcttggtgaagtcgcggtccgggtcgaggtagtagccgtaggcgtgcgcccagccgagcacccgccgcccctcgccgacctgctcgtacgcctccgtcacgaagcccatctccgtcgccggcacgcccgccgccgaggccatcgcctccagctccgaccgctccaggctctccatgtcgcggagcgccacgcgcagcgacttgaggttggcgtcccaccgctcgtagtggtagaggtacctgtccagggacgccttggcctgccgccgccgctcgtcgtcggcgttggcgccggccagcgccaccaccgtgccgttgggctggtaccgggagcacgccgcgtggccgtgccatggcttgaggcagatccagcagaactcgtggaggcacggcggccggcatgtcatgtgcatgcacccgaggttcttctcgatcggcagccggcacttggggcagtgctttgtgtgggcgagcagccacgtcgccgtctccgactccgagctgttcttctccacccacttcgccaccgtcttgcacgacaccggccggtgcgcctcctcgccgcaccgccagcacagcccgtgcccgcacgagcagaacacctcgctgctctcctcgccgtcgccgccgcccacgaactccacggcgcggctgcacccgggccccgggcaccacctcatcccggcgctctcctccacgtacgaccggagcgcgaaccagccgaaccgctccctgtcctcgccgtcggccaccgcgtcgaccagctcgcgcacgacggccgccgggcacgacggatccgggcaccggagcgacaggcaccgcgcgccgtcgcccaccgccgcgcggacgtacccgcgccagcaggagacgcagtagaagtgggagcaccccgccgacctcatcccgccggtgtcgaacacgtcgaagcagatggcgcaggtgagccgccgccggttgacccgcgcgggcacctcgccgccgccgccgtccgccggcaggaggccggcggcgtcgcgtatgcggcgctcgtccaggaaccactcctcctggagcaggacggccctccacctgtacagccggaggaggacggcggcggcgcccggcgagagcgagagcacctcgcacaccttggcaatgtcctcctcctgccgcgcgcgtacgtcgtcctcggttagaacaacgtacgtcttctccatcgccggcgcctccgtttcctcgaccacctgcccaccatagtcgtcgccatcgtcatccatgtaatcgccgtcgtcgccataatcctcgtcggagtcgccgaagtagtcgtcgtcgacgtcgctgtagccggactccatgctagtagctgtccgagatggcgacggcgaggacggattaattatcgatcagccagggtttaattaaccctaaccctcacaatttggcctcgcgcgcgagcctttatcggatcgagatcgcctcgtgataataaactgtttcgtttttaaagattgcttgctaaaataaatcggaatcgccttttttaaataaataaattcggaatcggcttcttagctaaattgtacttccggatattgcacgcgtgtttctgtgcggctgttatgggtggccgaagattggaaaggcctaggcccttagcccggcccattactgagaattcgattacggcccctttgttctcatgttattaggacgtcttttatacaagtacatacaaaacataacgagcctagacacctcccggtaaaaaaaaaagcaatattttaaattttctttataatctatgacgtgtgattttttttcatataataatttaagtgattatgaaagcaccttcaaaatccaaatcatcacatgctgtttttatgttttcaaattaactttttaatattattaataatcaacattttaaaagtttaatcaaatcgcatacaaaatgtcaaatactaataactgaagggagcattggtgatacacgcttataattggtagccaatgagcctttattccaatttaaatagagtaatacctagagaatttcgtgctataatctttataattttgaaaacattatttcacttgatcattttattggcagaagttagggtttatccaatcacttcttttttttaattccttctttttcatttatgggacttgttggctgtgtgcacatggccacttgggtataaggagcatattgatccatgtatttttgaaagaaataaaccatagtatttgttaagtgtaccttataaaatatgaattcctaattcgtaaaaaatgttggcccaaccaatggatcaaggtacaaattttcctgatgtaattgagtgatcatcaagtattctagtactacaaaagtgttgtcgttaatttgcacgtgatcctacgagctgtcgtcttgatgaagaggctgaagaggatcaacaggatcgtcggagctctcggccggacctgtagctacggcggctgcggcggcggcggcaacagcaggtcccacctccaacaggccgtcctggaacgtcttgacgaggttacggaagaagatcttgcagacgccggtgagcccggagagcttctgccggtaagccacgaccatgtcgaccatctcgccggccttatcctccatcttcttcttcgactcctcgccgtcgttgtccttgaggatagcgttcaacttgatggttcgttccacctcggcgaggagctcctccctctcgtgctcggcgcagtcgtgcagcttctccagctgccgctcggcctccccctgcgcgcactccaccatggtgcgccgctcctcgtcgccgtcgagccccgtgcccaggtggtagtacccgtacgcgtacgtccaccggagcagccgccggcactcggcgatctgctggtacgcctccgccaggaagcagagctccgtcaccggcatggccaccgcggcggacagcttctcggcgcaggcgtcgaggccggccatgtcgtccaccgcgctctgccgcgccttcccgtgcgccgccaccgctcgtagaagtgcatgtacctgtccagcgacgccatgacctgctcccgccgccgcttgtcgtcgctggcctcgccgttggccttggccgcgtcgtagacgttgcagttgtagtactcgctgctccggtgatcgctccacgggctgaggcagagccagcagaactcgtgcaggcatggcggccggcacgtcatgtgcatgcacccccggttcttctcgatcggcagccggcacttggggcagtgcttcgtgttcgccagcacccagctcgccgtctcggacttcatggcgttcttctccgaccacgcgtacaccgtctcgcacgacaccggccggtgcgcctcctcgccgcaccggaagcagaacccgtgcccgtgcctgcactccacgtcgtcctgcttctcctcgccgccgccgccgccgacgaactcgatggccagggtgcacccgggccccgggcaccacttgatcctcgtgccctcctccacgtacgaccggagcaagaacgtcgcgtaccgggctctgtccgcgtcgccggccacctcgtcgacgagctcacgcaccacggcggcggagcacgctgggtccgggcaccggaacgacaggcgccgcgtggacgtacccgcgccagcagccgacgcagtagaagtgggagcacccggccgatctcatctcgccggcggggtgctcgtcgaagcagatggcgcagacgagcgggtgggcgttgcgcgacacgggggcgccgccgagcgccacgccggtggcggcgccggctcggtcgccgtcgcagaacagcctgtcctggagctcgacgaggctccacttgtagtgccggaggaggacggcggcgaaccccggcgggatcgcgaagagctcgccgacgttggccgtgtccgcgtcctgccgcgcgcggacttgctcctcggacagattccggtacctcctgtcgatcttggtgaggttgacggcggcggccgccttctttttcttggcctcgtcgtcgtcgtcgtcatctacctcctcttcctccagatcccaactctcgccgtcgtcgtcgacgttgctgtccacctcgtcggtgtaatcgtcgccatcgtcggtatagtagctttcgtagctctgagcgtcgtcctcgccgtcgctcgccatgcctgcgctgcgtgctagcaatctaggtcgacaactgattctcagggtcaaggttgaatttttgtatgcacaattttccgtctattttttccgctaaaaaaattccatctatttccgaccccgagttgggatcagtctcgaactcagatcctgaacggattcgcttcttaacaacaattttaagttctcaataactttagtcaattcaaactgagtacggtttatttttcgttcaacctctctttgaccgatttcgtaaccaagattgatccctgcttcaaaacacaacacagtgctgtaaaaaaagaaacaaaagctacaaatgacttgacatgcatcacaaaaaaaaaaacaaaaaatcagacagcacagcatacaccattaacgtcagaatgtatgattggttggttaatggaagaaacgtccacaaactttattagtacattataaatacctatcacaaaatttattatagattgttattatctgtctcttctgctcccgtgctaagaacaggacaatgctgattgagctttactttactagacataccaagaatgccaatctctaccgtcggaaaacacgatttgtgttccgaacaaagccgcaccggcagacatcaccggcgccggcgccgccaccgccgccgcggcggccattgtgagaccccttgcactgtcccaagcaagcactccacatcatggctctgccattactccttcccttgctgcttgcaccgaagaggatccctgcgacgtgcatcccctgcatctccagcttcaccctgccatccttcttctccagggatgcctccatgaccccgatcatggggtcaccaatggcggcgtacccttgctcgggatccctcacctgaatcaggaccacagagaccatggaatccttcgtcgcctggtgcctccggtcgccgtcgtcgtcgccggcagccgtggacgaggcagagtcagccgtcgaggccatgcgaatctttaggccttgttggaccagtccttccatcttgtccatttccatgaagaggagagcctccaagaagtcgtcgccggagctgagcctcgccgagcggcggatgactttgccgggattcttccggccggcgatgtccttgatcggcatcatctttgacagtaacttgcacaggttctctgcgctcgtctctgtcatcttgtcaagaacctagagatcacaatgccacagattgtcgaacgaaaacaatgtgcagtgcaatggatgatagacttcattggcatccatggatcttgacagcgatcgaggtggctcacctccgacgcggtggcggcgttctcggcgacgacgggctgcgacacctgcagcgccagccgctcccagggcatgcccaccacccgtttgatctcgtgcaggtagccaccgccttccagcctcaccatttcccgcacgccgccgtggccaccgacggtgacgcgcttgttggccgccgtggcgccgatgccgctgcaggcgctgctcacccgatctctggtggccatggcgccgccattggcgctcctgccgtgctcggcgagcctactgccgagcctcctgatctcctcctccaggaactgcaccctccgccggtactgctccgcggatgctctagtggtcgccgccgtcgcgccatcgacgacgttggcgcgcgcaggcggcggccgcggcgcgcggcggtggaaggagaggcaggacgcgagggcggagcagccggtggtcgccacgggcggcgccggctgcttgttgtggccgccgggcatgccaatcttgccgatcgatcggtgtggcggcggtgcggtctccgacccgctcgctcgccggcgccgtgcaatttgacgcgtttgtttatcttgtataggcgccgcgccgcggctagctagtgaggttagttgcgatctatgcgtggggaggccggatcggatcatcggaggcgcgattttggagtttgaattcgaaccccaaactccaaaggtgtttgtcttggccaacttcatcttggagcagcaaatattgcgttgcgacgtgacgacgcggtgcattggatcgtgtgttgtacagccgcggtattcattgcatatcagttatcaccagtacaaatccattggatgtatccagtatccgtgcctgtaagggcctgtttagttaggctgtgtttagttcacaccaaaattaaaagtttagttaaaaataaaatgatgtgacggaaaagttggaattttgtggataggaaagttttgatgtgatggaaaagttaaaagtttaaagaaaaatttgcaactaaatacagccttggtgaaatgaaaatttttgggtgtcacatcggacgtttgaccggatgttggaaggggcttccattgtaggagtaattacttggggcttacgtgtatactaccgtgcagtaccgcactgctgctgatgccttgttgatacaactgtgggaacagtttcaaaagtacgaagagaacaaaaatctctaatattttgtatgtcgaagtttagaggttgcgatcttgtagattttcggtctcatcatttggtttttttccctaacaagtcaaaacggtttattagggaaaaaaataaatttataggtaaaatatatatatatatatatatatatatatatatatatatatatatatatatatatatatatatatatatatatatattgttggtgacttaaaagttaatgctaaaaaagaaattacgttgaaaaaaaatctcaaaatcaatgtcaaaattaagtttgaaaatttaaaatttagctttctatttggctgattaggccatccaataggagcctttcaataatcgttttagtctcatatgttgattttattattttagttcttattgttgtatgagtatttgctctctttgagataattttataataaatggttgtaccttctttgaagcaaaggtccgaacttttatttcattatcttatcttaggccctgtttagttcctaaaacaaaaattttcacgttgtcggcttgtcgcatcgaatgtttaaacacatgcattaaatattaaatgtatgaaaaaactaattacatagattgcgtgttaattgcgagacgaatcttttaagcttaattgtgccatgatttgacaatgtggtgttataataaatatttgctaatgacaaaataattaaacttaataaattcgtctcgcagtttcctagaggaatctgtaatttgttttattattagactacgtttaatactttaaatgtgtgtccgtatattcgatgtgacaactaaaccaaaaattttccacaacaaaaaaaaaggccttaaaataagacaaaaagtacaaatacatttactactagtagtacatagtacacacgatgataggagatgtgaccgtatgagtggggccgtgtttagttcccctccaccagcttcaaactttcaactttccatcacatcaaaaactttcctacgtatataaacttgcaacttttttttcaaacttctaattttcttcaaacttcactctttttccaccaactaaatacagcctgaggtgagcttcctaaaatagggaaaaaagaagataaaaagaaaaggtgtaggacacatgggctttagtgttgcaggactttggtccttgtgggccttgtaatgctgagctcaggctcatccgacacgtgtgcctcgcgggccttgcaatgctgagctctggcccatcacggcgaagacacatgcgccggggagcggcggtggaggggaggattgcccgccgcgccgcccgccgcggccgtcttcctcctccctccatctctccctcggaccctcccaatggcggctcctcggcgcggagtgcagcgagcaggcgcagcagcttttgtgtgtgggcgaccgccgtggggctgcacaaggccgtctcccgcatccctcgagggctccgacgccatcgatgatcgcccgcaccaccaaccccaactccggcgaccggccaccgggccaccaagtggtactgccatactctcctctcctctcccctcccgattgctggtcatcgatgatgagcaccaagctctccgcctttgtgtgtacctgtaccctcgatttttttttttgttggaaggactactctggaaatcccattgttgactgttgaggatactggctcttagcatatgcttctccaagaattgttcatgtttgatgcaaacatatcttgtgtttctgttcatgtaattactggtaacttgatgccttgctaaaaaaagagaactaattaacctgagatagttttaagtaaacgtatggatatgtttctgctcccaacatctatgtccttataggaagctttattgttttctggaacaacactgctttagaatcatttagatgccaatatgccataatcaacagagatgttttggttttgaccacctaattcgcatgaaagatgaaatatcttagggcggggaatctgggaacaatgatgcttttcagggataaatgttcaaatattgatgaaaggcttggttttccattccacgaggtgttgttttcttgtgtcctactattggacacacgtgtcactacttcttgttatgttctgaagccttttcaacaatctgaattccttgaatttgagaataggaacatccaagacaagtgcctgacttcctatcttactttcaaacatgttggcttcgtactttggcagatctgctcttactccagaagcagcatgaatccatttttttcaaataaaaatgtatctgttcttccaatgcccatagcaattggtagcctagtaatggatgaacaccattccagatgaagggcttacaatgtccatgatactatttcattaacaatagttttgtagagcatgccgtctcgtttttatttatctcctgtaatttaacctataacttaattgccgtcatatataatatcatttgccatattattttacatgcatttggcatgaattcatccacgccatgtataatatgttccgttttgaacaatccccttcaccgtgtcatgctgtagtgtttatgtgcatttggtatgaattcttccacaccatgtattaacattcagttttgaacaatccccttcactgtgtcatactgtagagtttggcatagagcattagaggctcaatcatggtggaaatgcagcaggcgtggtgggggagcttggaagatgcaatgggggtatggtgggctagtggctggaacagaacggtacatacacatctcaacttcatcagcactttttgctaaataaaatatgtcgtgaggttatcagcttttcttaaacttgttttcccttgatccggggcctttttgcacggtaggaatagagccaggttctgctaactggcagtacctaatctaaatgcaaaggcaggcaaattctttgcgtattcccgggaaaagaacttgtattgccgcagcacagacaagaattaaagcaagaaatggtattcttctagctagaggccggaatacataaattcatcagggaaagaaacacgtacaagaattgctagcaatagtacattagcactcaagatactaattatcactagacataacagctaatttagagaagagagtataattaagagccaactaatttagtactaggaggtaattatgaacgagggctatgaggaagcaggaagctgaggtcctcgccttcgtcggcggtggttgcgacggtagcggtaggctctccttgtactatctcttggctaggggaataaggccccgactttggctctggctcccgctccggctccggctccggctccggcatctggagcttgtcggccaaggtcttggcgcccttgagcgagagaatgagccagacgaaggagaggaactcgccaccttctccgaggctcttggcatgtaggtatcccctacacatgctggcggagtagaagagcatgcccacccacacacggtacatcacttggcaccgtgttctgcggcccatcttatccatcaactcctctgcgagcctgcatgcgtcatggacgagagggtacttggggggagggggctcatccaccctgatttccctctcttgttctcttaccatttctatgtcgatcgcagcattgacctcagcattgacctcagcttttgccttgtcgatgatcttctttgccaggatgtctcgtccgagcttcttgaggctatgcggctgctgctgctgagactcaatatccttcaagatgagctcaacctcctccattgcctgcgtgaagaggtgctgcctgctgccggtcatgagcatgtcagggcggaggttgagaaggtgggccatgtagtccgatatcgcctccgtgcactcgagaaatttcctgtcaatctcgtcgatggtgttttcagccatcatgcggcgcatgcaaaggtcagtggcgatgtgccagaggatgacacccctatcaaaggacccacgcaggctgccctgtacctctaggccgcataccttgcgcaggttctcattgagcacccagttgcggcgccccggcgcgaagcttcggtagctggtgaagtcgagacccttggcattcgcctccactaggtcggagaagatcaacccggccagcatgtggtacaggttcttgcgttggcaaacgaagaatccctgtgtgtagccgacatgtgcggcacacttgagcaagaccccagcaggctgtgtcctttggagagctgaccggatgaggttattgtattgggggactgtctcgcatagcgctgcgacatccgccatggacatgagcttgaacagcagctgccggatgggctccgcaaggatgtccagcgcggcggtgaggcagaggagcacgtaggtgatcttcacgtcgatggtgttgtggtggcgcttgctgctggcggcgaagagcacgatggcggtgatgtgaaggaacggcgccaacagtatgtggtaggccaggtatgcaggggtcaacaccacgttggctctggtgtagatgagcgcaaacgctctgcgaagccaacgcttggagcccttctctgctctagggcttagggtccccagcaagtctccctccacctcctccttgctgtcatcttctcccatcaaggattggcattgacggcgacgacgttgttcctgcttgaggtcagagtcggcagctagcagcgacatgtcggagagtatcagtaggaccttgtctctatctgtcaagatgtgctgctgactcctcttgacaacgtcagtgcctacccctggaggaggggtctccttctcttttttcagctggcagcagcggtcgagtatgtctctcttgtccttttccagctcggtgaagcagtatctccacttgctgacctccttcctgccttgtaccatggacgacacagctgccagccggttgatgctggctcgtcggagagcccacggcttctcggtgaagctgaacaccccaatgacgaagagcaggacggctgacaccagcagcttcctgtcaccgccattggcgggccatgacttgtagaaggcgtatatggcgaccgtgacctgggacaccagagtcacagtgtgccgcctccacagctcgttgtcctcgatggtgtaggcagacatctcctgctgcccgccaaggtggatgaggaggaccggagcccataggacctccagggcgctgccattgacacaatgctgtttcgcggcggtggtcgtgttggcgtggcggttgaagagggtggcaagcgcgtagatggccagggcgtcgctgctgatgtaggccagccagatgaaggtcctgaaccagtgagggatggtgtacttgcgcatgggggcagccagcagaaggaaccactggatgcccaggctgcacagcaccaggatgcgcagctgccactcgtcccaccactgcacagcggctgacacattcgtcattctatcatgcatctaatatctgtttgttactattttttttgtttgtgcatcgtaggttcccgacaatggacggttagtttagcacacctatatatcagaatgacacttgttgaacacagtttttctgtagcccagctgaagacttgctttgctagtgaagctcactttaattattactgctacacatgtgcgtgtgggagagagctaaagtgagggataagcattacatgataaaagccgaaaaagagaatgaacatagagaaaaatataaatgtacattacaacttttatcgaaaataaaggaaaaatataagatgtacattacaactttagactttatttatttacagtcatgcgctgcccttcgcgcacagctttgtatgatctctgcaatattcctaaatcttcatatgttagctagtgtggagctattgatgatgtctaactctttgctttgtttacgaggtggtccttactatctttgcatttgcatatttgcgtgcatgttagcgaaataaaccatttgttcttcagccacccaaacatcatctgtcttatcaaaccttcaaaataagagggacttttgttcatcttgcaccgaaaccttttcccttgcttgttttcctcttccttcttgtcggtctgttttcctttttcttttctccttctttctcatttcctttttcttttcttgggccacacctcgttgaggataagattttcttgggaacagttctgttgagtgagagcagtgcaaacacaactttggttcatgttctgctagaaggctagtacagtgtaaacacaatcttggttcatgttcataattggagatattactgctgaaggaggtgcccgcaaggaattgcagtcctgcagataagagatgccatttgctagttgcctccttggtaaaagtcttcacttgagtttatttatttgctttcctcttttccttggctggatttcccacaagtctcgttttcttatcagcaaaaccttttgttgacaaaaggtggtgtgattgtttaagtggggtccgaatctttttcttcttaaataaaggagtggaaatggaatagtgaaaggaatagtgtctctgttaagctttccttcatttatgttcctttcttactcgatgctgttgcctaatatatattcccttatttttatattaaaatgtgcatccaggccacacggttcaaattcttttttttagaacttcaattctaaattggtagtattaattggtgtccactagtaattttaagacacacgcgctcagtgggtccatatatatgctccgggaattttaattagccgtgtgtgaagaacatgcatgtgcatatgatgtctgaatgttgttgtgaaccttgtgtaaggtgtgaggattagtcctcttgactttgtttgtttgggctgtgtacatttaagttggatgtagaggttaggtttttaatccattttctaaaaaaatgtgcatatgatgcatgcgagtgtattttctgtaatatatttgtatattattgaatttggaaaaatgagatgacttgaacttcataacaatatatagatgagtgcgttgaaaatagacgcgcatgtaggtttcattagattctcacgtttgtaggcggatgaaaggtccactattcttctgttacttttgggtatgcggtggctaatcaccgagctactccctccgttctttttttactacttgccatataaaatactggcacagtgcatatatttaataattgaatttcctaatattatcttcgtaaaaattactgtattaaagatataactagataaacatatttttcattataactctgtcaatatcatttatcatattttaaatcttaatatgcatatattagtgggttaatgtatagaagtttgactacacattttctatttatgaaacgatgtagtgatgaatgcttttgtgataatgcaacgttcatgaaatatgtcagaaagaataaaatagcataagaaagtaaatagcaacaagactgaacgtgcatgagcatttgcctttttctttcagcatgtgaacttcaatttagtcaggattatcatggcaaaagaaatatcacttcaccctgccaagaaatagataaattatttgttcgccgcaaaattaatatgcgaaacagctaacggtcctagcgcataagttcggagcatatattcttcttctttccttatggcactcattagcaaggtagccaagaaagctctatataaaccatgtgcatcaccttacactgcctttaacctcctttctttccctaggacctacccctcccctaccctcttgagctttctcaaataaaaaaaaaggaacacctgaatttttttggtgattcaaagagaaaaagacaaagatttgatgggtaacatgcttttatcccctgttaatttcttgtgaccattatttttttctgccttggtttttggatttcatacagaaagtgtgttggtctgtgctaatcttttcctccctctgcgacagcatcttcgagctctaccatgatggcaaggcccggcgctgtgaagaatattgaaagctgggacgagtttacaaagcattttgtgaaatcagaggacaagctggtaaacatatatacatatataatccaatccaattcagatttacatgtgatgtgatcgatcgacgcattcatgcatgcatgaaattaatatattgaaatatgaatgatcaatcaggtggtgctggtattcatggcgccgtggtcggagccgtggaagctgatgaggccggcggtggagaagatggcgtcggggctgaagagcgaggaggccgaggtgtgcacgatcagcgtcgaccggttcaacacgctggggcggctgctgcgggtggaggcgctgccgacgttcgtgctggtgaagaggcaccgggcggtggctcgcgtcgtcggcgtcaaccgggacgatcttcacagcagcatcaacaagcacctcgcaccaccctcttcttctccacaacccattaatatttcttagtgctgttgatgattcttggttgattgcatgatataatcgagtaatgccatgcgtcttaattatgagttgtaattgtttatcacatactgtatttgagacatattcaaccttgtttcgagaaaaaaaaatggagatgaaaaaaaaatctattcatacttatagattttctttgaagaatttgtcttgatagggttgacacgcagttagcacgagagaacttccgtagcttgccttctgtacctgtatggctgtatcgatatgtatgcgtgtcttctacgcagctaagatatgaaatatatcatatgaggctgtggagaaattgactaatttatactcctacgagaaaaataattaatgctttcagaattccatttttcagtcttatgttaatgctatgcttgccaatttaagcactttgccatttttattcaagaaaaaatagtggatgctatgccatgtgtacccataaaaattaattaaaatgagaggaattaatgtaaaacaaaatattatatacacataggatagtatattcatctgattcctaatcctaattctcttcgattgattgcctccatctattcctaggagcctattatatggttctattctagggatctccaccactcagctccaaagagattgaaccatagatccgtggaatagaaaatttcagtataacactgttacattctagtgtttttaagtgagaaattaggaatttaggggggtcaccccccaacataatatagcttcgccaatggaggcaataaaaccatagatccatggaattagctagggaataggccaaggtaatacaagagaattagggcttgtttagttcccaagaagttttttccaaaaacaccacatcgaatctttgggcacatgcatggagcagtaaatattaattttttaaaaaactaattgcacagttagggaggggaatcgcgagacgaatcttttaagactaattagtccatgattagccataagtgctacagtaacccacatgtgctaatgacgaattaattagtctcaaaagattcgtctcgcggtttccaggtgagttatgaaattagtttttttattcgtgtctgaaaactctttccaacatccgatcaaacatccgatgtgatacctaaaattttccttttcgcgaactaaacagacccttagaagaattagattcaggaagtagaataacatgagaggaagtacaggggaaagacaaatattccctccgtttcatcatattataagttgtttttgacttattttcctagtataaaaaatatttggttatagaaaaatgtagcacaaaattagttttatcacatgtaacattgaatatattttaataatatatttattttatgtataaaatattgatatatttttctagatgtttggtcgaattttaaaaaattaaaaaaaatcataacgactcgtaatatgaaacatagtattatgaatataaaataaaacagagagtactataaatgaaagtttgttcaacacattatcacaagaacaacagatacaaccgacatgaagggggattggattctctgacttacatatcaatgtcttaaagttagataaaagtaaatcgaaaattaaaaaccgattcccacaagagctagtatatgcaaacacgcaaacaaatgctcaacacttgcagcatgaccggtccccagcagcgcagtaaaacaaggaatgattacaacacatgttaatgacctacgtcaaaagacagcacgtataaggagactcatctgaagtagggttattgtttgattttacttatttaaccagagttcaaacaatcaattaagtgttgagatggttaatctatcccgagcctcatcggttgacctaataagtcaaaacaaaagccaaaatttaaattttctaacttgattttgaagttacattttaagatgttttaaacataatttctttatagcattgggttttaaatcactatgaacaaatatataaaaaatctacctacaaaataaattttattacctaataaactgttttaacttattagaaaacatagtcaacggatgaggctgcccgttttctaaacagaggcagtacatagttgtacaagagacgtatcccgtgtttagactttctctatactatattcattctagtatatatcagtacaaattaggcatacataattaatttgatattgtactgtacatcgacgaaattcaagcaaaaaaacaattgatcttgcaatcaatcgatcagttagctcttctagctaaaaaaaaaaaaatcaaccgtgcggaatcggcgcgccgccgccgccacggcggttcgtgtccggcggcggatcgacgtacccataatccgtctcctgatcaacagcgacgccgacgacgccgcgcactggccgcttcgtctccgtctccggcaccgcggcgtcagcctgcagattcactccaccaccacttgtcgtcgtcgtcgtcgttggcgacagcactactattgatgcaccgagctccaccggcgg

SEQ ID NO: 12069 - DNA, 8059 bp, Oryza sativa
ccgccgccacaagcagcagccgcattataagtaggagggcgatgacgattagtgatatgaaacggttgggtaaagctcgcttcaaattcagtttatgcatgctatttatgcttgtgcttaattaggaagctcatcacaagcgcgtggcctacctaattaaatcaagctgatcatcaatcacttaattaatttaattcagagatatatccggatgtttaatactcctagttgcttcattgcggcaagaaaatggatcctcctcgacgtccgcgccttcatcgccgatcgccggaacgccatcaccacggccaccgagctgagctcagcaggagctccattgaggagggcactgacgagacgaggccatcggctctgaactttagggatcactgatctcacgcgatataaaacttaaattggtcctagggagatcacgaatgtgttcatttcgcgttaagattataagtaggtcaaccagcgaaccaattataggcaacctcatttccttgttgttttgtgcttaacaccatattatgaaactttcatcatttctccaatccttcttatccacggctcatttcaatgcaacttctaatgtttcttagccatgttgcttcttttgtttaaaggacaaagtctgttttactcccataactatcagccgagtaagaggttttagtactcaactataaaatcggatattgtatagacctcgcaatgcaactgtccaaaaatcgaacaagttcccctcgaatggcaataaggttgtttttgcaaagttggcatccaaataaattactaatatacttttcactaacatgtcacgtaatttcaataagcaagatagtaataataagtaaaagacacagtaatccatcccgttccagatgggctgaaaataaaactttaactggcgggccgttcgacttatgggccgattatcgttgggcctggacggcccatggataaggacgatccccatctctccggattccttctttccttccttattggggaaaaataaaaaagaaaaaaaaagatatggtacaacaaccgagagctcgctagtcgtcgtcctcgaaacgctcgcggcgactccggtggctgccgcgccgccgcctccggccgccgtaccagcctcacctcgcttcggtaatccctcgcctcactccatccatccccattccccaatctctccggctcctgcttgcagtagtccgctactcctacgaattcgccgccctcctctacttgttgatttggcctcttggtatggaattgagatcgcgaaatggtgcctccatccttgctggctgggcttgggtggtcgatttttttggggtgcttggtggttgatttggtggtaggatttcgtggtggggggcttaggtcattcacggtcaatttcgcatcggcgatgcgtttttcagttgatccagtagtttgtttcctctactggcgaatcgtgacaaatgtgtgacttgtttgggatatgctacggcaactcgaacctttagtcggtttgaacgctggtccgctaatccacttctcagtttcttttttctttttaatttttgggtctgtttttgtggatcagtttctactgattaggcagatctgaaccttgctttgagaccaagctaaagtttttctctttggacggattggcgcagagaaattagttatcttgtttctttttctttgccaaatgttaattaaccgcagtgaaggattagcctagtaacagtatcccatgaatgattaagtgcatgacttaatgacaaaatattttggtgctgttattttgttcttgtaaagcatgatgtttagaatagccatccattcctgttctatatcctatgctgtcacgtagacatgatatgttctccttccctgctgaaaaataggcttgcaatcagttagtatttgcctgatgcttgtttgtttctttcagatggaggatggagtgtctacttatactgttgatgaggctcttatttccatggggtttgggaaatttcaagcatttgtgcttgcgtactccggaatggccaagatatctgaggcaatggaaatgatgcttttgtcatttgttggacagtcggttcaagctgaatgggagctttctgcgcaggcagaatctctcatcacaagtgttgtttttgtaggtatgcttgtaggagcatattcttggggcatagtctcagacaactatgggagaaggcaggtcctttactatttacattccactgtttgtcagatttatttgaaatcttcattacaaatctctctccctaacaatatacagctattcctattactgttaattattgcatatttatcttctaatagaaaatctaggtattggcattttaatgagtcatggtgctcttgaatgatatcaaatccgtattatagatatgatagtacaactcttcaccctatggctttactaaatacgatgtcttctgggatagtcagattaatgtaacccttgctagagcttctttgagagactgagagcctgagagacaagagcttgtgtggagtttggatgtaggcctgcaaatccccatatactagactgttcccacttttcagtgacaatgagtgctacaacccagctgattaaccatatagcaaattgacagagacaatatcatggttaggaggaaaatgtgcatgacactagatgacaatctgaaattcattttacttggggattcttctggccttccagtttttctaaaaaagttccaagatactccttttaaattttctgttcatgcaataacaagaaaattacttggatttcataaggatcactcacagaagccctctacagtacttaatcaccttgagatgatgttttcatacattgctggtgataattttaatagccagttctctcattaatctaaaagtatactaaaaatacgcattttacaggatgtaactttatttttctgactgtattcccttgatacttttccagggttgggttcaatttcacagcccttgtaactggtggggctggtcttcttagtgcatttgcaccaaattacctttctttgatcgtgctgaggtttatggttggtgttggactgggtggtggaccagttttatcttcctggtttttggaattcattcctgctcctaaccgaggaacttggatggttattttctcagcattttggaccattggcacaataatggaagcttcactagcttgggtaaatttctacattttgccaaagtaatactactgtttgcaatctgccttgggtcatagtggttcaactgatcatacaagtcagttaaacagaacgatgcaacatatgattttaaaacagtcgctatatttattaaaacagtggagattgatgtaattgaatttctttggttctgcactgcagcttcgatgcatgtgtttctgctaccctgagtaaatttaacagtgataaaatattagaatagatcagatcccatggaacagaataatgagcttgcatttggttagtcagtgatgatttatgcatttcatataatgtaatggaaactgcaatgaacaatatgttgccttctagtatgtactgatgtatgctccaaactgtcattctaattttgtaggaacttattatttgtttaattttcaggctgtaatgccagtttgggctggaggtggctgctagcgttctcatcgttgccatcatttgctctactactgttctatccactgacactggaatcaccaagatacttatgcatgaagggcagaactgctgatgcggtgcaggttttggaaacaatggcacgattaaaccgtgtagctctcccttctggccatcttatgtctggccatcgaatggagctccatgagttgacagattcctcagagacatcacagttgctttctgctaagaaaaccaaccctgctgctcattctagcaaaaccgagattgggggccgcaatgcgattttaaagcttctgtccccaaatttaattagatctagtcttcttctttggactgtctttcttggtcatgccttcttatactacggtcttgttctactaacctcggaattgagtcatggaaataagatttgtggatcagaggggatagtaacaatgcaaacaaaccactcaaacgatgctaatctgtacagaaacgtgttcatcactagctttggaggtacatgtgtttcccccttaggctttaccatatttcttgagaatgttctacttcatgtaatcacattcatatcacactgttgcagaggttcctggccttatactatctgcggcaatagtggacaagattgggcgcaaactctcaatgtcctctatgctttatatcagttgcctgtgcatagctccccttatggtccctcaaacagagtccctgacaactatcttcctgttcggtgcacgcatttgcatctccgcaagcttcattgtcttgcacatctatgctcctgaggtttgcttgatcactcccaacatccccaatacttggttacatcgcttgcaacaataaaaagggaaataaaatcacaaaccattgcctcatgtattatcttctttccttgcagatatacccaaccgcagtcagggctaccggagtcgggtttgcgagctcaatcgctcgtttcggtgggatcttgtgccctcttgtggccgttggtttggtgcacgcgtgccatcagactgcagccatcctgatattcatcacggtgatgctcgtctcaggtgttgcagtctcatactttcccctggaaacaagcggccggaaattgagtgaccacatcgcggcgtaagagctaagttgcgagcagaatctgacagtgttgcaagtgctagtttctttagctatacaaaattacaggattgagctcctagaggccattcagattttttttttctttcagttcgtttaaagatcatatatatagaatagaaatgaaagatggtggatttcagattttaaatgtcattacattgttttaaccagacatatgtaaactgccaaatcgagatgcttgctttgctctcttgaaatgggatgatcaatatgttttgaaggaattatagtgcgtcgatcccccttacgcctcttttctttttgcaacagtactgtatagttttacatggcttataatattatagttcaaaaaaaaattcctcgctagaaataaaaagtgttgttcagaaaacgttcggtacactacaggcaatagggggaaaataccagtaaaaaagtggtattgtactatttttttcttttcttttttattttggctgctgcttaattaatgggccgtgttgggccggcccactgacagttggcacggccccacgcgaggaccagatttccaaatttcgttgaaacgaaacgaacggcttcccgccactctcggcttcctcttcacgttgctttctcccccaacctctctcctccctttttccccaattagccatgagagagagagaggggaattggtgaggtgatgctgcgtgtgggggatgatcctctcccagctgggaggctcctccgtccgtgctcccctcgctgcgccgccatggctcgccggtggccgccactggtggtcggcctcgctctcctcctcctcctctccgtcgcggcctcctccgtggtggccaagaccgaccagcctgacggtgagccaagttttttctgcaatttttgttttcagatttttcattcggtttcctctctttcaatccatgatattcatggattggattttgaaaaatgtggtttcctgactgtttgccttctcgtttcagttgctgctctgaacgtgatgtttgagagcatgaacaaaccgtctgaattgttgggttggaaagcgagcggcggtgatccgtgtggtgatgacgacgagtggaaagggatcgaatgcagcgattcatctgtcacagagatgtaattcactgcagcactttttacctttgggattcttgatttgcttgttttttttctttaaaaaaagacggatgaacaggcgcacttctgaagaacttttctctttttcatacaagatgttcacttcagtttgctaatcgcgttgcatttgcatagagcagcaacttgtcggggcttggattaagcggcacgctaggttatcagctatcgagcttgaaatcagtaaccaaattgtgagttgcccctgtgatttcctgtactgatcatcctagttatgcaacttagtgaattttttctctttcatagtacagcgatgtcagcaagaacaatttaaatggtgaaatcccataccagcttccaccaaatgtggttcagttgtaagtttctggatttgtccatacgtacttgctgttttcatgggtaatacaagtgtttttttctctagcacttttttaaagggttttcttatattctcttttctctaatacagaaatcttcgaggaaatgcttcagcggtggtgttccttattcgatatctcagatgactgatctggaaacgctgtaggaacttttcattcataccactatattagtattttcagttgttttgttttcctgtacttacgcatgattctgatatctgttttgttgataacttgaaatcttttttccccatggattacagaaatcttggtaagaatcaattgagcgggcagttgacagatatgttttctcagctgccaaagcttacaacaatgtaagcatgatttataagtttttccacacaccaaagaaagaaaaaaataagagttctctgtactttttctattacatacctacataattgtaatttcgcgcaatgcaaagtaatcatggtgccaattctcatgttacttctattgcccaaatcttatatatcagttgtgtcttcagggatttgtcattcaatagcttctcaggtaacctgcctccgagttttcaatacctcaagaacctcaaaacactgtaagaaactgaattttatgaactatagtaattcatcgataagttattttggatgctcaattgactgccattgtttccaaaatatatacagagatgtggagagcaaccaattcagtggtcatataaatgtgctggccaaactttctcttgaggatctgtaagtgctattcaagtgaaaactgcatccggaactactcttatcattgtccttcaaaatatattattcctaaatggctcacagcggcaataccgaagtattgatgttatcaaatatcaagagctgttaataaaatttatttttttaggcacaatgcaatcgttatttgttttctatagcttaactacattacttaaaactcataagtacaatctcaaacgtatgaatttttttaagcacatcagttaggaactaatctagaatggttttcctccttttgttcccaaggaatgtgaagaacaacaagttcactgggtggatcccaagtaaactgaagagcattgacaatttagagtaagtgggacatccagtcaatatgcctatttttgttgcacttgtgaaatctgatagttctggtcacatgatgaaggactggtgggaactcttggtcatctgggccagctcctcctggcatggagaaggagtcttcggcaggaagctcaaatggaagggatgatagcggaatcaatggtttcgccattggagcaatggtgatagctgtgcttcttgcagctctgattctcttgtctgtgctgaggaggaatcattcctctcccgtctcatctcattactacacggatgagtcaggtcagaaccaaccatttaccccgctagttgatgactcgagaagtatttatgcacactgtatctcttgaattatagaaaactacgtgggttcctttcagccgtgcatcattttgtgatgtgtagggaactacgaataattaatgtgatatgtgattctggtaatttaagtttgagacgtgcactaagagttctcatcttgcttcattttctaggccgtaggaattcttcagcagtcaacatgaagtcactggagcattccccatcgatgggctgtaagacaccgcctgctgttcctcgcaag

SEQ ID NO: 12070 - DNA, 2338 bp, Oryza sativa
ctaaggtctcaaagaagaatgcttgaagagttcaaagaggtcatataccttgaattatgtgtgtactagctcatcaattaccatgaacaaatttcaggtactggctgtcaagaagtttgatccattgagcttctcaggaagcagtgacttcatggacaccgtcaacggcattgccaagctgcgccatacaaatatctctgaacttgttggttactgctcagagcctgggcactacatgctggtctatgattaccatatgaatggatccctgtatgatttcctgcacttgtcagatgactacagcaggcctctgacctgggacacccgagttcggatagctgcctgtacagcccatgctctggagtaagttgacaagtaggagtaacattgaatcctagaatccaaaaatacatcaatttgaattcatgtgtaagattgtatccctttcttgtcattcattcaggtacctacatgaggtctgttcacctccagtgctccacaaaaacataaagtcttcaaatgtcttgcttgatgctgatctcaaccctcacctctcggattcggcctttcattcttctatgaggtttgcatgcagagtggctcttctttaacaattgatgaacaaagtataataattgtaagaacaatgtggtctaacggtagggaaatctctacaggacgcaagtgagaacttgggacctgggtacagtgctccagagtgctcaagaccatcagcttacgtgatgaagagcgatgtctacagcttcggagtcatcatgctggagctactaaccggccgaaagccttatgataggtgaattaagggggcaaaaagataaaaccttgaaattcactactgatatccataatgtgatgcatcatctaatgtctgcactctgcacattatgcttactttctctatgtggctgtctgatggttctacagctccaagccaagaacagagcagtgcttggtcaagtatgtggctccacagctccatgacagcgatgcgttgggatcactggcagatccagctctacgcggtctctacccaccaaaggcgctctcccgcttcgccgattgtatcgctctctgcgttcaggtgagctccttattgtcgaagagatatccccatcaatgtgctccatgtctgaactctgaagtaatttcagacatagtatgctatgtcattcaacctgagtagcaccccaaggtccttagttcaaatctatatatgagcgaatttcatattggttatttgagggctaagttcctaactttataaaggctgtatatatccggttgaatgtagagtctaggtaaaaaaaaaaccttctattaaaaaaataaaaaaaaaggtctgaactctcaagtcatttcagacatactatgaagctagtagtctgaactctcaagtaacttcagtacagtatgaagctatgtctgagctctgtactgtactgataatgggaaatggggggtgggattgggattgggaaatgaatgaagggttaggattaaatagaagagggagaatgaatggttaggatttaaagatgggtgggaaatcatttccctttcccatttgccaaacactacctgaagttactgaatttggtcttgttggtggtgatgcaggctgatccagagttccggccgtccatgtcggaggtggtgcagtcgctcctccgctgcgtgcagcgcaccatcagcaacagggggatggccggatacttaagcaactcacagcggagcgacatctccgattggtgatggtgatgcacttcaccgaatcattgccgactttgattgaggtttatctgaagcaaaactgcccgtcaagtcgttcgtgccattgtacaaaaagaaacggctttgaggttaagagtaatcaaattggttaatttttagagaagacggcaagaatgcgttattgtattctacttgtagtgtatattgtactgatttgttcttccccctttgttttgtttttatcgctctaaggagcacatgtaaaagtctgatactggagtagatagttagtaaatgaatacacatgtaaaaggcctctctacctagccacctaggtaacagcaagttcagtaacaggcattgctgacatagcatgaattcccttttgtaagatgacaaaacatgaattcacaagctcaatgatcactacttatgagaccaaatctcacaacacagctaaaaacagccgtttcctagcaacagaagatccaagcttaactagcaaactatagatgaatttgcagaactcatctagtcttgcacatagtacccaaaccgagtatacattgtcacacagattacaggg

SEQ ID NO: 12071 - DNA, 8449 bp, Oryza sativa
  unsure (1)..(8449): unsure at all n locations
tctgagtcaagagcaacaagcacatagactgcgtagatgatgccagggacatatccaaggatggtgagaagcaagcagatgcacaactccatctgtgtaagacataataaatatcaacactattagtatgtgaccacgaggggcggaaaagatagaatgcacaactgtcagtagtgttatcagcacaaaaaaaaaaagcttgttcatcgctgattcattcggactatgcctatggtttaacttttgatatcaacacaggcagatgtagcagagtcaagaaaactatgccattatcactagtcaaaattcaaacataatccccatgctctttgtgcagcacttccacttgagcctaaaaattggcctggggatgactaagttgacaatatatgcgctataatacatcgaagaaccagtttaaaataaaataacaccaggcagattatatggacttgtgacaaaatttcagcctactctcttggatcagttatcagtagatagggattgcataattaccagaaattctagggtacttacactgcaaggattaacataaatcataaatcacaaaccgacagtagcactttcatatgaactccagatgaaaaatggttagagagagaaaccaaaggaagcccaattgcataggatagccattgcacgaagcagagctacatcgagagttgtccacccaagattcagcgttggcagcgcagcgtttggagctcggggattcgcaaccactcccagtatcctcgaattattattactggatgcgagcaaaatcgacctaccagatcgcaaaaaattcgccccccgaaattgaaattctaacgaccagatgcacacgagacaacgaatccccccgatccacctatccacgaacagtagcagagcgagcgggagatcgtcggggaggcaaggagagagatagggagggcaagaaaggggattcgtggcggcgtacgctgcagcatccgagcggaggaagacgccgaggggcgggaggatgatggcgagcaggatctcgaggaacgtgcagcaccggccggacgccatgggtggaggatctcggatcggatccggggggatcagaggcgagcgggatctaagctatctcctcctcctcctcgtcgtcctgctgctgcttccgctggctgtgtgtcgcgtgcgcgtcgtctcgccttgtcgcgttggtcggtggcgtggcgtcgcgccgaggagattattacaggacggacggggtatgggccgacacgtcgcctagccttaattacttatcattggttagtttatgagtaaggcttaatcatgatttgtatgatggttaattacttattccaaatgtttcaaattgatttatcattctatctttaatctaacttatgtcacgttgaacgagtccgatgaaagattaagtatagagacataaaaatgagaaatcattagcacggacttccttcatttcatattataagtcgtttgattttttcctaattaaattttattagcttttatcaagtttgtagaaaaatttagcgatattaaattagttttatcaaatttaatattaaatgtatttctataatatgttacttaaaaaggtcaaacaacttataatatttataatatataacggatagagtatgattcattgatttttgattatttcaagattaaaaataaatttatatgatatttgaaaaaacttttatatagaaagtttttcacgtaaaatatatcgtttagtagtttaaaaaacttgttaacaaaaacaaataaaatatgtgtttcaattgtgaaagaatatggattaaacatgtctatgtctatttttaccattaacttttgaaaaatcgtttattttaagacttatataaattacgaattcttatgctaaataaaaactttgtgatattagaatatacgaatttataagaaataatagttaaaatagacatgctcgacataacccaaaactaaaacgatatctgacaatggttaatggattgattgattagctcagcaccctcaaaaccggacacgggagcctgcagtatcatcgacgcgacaccggtatcgtgtacggattctctccttgttcttttcctctttgtttagaaaaacacaaatcatatccctcttttaattaattttattaaaatgcattgtccccgattccatcgtacacccctgggggaccagcctagcaaaccaggagccccaattggctgtaaactaaccaaaagcatcgcattaacatctacccgtactaatcccatgccagctagatcatatgactacttaattagcatgctaatcgcacagtttaccgtatttagcaacctcaaatgcaaatcaatctgcgataacaatgtcaaattctaagtccaataaagtgcccacgtacagatcattttttttttcgtgaacactaaaaaagctttgatcgcggatatattacaagattacgagatccagggacaacaaatctgacagacaggtttgcattgggaatgatcctcgtcttgtaccatcaaacccaacgtgagctgcgtgattaagattaagaatttaagattattattataatgttatcggctcaattaatccataggctcccaggagttagtggccaacacggcaacacatgccaggatcccagctctgcctgcagaagcacacacgaaacaacctaaaactaccctgaaactgaaagtctcaactctgaaaaaatggctggaaaagcgacagatgatcaggagaaaaatattcctgaaaaatggcgagatctctttactctaattggctggctggatgtgtgcatatatgaaggattgtactgtgattctggtgaagattcaggaacataattaatgaagttcttagctatgtgagtttgatccgtaatcttcttgttctgaaagagaaaaacgaactctgaatctgaagagattatgataagctacaggagcatactacgtacagagtatcctcctggcatgattagtagcgtaccgactttaattaaccctttaagaataatgtatactagtagaatactgttggagattagctgacgtgtggctgtcttaaggtctccttaattatatattatggaggttaagtacagtgggatagcaaagcattgtgatgtttgcataattgcattttttgccgccattaaaaaggctgtgtagccttgacatgccgacatgtgtgaccatctaatcgcttttgcttaacaactacaattagcttatctaattttatcctccaagaaatcaatcaaacaaagggtgacagatgttcagagagcttgacatcccagctgtaaatttttgttcatacactgaagccaatacttttgagacatcagttagaaagtagaaaagaaaaaatctatcttgatgtgtggtgtttagccacctggggcttgaaagtttgatggtgacaaatcaaacggtgagataatcactatatatcctgtcaaactccgtttgatccttgcgagtatgaacagagtttcgttcagaagtgtatccacaggttaataatgaatacttttccgttcatccaatatgagaagtaattttccgtgccacgtgaatagataaagctttttgcacaaggtgacaatggaaggtagatactcacatttgtagcattgcaatttgatgatggaaggtagttttggatcaatgtcattcatgttttaagctattaattaagctgcataaagtacataatgtttcgtttttatggaacaaaataaacgtgtgagtattgtacgagaaactagtacacctaagaagttgccaaaagaaactagtagttgccatgataaatgtgccacgatttaacctatattcttagcttctgaattattatgtgcacgtttcctaagcaactaaatagattttttaagaaacattatatatagaaatttcttagatacttttcaaaatccatctttatttttttatatttaattcattttatatgtgcctttgaattgtaataaaaaaccaaaatattaactataattatcggctgcaatctaattcgaatgtagtaaagcctctactatggatgtggttgagaatactattatttcatcatatatactcagtaatggctcaaatctaattgcaattaacaataatcatttataggtataccgtaaaagtaaacttcgatataagaaaaggaaaagtaaataaagcaaactattcaatcactagattaattcttacaactatatgctcatgttaaaaacattagattattctcacaagagttattcgatgataatacgatcgtgatgtaataactgcagatatattttaacaaagaagcacaaatcaaaacaagaaattatttctttactagagataaattctctatttcaaaagaaagaaaaggctagagataaattctgaggcaggagtatatgtatctgttgataaccaccaaaacggtggatcggtgatctaccggaggaggagagggcattgcaacagggcggcgagcgagagagagaagggagggtggcggtgaatagaaaaaggagatacgcaatcttccccgaatcccccacccctcctcatctccctccttcccttccgcctccgcctccgactcctcctctccggctctcctctcctcttcccgtcgcttccgccccctacaaatactcgcccacctcctcctcccctccccttcgcttcctcctcacctcgcctctcctcgcctcgccgccgcctcctccctcgtcgtcgtcgtcgtcgtgagtaccctcctcctcccactcctcatcccctgcttcgattccgcgatgtttggttccgtggcgaagatcgcccgcggggatcgggggagcgccactgtttttgcgattgtgattggggtttgcgtttgtaataacggtgctggttggatgcaggggggtgtttggggggattcggttgggcggcgacatgggggtgtacctgagcacgcccaagacggagaagtactccggcgagggcgggaacgaccgcctccgctacggcctcgcatccatgcagggatggcggacgaccatggaggacgcggtgagttgagttccttccttccttcctccctccctctgtttccccttccacattacattattgttggcttctgctttctggttgattcgccaccaccctaggacccggaattcgcaactgttttttaggtcaggattgtctctcgtagatttgcttgattggttagccgccaaaagttgttgttccggggaactggctacgtggattgattccaattgcgttcgccaatggtggtgttctgttgccccaatgataagactcacggtagccttttgttgcgccttgtcacttgcatttggagtccagtgccgatactagggcagataaattgatcacgatgattagcactaggagtgccgttcgacattgagttctcattgatttggcatgacattagggaccgtttcaggtgaaattagattgaattagtggctgtacctgttctttaaacgcttattgagtgcatccttacattgcagcacactgccctgccacgcctggacgaatgcacatccttttttggtgtctatgatggccatggaggtaagttttttcattgattttctgttcatgtccaactcgctattatgttgcatcttcagatctaaacaaagacgagtgcgatttaatgcctaccatttggtgattgaattaatatcatcttacaactttatccattactagttgcaaatgattggtgcctctgtagtttcgatggcataaccttagcaagttcaattaagcatcgccaactttcacctaacaaactacacatattaggtaacctgagctgtgttgagttgatgataatctcatccattcatttattcatcatctcatccattcatgcagattaggtaaacttagctgtgttgagtttggtagtccagtaacctaacagggaaataacaatcaaacagtccaacattttcacattccctttttgatcgttgtaaaaggtagaagtgcattgagtaggtttaaattgattcatctttttcatatattttttttgaaaccaaaacttaatgcgcttctatgttgtccttttatccacatcatggacaaaactctttatgttgtgacttgacaaactgtcctttgtaattccagggaaggcagtatctaagttttgtgcgaaacatctacacttgcaagtactgaaaaatgaggcttattcatctggtgatttggctacttctgtcttaaagtcatttttcaggtatgtagcatgtacctcttttgaacatgaagtgcttttcagtgaaactatcgtatgcttggtggttttaatgagtctgcaccgctttttaccctttcagaatggatgagatgatgaaagggcaaagggggtggagggaactggctgaattgggggacaagggacaaaagtttactggcatgttagaaggcataatatggtccccgaaacctggagagtcagataaacctgaggacacttggactgaggaggtaaaactgctattctaaaagttccttcattaccaaccatttttgctggatgatggaattgaggggccatctttgatgtcatgatgcttcagagttattccttggtagaacaagcatttgacgggataaaatactaaaaactgattcgatgctagtaattctgaattcatatttaaagaggcttgtcttgagtggtgctgctcttaagtatgtggattggtgaagggggcttggtcctgcttgttatgtgattagggtttctgcagagagggatgtctttcttaaaatacccatttaaatccttaagggatgtctctctagtagttatcttgaaaatatgagaagtgctcttgagtcaggagtgcctatgatcgttgcatctgaaacttaggtcaacactagtttatattagaaggtgatgtccagttatttttaagcatgataacatgtgatctaaaattcatttggtgaaatacattattacaaaatatgtttgtacaaataaggaaaacaaagggaatatgcaccattcgttagcactgagcatatatgtaacttacgaaacatcagctccagagttctatatttttatacatgaccttgtttcctaaaaagaaactgttcttgtgaaattctagtgaatgtagagttcaactaaactgctctaactaagttacttaaccagggtcctcattctcattttcctgggccaacatctggaagcactgcttgtgtggctatcataagaaatgatgaactcattgttgcaaatgctggtgattcccggtgtgtgctctcaaggaagggtcgagtacgtcagtcagacctctatatctctggttttatttgtgaagaaaatgttagaatatgtgtcctgactcagtcttctgcataggcttatgacctgtcaaaagatcacaagccagatcttgatgcagaaaaggagaggatactgaatgctggtggtttcattgttgctgggcgggtcaatggaagtttgaacttggcaagggcaataggtagcaccctctcttctcatcgaaaaacaattccttagctacacgcataatttttatttatccttttgtgcttttccaccaggggatatggaattgaagcagaatgaatttctcccagccgagagacagattgtcactgctgaacctgaattaaacacagtgggttttgttgacaatttctgtcactgtatttgctttggacaacattttttgtaacatggaatttattcggcttgctcaggttaaactttctgaggatgatgagttcatcgttttagcatgtgatggcatatggtatgtcctttgcaccaatcattctctcttgaatatcttattgagataaacaattttagctatttttaccatctggtgtagctgtgctgatttttgacaactcaattttccaacaccagttttagtttattagcagatttgatttttttagtaaaaagaaacaatagttgtaattagggtaagtccaaagaaatgacatcatcttctattggtaaaccatttggacagcccttggagatagtaattcacaattctttttagatgatgtgtactagtgcactgtgtggcgtgcagatgctgatatgtaacttcttttataatggatcccagatacataaacatccagataactttgtatactagatgtgaagctgattttttatacctgcagttattttgaaatggtgctagatcttttgtcaactcttcntatggattattctgtattctttgtagtttcactggatagttatctgagacgtgatatcttatgacagggattgcatgtcaagtcaagaagtggtggactttgttcacaaagaaatgaacactgtaagcaactgatat

SEQ ID NO: 12072 - DNA, 3516 bp, Oryza sativa
  unsure (1)..(3516): unsure at all n locations
ccgagaccgaaccatggagttccaaccggtgatagacaaaaaggatagtaagtggtgtatataaaaaagggattctattctacagtcactatagggtttgttctttctttcaactagcatctttttcttgcaccacaacctgtaatacatgccatgttgcttaatcgaactgggttgtgtgaaatgcatgaattttccaatgctccatcctgtcgctgctttctccgcctggaaattttttcctgaatcctgatgctctatcatgaaccaatattcttgctgaattaatacttgaatataaatctgattttggtgctacattaatcaagtccctgataaaaatgcgagcaaaacacacaatgtgccaatgttcttgagttcttccaagcacaagtgcagagattaattaatcatggcaatatggcgacagctgcggcggccacggcgagcactgccatccacacggcggcgcccggcatggcggcagcggcggcctcctgtgcggctccgtcgccgccgtggttcttggcgccgtcgccggtggcattgtgcttcagcgggtggacggtgatggcgaccttcatgccggcctggcagaagccgttgccgcagataagtagtagcggcgtgagtcgttgagcgggatgaagtccttgccggaggtccagttgccggcgaccccggccatggtgcagttgtcgtaccccgtctggttcacctcgaacacgttgtgcgtccccttctggtacctgaacgctgcaacgccggcacaagcacaagcatctcgtcgtcggaaatcattgctgctggagcgaaagaaaggaggagatggagagaggaggcttacagatgaggtcgccgacgtagaaggtctggttgccggaccagagggagtagtcgatgtttgggttccagccgtggttagcgccgacgatatggtccgtcgcaccggcgaggctcacggcgaagccggcgacgacggcgacgagcagcaggtggcacgccattgcgccgccgccgagctcaacccagggagccaatggaagggtaagaggaggggagagagaagcacgggcgatttgatttgatttatgtgccgttcgtgtcagaaatctggacccttttttgttcagcctttggcctgaacaaggtaccatggattagtgcaaattgggcgaaatttgaatcatcacgcgccaccgccctcgacgccggcggcaaacacgccgccctggccccagcttgtcgccgccgtctacacgccgtggaacgtgaaaacatgcggacgcccacatggcagggcaactcagacgacaagactgaaaaagacattgatcatggcaagttgatattgattccatgtctcccgacggtctgagaaatcatgccacagaatgcggagcaatttcataccgatgcctccaaagttccaaccacaagcaaaattaaaaatgggagaaatgtcacacacccagagcacaccaccaacacccaggttggatagtacttgaaagcaaaagggacatttcattctaataatataacagtgattaaattgttactggtacatcatattgatttcatactggtgccagagtcaataataccattgattagagtacaagcagttcataatcaattgaattcttataccagtccattaaaaaaatttcaccaaaaaacaactccatcacaatgtgttctatccttgtagtcttgtactccaaattactacagtaagatgtatcgtttagccataacaaacataaattgttcataaactaaaacctaaaatgtaacttcactgaaaatttctttaaaaaaacccaggggattgatccccacttcgaacatacaattcccatgactcagaaggcttaaaaacatatgctgtgctctgtagtgttgcaactaatcaatcttcacagatgagtaaatcaacctcgtgaaccagaaacaagcgcagaaaccgatagtaccagtaagcacaaagaacgctaatgaagcaagcaacatgtacccaaagtacaagatgccagacaccagcttagtaatctgcagcttcgtgaagaagtagaaagcagcatataagaagagataaagtgctgaggatcccgaagtgaggtaagatctccaccaccacatgtagtcctcactgcacagttggaaatagcagagcacgaccgtaatctcggcacaggtgatgatgaggataacaaagacgaggaagaggaagccaaagatatagtagaattggtgaagccagatagaggtgaggatgaagaatagctcaatgaaaacagcaccaaatggtagaatgccaccaattagaatagtgaagattggattcatgtaccaagcttgctcggggatctgccttggaatcttgttggttttaactggaggttccagggcaggttttttgaatccaagatagctcccaacgaacacaagaggcactgagataccaaaccaaaggaggaccaaggcgaacatagtggtgaaagggacggcaccagatgacttctccccccaaataagagcattcaatatgaagaagataacaaaagcaatccctggaaataagaaggctgtgcgcatagttattctcttccactctgaacccttgaacatcttgtagaggcgtgaagaagcataaccagcaagcaaccccatcaagacccagacaagaagcatcgcggtcatcaatcctccccgatttgatggagaaaggaaacccagaactgcaaaaatcatcgtaaccagcagcatgccgaagaattggacaccagtaccaacataaacgcagagtaaatcagagttggttggggggcggaacacatctccatgaacaagcttccagccagtttcctcttgcgcttcttcttgagtttcaagttggttgtatctagagatatctctatatagagtgcgaagcattatcattgcgaccataccagacaggaaaagcacgatcatgagagagttgacaatagaaaaccagtgaatctgatcatcagtcatcaacagataggtgtcccaacgggaagcccacttgatgtcactctcctgcaatgagggaaaaagattcaatggaaatcattgcaataaatttaacattaagagaataggcaactatcacatgaagggggaaacagaatccaaacaaaacatgcaaaactagtacctcaaagtgaacatcataggtgaatatgatttctttgccagcttcgacctcctgaggagagtcagaacttgttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12073 - DNA, 1460 bp, Oryza sativa
  unsure (1)..(1460): unsure at all n locations
nnnnnnnnnnnnnnnnnnnnnnnnnnnnnnnnnnnnnnnnnttcatgtatcctgccatggaggagggcagcagctacctgcgtccgttgcatttcttctccatcttcgttgcattcgcttccttctcacaatgtggtatgctcgtaattccccatgctcttcatcccaattcttgtctgtattttgtggtgatttaaatttggatcatgttcattgttaagcacaaccaaggcttaactacgtcgtgttcagatactctgaccgtcaaaagaatatatatccttcaataagctagtctagtgccacaaattggtttttttttttgacggtttttttctcaagcatcaaattcgttgacccctataagctgacaatcaaatgatttgttggttgaacaggagcaagagtgttaaggccagatgagctactactcgatcactactactaccactcgtcgtcgtctgatccatactacagcacaccgatccttccaccctacggcgacgcattctcaccgccgaaccctcctccccctcctcctccgatgtcacccagctgcctcctccctccgatcattccggcaccaacattcacatacagttctcctccaccgccgccactctactaccctccaccgccggatataagcccaagcccgccaccgtctgttacaccattgccacctgtagtctacccgagtccaccggaagtcacacctagtccaccggaaattgcaccgtatccaagcccacctgaaattgttcctagcccaccagagatcacaccgtacccaagtccacctgaaatcgttcctagcccgccggagatcacgccatatccaagtccacctgaagttgttcctggcccaccggagatcaacccgtatccaagcccgcctgagattgttcctagcccaccagaaatcacgccatatcctagtccacctgagattgttcctagcccaccagagatcacgccatatccaagtccacccgaaattgtgccaagcccacctgaaatcgcacctagtccaccgatcgttacaccgatgccacccataatctacccaagcccaccggaagtcacacccagcccgccagaaatcacaccttatccaagcccaccggaagtcacaccaggcccgccagaaatcacaccttatccaagcccacccgaaatcacacctagcccgccagagatcacgccgtatccaagcccacctgaagttgtacctagcccaccaaagatcaccccatatccaagcccgccggaagtcacacctagcccacctgagatcaccccatatccaagcccacctgacatcgtccccagcccgccaagctatgagcctagcccacctagctatgaacctagcccaccggagtacgcgccagaaccaccggtgtacgcgccgtatccaccggggatcttcccgagtccaccggagtactcgccggagc

SEQ ID NO: 12074 - DNA, 13730 bp, Oryza sativa
tgccggaggggataatccagccggcgatggactacgcgtgcggctccggcgccgactgcgactccatccagccgtcggggccgtgcttccggccggacaccatgatcgcccacgcctcctacgccttcaacagctactggcagcgcgccaagtccaacggcgccacctgcgactttggcggcaccgccatgctcatcaccaaggatccaagtaagcttcttcttcttcttcttcttcttcacgcaatccagtacaaaatgaacttcttcagattgttcagagttcagactttcagtgaccaaatggtgcagcaattatctagttaacagcctgtaactaatgtgaccttttcttttctgtaatttgattttgtttacaggttatggtggctgccattacagtacgatgtgatcagatcacaccaagaaatgcggggttttggatgttggacaggaacctctgaaagtttcaggcttcagaggtactttgttctgatgttgctaagggtgtttattgcagttgatcactgattttgtatagagtaaaagggctcaatcaatcctatttagagagattcttctaacttttctttttgggcacttcttattgttttgtattgttctgaataaggttatgtaatttgccatcttagtaaattatcataaaggcaatcgaggtaacatctgatgaaagtacaggtaactgcacaacagtgatcactgaaaaaccatcgactgtatgggcaacatttttcagtgccagatggtaatgtttattctggcacatagcacactttctcaagccttatctgcagcgtaagatttacatccatgcgcgcataaatcgacctattactaacctctgaacggttgccactgtgccctccttgctcatgctggaacttcatctgaagaagggaatgactcaagaacataaactggatcgccgaccttgatgatccttccttcatcttttgccgacagagattccttgcagactaaattttgcccaaaatagacctacagaaacagaaggcgatgaatatggtcagttcttatgtacttaaactactctcagcttctcatagtctcaagtctccctaggataaatccgtgacagtttaatgacaattacccggcgtttatttttgtggctcggccgcaacacttcatcaaaccggagtgcttgtagagcttccgttggttcctcaccaggaatcccattatcttgattaatagtaggcacctgaagtagagtacacaaaaactaaggcaagagtatagctacactagctgtctagcttggcagttcaagaagtgcaaagcatacagacaaactctgatggtttaactctctagcaattttacataatttttttttataaataactgttgtctgaatgactccagaatcatcccttagtttgtcggtgctaacttcattgcaaagttaaacatggcagatctggagtctatgaaaaagcaaactacacactttatgctcatgcagagaacaactgaaatatcaattacataaattaactgacagtatagtcgttaatagatcatacagagaacaactgaaatattctaagaggcagaacaactcattttttttccaatcttccatcatgctgcttccagacaggaaccagtactttaaagccaccaaagtgcacaacactagagctgacagttttaccttgcaacgatcacataacttgacacctaaaaatgtcagtttccctatctttatggtcttccacagatcctccgagtatggatgacatccatcaactataatactggccaaaagaaagcatttgcaaagaaaggcattattacagaatgacaggtagatttatgcaagtaggtatatagcaaaacaatccaagaaataagctgtgaaaaaatggccatactttggtctgaagcgattcattggtacaggttctttaaggatactgtttagtgcatccactgagccctatagtttcgatatgaactgtcaagtgtcaactagttacagtattgtgtttagaagaaaaaaagaacttttgtacagcatagaaggcctttctccagaaaccacagaacagcttaatcatacctgggaggccagcaggaatgggaagtcgtcagcaaacagaactttgtaaccttgagcatagtcaggattggtctctctaatttctgatgctgttgaaaatatcacaaagagatatatatttcataagcaaagcagatcctttttaagtcaaaatagaactttgtaaccttgagcatagtcaggattggtctgcctaatttcttgaaatgtataccttcattaaaccgtacgagtcgagtcggcttcccaaagtaactggaaaaccattcggccgcctcatctccttcatcatacgcagaaccagaccactcccagatagagacatcatcaactgtggcacgtttcgcgccaagagggatcttcagtggatccaatccgggtgctctgataactgcaattagcaatgcctcagataaaaatgatatccttagcacacccactcgaacatgaaagaaaaatggcatgacattgtgtgattgagcatcctgccaagaacattttagaaccaagaaaacttctgcagaggtaactggcttattttagcaaagaaagcaaaaaaaaaaagaagaagaaatagaattagtaaatcttattgattggcagtcaacctatcatgctgacacaaaagataaatcaaagtagcaccactgcactttacaacctccccttttcacatcaatgcagtatgcaacccatttttttttcacacaatcctatagcaattaatcaattgtattccatgttaacaaatcaatcaagttcacattataattgtacatactacatagaggtacaacatacatggattgtaaacagatgatgaaattgggaaatacccatgtgagaatcaggcgttggctgccactcagtgaacgcctcttgcggcatctccacctcaatcagcgcgagcttgggctccactcgctgggtgaaggctctccctgcggagttcatcaccagccacggtcgatcccacctcaaccctgcccatccaagctcatcatcaaataaatcgaggaaaattcccaaatttcaagaaaggggagtaagcagagcagagaagcaccggtggaggtgatggcggcctggggcacggagatgcccctgcatgatttgatggggtacacgacgattgacttcaccgtcgccgccgccgccggctccggctccggcggcgcctcgccgctgccgcctgccttatccatggctaatggcttgctgatgatgccaagcctcctgccatgcagtggcaccacgattttttaaaatcatgtccaatttttgcattttattagtcggattggttcttgaaattacaatactgacccctatctctatgatttgtagtactagtatataggagtatgtgaaattttacgacacgtgtccaggattcttggaattatgcaactttagtgtaagctactgtagtaaaatctgaactttactgtgcacaaagtgaatacttcctccagcatgggatgggcatatgaaactgactgttcttgtgattctctacattctctgaaagttttaggcttcagaggtacaggccgttatgatgttgctaagggagtttattgcagttgatcactgattttctattagagtaaaagggctcaatcgatcctatttagaggggtcttctaacttttcctttgtcacttcttatttgttttgtattgttctgaataaggttatgtaatatgcaatttgctatattaggaataactatgatcactgaatatcaattgtatgagcaacagttttcagtgccagatggtactgtttattctgccacataataaaacacattttctcaagccttgttgcagcataaaatttacaatgatgccgagaaattcagcattctacagtactactaggtctctgaacagctgccagtatgtcctttgctcatgctggagcttcatcggaagaagggaatctctcaagaacataaaccggatcgctgaccttgatgatccttcctttgccctttgcagacagagattccttgcagactaaattttgcccaaagtagacctgcagaaggcgagaaaacagggagttctcagtgacctatatgttctgaacctggttcatgagcaacttgaaattgcagattcagcacatttgcatttagtaattgcataattcaggactccaagagtagagtaggttgcaggaattgattacctgccgtttgtttttgtggcttggacgtagaacttcatcggaccggaatgtcagtagagtttctgttggttcagtgccaagtatcccattttcttggttaatggtaggcacctgaatcagtgtaacagagaaactaagcaagcggtacatgtatattggattaccaaagtaaaatgtcagataacaccaaaaaaatatggtgatgtgaaatttaagtcagactccatttcacatacaagtatataacctcaggcttcttcatttaatgaaaactacccatggcacccatcccattgtagaatcacttccatgattcaaagttatatctcaactaaacaaaggccacatgccaaaactaagttggtgaccattctatgtatctgatagaaatgaagagagtatggaagattcaaaaatccatgcagaatggttatatatactcagagagttatgatttaacagatcacacaaaagatttagtacaagtaataatattaaccggcagaaccatcagttatcaagtatccaagtatcctctcagacagttttattcaaggttaagagagtatgggttgataatttgaaaaaacagggtcatatttaccttgcagcggttgcataacttgacaccctgaaatgttaacttgtttatttttatggttttccatagatcctctgagtatgggtggcatccatccaccaaaatgctgccaaaagatatcactttgtaagaaagcaagtgcaacaattgtcaaactaacggtcataatttaatgaccgaacagtaagttgtccataaaataaaagcgcacagatgtgcgggcttactttggcctgaagcggttcatcggtacaggttctttcagaacctcatttagtgcatccaatgaaccctgcaattcaacatgaactgtcaactgaacttttatgttgagcagcacttgctcaggacatctatcagcagaaactactgagcagtctgatatgtacctgggaggccatcagaaacgggaagcaatctgtaaacataattttgtagccttgagcatagtcaggattagttggtctgatttccgaccctgccaagaaatccacaaaacagacattctcaataaacaacagagaaaggaaatccgtactctggaaatcagaaaggttccaagacaggaaaaacagtactagtactactaagatataaaccttctttgaaacgcactagacgacttgggttcccgaagtaactggaaaaccactcggccgcctcagctccttcatcataagcagaaccagaccactcccatacagagacatcattaattatggcttgttcagcactgagagggatcttcaatgggtccattccaggtgctcttccaactgcaatttagtatcgcagggtagctcaataaaatggtaatttaaatggcatgacagattgacagtgaagctatcctgcgtgtgcggtgatgtaaaattcaaaaggcccatacaggttctactttttttttaatgagggggcaaaatcaacatttgtccagtcctacttacggatcaactattaacattcaactacatgtcaagataaaactaacattcggtaggcgactaattatctaaagcaattcaaacgttatttaacacagatgaagggaaaacagcattggctaaacattcttcagattgtttaactgaaattaatcaacagatggcatatacagaagtggtagtaaatgatgagataatagagggagaaggcaagaatacccaagtaggaatcggcggtcggccgccactcctcggcgaatgcctccggcggcatctccacctccaccagcgcgagcttgggctccaccctctgcgtgtaggccctccccttggagttcaccaccacccactgccgatcccaccggaaccctgccgatcgattgacgccgcaaccatccatcacaaaccacttctagctaattcagaagaaagattcttaatctttggagaggatgagcgacaggtaccagtggaggtgattggggcctggggcacggagattcccctgcatgacttgatggggtatatcaggatcgacctcaccgtcgccgccggctctggcggcacctcctcgccgccgccgaggagggaggagaggaatccagcggccttctccattgttcggctggcttagcttagctttgctttgcttgccgcaagcaagaaaacgaaaaaaacaacagtgataatctctttctcgcctagtgaagtgcgctcagtgccagtgaggtgtgcatttggtttggcggcacacggcaatgccaagttacaaaaatgcccctgctttctcagcaaccccagatagtataatctttgcacttggtagatgtatactccatttatcccacagaaaagagtgacatattctaatacaataaattcgaagaaacatatgtttaaattaatagtaatagaatatgtcacatctaatatcaggttgggttttttatgagacagatggagtacttatcataggaaaaggtataaaaaagtgaactttcagttttgctctagttgtggttgtctttatctctatgcatatcaacttcagcaatgaaagtttcagttctatacttccacttaacaatcatcttcatgtggtgtctttaacaaatggggcacctggaactcccaaatttgcactttgcacagcactcactgtattaaaaaattctttcagcaaccatgtctgaatcatgtattcctaaaagaacatgtttgaagtttgaactagtacatcacaagcaagttcaattacagccttacagataacacatatgtacacatagtagtagtatagcctgtctaacatttatcgtatatatacagaacaactaagaaatgattcccaaaatccatggtccaaaaagatccataacattccatgcccaactgctcaatcatcgtacaagtcgagcaggagtgtagtgcagcgacagatgctcctctctcctgaaaaccaacacattaacacaagaacgtcagcactactgcatctatcatctcgcaatctcatcataccaatataagaatccatgaacatttcatgaaggggatgaagaactgagggtttaattctgcagttgcagatactgacatggggaagacgaagtagagcaatgcgagcagcagtgccagcaggaagcaggccaagccgacgatggcgtaggcgcggccgaggaaggcgttcttccctccgagccacccggcggtggacagcaccagcgacttcttgccgttgaagctgtacgagttgtagttgttctgcatcgtcacctctacacggtcaccggcctgcagatccatgtcgattctcccgtacagctttctgaatgttggcagtgctgctattctcatccagacgatcagatcttcctgctcactcagctgttgaatttgcagacacagaggttagcatgtagcaagtattacttcgatataaatttcaactcaatcttgttaactgttcttggcaatgtgccttggaaagttagacaatcttacactgtatattcctgaaaatagttctgaaactcaaaactgaacaactattttgctttgaaaatggctatttacgacgaaccgtagagaatggacgcatgacatttcagtcgcaagttaccaaaacacttacaggtttgcttggatttaactgccctccaccaatcaaagtcccattctgaaagtttttaggatacacgttcttgccaatctgcgattcctttcactcttccacgaaatgccatccttgttcactctcaatgtctcgttgccatgaccacgagtgaagctgtatgtgtcgttgaacaggctccaagctatgagaccacaaggaacaataggtctgccattcgcagtagcttcagggctgcagtattgcgtgtcggccaccttcttcggatttctcagctgcatatcgttgaggctcttcacatacctgcgttcccaatcagagtgattcaactcagacagataggttttacttttgtatgaattggtcaataaaattattagccagatttctaccttctgtggttctggtagaacttgtcaagttgataatatatgtaaatcggcttcttcatatctttagggacctgcagggaaaaaagtcgttgttttaccttatcgatgaaagacacaaaatgtgttgttttcactgtgtactcaaaggaaacagttttaccttgaagactcttgtgcaagtcttatctattgatgagttttggataaaagcaactttgttgcgaagcatgttccgtggcacgcattttgtatcgtaacgatcaaccaattcaacgacctatttgaagaaatccaaacataagatggaagaaaaagcattcatttaccaatttgaataataatagcaagcacaattcaaccttaccttatttgaggctgcaatgcaagcaagaccaattggaatgaaaattaggcccacaaacactagtacaagaataacctgtaaattattcaaaattatgcagacagtcatcacatgttaaacttcccagccatattcataccgagaaaaaaatgttgaacagtgagattgtagcaaacaactgaacttacagtctggggtatcagtataggcttgcatgcttgaagttcttgctgcgtaaaccgatggtcttcaaaatcagaaagagtggatgcaaataagcacttgtttcatcagaagtaaatttcatgtactataaatttatccccaaactccggaagccattccaaaacaaagataattgcaagtgttgctgcatatactatacagtgctgaaatgaacacccgatagaacagttaaagatccgaagcaggtgaaggagtatacttctcgaaccaaagcggttgtggttaccataaaaattcaagtggcagcagaaagaaacataaattcaattatctggggagagagaaagagagagagagagagattacacttaggcctgttgcgcttcttcacggcggctgcagagccatcctcgccggagcttggtcctgctccgtcgctattcactggtggcattcttgtctccggccaagaacttgcctcagtgaagaagaagactcctctcctgcaactgctcttgagaaatgcaaagagaataggtaactgcccaaaatgtcagacaagaaacaaatagcgaggttataccggttttcagagaggatttcatcaggagagtacagaaacgagggaaagaattaaagaaggtttaggagtagaggcaaagcaaggaactgaaaggctactagtaagagtgacaacctgtcattgttgagagcgtcttaaacactggaaagttaaggatcacctaaccggtctgcatcacatggccctttcctctgaagattttgttggtgtttggatagcattggctggttgaacctgtgtatgtacctcgaatccacatgaaaagtcttgctttgctccgatatgttcatcaacaagacaacaacctaagtgtggggcccatgtgacagctccaatttgctaaggacataatttggatgccacacaataaatgaaaaaaagggtatatcataggacatgctccagagcatgaagtgaaatgatgcaaaatatccaaaaaaaagagagagtttaacctgacaattttaagtcactgtaagcaaagtttgccaaagttttggacaagcaacacaacatggtacctacttcaaccccaatataaaacttcacccctttttaagggaacagctcatgaggtcaacattccattgaaattattgaggtacaaacggctgcaaaaaatgcattgttgagtagtaaggtaacgccatcctcagcacaaagcaggctcaatgaagctcctgacgatcgcctcttacgtcttttctgtacctcaatatctcaacgcctaaataatcgacgattccttgtaccgcaacatgaggtttcccaactttcactctgacggctgagatttgagggaatttcagcaatgtggcactcgcgatgcgatgagctactgcttccaaaaggttccgcgatgggctttcaacaacatccttggcaatcttatagagcatgaccaattgaacatacttcagttttccaatggttggaattggtaagaataagcaaatagcagccaatgactttaccattcttaggttgcggaaatgaataagcaagtttaaatttttaaaaagtattcatccaagccattttaggaatactttacgaagcaagaaggcagaatttggttaccaataatgccattaaatccaatagaggccctttattttattattgaatatttaattacctggtaaaatttggggaagctactggaataagatcgcggtcagtttccccagcagcactcaaatccatccacgcatcaacatccacaacaaacttttggcccagagtcttctcttcttgtttcactccatggaaaccatggaactgcaaacctctaagtataagtttatccttgtcgattagctccctttctgccataacagtacctaaaacacagaatggattactcagtcagcacatggaacaggaggggcaatgaattacgaatgcgcctagatgataagaccatatttctgctaaccaccaacaacaattctgtcacctagccaacttgaatgaatcgatctgaagacttggttgaacttgtactaacctgacctatccgtgctcaattgattgtgttgtgaactgaaggaagctgtgtgaactgaactatagccaggagattgccgcctgatggcgaggaagcatgggagaccactggagatggacacaaaatgtttatatcctgaacttttagacttaggcagatgtgcagtctgacccccaaagctagtgcgtgcaaatgagagcataagctgcagcataacagtagaaggaacacaactgtcttatcttattaagtgtcagataatgagaaagagcaacagcatattcacacaacaatttgatatgcttcacagaattagtaaaagcatcgtgattacccagtaaaaaagggaggcatgtcatacttggagtgctaaacaacatcaatcaccaatcatccaaataaaaaacccccagggcctcaagcaagtaaattacagattgatcataggcgctaccacgaaaattgcttatgaaatttgcgaattacaatatcctccattcttcatacatggacgaatactgctaaaacaatcaaatcttttccgttgtaatactaatccgtccccaagaatttcccaactcaaaaggatttctcataatcggtttaaagattaggccagaggaacgaagaaccaatcttcaggagaaaccattatcatcacaagaaaaaaaaaagaggaatctctggagggagatatactaaacaagaaccagcgaagaacttgagggagatgaggaaaagaatacctgagaggccgtgaatccttgcgggagtggatcaagaaacacaaaaacccttctcctgggcttgtcgatggagaaggcggcgggagacgacgaggaatgagccaagatgcctgcttcccactgttcgtccctcccttatcttatctcttcccctttcctttttcgagcttttctcctttcccagaaaaaaaaaagtctttgcagcccaaatggcaatagaatttggccgtcatgtcatcggcaagattttcacagctttcaggttggtcgacttgcgatcagcttctgcacttcacagattcagctaagctacgctggatgaacaccaagcaagacgagagaaaaaatgttggcagtaaaagtgcagtttctggcgacagtaaaagtgcagttcagagaaactttttagcgcaaacgatgattgttctgcttagaaatggagctcaaaatttcccctttgaaaccacattacaccgcctcgaaggcttgaaagaaatgataacgcgtaataattcagtgactagaaagagaagcataaaacatttgctcggttattgagcagcaactgaaatcaggtttcctgagcaaagttatagtaagacccagaaactacaaaattttggtcagctcaactctttaactacagcagcagagcatctacaaattcgagatcagcaactatgagtacacagtctcatccttcgtgtcacagtattcaaaaaatatttcagtactcaaatttacgaaattaagacatgcttgtgctcagccggacctaatccacgcacatggccttttcttgtttatcagagcaggacttttattgtttcttgctgatgctgaactttgctgatcaagactctccaatttccaacaactgggtcagaaggctctaaccagtagaacatgaaccagaatgaactcacaggttagaatgtccaaactcgagctcctttacaaactggaaacacagaagcattatttctcattttgttgcctggagactaaacacatggcatgcgaggctcctattgcaacagaaatgacacgatgagggcccaaatcctcatcaccgtctgtgagaaaattaactttaaccggtagcggctgaatttctggcaaaccagggacacctaactggcaatctcttgcatttccccacatgtacaagtcacctttctctgtccagacaattaaacaaaagtaaactcgggttagttgcttagagcaaggaaatttagctgcttgcatgatgtagaacaagattaaggaaaaccaagctaaaacatggcacagagaaggaatctttgtacagcaaacttcagcattttctactgacctttgacacgagatattttttccattttatttaaaaccaagattcccctttataccatatttagttagcaaaactacaagagatgactaaaaacatctcaagaatcccagcacatcaataaagctttcacctgatattgcagcagaagtcgaacctccacaggctatatagacaattcgttcttcagacaaagctttgatagctagtgggactctatgattctgaagggttggatgcccaagttggccgtgtccaccatgtccccatgagagaacgacaccttcatctgaatacagccaaagaagcaagacgttagttgtgtgctacaataaccaccatactttcttctataaatgcaatttatgagtgaaaaaatctctctaactattattgccttatactgtttgttgcagttccaaaagaaacttgactcattatcagacatggtatctgattgaaggtcatcattgcatggtgcaaaactggcattaggtatggtcaacaactcacttagataatattttaaaatgcaaatttctttatttttcacttctgtatgaatgttcgtcgggaccttggttgcaaatgcttgtttcaccagtataatacagttttgaatttag

SEQ ID NO: 12075 - DNA, 2285 bp, Oryza sativa
atgtgcaaactcaaattggaggacaataattttaatatgacagctcttagctgcacttttttttttgaactaatacttcaataatgttcctcctggttctgcagattactggagcaatatactatcttctctccattgaacggcaaattacatgttggaatcagcagtgcctaaatgagtcttgtagttttaacttcataagctgtgacaatactggttctagcagttatcttacttggggaaagaacacaagtatatttgacaattgtgatcccaatcgtaattcaagtgctaaccccccaccatttaattatggaatgttttcaaccgcactgagtaaaggtgctgtttctgctccatttcttgagaagtacttcttttgtctgtggtggggcttgctgcagcttaggtataattaatttttaatatacatccccatcttgaatattaaactttctgtacatctgttgttgatatcttgcctgtgaactattaatctgattatatactttacttggggttcttccatgatttatccattttattcatggttctgtgtgattcaaatacaattgctcatgtttagttttctgctgctgtatgtgctctccttttcagttctagtggaaatcctcttcagacaagtgcatacatcgcagagaacacatttgccatagcaattggtgctcttagtctcgtactctttgctcagctgattggcaatatgcaggtattgtcatatcttttgttctgaactaggggagaaaatgctccaaggacaataattttcttgttactgtttcagtttactgtaaatgtagtaatgcaagattgttacgttctataatatgtgcacataagtggatgtcctatttctgtgatcaatggatgcttcaagtcagaaatttccattttcattgttttaaaatctgatgacaggaacataaaactatcactttgctcataagccattttccacatttgcaaccaattgaggttgttggttcagagatgttgcttacttcctttttgtttgtcatcttgtagacatacttgcagtccatcagtaaaaggcttgaagagtggaggctccggcaaagagatatggaggagtggatgagacatcatcagctccctgatgaacttcaagatcgtgtccggcgattcgttcaggttaaatggcttgcaacacgaggagtagaagaggaatccatcttacaagctttgcctgctgatatacgccgggatgtacagcgccatctttgtttggaccttgttcgacgtgtaagttgtggttatttacttacatttcaactgaattagtagaatgttttagtttctgaaaggttttagatgttaaattttctagtggcattctgtcgtttggatggaaaaatcagtgacaaaagtaccaccagtgctacttcatagtctagcatgttttcttatcccttcctaaaatgcaggtcccatttttctcggagatggattaccaacttctagacgccatctgcgagcgtctggtgtctttcctgtgccctgagcgcacatacatttctcgtgagggtgatcctgtgaatgagatgctcttcgtcatacgcggtaagctagagagctccacaaccaacggaggccgcagcaacttcttcaactccatcatcctgcgccctggtgatttcgctggcgaggagctgctcacatgggctttacttccaaagaccaatgtccatttcccgctttcgacgaggacagtgcagagccttacagaggttgaggcctttgccctgagagccgaggacctcaagttcgtcgcgaaccagttcagaagactacacagcaagaagctccagcacacgttccggttctactcccaccattggaggacatgggctgcctgcttcatccaggctgcttggcggcagcaccagaggagaaagctggcagagagcctgagccggtgggaatcatactcatggtggccagaagaacatccaccagctgacaagcctaaacaggagggcacttcaagcagtaccaagactattgctgagagtgccattgctcaaatgcacaagttcgcctccgcttccagaaggttccgtgccgacgataccgccatccggaggctgcagaagcctgatgagcctgacttctctgcagatcatttcgattgaggctgatgtttcctgctttaaaaaaactgttgtaaaaccactactgtgcactgcattgtattcaatagccatatagtaatccatgtgttctcaaagatgaaaccaaactgg

SEQ ID NO: 12076 - DNA, 11039 bp, Oryza sativa
tattgtcgcgaccgagaaaattgcattttcccgaacgctagtgtattaatccccggaccaggaaaagccggggtacaccacacaaacatgatataaaagacacatctttattatatcgataatatttacattattacaaaggcacttcacgcctgacaatcaaaaataaacagcagcggactagcgggcctacggctccatcttcacaggcgctcaactggggtataagccaggactccacctaagacatcttctccaaagcctctcttactgaagaggggaaagattgagcaagagtgagtacaaccacagtactcagcaagtcacaccggcagatgcatgattaatgcaagggggtacaaggggataataataggggttaagttttgcagtaaacagcatttaaaagtcacttagttgcccaaagctattttgtaaacacgatcctagagctatacaatattattaatcaaggccgtgaaccctcacgaacctgccttaacccaaggcctacgatgattcagaccgaactggcaacccgaccctgggtcccagctcgtcccaagccaacccaggctaaccattccacattttagttgttgagcaaattttaagaattaaaacactaacttgggtacattgctcggcttgcccataaccgagggcgcggctattcgaataggttttactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggcaggcaggattgagccccctagcagcaggacaccagccctgtgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccgaaaaacaggttttaggggctttgaaagaggaagagaggggtatgtccaattccaccataagccaaccattccatagtgtccaaatgatatgagaattcccaaagtctaaagttataaaatcacctaatgttgcctaattaatcagcgaagcatctacctaaatttatactagtggaaccatgaatagagtacccactagttggggttttgtttattctagggtgaacaaggtaataataacaatagcaataataatgtcttaacaaaggtaaataggcatggctaaataaaacagtgataacgcgggaataaaacgataatgcattaatttaaatcaaaataattttataaactgggattcaatatgctcaaggatgatgtgacttgccttgctcagagagaacggccttccgaaccttcggcgacggccgcgaaccacgcttcgggaacctccggaacgacgaagactacgcgaagcacacaagcaaagctacaagcctaaaaagaagcaataacaatacataaaaagaaagcacacggttctttaggttatacaaacattaggagacttgaacgggtcgattcagagctcgtatgaccaagatatgatcatccgaagtttaatgctgttatatggagatttgcggattattgtaattaggttttgcaactataaaacaggtgtaagcgctagcctggaaaagacaggaaggctgcgccgttgacatgcggaccccacatgtcaacctaaaggaccgcggtagaccgggtacacagagacggtccacgggtcgacggaagcggaccccgtgtgtcaaccgaggcgagtggccgacaaacggactccactagacaccacacgggctgcacacgtggaaaccacgcggctaccgagcgggcacactaacacggtcaccacacgcacaagcgaacgactaccgacaccggtacacgggtatcggggtcgacaaccgcacaacgggtacgggggacaccgaaaggacgaggacggggcagcgagggagagggaaccttaccaccacgcgacgaggcgtgggaacgacaacgacgaacgggcgcggcggagacagacgggcacaacggagacgaacggcgaggggacggcttcggcggcgatccttggacgaaggcgagacgggccgcacgaggcttgacgacgcggagccgaggacgaagacgatgacggggctgcagcggcacacttgacggacgcggacgagacggacgagaacggcctgacggagggacgaacgccacgacgaccgggaacgacgagaggaccacgacgacgacgacgacgaccgggcccggcgaggaggcgatgagggctgccggcagcggctgcacggaggcgaggatggcgcggaccacgccgctgcgatgccgacgacggaggcggcgccgcgagacgacgagccgggcgaccgatgggacgtcgacgacgagaacgatcggagacgacgctgatggaccgcggaggggtttggatggaggggaaacgatgccgaggacgaccttgccgctgcgatgccggaggtggtggaggtgtggccgaccggtgcacgggcgaggagggacgggcggccgaacaactccggcgaggcggatggagaggtttgcggcgatgtgcggcggcttccgggcgaaaccgaggggtggacgaggtggagggctacgtcaccgtgccgagggaggggacggcagcgccggctgacgcacgggcatggcgaaaggggcagccggaggagatgccgccgaggaggaaggagaagccggcgcgggcgacggtgttccggcgaaattcgggcgaggaggaggtgatgccggggatgagggcggcgtcgcggagccgagggaggtggtggcgacgtcgaccggcgctcaggcagggagatagaggcggctggaggcggccgacgcggaggaaagggaagggcgacggcgggaacgcagctccgggggtctccgcgggaaacggagggcaagccgggcaaggggaggcagctgctatgctggaggaggcgacggcacgaccggaagacgctccggcgaggagggagaggcggctggaggcggccggcggcacgggagagagaggaggacggcggggagagggctagggaccacgggagatcgcgggagggggctaaaacgatagaacggagcgagggggttgcattttatagcggagggaagcgagccgagcacgggagagggcggaacggcgacgggaatggcggccggcggcaaaggaaggcggccggacttggcgcgtccgttcccggcgattgggggcgccattcaagggggaattaagggggaaagagagaggagggaaaggggtttaattccccctaatcaatttgggaatcccatgcttgaatcgcgcggatttgagggaggaatggcgctagggttcacgggagagggagagaggacggccgggcgggaggaggacgatgacccgcctgacgcgcgggccccacgcggccggacgcgcggtcagcgcacgcgcggcgcgcgtgtgcacggccggctcggctcggcctggcttgggcgcggcttgggccgggcggccggcccaggaggagaggagggggaggcggcctgggagaaagagggaggaggagggagtgggccgggaggggaagaggggcccaagaggaggagggagagaaggaagggaggagagggagacttcggccgcgggccgaggggagagaaggaggactttgggccagacttggcccaaagggggggagagagattatttttaggtttttctttttaataaactctaataattgtttttgttgcttaataattatttccggtgctctgaaaattcaagtaaaatttaagggctccttttagaccaaggagaatttaacaaaaattccccgggccacattcgaatttttcttgtacgcattttagtgtttgccaatttcttttcgaattttaattaattctattattccttttagaaaataatttttattttgggatgaatttatcaggacgtgacatatatcgtacgatttcacatttcagttccatctcgttttgtttttctcgatctcgggttactctagctgggctgttcttgatggctgccgattgccacacttcacaggagacaattatcatgaaattccattattaggctttcttcgatcacaatcgctctgatcttccgagaatcgtttttggagattcaactttttaatccgttgttagaaagaagggttatgcatatagcttagctaacaatagatagaaatataagtctttgaggtggtatattaagtagtttttatgcctttaattaaattatttattcgtcctataacatatgcaataattagatgttactttatttaagcaaagatcggaataaattttattattatttttattaaaaaaaaaagtaagacaacgaattacagtaagtccaaaaaaaatcgtttgaatttcgaaagagatattgttggctgtgggctaaggtgggccggtaattttctagcctgtgggctgaagggccgcagttttccctcctttccatcgtcttccttccgtgggttagatcgatcgatctggctctctcgcggagatcgagcaagacggatgatggcatccatggcgaagggccgccgcttgtggaaaaccaagcatctcacactgcgcccgccctgccacggcggcggcgatggcgatggcgatggcggtcacccagactggattctcgtcgacgtccaggcctacatcgccgaccgccggaacgccaccaccgccaccgccatgctcagcaacggcggccaccaaatccaggtcaccatctgcgtcgcgccgccgccgctcgtctcctacatctgcgcctggtcccccaccacccaccccgccgagctcttcgacacggagcccaccgtcgaggccgtcgacgccgacctcctcctcctccgcatccacgtctcgctcaaccatgtccacgacctcgtctaccaggcatccatgttgccatcgctgacgctcatgcccagccaagatccttacctgcacgagcccaactgcatcgcgctcatcccccgctcctcccatggcttctacatctccacgctcgacacggatctccgcagtgggattgggcgatacaacctctgcctcttcgactccaccaactccaaatggagccatgaatcgctctctctggatcagctgcgcaatccgcctgacaaaaacgaggtgctccatatcacggagaaggtgatcaccttcatcaacgatccacatctggttgccttcgttgatctctggcggggcatcatcatctgtgacatacttgacaccaaaactcaaactgcaagctatgtgccgatgctcaaggagatcatcaacctccgcagaacccgagcatcgtcgatcaccagggacattgctgtcgtcaatggccgcctcaccgtcgtcaggctcaccactgtctttgatccagatatcaatggttgggactgggatctgtccacatggagcagggcagtggattgtttggagcaggaggattggcgcgaggactctctggtcgaggcctctgacatcttaatcgaccacaacatctgcaacgttgagctcttgcctaagatacaggggcaacctaccatggctaaactccacgttgctcttcccactctcagcttgactgatgctcaggttgtttatgtcatgggcaaggttaacgaatccgatgaaaaggctgtgctgctgtctattgacatggccaacagaaggcttgatgcagtatcagtgtatgacgctgcaagaatcctccactactttgatgtctgctacacgcagtctaccatcttccgatattccgccccttcttcaggtgattaattccctggctattctttctacttgtttttcttctggccaaacctttggatcaattgatagtaaacctgattcgtattgttgtgtttgctgatatatttgaacacatatatgtatgtggctgttgctatagtgctaggctgctagctagacttgctagtttagtcggctgttagttggaggctagtgttagctagactgctagttgagacaacattagtgtgaggctaggtatacttttagtcgtcattcattcattcattaagctgccagattagttatagagtatggttctagataaacaaatcatgaaatgcaagcccatatggcacatgtagccagttaaatgcaagggaatgttagctttcacattgccttcagatgaaaaagaaaatgttgctgtgggtgcatgctgtatcaaaaaacgctcataaaacaaatgagccattgaacgagatggttggaaatgaaaacatcgacaagatttctgccaagagagatatatagcagaccattgtaggtgcttttgcattcttgaaatagaatgaaaacttgttgaattatgtgtaaatggttaagcacatatatgtgtaaattattttgcactaacacatttccctttgttttgctgggtgcaggtttaaatggaaacctgaaacgaccagggaagttccctatgccatatcctcgcaagcaacaggctgtaaatgagccatttcttccggatgctgggagaggtttagaaactgaagatagggatactatggactgggagtagttatgtaatttggagctgaaacctgaatagacataaattgatcacagctgtttattttgcttctagttactacatggattgctacaaatgcagctactctagaagacatcagcctgcatagagaaatttactttggcagcaacaaagagtcgaacttggctatctcaatctttgagcatctgccgtcatctcacaacaattactgtcgtgaaactccatcattaggcttttcttcggccacaattgttctgatcttccaagagattcacgctttatgtgaacacagaaccatttcagattataacgcatttgaaattaattactgacaaaaatgacctgtaaattctggtaaaacactttgactggttcggggatctggagtatgattatagataagagtattattcacatttagacatagaagcgcccatggcctaatggataaggcgtctgacttctaatcaggcgattgtgggttcgagtcccactgggcgtgtttattattttttttctcttttaagactcagaaacagaaaactttttttataatttgtaattagcaaatacaagtacagatagacctacctcattcacctctaatttctgacaagaaactagttagctagtttttgtgagaaagcaggttggagaattgctacacgtcgccgcagcccacccaactcacagtattacggcccaaccaggcctcccgtaacgggccgggctacatgcagtttccattgcgaccagcatgctggcccacggtcaggttagcgtgggccaatttgactggcccagttagtaggcaaatggactgcatgaaatgggccgtagtcctcctattttagctaggtcgacttctttttccgagacatttaacttcttgcaacttttaaaatatggcaattaattatttgtcactcgctgtatgacatgtgggtccagtggtaaataatttagcaccactgcaccactcgtaagagtggcaaatagttaattgttcttctttttcccttttaacacgagcactgctacacgtactaattttttcttactaaatctttactaacaatcatctcaaccgtttgatttaggtagatggaagttattaaaaatctagatgcactcatagcatgacacatcactgttagtaagaatttagtaagaaaaagttagtacgtatagccttttccttttaacactatctccattttttaatatatgacgttgttgattcctttacacatgtttgatcatccttcttatttaaaatttttatataagcataagaaaatataattcatgcttaaagaacttttagtgttaaataaatagagagagtaggttcaccttgaaaaaggaaaatctcctgatcatctcgtctcatctctcatgtcatctgacacattgcagcatgcaagcaaagaagttcagcagcctgtctgatgctgcagctactacgaaaggggcgatttcgcatgcttaatcactgctagaggtgctcaagtgaactggggctgtgtttagattcaaagtttggatccaaatttcagttcttttccatcacatcaacctgttatacacacacacacaacttttcaatcacatcatttttcatttcaaccaaaatttaaactttacgctgaactaaacacagtctagagtaatcagtaactagctacaaatcgatctacactactgatccatcagcgatcagtcgtcgtcaacatctattgatgcaaagcagctggctatctatcaataatctggactgcagagattaattgaattcaaccatgcgtgcatgaccgatcgattctcctcgtcatccgtgggtacggattaattggactcttgctccgaatgggtgatacactcgggtggcagctagggcacacagctagctaactctgatcctctctcgtgtttgtgttagctcacatgactgcgtatactcatcatgttaagagatcttgatcactgacttgttcagcaggaagaagctaccttaccttagcttaattagcttttgcttagcttaggaaatagccactaacacacgccattaaatcgtcttgtcatctaactacacctaaatacgtgtatctagctagctcaatcaattaatttcagctgcagatagacgaaccattttcatatagttacaatagctagctagttgggtcgatcggttgcttgcatttcttgcatcttgtgtatatatgcatgggcaagagatcgccaacagaaaggaattttttttaaaggagttcgagaacaactgttcttcaataaacagataatgcgtttttaattgcagttgcagacaatgcaaacttcatttcccctgggcagctagctgatcttgttccataaattaactggacgatgtcctgacaagctgcgaccgacgtacgagcaaatttaattacttgtcgtgatcacaagttaatcaactatgcttatcattgacgacattatgcgcaggttcgtcgtcgcagaacaagttaagtcaaatcgattctactccagcagctgcatccatagatcgatcgatcagtctgatcacacactaaaaagcatctttgaaaaaacgtcatatcatcgcaacagtggtttaatcatgttccccagttaagttgcagtttacagctgatcataccggatgcgtgcagcaggaggactttgtgtcgaaagagtaattgtgtgtcaacaaagcatacatgcactatgacgctctgtggttgggtttgttgttgggtcagtaaacatctaatcaatcaattaattcatcttgctgcatgctgatttaatcttgagctcatacttacgtgttgatatatcgatgattctaatgaatcagcagtatagctagctagcagctggtagctaattaattaattgccgttagcagtaattaggagtagaaggtaaagactcttgcagcagataaagcaatttccaagttaaattaaactggaaagaacctcatttcaagtatgcaagatcccaaggaaaaaggatatatacattgttactgaacagtacttacagctgcactcaaacagcatgcagcttggtcaccttactaacttttttggactgatcaccttactatgatgatattattctatcaccttactatattactgattattattattattattttgtttgtgattgattggtcatttgagatagatcgttgttaattggtgggaatgggcagatagctagattcatgcatgtactagtttctactagctgctaatactaattttaaacaagaaaaaaatgggggaaaaccctgatgctttaagagttgtaactaagtaaaggattaaaaaaccatgagacgcacgaaatgtcgagataaattcggcttgatcgtgatatatgttttagtgcatatagtaaagcttctggtcattctcttagaacaataaaaagaggcaaattctccttgctaggatgaaaaggaagaaacactcaaacacatgatgaacacagcttgatccaatacaagaacacaaagacatactatgcaaaggattaatccacacacaatttatatattctctggggtacctaattaagcataggctcatccaaacatgtatacagatcgatcaaggagatcaattacgtactgaattaatgagatgtatattattgaactatatatatctctctctcaaagatcagggctatatatatgaattagccgatcaaacaattgcactagaaatcaatcaatcgcggttccagagacgcaacaagtactcgatccaacgctagctacctacgacatatgcatggattcatcacgatttgattaattaattaattaattaattaattaattaattaagccgtcatatacgtaatcaggttaattagctcagagcttcagcgacaagtcgatctcctccccattccggccgtagcgcccgccgccgcagccgccgtcggccggtggcggcgctggcggcgccacgtcgtgatcctcctccgccgcctcagccgccgcggcgtggccgtacggcggcgccgtccagaagaagcccccggcgacgccgtcgaagccgtggactgcccgggacgacgacgacgacgacggcgacggcgacacggcggcggtcatgacgatgtcacggctgcgcttggcgagcgtgcgctcgagcttgtgcgcgttctgg

SEQ ID NO: 12077 - DNA, 724 bp, Oryza sativa
  unsure (1)..(724): unsure at all n locations
ctcaaagtgaaagccgctatcaccttcctggttccaagtttattaagaaccaaagtgccacttcttcaccgagggtttctacttctacacctagatcatctgtggatgctaactataagccaccaccaattcctcatttgaaacaagagaaaaagtggatgcaagatcaaccatcaaagggcttaaacatgggtgtaaaagagggggaatttctaaagagtcatactcatgacaaaactagaaagcctggggttgtgagatcggaaagtgctctgggaagatatgttccaagctcagcaaggactcgagcatcaggggttaagggaaactttccagtttcacttaccaattcctgtgagcagccnnnnnnnnnnnnnnnnnnnnnnnnnnnnnngtgcttctaaagaatttgatggtaatgatgacatggcgtctgcatatgtagaagccctgaacagtggtgactgtgattatctgattgacgtaatggatagaactggacctgttcttgagaaattgtcacgtgaaacaacaagtgaacttttgagggttatagctggccagtttctgaataaaaaaatgtttgatttggcattgccttggcttcaacaggtaagttcacttgtagtctatttatgtttcgcaataactgctaatgccaagaaagcttatacgctttattcatattgtgggttttattgttgtcctaggtagcggatttgag

SEQ ID NO: 12078 - DNA, 1574 bp, Oryza sativa
cctctagccgacgcatccaggcaagggtgggcgtgatggagtttggatgggccctgcgacggcctatgcggcttctggattcacctaggcatgagaggggactgcccgctaccttgcgaggagtgggggtgaaacctgaggtgtggtgtgcttggttagagggggttatacgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgagcccgcggttatgggcggtcaaccagattcaccgtgattagtctcaccctagtgtaatcttttgaatttggatagtttaggtggatggttgggcctgtcgcaacgtggtatagcgttggacagtggatgattaatattaattaattattataactgtttaaatctttcaacttctgtttataaatgctcgctttatgcaaatgaaccactctagctcttctttgataattccctgcatcatacccctattccggtatgacttgctgagtacagtgggtagtactcagtcttgctctatttttcccaaccccagagcacgagtatgtgtcagatgaaggtttctccgaggagtaggcttcgtccgtgtagtcgaggatgcctgtggagtggtgttcccgctgcagttctagtcaaggcttagctcctgttgtcttccgttttcccgctgcatttatgtaagacttttatgatgtttgtaagacgtggatctgaatgtcaacattgtcgtttgtgtaccccggccggtcctggatggggattttaatgcacattctgcttggaattctattcgggaatttctgggcatgacagtgtccttctggtattttttacaaaaaatcagaagagaagggttcagagattaaggaaccgggaacgttttcaggaggttgaacaggaaatcagtcatcggctaaagaaaacaaagccaaggcaggagtggcgtgttaaaaatcaggttcctgcagccgatgaagccacgaccgatgaagcaaagagattggccaaaggaaaaagtgttgtaactgcatcggttaacatggttttcatgttgcctaccgagtttggggtcaagcaagccgatgtcgatgatgttgaagaagaatcggctaaattgattttgtcaccagaacaagcagtcttcgagaagccagagggtacagagaatcggcatctcaagccattgtatataaatggtttatgtcaatgggaagttgatgtccaaaataatggtcgatggtggggctacagtgaatttgatgccttatgctatattcagaaagttgggcagaaacgctcaggatctcatcaagacaaatatggtgcttaaggattttggtggcaatccatcagagaccaaaggagttttgaatgtggagctgacagtcggcaacaaaaccatccctacaacgttctttgtcatcaatgggaagggttcctacagcttgttgcttggaacggattggattcatgccaattgttgtattccttcaa

SEQ ID NO: 12079 - DNA, 727 bp, Oryza sativa
  unsure (1)..(727): unsure at all n locations
agcaattcagagagcaccggcgtcggctatgaatcctatcattaagccatcgccatttagaggttgggaaattgatatgatcggcatgattaatccaccatcgagtaaaggtattggtggcgaccgattattttaccaagtgggtaaggcaattcctttgaagaaggttgattctggggatgctatacaatttgttcaagagcatataatttatcgatttggtattcctcaaaccattacaactgatcagggttcaattttcgtgtccgatgagtttgttaagtaaattcgggatagcaaattcagcaagtggtcgccgaattgggaaggaccgttccaaatctatcgagttgtgtccaagggagcttacatgttgcaaggactcgatggagaagtttatggacgagcactaaatgacaagtacttgaagaaatattacccaagtgtttgggttaatgcatgatcggctgatacttgccgatacatgacgtctccgcggaaccttgtcccgagcacccggaggtctccccctctttctaggatgggggggtaagagcagagtcagtatccttctgggttacctctactctttccggcacatttactgcaggtatatgcgaccttgtcactcccttgtaatcagtgaaggcatctggcaacttatttgtaatattttgcanatttatgattctctgaacttccagttcagcttcactagtgcgtggat

SEQ ID NO: 12080 - DNA, 364 bp, Oryza sativa
tggaaaatcatggtgccttgtcgataataggtccacatggctccacctggtaaaagcatcaatcagtaccatgaaatacctaaacgggcccgacaggggctggataggtccacatatgtcaccctgtatccttgccaggaaaacaggtgactcatccctaatcttcagagggatggcctaatgatcaacttcccttttgtacaagcagggcaaataaaatcttcaagattacggaagttattagttacaacattgtggccagcagaatcgttgatgattctcctcattatacccaaccccagacgacccaccctgtcatgccaaactctaaatgacctctgggtttctaaatatggtcttcatc

SEQ ID NO: 12081 - DNA, 1032 bp, Oryza sativa
taagagcccacgcttcatggggacagagcggaccttaggggcatcaagggcccatatgggtgatgtccataaaacaaaggacatccataaggacacttcagggcccgtccattaaggttgccatgccggtgcttcaggcacctacatggcctctagcatttagatgataacggcggcagagccgccattgtgttatcaaatagtgctaaggggatgtaccatctcaagcctttggacggtaacggcggcagagccgccatcatgttaccgggcgttgctgagaggatgtatcaactctagcaattgaacgataatagcggcagagccgccatcatgttatcgtgtattgctgagaggatatcgggggatggtactttaggtaccatgttcttatgcttatttcaactatagcagaagaatgatttgcatataaagatcaagatgatcagtagaaactgatttctcacatgtttacctttttagctcgatagagtctcgtgctgataacgtgttgagaaaccagtctattctattgatcagcacacaagcaaaccaaacacagagttgtggaacacagaaagtatgaacgagtggaagctttatttcttctggatttaagtacatgctacaagaggagaagcaggagaccggagatccgttgttctcgccttggaccttctgggccctatttataggcggaggagggtggaggcttacgtcgtatgccttggaccttctggcttgcgtcgtaagctggcttctcttataagcttgcttcctctgtaagctggcttgcgccataagctgccttcctctgtaagctgacttctggtgtaagctttcttctacagtaagcttcccacttataatttaattcgtccataataagatatgtttcataacactgaatacccttgtgtgtattctttgccatgatttatcctttgtatcgcctttccatcaagctcaaagtgatgcaaagacacagcaatggaaaagcatgagccagaaaagtctaatccattagacgag

SEQ ID NO: 12082 - DNA, 2134 bp, Oryza sativa
aagtgcatcagtggcgcgtccaatcgcaacgcaccgtagtgcgtataaagtgcacagacagacgacgacgcatatgtgtatagtgggggtggccgatcgaaaagcgtgtgcgtgagcgtgcatggattcgttaattggtgggagtatgcccgttgcacgatcgcccaaatcaacgacctaactacctgtgtcgatcgtcagccgatcaggcctattccatgtcgtcctgacaaccttttttttactattgcagttgggcggcttttcatatcaacttaaacttaaaaagagtttttaccattcttgaaaagatatctagtaccatataccatgaggcaccaactatcatccgtttgtaagaggtagaatcaaaacgcttaaataatgctcgcattttttttagataatggaatataatatcccggtctttgctcaaaagagctacagcccattattacaatctagcactcaaaacaagtgtagtccaaaaataatagcaactagcgtatcaagataaaaataaccaacaaaacatatggagaacatattattgaagtctatttgtgagtctttatccataattggcaaaaagctgtataaccatcgactcaagctttctgcatgcaacttttaaaagctcaattatggaacttttaaatgcaacttcatcagacctttgtaactgtgcccaaaaccgaaacccgtatgtcgccctgaaaattgcctgcatatatgaaacagatggtgatttatcaaaaaccatgtcattactgcacaaccacagagcccaacatctcgcaaaagctcccagcaatataagtttacttttcttcttatccacccttaacagccacccatgaaaaataggagaaacgctagtagtaatatataagtcaaaagaaaactgaactgctctccatatgaattttgcataatggcaatcaataaaaagatagttaattgtctcatttttcatacataaacaatatcttaagcagctattccagttttgtcttgctaaattatctttcattaacaccatccctttaagcaagtaccacataaagattttaatcttaagcagcatcttaagcttccaaattatcttattcctctcaatatatccattattaatcaaagctagatacattgaccttacacataaccgactattctgattataattccatgagacacaatcagaaaattgattcaactggatatgtataatagacgcacataaatcatgacaaaatacaagattctgaccaactaaagctctcctgaaagatacattaagtggaacagaacccatgacggtagcaattgaagaattcttccttcttacgggagcatataaataaggatacttatctttaaaggccagaattacttaaccatttatcttcccaaaatcttgtttgttgcccattattcactatccaagaacccatattcaagaaagtattattagctttcataagacctaaccagaaatgggaaataatgcgcgtatgcagtaccgactagccgagactaacgacgactcctcgcaggttcacagtctccctctcctaatcgcgctagcccaaacaactcccacgcgcggtttgcaccatgtcgggcccgtgccacactgccctgcggcccctgcccaagctcttgtaccgatcgagtagctagccatagttgcaatcgagctttgaagaagtttgatgacaaaggatcaaaaatatttgaggtaagtttttgggtggtgacaagcccttgtctatattatacaaacctcatctcagttccaatagggatcagttatctattccattatctgaaaaaatagggatcaacaccaggagtttatcggtgtacaaaatcgtcagcaaacttatgtgtttatgtgtgtaagagaggtcactagttaatatatgttattatttggataagagggatcacctaagattacaaacttatgtgtatgatagagaattagagataaccggtatgcacttactcatcgttagttaatgatagtcgttcatatgcgtaaaagagaccatcaacttaacaaatttcacctacaacaaaacactccattatacatttatactcctatgtgtatacataatacaaactg

SEQ ID NO: 12083 - DNA, 22911 bp, Oryza sativa
tatatatatattataatagaaaaataaagtcaaagatatattttgtagactgtgtcattttacaaaacgtcaattaaaatgaaactggagggtttggggtatatttgtcgccttcccttgagtgcggccccgtataggctgtgttcggggcacatccgtctccgagcacacctcaccatgggttgtgcaagcacatctagctccgggtgcggtcccccgtgggatgttcctggggcacgtccgcccatgagtgaggtcccatgtgtgttatgctcagggtacatctctcaccttcccttgttcgctcaggcagcaacaatgcattgacccaatcaagcctcgcattcaataagaggtgacgtataccaacccagcttgcatccgggacgacaggcgacaaaacggctcatgccgcctctaaggatatgccatcatcaccactaaaaaggtacggagcatgggcagtcagacaacatgcgcctgtaccaggctacagtagtgcggtcccacctagcctctaaagctagcaagcgggcccgacaaccatcatggtgtccatgtcacctacactaagccacacgtcgaatgaaggatcaaggcagcggaaaaaagctgctctacgtcccaccagcacaatcgacacgaacgttcaggtccaacagtgggcaccaccaattgttggggacaagaccgaccctaaccacccctttgagctgggttccatctgtgtacaatgtacgcatgattgggcactgtgtaatcccctcgatatataaaagaaggatcaatgccactgagtaattaatggggggtattggaaaactactctcagtgagtctaagttagattctagaaaaaaacaatgaagacggattcatcatcttccacttagaacatccacccaagaacacattgtgaacttcatcatctagccatgaacataggagtagggtattatgcttccgagcagcccaaacctatctaaatgatcgtcttttgaagcccatgttgatccacgtgacacgaatcgtctcgcttccgcacacccacttcaaggctgaatccaaaaaggagtaccactcctctctgctagaggagcatcctgctccgaaaaatacgtatgaggcaaaggctttgttgatgtatggccgccgttgatcggtacactaggttaaagggttaatttgatcggtgccactgtaaatgtgtctattcagataaatatcattacaattcatctatttgtagctgtgctattcaaattttacaaaactgaaaccataccatctctgtcacgttttccttcttctttcctatctacacgtggaacccatccatccgatttatttctttctttcaccctcccttatcttgagcactagggcatctgtgagacggccatgctccagggtaagggatccagggcgtcgtcgtgcacgagcggaaaaagcgtcgggacgagaccagcttagggcgtctagagacagtagctctatggtagcgatggcagtgtcacatcttcggtgtccttgtcctttcccaaggatgcggcgacggtgctcgacggcggctctcgaatcgggagatcaagaggacggagctctggtctcggacatgctgctgcatccagacttggtgagctgttgctagacatcgttcgcgttttggggaggagcaggagcagcaacatcagtagcagttggggaagatgagttgttgtgctggtggttgccgtctgcatcttggggaagaacaggagcaatggcagcaatagcagtggaagggagaacagggggatggaggaagaagataaatgtgatgggtcggtcccatgtgcagatgggagagaagatagaaaaaacgtgacaaaaagttatggttttaattttgtaaaatttaagtgattcggttacaaataaatgaattataatgatatttatctaaatatgcatatttataatggcatagatcaaattaaccctaagctaaaacacctaaccaaatgtcctttgcagctagtcacattcgtgagcgcaaaagagaattaaccaacataacgctaggctaactataacaaaagcacatacaaataatataatatataatgccatggaaagttggtgcacctaggatttgccctgtttattgagctcaaactcaaaagaaatggttccatattctagtattagctgaggcattttaacttttgtactactaggagtaattctctgccacgcagcaagaaaaagatgtgcagaaggctctcaaaagttaaaccaacgaaaggataaggacatatatatatgctctttacccaaattgtttgtttttaaataacagtagccacagggccacacactgcgaatctgatcgcacacagcatacgaccactcctgagtcctggccatctaatttcacgcgagtcaaagcccatccagtcaattggctacgatcgagaaatcgaccgtcctccctaacaacaaattttcataagagaccaaccaagatcaggtttttttttggggcccgtctagacgctatctcgcgatcacattcacatctcgcatagttgcatggcaggcgagccgatggttagagaccttggtgcccaaagacgaggacgtgtgggcgtgtggcagcatcaagcgtggaacattgcagtactgcagcagggccgtccagtcaaattcgggcccctgtttaaaattgaaagataaaaacttaatttatgatataatataaaaataatttatactccgtaatatatttcatagcaatctagaatggtctaaggccctgtttgattcagcttagcattattataatctaacttattaggagtaggctgaaacaaactggtagattattataatctataagctagattacttttttcagattattgagtggctaaagacccactacccctacatacttgagaaaaattacccacctatgccatcaaccgaacagatagctgagggcattatagactttagccattcaaacccaacaatccatgccttcaataatccatacaaacaaacaactcacagcttattctatgcctgcttattataatccagcttatagtaatctggcttaataatctatattataataatcataagttgaaacaaatagggtctaaaatgataatccaaaattagcgattaccgaactcgaaattaccagaaagaattaggtcagggtgcgtcaggcggcacgaccgcatgagagagagaggtgaggcgtcatttactcctctcgttcgttgcgattggcgattggctaggtccacagtaggaggcgattcaagattacgaaccagcgcaactgtgcgaaccggcaaaaggcgtaatcgaagctataacgacaagaaaaataacaaattttcggaactatttagattaccaatttacttattaagttgtatatctagtgttgaggttttgagcctagaagacccctgaaaattaggagccctgtacagacgcgctggtcgcacgctggtagggacggccctgtactgcagtgcagcgggggtccggaggagaaggggtccaggtgccaactgcagccatccagcccacgggaaaagggcaaagatgcgccttgcaagttgtggaaaatatatattctccaaaacggcaacagctggaggaggcggcgtttagaaaactcagatgagagttgtggatcagttacgtgcaagaaacaacctccggcacaaatggggcgcagatatgctcgaggcaagatgttaaaaaagccacaaaagttggagagaacttttgcttgaggtggatggattcaatgcatatgtttagagcttgataggtccattttaaatttgatttgagctgccgaccactcgtgatcgtaaagaacaattatattttaccgtttcaactattgtacaagcgtgcacttgagaaaaagagctatcgcccgagtaaaaaaaaatcccaatagtttgctacacgtactaactgatcctgcatgcgagtagggcattctcattttagactgttccgttgggtaataaggtgggttccgatcactaggagagatattatcttcaataccggtttttaacccctattaattctggttatagcagccgagactaaatttcttgatgtttagttttattagtaccggttgaagcatcgttactaaacatatatgctaagtcaaaaaaaaacatgaaaaatccctattaattctggttgtagcaaccgaaacaaataaccggtactaaagttgttgatttttagttttagtatcggttgaagaaaccgatactaaacatttatactaagttacatatgtgtgatgtgggattcgaactcaagatatctcacctcagcccttaaacacgttaccatctgttggcggatggcatgaggcccttcaaccaagtctgccgaaacccgtggcgtaggctatggagcaagaatggcgtgaggcgaagagtcgtatgagtgccttgccgggccagaggcgtctcaagcgaagggtgcaaggcaaagactatccgccgagggaagacgacttcgccatgataagttcgcccccgcgagggccgaagaagcctttccgacccatcaagcctaggggttataaggccggcgatcgcctgacggcccatcaggggcccatgagcccctataacattatgtacccctgtaaatatccctttcgtaagggtaatcatgtaaattcccctgtacaacctaaaccctagtagtaagatcctgtaatggggctataaatagtcccctagtgccatgtaatggggggatggaaagaaaagaattcaaaagttcaatacacttcgtttccttccaaccactgttgagtaaccacgtctttcgacgtatgcagttgtcatttcgacaacagctggcgccgaccgtggggacctctgagcgaaaccactgagagcgaatgccaccgaagagggtcgtgaaggagaaggttgccaggcggaaggggagcgacgccggaccggacatggccgccgaggaaggagcagagcattcggcgcccgtggccgaagatggaggagcactagcgccgtcacaaccgccttcggcccctgcaacctctgtgcgggtgccgaacgcggccgacgtggcgaaggcggctgcggtggcaagggcgctccagaccagggaggagatcctttcgacaagccaaccggtgatgccccaagccgctccatcgcagccggcagcggccccaactgcgctcgccgttgtacaggcccaaatcagccttgaccccgaagcacaagccgaagccgacatggaagccgtgtggcagaacatgacacggctccaagacatgcttcgccaaatgcaagagcaacaacaagcatatgaggcggcaaggcggaccaaggcctcgtcggctccaatgcttcagtattcggcagattatgtcccacctcaagtccatccgcaagtgacgacccagccctttccgccacaagccgcacaggcgccggtgtacttcgcaaggcagcatcaaccacctggccaagcgccacaaacagtggcggaaggggcttcggctctgcaggcgcaactccaagctttccttcagcaactcaaccaaccccactacatttcaagtacaaccccatcggctcacccggaggggaatacaagtcagggtgcgcctaattggttgccaccaattcagccgggcctgggagtttcgccgtggaatcaaggaccgcaattcgacttcgtcaacgctgctcaggcaccgaccgttcgacagcaagctccaactccagtcttcggaacaaaccaagcaccaatccaagctgccatgatgtggtcgcagccaatttttgactcatccatggcggctcagcaagtacctccagttggagccgggcagtcgaatgccacggcccaacctcacgcacaagctgcgattttgcccttcgccacaccgtacccgcagcaaggtgcggtaaacagggcgggaggcgaaaaggggctaccactgagtgggggaatcaagactcgtccaataccaccccagttcaagttcctgctcgtcccgcgctattcaggcgaaactgacccgaaggagttcctctccatttacgagtcagcgatcgaagcggctcatggtgacgaaaatatcaaggcaaaggtaatacatctcgctctagacggcatcgcccgttcttggtatttcaatttactagccaatagcatttactcatgggagcaattgcacgattcttttgtccttaactttcgaggcacttatgaggagccgaagacgcagcaacaccttctcggcattcgccaaaggccgggggagtcgataagggagtacatgcgtcgcttctcgcaagcccggtgccaagttcaagacataaccgaggcgtcggttataaacgctgcttcggccggtctgctcgagggcgaactcacaagaaaaatcgccaacaaggagccacagacgctcgagcacctacttcgcatcattgacgggttcgcaaggggcgaggaggattccaagtgacgacaagctatacaagctgagtacgataaagcctccgtcgccgctgttcaagctcaagcacaagttcaagttgccaaaccacctcccctctctattcgccagtctcagccggcaatccaaggatagccgccgaggcaaggccaagcccccatgacttggagaaagttcagaacagatcgggcgggtaaggctgtgatggctgtcgaggaactgcaagccctctgcaaggagttcgacgcccagcaaggaagcaaccatcagcagccagcccgcaagaaagtccgaaaagacctccactacgcctttcacggacgctcttcgcacaccacggagcaatgccgaaacattaggcaacgtggcaactcgcaagacccaaggccgtagcagggaacaactgtcgaagcaccccgcgaagcagttcaggagcaaacacccctagccgaacaacgccaagatgcacagcgaaggataatccaagtgattacatgggccgacccgccaagccagttatccaaacggcagaaaaagatgcagatccgtatggtccacagcatcacttcggcgggcaaaggggcgccgcaatatctgaaccagctaatctcttttgggccggaagacgcagaaggagttatgttcccgcatcaagatcctttggtaatctcagcagagatagctggtttcgaggtccgacgaatactggtcgacggagggagttcggccgacgttatctttgccgaagcatatgccaagatggggttgcctacccaagcacttaccccagcaccagcatcactccgcggtttcggcggagaagcagttcgagttctcggccaagcactcttgctgatagcctttggctcgggggagaacagacgcgaagagcaaatactgttcgacgtcgtcgacatcccgtacaactacaatgccatcttcggccgtgcaaccctgaacaagttcgaagccatttcccaccacaattacctcaagctcaagatgcccggcccggcgggggtgatagtggtcaaggggcttcagtcttcggccgcttcaaaaagcgatctagccataatcaatagggcagtgcactgcgttcagaccgaaccgcatgaacggccgaagaacacgccaaagctcacccctcacggcaagataacaaaagtgcagattgatgatgccgaccccacaaagcttgtatcactgggggacgacatgggcgaagaagaagttgagagtatgctagaggtgctcaagaagaacatcaacatcttcgcctggagccctgacgaggtgggggggggggtgttccggcagatctcattatgcatcacctggcggtcaagccagacattaagccaagaaaacataagttgtgcaagatgtctgccgaccgccaagaagcggcgaaagccgaagtacaaaaattgctcagggcaggggtaatccaagagattgaccatccggagtggctggcgaatccagtgctggtgcggaagtcaaatggcaaatggcgcatgtgtgtcgatttcacagacctgaacaaagcgtgtccgaaagacgacttccccttgccacggatcgaccagctcgtggattcaacagctggatgcgagctcatgagtttcctggacgcatattccggctaccaccagatccacatgaacccacttgacatccccaaaacatccttcatcactccgttcggcacgttttgtcacctcaagatgcctttcggcttaaggaacgcaggaacaaccttcgccagactggtgtacaaagtccttggcaagcagttggggcggaatgtggaagcttatgtcgacgacatcgtcgtaaagagccgcaaggctttcgaccatgcgattgatctgcaggagacattcgacagcttgcgcgcagcaggcattaagctgaatccggagaagtgcgttttcggtgtccgcgcaggcaagttgttgggtttccttgtttccgaaagaggcatcgaggcgaatctcgagaaaatcgatgccatccagcaaatgaagcctccgttaagcgtacatgaagtacaaaagcttgtaggccgaattgcggcactcagtcgattcctctcaaaggcagccgaaagaggtctgcccttcttcaagaccctccggggcgcgggaaagtttaattggaccccagagtgccaggcagcattcgacgagctaaagcaatacttgcaaagcctgccagccctgataagcccacccccaggaagcgaactgctattatacttagcagcttcgccggtggcagtcagtgctgccctcgtccaagaaacagagttcgaatagaaaccggtctacttcgtctccgaagcactgcaaggagcgaagacaagatacatcgaaatggaaaagctcgcttacgccctagtgatggcctcacgcaaccttaagcactacttccaagccaacaaagtcatagtgccatcacagtaccccttgggcgaaatactccgaggcagggaagtcacgggccggctcagcaagtgggcggcagagctatccccgttcgacttgcattttgttgcacgctctgctatcaagtctcaagtgctagctgacttcgtagctgaatggacaccggtacttgccgctgaccccgagcccgccgaacaattttgggtgatgtgctctgatggctcgtggtcgcacagtggggcgggtattgcagcagtcctcttttcgccgaatggtgtgccgattcggtacgcagcaagactgcagttcgacacaaccaacaacgcagcagaatacgaagccgttctcctgggcctaagaaaggcgaaagcactgggagtccggcgcttgctaattcggaccgactccaagttggtagcaggtcatgttgataactccttcgaagcaaaagaagaaggaatgaagaagtatctggaggctgttcggtccatggaaaaatacttcactggtataacggtcgaacacttacctagaggccagaacgaggaagcagacgccctggcgaaatccgctgcttgtggtggcccacattcgccgggcatcttttttgaagtcctacatgctccaagtgtgcccatggacagttcagaagtcatggtaatcgaccaggagaaactgggcgaagacccatatgactggcgaaccccatttgtgaaacaccttcaaactggctggcttccggtagacgaagcagaagcaaagcgtttgcagctcagagccacgaagtataagatggtctcgggtcagctttaccgctctggggtacttcagcccttacttcgttgcatctctttcgccgaaggcgaagaaatggcaaaggaagtacatcagggactatgtggctcgcaccaggctgcaagaacagtggtctccaaagtatttagacaaggagtttattggcccactgtgttgaaagtctgtgttgagcaaatcaagaagtgcgaaagctgccagcgtcatggccgaagccgaaccgcgccccagtatgatctgcagcccattgcgccaatatggccctttgccagatggggactggacatcatcgggccgttcccagtggcgcgaaacgggtataaattcgcaattgtagctgtggaatatttctctcgatggattgaagccgaaccccttggggcaatcacttcggcagcagtacagaagtttgtatggaaaaacattgtttttgccgtttcggagtgccaaaagagttcattactgacaacggcaagcagtttgactctgataagttcagagaaatgtgcgaagggcttaacctagaaatcaggttcgcgtcggtcgcgcacccgcagtcaaatggggcggccgaacgtgcaaatggcaagatcctagaagcactaaagaaaagactcgaggaggcagcgaaaggcaaatggccagaagaattgctatcggttctctgggccctccggacgacccccacaagaccaaccaagtttagcccgtttatgcttctttatggcgatgaggcaatgaccccagcagagctaggggctaacttaccaagggttatgttctctgggggcgaagaggggcgcgaagtatcgctcgaactcttggaaggggtaagggtcgaagcgctcgagcacatgcacaagtacgtcacaagcacttcggcaacttacaacaaaaaaagtttgacccacggagctgatgcctggtcatcttgtcctaagaaagaagacgaacccagtagcggttggtaagcttgaatcaaaatgggaacgaccgtaccttatcaaacacaagtccaggacgggatcttttcgcctaacgacactcgaaggcgaggagttcgaccattcctggaacgccgcctctctcaagcgcttctatgcctagaatgggtggcacccaaatcgccaacttgtaaaaatgtacatatagtcatgtaagcccttcggcactatgtaagtctttcggcaaaagaaaaaaaagaaaaaaaaagagaagagagaaaaaagagaaaaaaaactggatgtagggctattatccactatggaggaccgaaccagtataaaatctctgtgtcctccgccttctttttatttttcgtgtgattgataatttgtggaaaaaccccaaggcaaacgcctgatcagcgaaaaaggccagggggtgaaacgaatcggccgaagcattgcttgccaaacgttgaaaccgcaacagcttgtctcggaaaaaaaatagccgaacaacgttacgaccgatcagcataaaagcaaaagcgtttctctcgacacagaacgctacagatcgaaaacgaacgacgaaaagctgaaaagtcagtacacctatttcgctaatatacgcaaaggggccggcatgttccgacctaacaaaagcacaaaatgtgacgatgcgaaaaatagcgaaaaggaaataaagcacgttctttattaacttcgaaaaaataatcgaagaatacaaggttcacaacccgatacaattcacttcacaagtaaattacatctttgcccccgtaatcattatccctccctaaggaatggtcagacgaactaggttcgtcatcactactaatatcatacacaaccttaagaggagtagggggcgaaacacagactaaactgtaacgacgctgaaagatcgattcctgacgtttagttttctgatggtttcgccaaaagcgagccatatcctccaaacgtcttgaatgaacaagatcgtaatcttctaaggttcgcccggggtgcgcccgcagccaatcggcaaccttgaaaaccttatagctgcgaccgtttatctccatttggcgataaacaggccgaaatggacatcgcaccttcggcagacccttcaacgccacaaatttctcgttttgacttcgccagctcccagaagggggccaactgcaagattttcagcgaaccccctggtagacagtgcagaaaaggcaaaacacaacttacatagtaagaataggcaaaagaaggggaaggtatggcataatgcgaaatgagcgaaataataatatgccaaaaggctttgatcattaaaaagtggttaaaattgtgtcatacagtccaagtatgcaaaaaggcctctgctaaggtttagcggcagcttgccgaatatacaacggttcgccacatctagcgaacaccaaaagaaaactatgaaaatctaagagaagggcggagggcctcacacctctgggtggtcctgggcatcgcctccaccctcttcggccgccgcgccttcctcttcacaaaggtccgccgcctctgctttcgtcagctgctccaaaaggcgcgccttagcggcggagcggccgtccttctgccagaattgttttcaccacgcacgaagtgcaggcgaaatgtcttgcgcgctgatttcccaatcccccttcgcgtacttggggaactcggcgatgtgctcgcagccgaactgctgcaggaggcccatggtaaaggccgctgacacgcgcgcacagcagtcgccgtatgcggtggcgcagtccgaaaccgaaccaccagcctgttgggtccattcggagaagtcgaaggctgaggcatcttcggaggggacatcccgcactttcatgcccatatcagtaagggcgaggcgaagcgtttggcacgctgtccgcgcggactcggtggttttcaccatctcccgcgaaaaccaccgcgactccaccgcagcgcttgctttggccttgcgaacctcctgccgaagagcctccatcttcggctcggtgaggttgtaataatctatgagcacggcggtgtgggccttctctttctctagttcagcctttaagcgatcgacttcggccctagcttccttctcttttccagttccgattggagccgcttgtttttggccttcgcctccttaagggtgttggcaagggcctccatctccatatttttgcggcctaattcatcatccttggcccgaagacggcttttgaacccgtcaaggcgggctcgcacagttcgctctgttgaacagtgagccgcgaggatctgggtgcagaataggagcggcgaagagaacaagtgtcagttgtaaaaaaaagagagggagagtaaaaataaaaaaaagaggggaaaacgtacccgaacagccaggctttttatagcagagcacccctcatcgaactcattcagttcggtgaacaatctcggggcactggcgggcagtacaagattgcttaccccctccacaaaaggaaggaggtccgcccgcgtctcgaaatcgccaggggcgaagcggggtaacgggagcgaatattccgaagcggacgtctcaacgaccgctctctttcccttcgcctcaatcagcggcgacgcaaccggctgacgtgaaggactgccgaatactttcgccgcggccgtgacaattctttcggcagaggccgaagccccagcggcggtactaccgcccgctccagcggcgccgagtggaggaacgggggcagccgaaagatccaggctgcggccagcaggcgaagtaggagtcccgtcggaggactcatcatctctaaaaacgcgagcgacatcgacgagtcctttcttcttagccacctttttgacaagacctcccttcgccgctgcacccgaagagaatgcaactagggccttcgccccgtctaagtctttctggagaaggggggagctattcgactccaccccggtctcgttatggccaggactcagagtaggggtatagccgggagtctcagcgcggcccccgaccgcctcgcccgttgtcttctcgaccatgatctccacctcctcttctccccccctcctctttgccattatgttcttcggcatcctcctcgtcatcagcatcagagtccgacgaagcaggagccctacgcttcctaggggcaagctttacctgaccgcgcatccgtttccgcgaaggccctgtttcgtcatcggtcttgtggagattcgcccggggaggcagttcgccattgcaaacccggttcgcccgaccagctgcctgccgtgtcagcaactggctgaactcaacgacagacacatcgccgatcatcttgcgggattcggcttcagcttggtcgagggttagcactgtaaaagcaaggagggggaatcacgattaaaagtcaaacaaggcaaaataataaagcacaggagtacagcaaaacaacagtcttactgttcgtccccttaggaagaaccaagttcggtaaactgtcaacctcttcgctttgctcaaccgtgacttgccatgactgggagaggggaaagatgcgaagcatacagaactcctccaccaagtcacgacagctaaggcgggagcaagccttgcgcagcagaacgaaccgcgcctccgtagcgccgtccacggcgatcttgggtttccggttcggcgcaatcgccctacgccggcaccggagggctttcgccgattcagaaccagcctcgaaggggatggtgtgatagaaccacctcgccatccaatggcggtcccacttcgacatggcagcgttcaccggccagagatcggaccgctcggggcgaacgttgaagttcacactcccgaacacggtcttcctcgtcccagctggggtaatcaccgtcttcgagttcacggtggcaaagaatatggcgccgaaaagctcggcgttaggctcaaacccggaagtccggcatgcccagtcaaaaatagcggtccgaacaagagccgacgggctcggctgtggaagttccacctggaagaggcgaaggatctccggcaacaacacgttgtagggataccgtagccctgcctcaaaaaagatggcgaacaccaccgtccgattgtcgattggtttcagcaccatggctttccctagagcgaaagcctgcccctcaaccaatgctccagagctgaccagcttcgccagctcgacgtcgtccataagagaaacccccaaaaaggcggtgctgtcgtcatcgactcggccgggatccagccctttcgccgaagcagggtttggcctgcgaggggccatggcgaacggtgcgtttgcaatggcgaagaaagagaatgggcgaaatgcttgaggggtcaagagattccgtggaagaaagaaatggaggaagagaccgcccacggtaaaatggcaagtgtggcggtgaaaaggaaagagcggcgggaatttatagctcacctgggcgaccgttcgcctacccaccagtaataaagcaatacgtgtcgcaagggtaggcgaaatggtaaattcccaccatccgagcggcacagtaaaaagcccacgaagggaaagcccaatactgttccgttcggcccgggaaaagaaaatatataaccaccaatcgcaggaggcgaagcgtggcaaaataataccagccgcacaagtaacaaacttcattcgcaggaataatgtaggtttcggcaggagcatcggtcgaaaggagggcgccgcataccataccacatggtttgcacggtctcggccgaagctccaatctcacccttgtccgtgaggggcttgttggaggatggcatgaggcccttcgaccaagtctgccgaaacccgtggcgaaagctatggagcaagaacggcgtgaggcgaagagtcgtacgagtgccttgccgggccagaggcgtctcaagcgaagggtgcaaggcgaagactatccgccgagggaagacgacttcgccatgacaagttcgcccccgcgagggccgaagaagcctttccggcctatcaatcctaggggctataggaccggcgatcgcctgacggccctttaggggcccatgagcccctataacattatgtacccctgtaaatgtccctttcgtaagggtaatcatgtaaattcccctgtacaacctaaaccctagtagtaagatcctgtaatggggctataaatagtcccctagggccatgtaatggaggggatggaaagaaaagaattcaaaagttcaatacacttcgtttccttccaaccactgtcgagtaaccacgtctttcaacgtatgcagttgtcattttgacaacaccatccgttttcttttctaaactaaccctgtaggcatcttcagtaccggtactaaaaatatctttagtccctgttggtactaccaaccggtgctaaagatacacttttagtaccggttggtaagatcaaccgggactaaatatcttttttgggacttgagctttcagaaccgttattaaaaagttttcagtactgattcttaataaatccgacatatctgtggtttggggcaatggataaaagatgagttgtctagtagtggttatcaaatatgataattgctatagtgtactccctccatctatcttgagaaaatcctttgtatacccctaaaattatagctaatcctttttatgcccctaaattttgcgcctcaaattttgattttgatcccttccattccatactcctcccatcagttgaccgtgagttgatcatctaaattctataaaaatgacaattttaccctttgaatgagtatagaaatttatgaactatattattgaaaatgtaaaagtttgttatgggtttgctgtgcgatacactatttatgacaaaaataatttttagataattaaataaaaaatatgtatttattttattttcaaaaattcataaaaaattagtagcaatcaaataaagataggactaccaatgctcatgatatttttttttatgaatgctcttgataaaaaaatttcactgccgtattaaaattttaaaaaataattttaatttatacatttgttttattttcaaattaatgttaaattttttcactaattatttagtcccattaatttcataaaatacacatactgtgaactcaaacaaaatttccaattgttattcaagctcatattcaaacctaaatcatcaaaatgtaacaacgaaatgaaggaaaatgtaacgacataggcatgaaaaagatcaagttaaaatttcaggggtataaaataaatcgggtaaatattaggggtgtcaaaagggatcggttgaattttcaagggtacacatggaatttactcatctatctattgctccctctgtccatgaatttagtggattatggaatgtaaaggatttttgttaagaagtacaacagcaataaaaaattgagtactcccttccgttcccatcagaaaaaaaatatagagaaaagtacatgtagtattactctatagctctgaatctaggccctgtttagttcccaaaataaaaattttcacgctgtcacatcgaatgtttggacacatgtatagagtattaatgtaggcgaaaaaaaccaattacacagattgcgcgtaaattacgagacaaaacttttaagcctaattgcgccatgatttgataatgtggggctacagtaaacagtaaacatttgctgatgacaaattaattaggcttaataaattcgtctcgcagtttcctggcagaatatgtgatttgttttgttattggactatatttaatactccaaatatgtgtccgtatatctgatgcgataaccaaacccaaattttttccccaactaaacaaggccttatgtttatttctaagtctaagggccagcttagttcacgaacgaaaatttttggcgtgtcacatcagatatacggacacagaaaaattcgtctcgcaatttacacgcaatctgtataactagtttttttctatatttaatactccatacattatccaaacattcgatgtggcatggtgaaaattttttatttgggaactaaagagggcctaaatgtatactttctacacttctttcattctaaagatgagtgtcttttcacactaccaaatggctcagatgcatttcttcctcttccttaatttgggctatattgggcataataccctataatcttcgacagagggagtatatactaaaaatacattaaacttcttaaaaaggctctcaagcttacatgtggcattaaaaaatgctctcaagtttacatgtggcgctttaataaattagataaaatgctaagaaaaaacaaaacatatcacttgattttcacttaaattggtgggtctaatattatgaactattatgttatattcgcagcaagccggcatctcgtctactccgagcaccagctgcgaatcggcctcatcggccgccgctgccgagcacctgctgctccaccaccacgagctcgacaacagagaacttggcggtgagcctcaccttcgcgtcccggatgatgcgcaccatgtcaacgatgtcggcccccggtcacctcgcctctgctccccgtcgctgccaccgggtagaagcagttgctgtagaaccccatcgccgccacgccgtccgccttgagaatcaggtggcgcgtgttggcgaagaagcagacgcgcatgatgcactcctgctcggcatcgccggcggcaacgagagcgcgggtgcgggcttgccatgtcttggcgacacagacgtcgaaggagtagcagcggtggccggtggacgcgaagaaggtggacttgaccttggcgatgtggtccaggctgaggtcgacggtgaagtagcggaggttgagcagctcaagccgcggcgatggcggtgccggcatcttgggtgggttagggatgacgttgcgcgcccacaccagggacacccatggcttggcgaggccgcgcgcgtagtcggccacggcattgatgaactggccagcgccggcgaaggagctcgatgtcggcgagggagctcagcggcggtgagggagggagcttggtggcggcgaaggagctcggcgccggggatggatggatggacgatgaaacgaaggaggaagggggatgacgacggcgtgagaggaaaaagtgacgggagtggcatggttccaattttagaaatttctagtgatatgatgaatagtagtggcatttttgtaattaggcaaagttacattggcatggatccaattaacccataataatatgggaggtgatatggaggatgtaatatgaagagaaaatcccttctatacccctgaaattgtagctaatctcttctatgcccctgaattttgcttacttctttgtatcctcccaaaatttgattttgacaccttccatatccctcccgtcagctgaccgttagttgatcgtctaatttctataaaaataaccattttaccctttgaatgaacatagaaattcatgaattgcattattaaaaatgtaaaagtttgtcgcataagactattatagttatgagtttgttgttgtcagggttacggataaggtatacactctaccattggatatacgctttacatcaatatggtatatctgcgcgtgtacggacgtcctctgtatgcgctaaggaaattcatcacagagtccatagatggagagattcctaccaggataggactgggtcgtcactgtatcgtgtagggtccgatgtctctgagtccaacttggagaccacctgacctgcggtataaaagggacccctcgggagaacctaacgcatcaaatctcacaaccaagaccaccacagcttacgaagccggagcctataggagccaagttgccgggtgatttagtcgaaccaactcgactacgatctcgtcagtatcatcgagttctgttattccctcgagttctgttattccctttgtaacttgtggtagggctattacctataaaggggcctgaaccagtataatctttgtcttctgtttccttgatgtcatactatgtagatcctcgtaccaacgtaccccagtaccctctatatccggtctatgggtatcccctgtcgacagtggcgcgccaggtagggggccttggtgctcaaggttctactactatgaaatcaagcctcgtcgacaatagcatcaacaccggcctcatccaaggagtccctacttcaacaatgctggtgtggactcaagtcggcgaaatcgtcttccctatttacaccacaataccgatctcggctagtccatcaatgatcggaagcgagaacaccgtggctataaccccgggcgactccatgtcgaaagatcctcccgctgtagcggagaacggaacgtcgatgacatacgagcccgagaaggatcctagtgcggccaaaccttatccttccgacaaggaccatgcgccgacaaggacaacttccgaggtgacaaagccctggtgtcctatccacaagaccaggaaacacaatttgcaagcttgttgggtttttctcaacgtacaagctaaaattcatgcctgcaaagagcatggaatccagcgtgcttctccaactcgtgatgtctattgtcctattcacaagacgaagaatcacgacttctcaagctgcaaagtccttctccgtgccatgaagacgccgcttcctaaggtccagcaatcaaaaatctctcttagggatgcagacaaggaacaaggagcgacgctgatctcggatcgattcgttggagtgattgacatcgatccccacgagccatcagtcctatacttgctcgaagactatggctcatcatcctccagtacaccacgcgtcgtatttgccattggtgggaccagcacgtccacgcacgctaatgcataggcggagaatcaagcggtcacgccggcccaacacctcggcaccatcaacgcaatactgagagaaaacacctatgatcccatacttaacgatgatctcgcatgatggacagaatgactatgggaatcggttgccaatctcagtaacgcgttcgaggaggccgctaccagagcgcaaccagaacatccgacagctggcggtgctgatggcgaaccaccggaggaacggacgtcgcctagacgagctacccctccacctcgcggcaccggcgatctccgcgaccatttgaatggccgccgagaagaacgacgtgcgtgagacaacgagaatcgttcccgacatcgtgtctcttcacggcgtcgcgagaacgaagagcgaggaggccgctcaaacggagatcgacaccatgataatcgtcacaaccgccacgaccgcgacgatcacgaacagcggacgccggaagatactgttcgaggacgccgacatgacggcgatgataatggggatcggcgccaggacaacaatgctggacaacgacaggactctcaagaacccgaacgtcatcctcggaatcagacaccggagccgagtgacccatcgtcatcgtcatcatcctcttcatcctcgtcatccgatagacatccacggaggacatacgatcgctgataacccaccgcccccagtgccgggtgtagagctttcaaccgttccctacgtgatgtccgatgtcctgagagattccgacctggggcaatagagaagtacgatgggagtaccgacccagaagaattccttcaggtctactccacagtactatacgctgccggagcagatgacaatgcgttagcaaactatttgccgacagcgttgaaaggttctgcgcgttcgtggctgatgcacctcccgccctactcgatttcttcatgggcagatctgtggtagcaattcatcgctaacttccaaggaacttacaagcgccacgcgatctaagacgatctacacgcgttaacacagaatccgggtgaatctttgagggactatgttcggcgctttaatgagtgcagaaatacaatccccgaaatcacggacgcctctgtgattcgcgctttcaaaacctgtgtcagagatcgctatactacccaagagttggcaacaaggcgaagattgttcgaagtcatcgatcgatgcgctcacgcggacgacgcactaagacgcaagaacaacaagccaaagacggggggagagaagaagccagccaagggcacacctgaaccgagcaagaagaaaagcggcaagagtgggaaaaggaaagctcaagcggaagttcccgcgtcggaatacgaacgccctcccaaacacctagacccacaaggcagtgacacaaagagaatatggtgccccatatacaagtcggacagacattctctggaggattgcctcatcttcaaaaagtcgctggaaaagcaactggcattggaaaagggcaagcgagtacgtgtagtcgagaaagctgccgaggccaccactcaggactcgaactcagcatacccagattctgatcttcatgtctcgcacatcttcggaggttccaaggcgtactcctcaaagcgagaatacaagaaagtggagcgtgaaatttgttcgacatggcaggaggctgcacccaagatgaagtggtctgaacagaagatcgagttttcagatgaagaccaccccaaggctgctgttatcccaggacgatatccgatcgtggtcgaacccactattcggaatatcaaggaagcgtgagtccttattgatggcagcagctccatcaatcttctcttcaccaacaccttggacgcaatggggattccacgaagtgagttgacacccaccgatcaaccctttcacggattctgtcacgtcctgataaattcatcccgaaataaaaatcattttctaaaaggaataatggaattaattaaaaattcgaaaagaaattggccaaccctaaaatacgtacaagaaaaattcaaatgtggcccggagaatttttgttaaattctccttggtctaaaaggagccctcaaattttagtggaattttcagagcacgaataataattattaagaaataaacaaagttgaaaaggttttataaaaagaaaaatccctaaaagtcttcttttccccccctttctctcttgggccggttcggcccaactcttccttccttcttttccttttcccccgcggccaat

SEQ ID NO: 12084 - DNA, 12317 bp, Oryza sativa
gtcttaacaaaagggcttggggcaaataagtgacttttaaaagctgttgacggcaaaacttaatccctatattattattccctggtacctcccttgcattaatcatgcatcggccggtgtggcttgctgagtactgtggttgtactcattcttgctcaatccttcccctcttcagtaagagaagcttcggagaagatgtcttaggtggagtcctggcttataccccagttgagcgcctgtgaagatggagccgtaggcccgctagtccgctgctgtttatttttgattgtcaggccttaagtgcctttgtaataatgtaaatattgtcgatataataaagatgtgtcttttatatcatgtttgtgtggtgtaccccggcttttcctgggatggggattaatacactagcgttcgggaaaaggcaattttcccggtcgcgacaagctggtatcagagccatcttgactgtaggataagccaagtggataaaacccaaggacatattttataaataaaaattatttgcgaaagttcctttttctccttcccctaatgctatttgcaaaaggtttactccgttcttccttcttcggatttcaactagtactagatggtcaggtcagtgaagaagaagacatcgtcagttgttcgccgaagctccggaagactgcaggatctgctagtgaagtggaggaagcagtgaagccagctgtgaagcaggagtgaagatcttggagaacccgtcgcagaacctaagccaccctctagggtagagtcgttagtcgtgtgtttccttgtttgtgtgtgtagcgcgtggtttgcatcagtggggtgtgatgtaaccatgctaggttgattgcttaatcaacttgcagaataagcctaacatacatcataacagcaaaagacttagatctgttaaggtcctatccttagtttttaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtggcagtggtccaacacctgattaaccagaacaaattgcttatagagatactacagcagcatcggatgccaattttgaacccgagtcagatacaacctcaagtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactatgcaaggaactgtcctcagcagaaaagaaaagcaccaatgcgaaccgaagatgaagtccgtaagatgatcattaccagcacagaatggcctccaccaggaatgacaaaatgtcagagaagaaattcctcccgaggtgcacaacagttgacagagcatcttttagctaatggaggtagagtgtctggtagtgaagattcagatcaagtctcctcagatgatgaagatgagaagtctccccaaggttttaaccagaatgaaatagaacttaaggcatgctctcgttgtggagaaatcggtcatgttgccagctcgtgtgcctctacatgcgttcattgtgaggaagaccatccacccgataggtgtccaatgagcaggatcacttgtttcttttgtgaaggaactgatcatgtaccaaaagattgtcgattcagttttctgctgacgaagaagatggccaaccaacccgtcagttccaacggagagaagcatcaaggaaacacaaatcctcgccaagattacagtttcagcctaactccagtgccaggacagaggaaacaaaatgagaaaagaaaatgccgagtccgggaagatatctgttgcttcaattgtcaaggaatgggtcatttcgccgacaagtgcccaaaaccgagaaacgtagctgccagcacgtcagtccacgcaaacccccgcaatcagaagcttgctcctcaacgaattgtcatccatgcatcccgaagcagtcctatagcccgcgttgcaacagctccaatttcaatgagtgcactaccacaaggtgtcaatgctcaatttcagccccagccaccagctgacaagacagaggccagtatctgcgttgtacctttggaagttccaatacagcagctgagaaatcaagtacaagatgaagaacccgagtgtaagaaagttattgtttgttacaactgcagtgaagaagggcattactccaaaaactgtccccaaccaaggcaaaatcgacctccacattaccgccaatttacacgaagcagacattccaatcgtattgtggtcactggagcaaacgccgtacccgtaaggcctcgtgttaatcagaacccatagcagaaacaatgcaccaatgctcctcctgctgcacctgacttggcaataaatcatagcaaccattctctgcatcgacagcctcagcaaagaattgtcgtagatggaagaagttgtgtctctccccgacctactccaggccgagccaagagcaatcaacctccggagggcgataccaagcagaagaccgtcatccgcttcaaccagcaatcagaaggaagcttctcctgtgaatgatagcattatgcagtcctgtcacatcatcacagaaccaatcaaggatgcagtcactagaacaatgccagctatatctctccagaatcaaaatgagcagccatgtttgtggttttcagttcgctacttatcatggtgtaatcgaaagtttgcagcaaccatgtaatacataaatatattcatgtctataaacagtgagcttgctatgcttatggatgattcacgttgagaatacaatgtaccgatgttaagcaccgtccctttttgtttaaggcagtgcctcgtattcatgtaatgagggagaaatgtgtaatacagacaagttccaggaggattcgtttgaaagatgcggatatatgatcatgtgtataattgtttactgacaaaggagacctagggtctcgtgtcagaggaactatattctaacctcgagttaataaccaacctgtggatggaaaagaaaaacaattaaactgtgttgggttaaaaagccaacgagacagtagttgaggataggagtttggatacgccttttacagatcaagataaggattgttggaggaaacccctaagggtacccgccatgcctctacattgataagatcggatatacctgccaacagttaaggagatccaggagacatcaatatttgagaacataatagtcgatggttggtaattagtttatccggtatcagaaaaaggtcaaaggtgatgtggcagaagaacaatttggatgctccccatctcgaggaagcactaaagatgaccattggcaattaaaccctagtggtatagatacagatagcaggcaatgtatttccctgaaggtagtcagtgcagcttttgacgaaccacatcaaggttccactgaaaggcagcaagccaaaggacctcatcatccccagaagcgtccgcaatccacattaaagaataccacctgttagagataagccgaaagaagattgataaaagagattggcaaagatgttctctagcatgaaagaagtaggccgaaaggtgattgataaacagaaacatgctctgcatcgctcacggaagacccctgattgtaattgccccgcaacagtcaccttgtcattaagtaagcaagatgacctaggtaaaagtgtttctatgaaggcaaagagtgaaatcttccgctcggtatcagatgctacacggagtgaaaaatgcaagcaccggttaccaggcaacgccacgtcctgggagatgatccaacgggaaagaactcatcaaggttaaaggtgtaaaggaatacgttgagtgctaactgatgacaacatgaagagaatagcggaaagtaaactgaacataaagaaagtaaatctgagttgcttgttcgggggagctattcccagttatgaaccaagtgatatgttcgaagatagtctacagaggtcagtttaaaatcacatgtaacggcgaagcctcagatttggcaggataatgattagacaataacaaatccagcagtaaagccatttgggaagacgtcaaagtatatcaagtaggataagttggctcccttgggaagcataattcaaaggtaaagttatcgacccttgcatcaaatagcagaagtagctatcacccggagaccagggaagctaatatgaggcagttggtggcgagttagaagcaaatgacaagcatggtatcttagtaatgacgagctgatctcggcacatgacatgaagcgggtaacttgtatgaggttgactccaaagatatgaactatgcgaagttctggaactgaagccccatcttcaagtgccgcaacccagtcgaagtcagctaaaggttcaaccctggttcgagtcaggtgaaaagaagattccacctgcaacaggagatcgagccaagcagtccagagtggagaagctttgttaggcaagtttgttatagaaagcggagcggaagaagtcagacaagaagagaagaccgcccaacctatcttcatgctagcctcctcgaatctcggggacgagattcttgtaaggggggtggatttgtcacgtcctgataaattcatcccgaaataaaaatcattttctaaaaggaataatagaattaattaaaaattcgaaaagaaattggccaaccctaaaatacgtacaagaaaaattcaaatgtggcccagagaatttttgttaaattctccttggtctaaaaggagccctcaaattttagtggaattttcagagcacgaataataattattaagaaataaacaaagttgaaaaggttttataaaaagaaaaatccctaaaagtcttcttttcccccccttcctctcttgggccggctcggcccaactctccctccctctctctcctctcccccgcggcccatcggcctcctcccccgcgcgcgcgccgctgacaggcgggcccgcccgccgccctcgctgacgggtggggcccacctgtcatcgccttcctcccgccgctcccgccgctcgcccgtgccctagcgccgccgccgccgcggattccgccgcatcccgccgtccccgcgcgccataatgaggggggaatcattccccgcgattccctctctctttccccccgtttttccctctctctctccctcggattcgtccggaatcgctcccgcaaacctcgccggcgccatcaatggcggccgagatctccgcgcccgtttcctccctctccggccgcgctctccccctcccgacgctatataagcgttccccgtgctctccccctccgtttccgccactcgccgtctctcctccccgtcggaatcgagcccgcaccgtcgcaccttctctccgccgtcgccgccgagctccggttcgccgccgtcgtcgctccggacctcctccccactcggcgtcacctccatcggcttcgccgcgtccccgtcgacctcggccacccctccgcttcgctcgccgaccgccagagcaccgtcgcccacgccgtcccgaaccgcgccgccgccttcctccgcttcggccgccgttcccgtcgtcgccgtcgacccggggtgagccgaagaccgccctttcgcttccctctcctctccgctctctcgggcgccgctccgccgcgccggtggtcgccggcggtgaccatcggggcgcggtcgtgccgcctcccgtcggccgtgccggcgaggccgccttcgggcgcgccctcgcggctgccaagtgggcccggccgtcagccgcccgcgcccgcgggtgcggctgacgcgtgggacccacggcgccgaccgccgccagccgcgtgctcccggtccaccgtggaccgagaggctgacgcgtgggccccactcccgtggacccggtccgcgcgccctctccctcggctgacgcaataaacccgattttttaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgttcctgcttgttgtatggagtttattagagtaaaagccttttcttttccgttggtcgtgtagacgctgcagcttcgtaagatccgctcttcgtggaagttgaagccggcgtttgggaaagcgagcaaggcaagtcacatcatccttgaacatgttgaatcccagtttatcaaattattttgatttaaattactgcattattgctttatttaaattcccgcgttatcactgttttatttagccatgcctatttacctttgttaatacattattattgttattgttattattaccttgttcaccctaggaaaataaaaaccccaactagtgggtactctattcctggttccactggtatgaatttaggtagatgcttcgctgattaattaggcaacattaggaggttttataactttagactttgggaattctcatatcatttggacactatggaattgttggattatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtactaaccacatgtctaatgggtaaggcttaactcggtgctcaggctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctagcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttttaattcttaaaatttgctcaacaactaaaatatggaatggttggcctgggttggcttgggacgagctgggacccaggtcgggttgccagttcggtccgaatcatcgtaggccttgggttaaggcaggttcgtgagggttcacggccttgtttaataatactgtgtagctctaggatcgtctttacaaaatggctttgggcaactaagtgacttttaaatgctgtttactgcaaaacttaatccctatattattattcccttgtacctcccttgcattaatcatgcatctgccggtgtggcttgctgagtactgtggttgtactcattcttgctcaatccttcccctcttcagtaagagaagcttcggagaagatgtcttaggtggagtcctggcttataccccagttgagcgcctgtgaagatggagccgtaggcccgctagtccgctgctgtttatttttgattgtcaggccttaagtgcctttgtaataatgtaaatattgtcgatataataaagatgtgtcttttatatcatgtttgtgtggtgtaccccggcttttcctgggacggggattaatacactagcgttcgggaaaaggcaattttcccggtcgcgacagattcacccctcagtcatcatccaagccattgggcaagatcacgcttcctgtgactttcggacaagcgagcaacttccgaacagagcagatcacgtttgatgtcattgagtttgacatagcatacaatgccatcattgggagaactgcactcgcgaagttcatggccgcatctcactatgcatatcaagtactcaagatgcccgagccgaagggaacaatcactattcaagggaacgcaaagctggcgctccaattcgacaagtggagccttgacatggtcgagcacactcctagcccacccgccacagctgagccacccaagaaagtgagcaaaacaaccaagacgccgaaaccagacggcgcaatcaaaattgttccactctccagcgccaaccccaacaagacagtcaagatcggggcatcactgaacaagaaataggaactcgcgctcatcaccttcctccgcgacaatgctgacgtgttcgcttggccatacgagaagagctcgacaaacttctcaaagctggttttatcagagaggtactccatccagagtggatagccaacccagtcatggtgcggaaggccaacgggaagtggacgatgtgtgtcaacttcaccaacctcaacaatgcgtgccccaaggatcacttccccctccctcgaatagaccaactagtggactcaacagctggttgtgagctgttcagcttccttgacgcttactccggctaccaccaaatcagcatggcaaaagaggacgaggagaagacagcattcatcacgttgttcggtgtattctgctacgttaagatgctgtttggactaataactgcaggaaacacattccagcgtacggtccaaggggcactcaacgatcagctgggaaacaatgttgaggcctacgagaaacctttgacaacctccgatgatattgcctcatgctcaatcctgagaagtgcaagttcggagtaccatcgggcaagctgctcggcttcctcgtctctggcagaggaatagaagcaaaccccgaaaagatcaaggcaatcgagaacatgaagtcgcccccgagactcaaggaagtacagaagcaacccggatgcatggtggcactaagcaggttcgtcgctaggatgggcgaacgaggacagcctttcttcactctactgaagaaacaagaaaaatttgtatggacacagaaagccgaagaggcgtttatcgcattcaagcgctacctgtcaaatctccctgtacttgttgctccccaacctaatgaagaattattcctctatattgccgccacgccctattctgtgagtacgatcattgttgtcgagagagaaaaggtgcaaagaccagtctactacgtcagcgaagctctccacgacgcgaagataagatacccacagatccaaaaactgctctatgcagtaatcatgacgtcaagaaagctacgccactacttccaagcccacagggtcacagttgtctccaccttcccccttggtgaagtggtgagaaatgggtagtcgagctaagccagtttgatgtccactttgtaccacgaacagccatcaagtcccaggttctcgccgacttcgtagccgattggactatgcctgaaaacatgttagacagtcaaacagacaacgaaacatggacaatggcgttcgatggcgcactcaacagccaaggagcaggtgcggggtacatcttgacatcaccttcaggagatcagttcaagcatgcaattcaccttacttgagggcgaccaacaacacagccgaatatgaacgactactcgctgggataagagctgcggttgcacttggagtcaagcgactgatcgtaaaagtggattccgaactggtcgcaaaccaggtgcacaaagactacaaatgctctagccccgagttgtctaagtatctcgcagaagtcaggaagctggaaaaaagatttcatgggatcgaggtccgacacatatatcgcaaggacaacatcgagccagacgacctaagacggcgtgcgtccagacaagagccactcaaacccagcacctttctagacatcctgacaaagccatcagtgagagaggccaacgatgaagatagcccagtcgcccccgacatcagctcgggggctatagaggcagaacgcatcgttgccgacattgagaccacgaacgactagcggatcccattcattaaattcgtaagtagcgacgagttacccgaggacgattgttaacagtgaaatttggtaaatccggaatagtcatcggcttagagtcagcatcggcttcgaagtcctgagattagccgataagagttgtcaagtcgccagttgtcggattcttgctatattcggttaaggaaattgatctactaaaggaagcttatccagaagagaccgagttcaaagagaatacggcatggcaagttatctattaattaggaatagtttgttagtttccttttatctttaggaaagtgtgtttagtgtcctataaggactttatcttttccttttatctttaggaaagtttctttcttgtccgacaaggacttgtatcaactcatggctataaatatgtacacccggggtgtatgtaatctatctctacgatcaatacaattcggtgcatcgccaccttttaccttttctactttattttatcgtccggcgggaattggaacttgatgcggggctgcatcggtgttcgatctccgcctaaggggtaagtccaatgttccaccggcccaggcaattgtatcgtctacatcggcatcgttcaaggctgcatcagtacattcgatctcttggattgctctggtttgaatgatatatttgcctacctatttatcatatgtctctgttaatctagtcttagcatctcaatttagctctatcggctgcttctcgttttagggtttctgccggtatcggctaaatcgccatgctagattagattagcttagatatctaccaccctgaaaatcagtcaacggcttgattgtatagatattgggtttcttttcatacttagtgctgcatcagttaagtttgatctactaagtcgtgcttagattcataatctctagcctgctttttgactgccaataagggtttcatcggggtttcagccgatgaggtatctggacattgcatcagcttataaggattgcatataagttggatttagcttatgacaataaaggtttcactgttttatctaatcatttggattttatggcatcggacccccagccgatgtatgctttagccttcggatcaatgcttattccatcatattattatcagccgattggtttttatcggattatattatcgttatattatcatcagccgattgcctttatatcattattaatatcaagtgtcagattctacattggatatatagccgatttatcaaaaccctatcgagatcggctggtatcggtatcggctattatcggcatcggctagaatcactccatcggcttgtcagctatcagctgtttgatctactgtttgcatatcttgtcagttgtaggatcaaactgactggcacgtccgcatctcatcaagatttggacatgcacaggagctaagcagatctcctaggctggtgtgttcgatttttttcgtcaacaacgatgcagaagccgagaaaataacccgtcaggcaaaaatctacagtatgatcggcgacgatctatacaagaaggcgccaaacagggtacttctcaaatgtgtctcgtccgatgacggcaaacacctcctcctcgacatacacgaagggatctgtggatcacatgccgtcggtcgtacattggtcgggaaagcctttcgacaaggatttttctggccaactgccctcaaagacacttgcgacatggtacaacagtgtgaaacttgtcaatttcatagcaaacacacaaagctaccagcgcaagcgctgcaaaccatccctctcacttggccgttctcgtgctgggggctcgacatactcggaccgttcccacgaggacagggcggctacaaattcctgttcgtaatgatcgagaaattcaccaaatggatcgaagtgtcacgaccagaattaacccaacgggcgttccttacgtgcgtgtattattccttgtcccaggaggcaaggtacaccaaaagttgatacatttcagagtttatcaagcggaagcgtaaatagttaatttattacatgggcggggaaggcccagcacacacaaagacaaacgagaaacagcggaagactagggcgacgaccacaggcgcttgacgacaggcacgaactagacaccaaagccttcatcttcaagggctccttttctgggtttgggaaaaatt

SEQ ID NO: 12085 - DNA, 20744 bp, Oryza sativa
  unsure (1)..(20744): unsure at all n locations
ggagggagatgggccgagccggcccaagagggagagggagggaaaagggactttttagagtttttctttttataaaatcattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacatggattttaattattctaggcatcatttaaaggatatattttagagtcgttttgggacgtggcaaacctaccccccttaaacggaatctcgaccccgagattcggaagaactggcgaagagatcgggataggctgccttcagctcgtcttgacgctcccaagtagcttcttcctcggcgtggttgctccattggaccttgcaaaaacggattacccggttcctagtcctacgctccatggtgtccaggattttcactggcctctcctcgtaggtcaagtcttcgcgaacctcaatctgctctgagtcggcctgctcggacggcactcgaaggcatttcttgagttgcgacacatggaacacatcatgcacgttgcccaaggaggcgggcagctccaactggtaagcgacttccccacgtcgagcaatgatacggaaaggacccacaaaccgaggtgcgagcttccctttcgtctgaaacctgtgtacacctcgcaatggcgtgacccgaaggtacacaaaatcgtccactgcgaattccagattacggcgtcggttgtctgcataactcttctgccgagactgggccacctttagattatcccgaatggttttgactttagcttcagcttctctcaggatatcagtcccgaacacttggctttccccaacttggtcccacaatagcggtgtccggcatttgcgtccatacaacgcttcatagggtgccatttgtatgctggcttggtagctgttattgtaggagaactcggcataggggagactcttatcccaggtcttcccgaaatctaggacacatgcgcgaagcatatcttctaggatctgatttagacctcggtctgtccatctgtctgcgggtgatacgcggtgctgaaatttaatcgggtacccagctcttcttggagcttcttccaaaagtgagaggtgaattggcttcccctatcagatacaattttcttaggaatgccatggagactcacgatcctagcgaagtagagatcggctagtttgttccctccacaggtggtcttcacaggaataaaccgagctaccttggttagtcggtccacaactacccatatagaatcatatccgccttgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactaacccaccagtatttctctttcaagtctaagtacatcttcgtactgccagggtggatggaataagggctttcatgagcttcctgaagtatcaactgtttaagttctctgtcgtctggaacgcatacccgatttccgttccatagggttccgtgttcatcctctgtgaaaccagcggctttaccttgtttcatattcttgaggagtccacgtatatccggatcattcttctgagcctcgcggatttgatcgagcaaggtaggcttggcttccagtgtagccaagaatccacgaccaactatgcttaggttcagggcttccatctgttgattaagttcaggtggaatgccacggacgccaagagtgttgcaatggctttttcgacttagagcgtcggcgaccacgttggccttaccaggatgatagtggattcccacatcataatccttgatgagttctaaccatcttctctgccgaagattcagatccgattgagtgaagatgtatttcaaactcttatgatcagtatatatttcacagctattcccaatgagatagtgccgccagatttttagagcatgaaccacagcggctaactccaaatcatgggtagggtagttgccttcatggggccgtagctggcgtgaggcataggctaccacatgaccttcctgcatgagcacgcaccccaatccttggcgcgaagcgtcacaatacaccatgaagtccttatgagtatccggtaagattaaaaccggcgaggaaaccagcctttccttgagagtttggaacgccttctcgcattgcgggctccacacaaatttctcttctttcttcaacaactgtgtcatgggtcgagcgattttggagaagttctcgatgaacctctggtagtatcctgccaaacctaagaagctgcgaatttgagtgactgtcttgggttgcttccaatcagtgacggcggtcactatttcggggtccacagcgactcctttagcagatatcacgtgccctaagaatttgacttcggacaaccagaactcacacttgctaagcttggcatacaattgatgttcccgcaactttcccaacaccagacggagatggtgctgatggtcatcctctgattgtgagtacaccagaatgtcatcaatgaaaaccacaacaaacttatccaagtattccatgaacactttgttcattaagttcatgaagaaagcacgagcattggttaaaccgaatgacatcaccgtgaaatcatacagtccgtatcgcgtggtgaatgcggtcttagggatatcttcttcacgaatacgtaattggtgatatctggaacgaagatcaatcttggagaatacagtggcacctttaagctgatcgaacagatcatcgatccggggaagagggtacttgttttttatggtaacttcattgagagctctgtagtcaacgcacatcctctttgtcttgtctttcttctccacaaaaatcacaggagcaccccagggggaagtactcggccgtatataccccttttctttcaactcttccaactgtttcttgactttggccagttcattagctgccatacggtagggtcgcttgtacagaggagtggttcctagagcaagatcgatccggaactcaatctctcgcttgggcggcataccgggtagttcttccggaaacacatctccgaactctctgacgatggggatttccgacagtcttatctgatgaagttctgaactaccgacagaggttgggggtgcaaagaaaacgaccggttgttccgtccctcggtacagagtgacagtgcatcttgcacaatccactacacattggaattgagccaaccaattcatcccaaggatcacatccaagttcttggtgtctagaagaatcagatccgagggaaaaggaattccctggatttctataggaacggcagggctataatactttgctgtcataacccctccaggggtggtgatgagcagagggttcctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacgtcctcggccgtcacgtggttcacacgaccccgaatgacatccttaccaccgttgttggagcggggatgcgcttggccttgctggcgcctcggctttgggcatttatccgcaaagtgcccaggcttgaagcagttgaagcacagacgctgctgaccttgaacgtccctgcggccttgaccaggctgcacggctggcataggaggacggggcgcacgagtcccttgctgactctgctgttgctgcggctatgggacgcgcaccacgaattgaggacccggcgcacccgggctcgcaccggccggcgccgtgggccccacgcatcagccgcacccgagggcgcgggcggctgacggccaggccccacgcggcagccgctcggtgcgcccgaaggcggccacggcggcgcggccggcgggaggcggcgcgcgcgcgcccctacggtcgccggcggcggccataggcatggcggagcggcggccgagagaagggagggaaagggggaaacgaggcggcggtccacagctcaccctaggtcgacggcgatgacgaaaaggcggccggagcggaggaaggcggcggcgcggctcgggtcgaccgggacggcggcgctccggcggtcgacgagcgaaacggaggggtggacgaggtcgtcgaggatgtggcgaagccgaaggaggcggcgccgaggtgggaggtggtccggggcgacgacggcggcggaccggagctcggcggcgacggcggagagagagagcgacggcgcgagctcgattccggcgaggaggaagggtggcgagaggcggaaacgaacggaggaggtgcggggagggtttatatagggttggaagggggagagggcggccggaggggaaggaaaccggcgcggcgctctcgggctccatcaatggcgccggcgggattaggggagggtttccaaacgaatccaagggagagagggagggaaaattggggggaaagagggagggaatcacgggactgggccacctttagattatcccaaatggttttgactttagcttcagcttctctcaggatatcagtcccgaacacttggctttccccaacttggtcccacaatagcggtgtccggcatttgcgtccatacaacgcttcatagggtgccatttgtatgctggcttggtagctgttattgtaggagaactcggcataggggagactcttatcccaggtcttcccgaaatctaggacacatgcgcgaagcatatcttctaggatctgatttagacctcggtctgttcatctgtctgcgggtgatacgcggtgctgaaatttaatcgggtacccagctcttcttggagcttcttccaaaagtgagaggtgaattggcttcccctatcagatacaattttcttaggaatgccatggagactcacgatcctagcgaagtagagctcggcggcgcggagcgaggttgctgctgctgttgctgctgcgaggacgatccccctggatagggattggtgtagcggaccctttgattagccccctgttgattgcggaaattcgccaagcgacgcttgtgcgactccagttccttgtgcttggcttccaagcggatgctcttgtcaaccaaacgctggaaatccggatagtccccggagaccagacgcacggatagctcagggtccattcctgccaagaacttctcctgcttttcctcatcttcccgtacatcctccggggcgtaccgggccaggttgttaaactcatgcaaatactccatcacggagcggttgccttgcttcatctcccggaattcccttttcttaagggccatgactccggcgggcacatgggttctccggaaagcgacggtgaagcgggcccaagtaataggttgcccctctggctgcgtagcctggaaatggtccctccatatagatgcgggcccctgcagttggtgggcggcgaagatgactttctcctcatcgctgcactgcacggtgtctaactttttccccacggcatgcaaccaatccaacgcatccacggggttattggagctagagaaggtaggcggacggatgcggaggaactcggcgagtttagaatgttgtgggggtggtggtggagcattatgttgtggcggattttggatgtggtggaggaaaccagtcatcatgttggcctgctgggcgaggatttgggtgaggatggcgttggtgtctggtggtggtggtggaggcggaggaggaggtggaggtgggctgccatggttgttgtggttgctgccttcgaggtgactgccttcaccggtagcagcacttctcctggttgtcaccatctgaaaacccacacagaaccagcaaacagagagagctgacaattaaagctaaccacccacgactaccataattcttgaatttattactgctattaaattggttcattaaggttcaagttgcttaagcaaataaaataaagacatgctccgacatagttataccacacaccggcataaccatgccctatatgactctagcagaaaaacaaacgagaagaacacacgcgcaagcctactaactgctcgtctactgctacgacgggccagggcggaaggtgagcagcaacgcatcctctgtgctgccaacgccggaggctccatcctcctgaggaacaacgggggcgggctcggcacgaggggtctcgacgaagcaggtccacgccagggactgacgaacaagctcgggcctggaggtactcttgcgggcggtgatcttcaggctgcggcagacgcgacgacgcttggggcgatagacctctccctgggcgatcttgagctgatgcagctgcgcctccactgcgtctaggtccttcttcagctgcagattctcctgacgcagctccaggatcttcatgttgttctcgaccaacccgcgacgcaccatctgatggaagtcgatacgggccacgtcgtacgcctccaccatgcgcgccaggtgcatgatggtagcgtcatcctccgagctagcatcccggaaggtggcgtagtcgcgggctcctccgcgacgagggtggtagcggtagggcgagtgctgcaactcgtccgggtagcgctggtgaagagtgccgatggcgaggagtgcggcgttctggcaagcggcggagaaggaatcaccacccgcggtgactgccaacgaagtcctctcgggtgagccagtgaggatcactgcagtaacctcccaagcagcgtggggctctgcatcgtcaccctcttgctccgggagctgcttgccctggtaatccactccatgcggataccctaggacaacgcacatgccccgtagctccaaaacgaagccagtcaggtccagaccacgacggttgatgctgctggccatctacaaacaaaaacaaaagagaaaagcaacattttaaaggttagattttgacgataaatgaagcagcaggacagagagagactagaggattttcacaaataagaaaggatttttattttgaaaatattgctaaggcttgggatctacggctcgtcctagtgtcaagggggctctgataccaacttgtcacgaccggaattaacccaacgggcgttccttacgtgcatgtattattccttgtcccaggaggcaaggtacaccaaaagttgatacatttcagagtttatcaaacggaaccgtaaatagttaatttattacatgggcggcgaaggcccagcacacacaaagacaaacgagaaacagcggaagactagggcgacgaccacaagcgcttgacggcaggcacgagctagacaccaaagccttcatcttccaagggctcctcttctgggtttgggaaaaattgagcaagactgagtacaaccaccgtactcaacaagacacacccacaagtgcaggataaatgcaagggagtacaagggggttataatataaagggttagggtttgcagtaaacagcattaaaagacacttagttgctcaaagctattttgtaaacacgattctagagctatacaatattattaatcaaggtcgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacctacaagacacatcttcctcacgtgtaaccacgtcccgcataccaccacggtatacggacggaagacgtgacatagtttccaacccatcctagccatagacaagagtaccgacccaatcccacctacggccggaacccccgggacaggtaggcaggactgagccccttgcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggcgctactatcaaaaccatgcaccccgagcccagcctaaaaccattttgaggattttgaatagagggggaggtgtgaatccaattccacaataatccaaccattccatactgtccaggtgatatgaatattccaaagtctagagttgtaaaaccacctaatgttgcctatttaaccaacgaagcatctacctaaaatcatactagtggtaccgtgagtagagtgtccactagttggggttttgtttattctagggtgaacaaggaaataataacaataacaataataaggtcataacaaaggtaaataggcatggctagataaaacagtgataacgcgggaatttaaataaagcgataatgcagtaatttaaatcaacataaatttataaactgggattcaatatgttcaaggatgatgtgacttgccttgctcgctttcccaaccgtcggcttcaacttccacgaagagcggatcttccgaagctgcaacgtctacacgaccaacggaaaagaaaaggcttttactctaataaactccatataacaagcaggaacaaagcacaaaaatgggttcatgatttcttaaggaaaaattagagacttgaacggtccaattccgagttcaaatggccaagttatggctatttgaagtttatatgctctttaagtgaatatttgcgaatttcttcatttaaattttaatttaaaaaaaaagtttattgcgtcagccgagggagagggggcgcgcggaccgggtccacgggagtggggcccatgcggcagcctcacggtccacggtggaccgggcgcacccgggctcgcaccggccggcgccgtgggccccacgcgtcagccgcacccgagggcgcgggcggctgacgaccgggccccacgcggcagccgctcggtgcactcgaaggcggccacggcggcgcggccggcgggaggcggcgcgcgcgcgcccctatggtcgccggcggcggccataggcacggcggagcggcggccgagagaagggagggaaagggggaaacgaggcggtggtccacggctcaccctaggtcgacggcgacgacgaaaaggcggccggagcggaggaaggcggcggcgcggctcgggtcgacggggacgggggcgctccggcggtcgacgagcgaaacggaggggtggacgaggtcgacgaggatgcggcgaagccgaaggaggcggcgccgaggtgggaggtggtccggggcgacgacggcggcggaccggagctcggcggcgacggcggagagagagagcgacggcgcaagctcgattccggcgaggaggaagggcggcgagaggcggaaacgaacggaggaggtgcggggagggtttatatagggttggaagggggagagggcggccggaggggaaggaaaccggcgcggcgctctcgggctccatcaatggcgccggcgggattaggggagggtttccaaacgaatccaagggagagagggagggaaaattggggggaaagagggagggaatcctggggaataattcccccctattgattgcacgcggggaggacgggggcggcgggagtcgcggcggcggcggcgctagggcgcggcgaggcggcgggagcggcgggaggaaggggatgacgggtgggcccacccgtcagcggcgcgcgcgcggggagaggccggatgggccgcggggagaggagagggagggggagggatatgggccgagccagcccaagagggagagggagggaaaggggactttttagagtttttctttttataaaatcattttaactttgtttatttcttaataattattatttgtgctctgaaaattccactaaaatttatttacgcattttaggcttttaggaaatatacaaaaatcctccgagccttatttgacttttaactttgcacattttaattgttggaggctttcacatggattttaattattctaggcatcatttaaaggatatattttagagtcgttttgggacgtgacaaagcaacacccacgggggaaatcaaggccgacaacaccatcaaattcattaaagggatattttgcagatatgaattgcctcaccgcatcataacagataacggttcccagttcatcagcgccgatttccaggattactgcactggactgggactcaagatctgcttcgcctcggtttctcaccctcagagcaacggacaagtcgagagagcaaacggcatagtactacacgggatcaagacccgtgtctacgacaagctcatgtcacatgacaagaagtgggtcgaagaactcccctcggtactctgggccgtgcgcaccacaccgataacgtccaacaaggagacacccttctttcttgtgtacggctcagaagccatgctccctaccgagctacaacaccagagtacacgagtacagaagtactccggcgaggatcagaaggaacagcaaaacgacgacgtgaacctactcgaggaacctcgagaacgagttgccgtcagggcagctagttaccaacaagcccttcgccggtatcacgagaagcgcatccgagcacgcatactttcgatcggcgactacgtcctccggcgagttcaaagccaagcagggcgaaacaactctcacccaaatgggaaggaccgtacacgatcacacaagtcttgtggccaggcgcattcaagattgcagacggtgatggtcgcgagttagaaaattcttggaacattgaccaattgcgtaaattctatgtataagtcaatagtatccatacttgtaagacatcttacgacttcaataaagcctgtcttcaggtacagatttcaatcaaagtgtcccttcccgatgatccctcacccagatcacacctagtgttgaaactgatcctcatgtctctttacgccgtcttgacaagccctccaaggaacctaaggaacttctgctggagacgcctagagctgataaggccttgtcggatcctttagagacgaaagaccatgtaagatcctggccgcatgcttggaggggatcgcctccatcgccgtcgccagctccgcgagcgaagccgtcagcgagaactcgtcagggttcgccgggatggtggtcttaacaccacactccccgacgagctggtgtaggccggtgtaggtgacccacagcgaaccgcggatttccgacaggttgttctcgagttccgacatgcggttcttgagcccctgccattgccgctcgttgccggccaccagctccttcattttctggaggtcctcacgaacctccgtcaagtcatgcgccagcttgtcggcgcgtttgttcaccgacgacgctgccgccgccctcgcctccgctatctcgcgaactatgccgcgagcgccggcctggaggaggcgccccatctcgacttggagctcctcccaggtgaggacgtcagcaggagggcctcgagcaggcgcaagatcgccgacagggccgctgggcgtcgcctcacggctcctgggcacgaccacgacatctgtcgaggccacggccggagacgcgctagagttccctccagatccatcttgcgctgctttcacccgcgccgccctatgaaaggctgccatcaagacaggatgcgagagttcaacgaaataacaaaacctcgaattcatccacttacttctcaccaagcgtcacaagccgctgccgtcgcggaggtggcggagacgcatccgaggcctagagtaaaacgagcatgatgtgaggtcaaggttttccaactacgcgatgaaggaccatgagagcttaccgagggggtgggcatctttcgacgatttctgagcacggaggagaacatcctccctcttctcggaacgttgctgccactcgttgtgacagcagcggcagcaacatcggatgcctccttggcaatgtcctccttcagcgacgccgccgcctgatggtccacgagcggcccgatgatatcagtcagagggagagcctgcactacatgaagtcacagtgcgatcccggaagaaaaaggcaaaagggtcgctgagtacactcacgttgattacggcttcgcgttcggctgcccccttcttgcaaagagggacagggacgttgctcgccgttgaagggccgctgatcacgacttgaccgacgcggcgctccacggtctcgccgttcaaacctgtagatcgagaaccaaaatcgataagtcaggaggaacacacacttaaggagtggagtccaaaatactagaaaaataccccgaggagaaacccgagtcacatcctccagcccagaatagtcaaaggctggatgggctcgagcttggagcggctagatccgcctaccaatgaagtcggcggcgacttcataccccgacaaccctcgcactcggaggtcatcgatgacatcgataaaagactgaagggaaggggttaaggtgggtttggcggtccaagacgaaatcttgtctggttgttcctcaggaacaacaatgactggatctgaattttctatctgaagatagaaccacctcgcccgccatttactacgagaagaggggcactagaaggggatgtagcgtgacttcaggccatcctgaagtcggaaaccgacgcatccagataccctgttggattccatccaacgcaactcatagtagaagcgaaagaggtcatgaaacggctctaccccaatgtaggcctaacaaagatgagaaaagatgatgaggaaggcgatagaattggggttcaaatggagcaaggaaagaccgtagaaattcaagaccaaaagaagaaactcggagggaggaggaagaaaaccacagagaatatagtcctcaaccgcaaccatgcggcccaggacaggttcaggttcagtacctcctggttccctctccatggtcccgcgaccagggagagcgccttcctcctgcaacttcttcagggacgcgctggtggaagtggacttatcaaggtccattgccgtcggagatcgccggagaagggaccgagatgagcaagctagggtttgtgcgggaatggagaagacgaagagcacttggaggcttgaaagttttttcgcaacaggcagactccaaaatggatccccaaaactcccttaaatagacgcactaccgacgatgcgaattccaaggaaagaagagagatgcccgccgaaaatttctgggtctgttacccacgacagtttttggacttcaatttaaattcactcacgcccattgaatttcacatagcgttgtcgattactccttgtctctacgatcttcacgccgagatcgactagtcgagaatgacaataaccccgacatcggaagtcgcgatcggttatatgagttcatttaagcagaagtcgggggctactgtcagggttacggataaggtataccctctacccttggatatacgctttacatctgcgcgtgtacggacgtccactgtatgttctaatgtcacaccctaaaaatccaaaatatataaattgttgtttaattggaattattagaatttattttaaaaagcctagaagagaagatctaattttaattaataaattccaatataaaatggggccagataaaatttcattaaatactttgcttaattctataattcctagatttttctgggatttatttgagctaaggaagtattttgaataaatggaattgcatttcatgaataatttaaattgaaaaaggtttttaaaagtctctttttgctttgggccgaaagtcggcccaaaacccctctctttttctctctctcctcggcccaagccggcccgcaaccgagctgccgctctcctctctctctctcccgctgacaggtgggccccacctgtcggactcgtcgtcctcctccggccgcccgccgcccgaaccctagcgccgcgccgccgccatctccttccaaattcgctcgcgcctttccttctccggtgaaatcaatagaggggaaatgatcttcggaatcccctctatcttttctcttatggaatcgtcggctaatttcgtttggaaattcgcggattcgagttcgattcagatcgatctctctcctctgaaccctagaccttccttcgccgtcgccggtcaccgtgggcctccgacgctgccttccaacccctttaaaaggacccccaagtccgccgctacccgtcgccacccttgccttcgtctctcgtcgtccgtagcgccctagccccgtgagacctcgcgccgccgtcgtcgccgccgctccagccgtgcgccgccgtcgctccagtcgtcgtcgtcgctcgggaaggtcgccatcgtggtcgccgtcgcgtcgccgtcctcgtccgcccctccgccgttgctgtcgaccgccggaacaccgccgtcgtcgtcaagccgaaggtcgccgccgcttcttcctcgacgccgtcgccgtccgttgatcttccgtcgccgttttggtcaccggtgagtttgccgtgccgtccgctacccgtaggtgctctccgttcgcgccgccacgccgtcgttcgccggtgagcatgcgcgcccgagccgccgccggtggtgacgtcgtcgctgacgtcatcgtcgtcgtctctcgtggtctggccgtggaccgttcgatctcggccgtccgttttggataggatcgatctcggccgttcgtttccgtgagccgccgccgtgcacccggtccaccgcaaaccctagccgctgacgcaataattcctttttcctgttcaaaaataattcattattgcgtcataattcaattaaaatccatataagtgttttaatctgatttaatctttaaaaattcataactaattcatcttagctcggatttagttggttcaagtctctaaatttttctaaaattgagatctacatgttaaaaatatccacatgtactgctcatgcttgttattgtgctgttttggtgattttgctccattctgtttagattccgatgtttccggagagtccgttttcgcaggagaagaatttgaagagttccaaggccagcaaggcaagtcacacagatcccaaacaaccctttgagcatgttgatcccgtttaaagctactgtttctattcaactattgcatttatttttgaatgtcattgggtggaattaacctattgtttgttatagccctttttgttcttgattactttactccttgataccttgggtgattataacttgactagttgggctatatatattggttcagctagatattagatatgattgcttagccatgcctagaaacattagcacactattgggataacttatgattcactattatttaatgatggcttaatgatagttcacgatggtcaatcgtgattggttaattaattatttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatccaggaatggtgcgctgtggtggattgtgttgtgcgaggggtactatcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtctttcgtgattagtttcacacttctcatcataataaaagatgctataactgatagtaatttgattagctcctggtttggaatggtatattcctggtttggagatagaactgtgcagccgggatggttgttcagaatggttgggcctatgcaacagggtatgttgtatagcgttggattaatattgtttaattatcacttaactgttttattaaattctgaaatgtttattaaatgctgtttatgcaaatgaaaccctactatgccatcctttgttatcctgagcacttgcatatttgctgcgtggcttgctaagtatgtcatatactcaccttgcaatcattcatcagaggaagagttctacagtgatgctgatggtgtggaggattaggtgtagccttggtcaagctgcctgtggagtggagtcgtctgcgccgtttatcttattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacagctaaggaaattcatcatggagtccatagatggagagattcctacttggataggactgggttgtcactgtatcgtgtagggtccgatgtctccgagtcctacttggagaccacctgatctgcggtataaaaggtaccccccgggagaacctaaggcatcgaatctcagaactaagaccaccacagcttatgaagacggagcctacaggagccaagtcgccgggtgatttagtcgaaccaactcaactacgatctcgtcggtatcatcgagttctgttattccctttgtaacttgtggtttccattatataatcccataccaactggattagggctattacctataaaggggcctgaatcagtataatctttgtcttctgtttccttgatgtcgtactacgtagatcctcgtaccagcgtaccccagtaccctctatatccggtctacgggtatcccccgtcgacaattgtgccgatgcattatttatcacaaaatttatttttagataaataaataaaaaatatgtatttactttttaaaagaaagttattaaaaatgaggagcattcatacaaagttaggactaccaatgctcacaatatgttttttatgaatgctgctgatcaaaaatatccgttgtcctattaaaatttcaaatataaaatttaatttattacatttgtttatttttcataatttatgtcaaaattttgtacactaattatttagtctcattagtttcataaaatgcacatactatgcacttgaacaaaaatttcaatcgtttttcaagcatatattcaaacctaaagcatcaagagtaaaaatgacatttgcaaccaaacgtaatagtgaaatgatggaaaatgtaacggtaggggcatggaagggatcaagttgaaatttcagggatatagaagggatcaggtaaatttcaggggtatgaaagagattgagtgaatttttaggggtatacagggaatttctcataatatgaatgatatattggagtaggaagatagatacagaatgatctattttggatgactattcagaccaagatatggagtaccgatactctagtgtgtgatatggagggtaaacaaaggaaaatagtataattataaacagtgttccttgttatgaaatctatcttattgtggatgaattaaattatgaatgcgaagcttactacagaagaaagcttacgccacaagccaacttacagaggaagccagcttacggcgcaagccagcttacaggagaagcccgcttacggcgtaagccggcttacaacgcaagccagaaggtccaaggcttacgacgtaagtctccaccctcctccgcctataaatagggcccagaaggtccaaggcgaggacaaccgatcttcggtctcctgcttctcctcttatagcttgtactcaaatccagaagaaataaagcttccactcactcatactttctatgttcaacaactctgtgtttggtttgcttgtgtgctgatcagtagaatagactggtttctcaacacgttatcagcacgagactctaccgagctaaaaaggtaaacaggtgagaaatcagtttctactgatcatcttgctctttatatgcaaatcattcttctgctatagttgaaataagcagaagagcatggtacctgaagtaccatcccccgatattatctcaacgatacacaataacatcatggcggctctgccgccattatcgttgaattgctacagttgatacatcctctcagcaacgcccggtaacatgatggcagctctgccgccattaccgtccaaaggcttgagatggtacatccccttagcactatttgataacacaatggtggctctgccgccgttatcgtccaaatggtaggggcgatgtaggtgcctgaagcaccggcatggcaacttggacggctccgcggccgttgccaccaaatatcggaggcaaacgaaccttctgcacgaccctgaagtgtcgttttggatgtcctttgttttatggacatcacccatatgggcccttgatgccactaaggtcggctctgccaccatgaagcatgggctcatagtggggaagtgctacatggtttatcttactttttacagtctgcacaatatacatgaagttgtgcccatgtatactcttcgttttgttttacatgcttactttgttgtttgcatgtctttcataacatttattttattgttatgaaattgatttcctagcatgattgataatagttaatcaagcaatatgtaatcctgaagattacttaagttaatttgctaggaaagattctatgggaaactgtgtgataatcctaaagattacacacactagtaatcctgaagattacgcatgaccaattcatgtcgaccctgcacatgtatttaccagtcgtaaataccaaattatgttgcagaacatgtcggacataacaaagaaggaattcgccgagcttgccttggatggtagtaactacctcacttgggcattggacgttgagattaaactcgactccattggtctcgatcatactattgtgctgcccgaacttggcactgtggagtctacgaaggccgagaaagcaaaggcattgcatttcttgcgccaccatctccacccagacctgaagtctgagtatatgaccgagaaaaatccactggtattatggcaatccctgaaggatcgctttgaccagcaagggtcaattgtgctcccacaggtacaacatgactggatcaccctacacttccaagactacaagtctacggcggcgtataactctgccccccataggatcatttctcagttgcgtttttgtggccagaagatcactgacgctgagatgatcgagaaaaccttatctacctttcatcccaacaacatagtgctgcaacagcaatacaggaactcaaagtacccgaagtactctgatcttatctcagtcctgttagttgcagaaaggcagaatgaagttcttctaaagaatcattctgctagacccactgggtctatggcagtgcctgaagcacacgccaatgttgttggaaactcgcgtggccgtaaaagaggccatggtgagaagaaagggaaaggtaagggaagtatcaaattcaagggcaagagcaagggtaaacccagaggtaaaggcgaactcaagaaggttacaggtgaatcatctggggaaaagcaggataactgctatagatgtggaggcagagggcattggtcccgtaactgccatgtccccaagcacctggttgagctctaccaacaaagcatgaatgagaaaaagagccaacatgagtcccacttcaccattgagcctgaagctcagattgaaaagcatgatgacatgcttatcaatgttaaggatggtggggacgtccgtatggacgatgattggaacaaccttcttgaaaaagatgataacatatttggagacctgaagtaatctcctatatgtcagtcatatgcagtgttccgcatgagtagcacatgtagaactttggtcataaataatgctcctgaagagcaagcttagtattttactgggcctgaagtccttgtaatgtttcccttaatagaatcaatttactccatgtttaatttcatttatgtttatgttctataaacagaccttatgggaatcccatggcagaagaggatatatgtctagtagacaatgccaccactaacacaatcttaagggaaactatgtatttccacaccttaactaagaaaactagaaatattatgaccattgccggaagcaatgctcatatagtaggcaccggaagtgctactctagttctccctatgggtacccatatctttgtaaaggatgctctattggatcctgattcaaagcgtaccctcttnnnnnnnnnnnnnnnnnnnnnnnnnnnnnnnnnnnnnnn

SEQ ID NO: 12086 - DNA, 10411 bp, Oryza sativa
gaccactctttcatgacttgattaacaaccaactaagaatctccacgaactattagatgctgaattcccaaagatatcgcgatccttaatccgtgatgaagcacctcatattccgccatgttatgggacgcagaaaaatatatccacaatacgtaactcagcctttctccagtcggggaaatcaggacaacacctgctccggtgcctaaaagcctctttgactcgtcaaaatgcatggtccaatactccatcttttctatcggcatgtcttcttggaactcggtccactcggcgacgaagtctgctaaggtttggaacttgatcaaagttcgtggtttgaaagatagatccaaagacatcaactctaaggcccactttgcaatccgtccatttgcctctcgattatgaagtatgtccccgagtggaaaacgacgtgaccaccgtgaccgagtgaccttgaaaatagtgagataatttcctaacggtaattaaaacaccacataacaatttttgcacctgaggatatcttgtcttggagtcgaccaaaacctcgctgacgaagtaaattggttgttggactttttaaacatggccatcatcttcacgctcgacaaccaggaccatgctcacaacctgagatgttgtcgacacatataacaacagcggctcttgtggatgcggtgaagataagaccggtggagtagtgagaagtttcttgaagtcttcaaaggctttttgtgattcgggtccccactggaaattgtcagctttctttggcaacttgaaaaagagcatcccccactctccgagtcgtgaaacgaaccagctgagtgccaccatgcatccagttaacttttgaacgtcattctgggaactcggcggtttcatgttgaggatggcgttgattttctccgagttggcctgtatgcccctatgggacgccataaagccaagcaacttccctgacgttactccgaagatgcactttttagggtttaatttcatcttgaagaagcagatgctcgcaaaggtttcttctagatccgcgatcaaatcatccctctgcttggtcttgacgactacatcatcaacataagcttcaacgttacgaccaatctgagttgaaaagcatctctggatcatgcgttgataagttgctcctgcgttctttaatccaaaaggcatggtgatgtagcagtaggccccgaagggcgtgatgaatgaagtcttcaagtagttggactcctttaaatggatctgatgatatcctgagtagcaatccaaaaagctgagtagctcgcagccggccgttgagtcaactacctggtcaatgcgaggtaacccgaagggatctttgggacaagatttgttgaggtcggtgtaatcaacacacatacgccattgtcccgtcttcttcagaaccaggaccagattggccagccagtcgggatgtaggacttctttgatgaagcctgttgctaacagcttggtcagttcctccttgatcgcatccttcctatcctgtgcgaagcagcggagtcgttgctttatgggtttagcgtcttccttaacatgtaaagagtgctcaatcacctctctaggaataccaggcatatcagatggtttccacggaaagatatctttattattttgaagaaaggtgatgagcgcgctttcctatttacaatctaactcggcgcctattacaacagttttagtgggatcagagggatctagaggaattttcttagtcttggcatcgccctctccgttctttggcatcttggttgcaggcacttctccttcggttgctgtggatgcagccagtcggatttcctctcgagcgagcgtaatctcgcgggtctgggccatctcgcagctttccttgtggcaagtcctggcatcttcatcatcatgtaggtatagtgcgggacggccaagaacttggctaacaccgggcgttcgagtatagcatggtacgctgtctcaaaatcaacaacttcgaagcaaatgttctttgtgcgaaagttctcccaagtgccgaaagtaaccggcaaagtgatctggtcaagtggagtagaagatagcccggggatgactccgtgaaagggcgcattactcggcttcagttctgtgcgagggatctgcatgtcgtccagagtcttggcaaaaaggatattgagtgcgctgccaccatcgatgagggatcgtcggagcttgacgttacgaaccactaggtctagtaccatggggtaccgccccgggtggaccactcagtcaggatgatctaagcggtcaaacttgatagctgtctctgaccaccgaagatattgtggcgtatcgggctgaacggcgttgatctcccgctcggttagcttttgctttcgcttacattcataagccaggggtccgccaaagatatggttgagttccttgcgtgagtcttggaaaccagtaggggcatcatcttcatcatccttcttcttcgacgtgctttgaactccgtcagtcggtttgcttgagttcttggcgtattgctctgcgaactatttgtagacgaagcaatccttggccgcgtgatttgaattcggatgatgtgggcattgggagtgcatgatcttgtcgaaagtgttgacgcgcgaacgctgtcgggaggatggtgtagtagttgccacaagttcttcgggcttacgcttgcgatctttgtaattggtacttccactcccccttgtcgtcggcgtatctttctttggcttccaggtggtgcctgactgcttggatgcggtgacgacgtcttcagcttttgcgtactcattggccttttcaaacatctgcttgacagtcctgggaggcttgccgactaagagttcatgacgaatgcccttggtgaaggcggcaatgatgacgtcgtcggtgatatcagagatcttgttatgttgctcggaaaaacgtcggatgtaatctcagagggattctccagacttctggacaacgttgtaaagatttaactgagtaccagggcgttcaaaagtgccctggaagttggcgatgaagtggtcgcgaagctccgcccaagatccgattgtgccacgggatagcccatgaagccaggaccgagcagagtctgctagggccacaggcagataatttgccatggctttgctgtctcctcctgttgtgcggatcgcgagcctatagacagtgagctaagactcaggatttgtcgtgccatcatacttctcgattccagtcggtttgaagccggtcggccaatccactcgacgcaggtcacttgtgaaggcagcatctccatccacatcgtcatcgtaatgatccagtgaatggtgggggatgtagcctcttgccgtgcggcgctggttgatagtttcgcaaagatcgacgggacgactgcgacgtggggagcgaggctgttcggctcgacgctccctgtgtcggtcaggaggcgagtggacatatcgttcgccatgatccctactcctgcggctagatccggcgccgacgacgctgaggcttggttggtgatagtcttgagatcgaagaggcggaactcggctgccagtcggcgtacggacacttgcagagttcaccgggactgaagcgacgatcatggtcttgatctgatttaagatgttgacgacgtgattggcctgattgagtgcatcttccttaaggagagtgtcgagaagggtgatcgctgcaaccgcgttctgctggggggtgcgaaaaaccgccgtcccttcgacgtcttgttgcccaataagttctcgtgctcgtcgcccggcctccaaggcgcgctgtcgccggtcctcagcctccttcgtagcccgttcgtgctcttgttgctcacgctgtagccgttctcgctcttgtgcttgacgctcctcctccagtcggcgacgttcggcttcttgtcgcacatgctgttcttctgcttctcgggcttgacgctgttcttccgtgtcattgtcggccatgaaaacgccgaagaagagaggcgcgtagttatcttcgtggccttcgtcgaagttgtcgaggttgcggtagtcgtagtggtagtcgaagtagtcgtactctacaatctccgttggtcgagaatcgacaccgggggagctgaggaagccatacaattcttccgtcgaaaccgtcccgagacgttggagtatgacgccgacttccctggagctaggctggatcgaagccgaggctggatctggcctaggcctacgggaagaagacgcccttgtggtgaagactgtggccaagtcgtcggggagactcatcaggattgagggataggccccattgtcttgatcaggtcgtgttgaagtagattggatctcgtccgactggtttgaagccgactcggttgagatgatcttggagtagatctcggccgagttcgggataccgaacggggcggagacctggcctccccccgactggttcggatccgagtcgaggagagaaatcttgccgaagtcgttggtgatgaagtcgaggctgccaaaccggaacgcctgcccgggagggaagacgaagtcgtcgatgccggagacgaaacccatcgcactagtcggcgaagaacttgacactaccctacctggcgcgccaactgtcgaaacaagatttcggcaatactaaaagggggtggctatcaagctggaaaagtggatgggtttaaagacaaaaaattttatacaggttcaggccttcttaataagaagtaataccctactcctgtccagggattgatccgtcgagtgatctaggagaaaaatcgtgccccaagagacacccggacccctccttatataggagaaggggtccgtattacaaagtacagcccatactcctaacggaataggtagttacagataagatacaatcgtaaccgactaggatcccgggtatttccttgacataaaagtttggaatttaacccgagtccctttaaagatattctatctatacatggcaccccatacccagtcggatatacatgccgtgtaggtatggggtatccataatctccacagatagagtcctgagaaggcaattgtatctatcaattaggatattttatgtaatttccttagagatatatttgggcaaaagtctgccgcaaagacttatggtatcttagagtttgttagagataagagtcgtatccgataaggacatagtttgtaattctcgggtataaatagaccctgaaccccatgtaatcaatgaacacacatgttcaatacaatctcggcgcatcgccaccctttttactttcgttttgtttcgacgagttcttgctttcgggttgagctgtatcggtttcgatctttaacaagaggtaaaacttgttatgacggcttgcgttctcgggattagtgcttccatctttacgacactctaatcttgtttatgtaattcatcgagttatcatatatcctgcataatctctggcaatatcgttatctggcctacaatcggctaacatctatcggtagaaggcagccgattaggttaaatagtgacgttggcttggattatataggatatctaccactctatgaaacttctaatggcttgattgtctagatatttgtcacgcccggaaattcactagtaatttcaaacttatttgtgcataaaatcctcgtctaggaatcagccgaggtacacaaactgataatttaatatacaaatccatcataataataacgttacatacatacaaaagaaaagaaaacagcagcggaataacggtctagcgatggcttcagctccactcccacaagcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatatagtctcatttgcgaaagcagcatttagtaaagatttaagagtagtgaaacagtagagtaattaatcagaaattttaatcaacactgaacagcacacccatgctgctcaggcccaaccaaacctgaacaaccaaccccggtcgtacagatcaaacctccaaaccaggaatttaccattccaaaccaggagtcaaatttattatcacattattatcattaatgagtagtgtgggactaatcacgaaaaacattgctcaacccgcccatgaccgcgggcacggctattcgaatagttttactctggccagaggtataccactatacccacaagacacgattccacacatgttgccatgcctcgaagtaccaccacggcactgcaaagggggaaatcatgacaatacccttcgcacaacacaactcaccacagtgcaccattcctgaatcataatcaacccctctataaatataaccagaggcatggactccctagcgatccccacggacttctcaccgcttctcagtctggtgccccgtaatgaatcatgctatacaaaaggtaaagccgttgcccacgctggcttgtggttggcacggttaatgtctcacaacagtagctcgcgaaccggtccttaattgccataagcacgaccttcaaaaccatgtgctgacaacccaccattaattatattttaattaccaattaattatcataacacgattaaccatcgtgagctaccattaaatataaccataaataataatgtagtatatatgattcatcccattagtgagctaatgtttctaagcatggctaagcaattatatatataacatttagctgaaccaaaccaatacataaggttcaagctaatcaatttattacccaaggtatcaaggaatagggcattcaatgcaaattggccataacaaaggaataggttcacaccacccggtgacattcgaaaataaatgtacagttgaaataaatagagaatttaaatataggatcaacatgctcaaaggattgtgtttaggatctgtgtgacttgccttgcaataatcgatcttcaattaatcttcttgaacacttccgacgcactcacgaaccttcgcaacgacggaaacgacaaagctagcacgcaaaacgaagaaaaagactaataaaaaccaaataaacagtacaaaaacaagcataaacagtatatgtggatatttttaacatgtagatcttgattttagaaaaatttagcaactagaaccagtcgaatccgagttacgacgatttagttatgaagttccgaagtttaatcgattttcatctaataaagaaaacctagaaaaagggatttatgacgtcatcgctgacatcatcatcgccggccatggcacggttgacacgaccaccggcaaaagagggctcggttgggctatccgaggacacctacgcgtagaggacgacgacgcgaactcaccggtgcaaagaacaacgaaggacgacgacgaacgacggccggcgacgaggttcaacggcggctcgactcgggtccccgacggcgacgctccggcggtcttcggcggctgcgaaggggcggacgggattcctctcctcctcacgaacccgactgtgacgacggacggcagcggcgacgatactagcggcagcgcgacgcgaccggaggatcgccggcgacggcggcggctaaaacaacgcggcggcaactctacgggcgacggctcggttgggacttggggtaaacggaagaggacgactaggggatgctttatatcggcatgggtggaggagatcggctcaggaacggatggatttggtgaaagaagagtcgggcttatcccgagttcacccgaataaaaacggccaaaattcgtgagatagataacgaatttgatgggggtttcttcgggattaggtggaggagatagagaggaatccgtttttgcaatcaattttggaagggaagcaacggatgcaccggatttgatggaggaggaggcgactgcacaggttggctcggctctgtctggagctggaagacgacactgtagcagtagggaggccaactagactttttgggctgggccggaagggagcaacaaaggacttccaatttaataaattaatcaatgagatgagctttgaattgttaaaaatacttccaatgctcaaataatttcaagaaaaatcctgaaaatacttggacactcaaagtatttaacaaaattaaaatcagatcattaaatgattaatttaatatttaaataattgctgaactgctctttgtatgattaaaattaagagttgagctccgaaaaatccgagaaaattccagagagtataattaaccatggagaatttaataaaaattaaatccatccattctttatatttaggaaattttatttcccacatttaacttcacttgtaaattaataaacatttaatataaattctaataataatttattaaataatttataaatcctgaaacgaaaatcaggatgtgacaatattgtccttcttttcatacttatagctgtatcagttgagtttgatcttatgagtcatgattagaatctcaatctctagcctgcttcttggtagccgattagggtagtatcagggtttcagccgatcttacctgattgaactacaatacttgttttatatgcttcgttgatatgttaaatctgccctttatgctaagatcttatagcatttaaatatattaggctttcgtttgatatattctgcttgctttaatatcttaatatagagtggtatcggagtattagccgatacatgctaaatctacctgattggctatgctatgaacctatatagtcccattattaatatatatttcgatctaagtgatttatactgtctcggcatggcgaccgatctatcccaatcacttgatttaagtatatatcgatataaggagtatatattgttaatatctacagccaatcgagtagatttggttccttcttgtttactcatgactgtcgatcgatacatatatgacatcggctcaaaaataaatgatatgtcatcggccaagggtcgatcggctgtcatttatgaatttaaccgcggtttctttgtctttgttcttgttgattgcaggatcaaatcaactggcacgcttgcatacccgaaggcgagttttggacctgcactggagttaagcagatctcccaggcctcgtgttttacgtcaacacgcttttggcatgcccggtgggactgattagaagtcagagttttcctcatggatgagaagccgccagcatcgttgtcttcggctggtgaacccggctctgttaaagctaagatccagaagctaggtctatctgaagtcgaagaaggcaacatcgtgaatatcactccggacaagttgacacctgatcagcagaaggatcttgaagcaatgatgcaacaagcacgtaacctattcttgaactcattcatgcaaacccgcaaggggacagttgtgcagaaatatgaagtaaaggtagttgctgatgtccctgggaccggttcttctaaggatagagaagtgaaacaagctccaagtgatgtggctcaaccgagtgataagggtgctgcagatggttctcaaggaaatcaaggtgttggctctaatcaggatggcaatatggcgcagttacagtttaacaactttcaggatcaggttgactatgccgtgcaccatgctttgatcaatcaatctggaatattggtcaatactttgtcaaacatggtgaagacaatggttgatggttcaatggctgaatatcaggctataggactggtttatctaccaggaggggtgttccccaattatcggccgttagtcactgataatcagccagctgttcaaccaatttctctgaatgcaccatcagctcagccgacggcaccattatcggctccttcacctgctgcaccatcatcggcaccgggccaattagttaatccccggttgctggtgagagaacaaccacagcatagtggacaaaatgtaaatcggctaacgcaagatcaggttgcggctaagttcttacctcctcaacctactgttgatccaacccagcagcagccgattcagcaaacaccaccaaggcagcaggttgcgcagtcgattcaacaaacacccgcagtccaacaagttgtgcaaccaattcagcagacgccaccaagacggcagattttgcaaccagttcagcaaacgccatcaaggcaacaggtcattcaaccgattcaacagcaaggcttgatgaatgcatcggctgggtttgcaacacctggcagtcagccagggcagcatgctgcgaattaagttgtcccagagcacttggttcatcatgtacagccagatcaaacggtgatccctcaagttgttcctgaacatttgg

SEQ ID NO: 12087 - DNA, 2288 bp, Oryza sativa
aaccagtcatcacaattcaacagacaagtctagagattttttcatcaacatcgtgcatcggtttggagtacctaatcggatcatcactgataatggcactcagttcactggcggagtatttaaagatttctgtgaagacttcggcatcaaaatttgttatgcctccgtagcgcatcccatgagcaatggacaagtcgaacgtgccaatggtatggtacttcaaggaattaaagcacgagttttcgaccaactgcatccgtacgctggcaaatgggtagatcagctgccgtctgtactttggtctctgtgcactacacccagtcgggctacgggccagtcaccgttctttctagtctatggtacggaagcaatgttgccaagtgaggtagaattcgaatctttacgatttcgtaacttcaaagaggagcgctagggagaagaccgagtggatgatctcaaccgactggaggaagcccgtgaagcagccttaattcagtcggctcggtatttacaagggatgcgatgttatcacaaccgcaatgttcgatcgcgggctttctcagttgaagacctggttttaaggaaaattcaaactacacgagatcggcacaagttatctcccttatgggaaggaccgttcataatttttgaagttactcggccaggttcttacagactcaagcgtgaagacgatactcatgttgacaactcttggaatattgagtatcttcgtcgtttttatgcttaggcattacttttgtatcttcctctttgactgctaacatcaagttgttccttgagttaccagtcgggggctactataataataatggagtgtgattattatcaattcaattttcttacttgatttatcattgccttgtttgatcttttggcttagtcaatgaggactgaaagtttttaacaacttttgcgagttctaggctcaataaggtttgacgaaaacttttaagaaatcaggagctgagtttaaattatcaagcacagcataaattcatcagtattgtacaaattgtgcctccatcatcataagttaatactatacaatgtaaatcagactcagttttttcatcatcagaattaccagacccagtcggcccgagattgttgtcctgaaacctctcaactacatcagcagtaatcttgtctgcagccttttgtgcatcattgatgagatcaagggcatgttcttcacttgtcccatctgcaaagtcgtcgacagcatcaatatcgatcttcgggtacaaggacttggtcattgccaatgccaggctagcccctatgcatcccgctttcttgatgttcttaaaatatgtatctggagcagctcttagcttgtcgaagatttcaacagcatcaaaagaactcggaccattattattgaaaaacatggcttggatgagtggtgtggcggcgttggcaacttcatctccggctccttcaagcttcttaattttgttgaccaagacgtcgaattgagcttgagatttgattttgcgatctgcgcaaatggttcacatcaacgactatgcaagaagacaagaatggtttgaagtttcagcaacaagtacattcgacatctttcagagccgagtccctttgtttggtcaattcgcccttgtctttttctagagctttgattcgcttttctagctcggatatcttggtagcttgcactgtattattttccattgatcaattacatatggatagcggctttgagtaagataggcaggactgaaggttggcgttggtacctttttagggagggctgcttgcttgagcctctgcttccgggatgtcttcatttcgttctgtacccgactgatttctagtcgggggctcctgatcagtactgacttcagcttcggccgactggtttccagtcgaggttcattgctggcctgtacattgtcggttgctggttgattactactcaggcgatctttggcagtcggcccggtttctgtcgtaggactagtctccgcgccagttggttcagagtcttttccagaaggatcgatgtcataaggcttcctgcaaatttgagatatgctattaacaatacttcaatagtgaatgattagcgatacaagagaaaatgctaagtgacatgtacctggatgacttcctgattttcggtatgggacgactggatgttttcttcttcgggttagcttgtcttggctgttttccagtcacccctttgctgccagccttttcaacatcgtcaccctcatcgtcactcagaactaatttcctcttac

SEQ ID NO: 12088 - DNA, 5665 bp, Oryza sativa
cggtggttgcacggaaaattttgtggaagctgtaaagttctaaaaaaatggattgaagtgaatttgtgacccctagctttcgctggtgtggttttgcattgtagctgagggtggggaaagtggcaaaggttttggcgggaaagacaaatcacctcgacttaatgtcgtaccccaagtcgtattgtccgaatcggctgtatcacctaacccagtctgactcggacttagctgatctcaatcgtatccgatccggactcccgccgattcttgctctgtttccgcgacaatcctcgtcttagattccgtttcgatctaatcttcttttccaatgctgatattaccaaatttggttgttaacaaaaggcgagcaagtgccaccctcactgatcaatctagctcgcccaagaatccaccaaagtattcaacgagatcatcccaccggcaacattttaggagacatcaacaagggagtatccactcattctcgtattgcaaatttttgtgagcattactcgtttgtgtcttctcttgaacctttaagggtggaagaatcttttgggaggccgattgggtgaaggccaatccagaagaacttgaccatttcaccccgaatggaagtgggacttttgtggagcgaccttcgcaaaacctgattggccttaaatggatctttcccaaccagccagaccaaggccgggtcgtaataaagaacaaggccaggttagtggcgcaagggttcacccaaatcgaaggattagatttcggtgaaacttttgcaccggtagctagacttgagttgattcgcatattgcttgcttttgctagtaacctcaattttaagctatatcaaatggatgtcaaaagcgccttcctcaacgggcctatcaacgagttggtatacgtggagcaaccaccgggcttcgaggatccgaactatcccaaccacgtgtacaagctccacaaggcactctacgggcttaagcaagcccctagagcttggtatgagtgtcttcacaattttcttgtgaaaaacggctttgagatcgggaaagccgattcaactctttttactaaaagagacatgataatgatacttttgtctaccaaacatatgtcgataacattatatttggttctactaacaagtcttttagtgaagagtttagtaggatgatgaccatacgatttgagatgtccatgatgggtgaattgaagttcttcctcgaccttcaaatcaagcaactcaaggaaggaaccttcatttgccaaacaaagtatttgaaggacatgctcaagaagtttgggatggaaaatgccaagccaatccacactcccatgccatcaaatggccacctcgacctcaacgagcaaggtaaagacgtcgaccaaaaggtataccgttccatcattggctcacttctttacctttgtgcatctaggcccgatattatgcttagtgtgtgcatgtgtgcaagatttcaagccgctccgaaggagtgtcaccttgtggccgtgaagagaattcttagatatttagtgcacacacctaaccatggtctttggtatcctaagggagcgaggcttgatctcattggctataccgatgcggattatgccgggtgcaaagtggatagtaaaagcatatcgggtacttgccaattcttgggtaggtctgttgtttcttggtcttccaagaagcaaaactctgtcgccctatccaccacggaagcggaatatgtttcggcgggggagttgttgtgctcaacttctttgggtgaagcaaaccttgagagactatggcctcaatgtatccaaaatcccactcctatgtgacaatgagagcgccattaagatagccaacaaccccgtccaacactcccgaaccaaacatatcgatattcgccaccatttcttgagagatcattccacaagaggcgacatagatatccaacatgtgagaaccgataaacaattggcggatatcttcaccaagcctctagatgaagctaggttttgtgagttgagaagtgaactaaatatcttggattctcggaatgtggcttgatctattgcatgcatgtttgcttggtagaataggtttgcatactactttgtgacaaaatggtcattcaactcatggatggacactagtcacttttgtggagaacttgaatctatgtgtattgggatctcatttttcaacaaattttggtcgtagcacaacttgaaatagattcacacattccctctctcgagggtgaattatcttgtctcatggtaattccctctcttttgatccctcggattgtccatttgacttgtggctattgttttgtgtgattgattgtgtgctagtcacaagttcaagtggaccctctagagctcgaccatccctcctttcctaatcctatcaaaaatctttgtgaaatgtgtttttgaaaaaaatttcccggtgcttgtcccctacaaaattcctttcaaatgtttgcaaaatagtttcatcaaaattcccggcgaaatccccttgcaaaactgtgttttccaggaattttcggactttccgaaaaattttcggaccttccgaaaatttcccatcctgtcgctcttctattcatgctattccaggatttttcggactttccgaaaaattttcggatatatccgaaaatcatcaaaaccgtgtgcttcccctctagatccgttcggacttatccgaaaattttcggaaatgtccgaaaatttcggggctcatatattttgacccgtggactcctctctctctctctcttcctcactttttcccaacgggtttgactccctcctccactccgcaccggcgaccccattctccggcgacctcccgcggctcccctcctctccaacattgtgggagcgcgtttggggcacttattgggacttgcgttgtcgatcatcaccgcgttcttcaagtgttcttcgtgttcttgaggtatccgccctaaaatcaaatcctttgattcctcaagttttatcttgtgattccctttggtggagatgttcccctagtgccctaggacctgcagattcattttcccaagtttttgttggcggatttgtgctgcatccggatgataaggttcggccggatttttccggaaaatccgaaaattgtttccggatatatccgaaaattcctggccgacccctatcacctcggttttgcacgattcttgccttcacttacttggtccttgcttctttggcttccattcactgattcattgtctatatcttgtttgaaggatgcctccacgcaagcaaacctcccacaagtccaagcaccaaagggaccgctctcccaccccatcctctcatgatgatttggacagtgattggtccgggagagaggatgcggttcctcaggttgcgcgtgtggcttgggccgacactctccctcctcggcggtccactcaagctcttggtggtggtggtgatggtgagggctcctctcatcaaccgcaaacaccaccgcaccaacccaatgtccccacaggtccttttcgcattcatacacccaagagggatccggcggtgattcgccaagtgtatgattggaagcggaagactgaggttgttgctcctcgccgggatgaggatccgcgcccccttcgccgcaccgccacggattcgcggttttggactctctttcaacaagactttgatgagtctgtgatcaagtccaaagctcatcccaccgttcccatgcaatggatcaactaggaggagctgcaggcgcatgatgatccggtgctaaactttgtgattgcaaattgtgagctcatgggaattcgctctttcgtgactttgcagcagaattggtgcagcgaagtcatcgctcaattatatgccaccgttttctttgatccttattgtgccatgcattggatgacccaaggctcttactattatgtctcctgtccgcgatttgttgagatttggggttttgacgtctgttccttgctaaaccttcctgatatgcatgatcttcccattcctgccaacactaatctcctccctctttacactccaaatgatcctaatgtggtgttgggtaaagtcgacggtctcaaaccgtactttgcctgcttgaaccggatgttttgccggtcctttgtgcctaaggatggtgatgccagcagcattaaccacctctccaggaccgtacttctcaggttcaatcccctcctcatcgctttcatgttttgcactttgtgtgggaggagatccgcatggcctccattcagtacaagaaggggttggtctatgctcctcacattatgcggatgatcgagactgtcactcagcttcagtttcatcatgatgtgactcattcccagcttcacttgcgccttgttaaggcagtaaccccgacaaataaattcttcaaacacccgaacggaaatattattgaaggatttgggattgtacaagatgtacctgtctgctttgaagacaaggaggcagtcttggatttccacgtctttgtgaaagtgcgactaggcccctagtgattttggtgattaattacaatgcgattagagaggattaaaatttttattcacgtaaatgtgaaggttgttatgtcctcaatgagttaaagtaatgcatttcccacccaatgcattgacatgatgtgatgcggcaaatgagcaaatgctatattgtaccttttcttttccttgagttaataggaaagccgcactattaagagggatgatgcattgacatacgaggagtgatcaaagtgctcaaaatcaatttttaaaagtgtttctccttagtttggtgtgttctggaatttttttggagttttccgaaattcattttcggactttccgaaaatacacagagccagtttttcgcttctggaaattttcggatatgtccaaaaggcattttcggactttccgaaaatgactgagaaggcaaatatggttctgcatattttcagacttgtccaaaactgattttcggattttttgaaaaacatcaatagagtcttttcgcttctgtaaattgtcggagttttccgaaaggaattttcggacttttcgaaaatgtccagaagggtgtttttggttctggaaatattcggacttgtccgaaaagttttcggaatgtccgaaatatcttcagttaactttactgtcggtgccgagctggaattttcggacatgtctgaaagagaattttcggacatgtccaaaaatctttcggaatatctgaaaatcacaattattgtgcataacgggcataatttaggctgtggctataaatagccccctcccctcacttgtgagggctgctggtcacattggagattcttgtgctcttggcttgctcttgttgagattcacttttgagccttgctttcttgtttcccctctcacccgtgttcgattcggatttggtgtgtgtgagagttgtggattcgagtttgtgtgagtgcttgttgttgacttcgtgaagatttgtgagcacttgcatcatctccaggagttcattgcttcatttgttactcttggaggctgaggactcctaggcggctaggtgtcgctcccgagccaccgatctacttgtgattggccgggagaagtttgtgatggtcagatctcacctccgaaag

SEQ ID NO: 12089 - DNA, 6422 bp, Oryza sativa
  unsure (1)..(6422): unsure at all n locations
atgctttcttgcacaatgacagagaagcccctatcataatcagtgacaagctttctgaagacgagactcaacgtcttctgtctatgttagaaaagcatcgtgttgttcttggctattcccttcaagacctcagagggattaatcctgcactttgcactcattgtatccctattgaccttgagagtactccctccagggaacctcaacacgactcaataatgcgatacgagaggttgtaaagaaagaggtcctgaaactcctgcatgccgggattatttaccccataccatacagtgagtgggttagcccagtccaggttgtgccaaagaagggaggaatgatggtcgttgcaaatgctcaaaatgaacttattctgcaacgaaccataactggatggaggatgtgcatagaacaaggctacgaaaaaggatcattttccgctacccttctttgatgaaatgttggaacggctggcaaatcattcctttttctgtttccttgatgggtattgcaggtatcatcaaattcccatccatacggaggaccaaagtaagactacgttcatatgtccgtacgacacatatgcttatcgtaggatgtctttcggactgtgcaacgctcttgcatcttttcaaacgtgcatgatgtctattttctcgaatatgatcgaggacattatggaagtcttcatggatgacttctctatctatggaaggaccttcggtcattgtctgcaaacgctcgacctctgaccaacctgttagccaaagatggtcccattgagttcgatgacgcgtgcctaaaatactttgaaattctcaaaaaggcactcatctctgctccaatcattcaacctcctgattggactctgcccttcgagattatgtgtgatacaagcgatttcactgttggcgcggtcttgggccaaaccaaagacaaaaaacatcatgcaatctgctatgctagcaaaactttaaccagagctcagttgaattatgcaactaccgagaaagagctgctcgcgattgtttttgctatcgataagtttagatcttacttgatgggacgtaagtgataatttacactgatcatgctgctctaaaatacttgctcactaagaaggatgctaaaccacgcctcttaagatggattttgctgctccaagaatttgacttagaaattaaggataaaaagggagtagaaaattctgtagcagatcatttttctaggctgcacatcactgacatgcaggaataactgataaatgatttcttgagagacgacatgctgatgacggtacgtgactccaacccgtggatggaaacatagtgaactacatggtatcaaaatacataccaccgggagaaaatcaaaggaagttgaaatacgatagccgccgtaacatatgggatgagccatacctatatagggtctgctccgttggtttactaagaagatgtgtgccgactgaacagggacttaagattatagaacgatgccatgcctcaccttatggtggccattatggcgcattccgcacccaagccaagatttggcaatgcggtttcttctggccaacgatgtatgaagattcaaaagaattcgtcagaagatgtccaagttgtcagaggcaaggaggaatcactgctcgtgatgcaatgcccctcacatacaacctgcaagtcgagatattcgatgtttggggtattgacctttttctaagtcatgtaactgcgagttgcaagtttattctggtggcagtcgactatgtctccaagtgggttgaggctatgttgtgcagcgctgcggatgcgaagcataccaagaagatgttgatagagatcatcttcccaaggtttggtaccccaaggatggtcataagtgacggaggttcgcacttcattgacaaaaccttttgagacctcctacgagacatgggagtgaagcacaacgtggccacaccttaccatccacagaccagcagtcaagcagaaacgtcaaataaacaaatcacgaatattgtgcaaaagacggtcaacaaaatgggaacaggataaaaggagaaattgccagactcattgtgggcataccggacagcatacaagacacccattggaatttctccctatcagattgtctacgggaagtcatgccaactccctgtagaacttgaggacagagcatattaggccatcaggaactggaatatggactttgaaggagtaggagaatggaggatgatgcaaattgctgaacttgaagaatggagagagaaggcatatcacaacactaagatatacaaagagaggatgaagcgctggcatgataagaggataaaaatcaagaaattcaagcaatgagacaaactgctgatgttcaactcgagggttaagcttttcggccacggaaaattgcgcagtaaatgggaaggaccgttcgacgttatcgacacctcttcgcacggggcaatcacactctgcgacgactcaaataacatatttaaggtaaacagttaacgtttaaaaatttttcatgagcctaatgaatctttagatgaagaagtggatattattgaattaatcgattatgaaccataatgatctcatctaaagcatgcttaatttcctgtaaaattgtcatttctgagcttagaataagtttgcttgagcgtgtgaaaattttggtagccagctgagcccactagggttcggccgaacccctggttccattctccttcaaagtccatattccattctcctgctcccaccagggtagcacccaatcggccccaagtttgaatagcttcctctccgcgctcgtttgagtttgtttagatgcgcattcggaggtagaacttttggatcagcaccataagacccttcttcctcctctcctccatctttgcaactcttctctccatcctagctcaattccttgatttacaccctcaactcaccaatggctggcaaatccctgatgccatacattggctcctcctcaaactccacctacaaccttgaaggagaaacaccggcgaatcaagtcatcccagtggaaaactacacaatggaagggggcattcaccccttgctacggtgcccagctccccagcaaatatggagccggccggcaaactcactggttcggccaaaccaggggttcggtcgaacccgtctcggccccgttcggctccccgttcggcagcacgatccctctcccctcgtcatgtcaccaagaccaaaatccgggggtattagcctgcacgacgaacaacgacgggtgaactcagcctattaaagcgagacgtcttttccaagacgatgacaaggccactccgcctcctgctgagcggtatgtgggcaccctctacaccaaggcaggggatgaggagctccacaactacatcacacccaccgccactccatccacccccaaggaggattggttttgcattcggagagtgcgaactcccggcggtaggtatggtaaaggcttgctccggccgttgacggcatcggagaaggaggggcagcggaatcccgttgccctccacctatgacggtgaagcgtcatttgacgccccctccaattgtaagggcgcttggccaatttcaagaggaagaagtgaagtcgccggaaccctcggtccataagctagcggcacaagtgaagaagctccgcaaggagaacattgagcttagggaccgtaacgcagaactaggggtagagcttgctgagcttaggaataattttgatactcttagtcgcggttcatgcgctagatcaagcgtgcattcgtagagatggggaaggagaataagtatgatgctaattaaatgtctcctttctcatgaataaatgtaattggtgcttggtcatttattttccaatcatgtaagcacttgctataaataatgtgactcattggtgttaaccccaatgtttgccaagatttgtttttgttttgtttaataaagatcaggttttgaataagtgtgggggagatatcctagcttctgacgtgcacatactctgaaatttgctgaatatctaaacacctgaggtacactgaactctgcagggaattgcagaggaattgggtaccaaggtggttgggctgaacccaaccagtgctagtcccaatccctctcaattttcctaggtaagcaggtgagcacgtctattatctgtatatctccaccatggtatagtactagagctgtgaattcagaaattaattagttcaagcataattaaaaagataaaatttccaactaatgaaattcttcctatgattaatcttgtatatttattattcttagctgaacttgtacttgtgaacgaacatccatgtttagggaacgttatgcatcaaagtaattgttatatgtgagatggttaaagatgaaggaagttcttcaactgttgtcattacttatgggaatttgtttttcaaaataaaattttgttttaaagagctcattcctccaattgactttattttatacctaccaaggccatatgcaagtatatcaatgataaactttattatgcatatgactgcttgacattatattgagctttgtcaaatctatgtgactcatgttagatatcttttatactctcatgatcaaggggtcatttccatatatataattaagctaagcttctacactggaagttggcttcccacaaaaattccattaaaatatacacctattttaaactatgttttcttctcctagaaaatccttggaaaaaggaaagaaaatgagaaaaggagggaaaggcatggctataaaaaagagagagaaataaagcttgctctcaaaacattgagcatgatgaaaaaaaaatatgcatatagccatgccacttccacattcatgcaagaaaaaaaaatggaggaggtataggaaaaaaaaggagacacatttctttattccatcattccacaaaatatttcacttttcctttttccaccacatataaagacccttgatctaggagtatgactgataatcttcttgagtccatatatttggctttgcaatatatatgatgcatgtatgtcacacttttacccctaccaagctccatatatcagccttagaataggggtaagtttggcacatttttgccttggtgaggatccacaagaaaaaaaattatttacttgagtgacaagggataaggtcaatatgaggaaaagagttagtttgtgaaaattcataaaaatcccatgagtctgaccggagaagcaagaaggactggagtcgagatcattccatttattaattacccaagatggcaagtaaccactgttaaagttcacaggtgtaggtatggttctgaataatttatatactcgaattatatcttggagaaatttattctacactaacttttactccgggacgagtaaagagctaagtgtagggggttttgttggcagttattcaatgccaattctataccgccaacatctgcataaagtccagacaataaaacatccaacatagagtgataggtgttaaatctcacatatttcacaagtgttggtgtatatttgtatgcaagtgataaactctaaagttgggaggaaaatcatactaaagtgagagaaaatatgtatccatacaaggatggtttttgaacttcatcaaaataccatagaatcaacacaaaactccgagaaatggatagagaagaaccaggagaggagatgggccgaaggccaggccggaagggcccatgtcacgtcctgataaattcatcccgaaataaaaatcattctctaaaaggaataatagaattaattaaaattcgaaaagaaattggttaacactaaaatatgtacaagaaaaattcgaatgtggcccggagaatttttgttaaattctccttggtctaaaatgagccctcaaattttacttgaattttcagagcaccggaaatatttattaagcaacaaaaacaattatcaaagtttattaaaaaaaacggtggttgtactcattcttgctctatctttccccccttcagtaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12090 - DNA, 1074 bp, Oryza sativa
gtgcaaccacccgccgccgccgtttccgctactccggccgccgctagccgccgctagggtcaccgccgcaccgcgccgtcgccgccgtcgggttcgcgaggctaagctccaccccggccgccccttccccgttgagtttcgtcgccgaaattcgcatcccctcgcgctccggtgagttcaacccctaccgccgccttcggccatgaacgccggtcgccgtggttcatctccctccctctaatctctctcttctccttgtttagggcaccccgaatcctgtccgccggtggccgtcgtcctcccgtggctcaccgttgccgttcgccatcgtcttcctccgcgccggccaccctcggtgaggcatcctctcccttctattcccctccctctccctcctagccgtcgctttagcgccgccgcccgttagccgtcgctttagcaccaccgcccgtcggcgccgcctttgcgccgccgtctccgccgcgcgttgccgtcgccggcaacgcgtgtgcgcgcgccgtcgccatggccgtggctgcttggccggtcttgagccgagccgggtcgccaccgcccgtccgatcggccccgagggcgatctgggccgtcggtcccgtggaccggcggtggaccacccgcgtggtcccggtccacggtgaaccgccccttcctccctctcccaagccgctgaccggtgggccccgcttgctggcgccacgccccgccttgatgacgtcagccctgggatttattgcgcaataaatgatttaaggtttttcttttatagtaataaacacagtgaatcttctaaaattcataactaattcatccgagctccgtttaagcccattcaagtctcagtaaatcaagaaaaatgagtagaatccattaaaaatacttttgttccctgtttcagtagtcttatagcctgtttgcattgtttgctttgtatgtagatagattccggttcctccgacgctccggtgtactttgaaatagtcgccgaggttcctccagcagcagagcaaggcaagtcatgcttgttacttgaacatgttgatcctatattgcaaa

SEQ ID NO: 12091 - DNA, 566 bp, Oryza sativa
ctgcagccttgccgcccttcctcctcgccggaatggagctcgcgccgtcgctctctctctccgccgtcgctgccgagctccggtccgccaccgtcgtcgccccggaccacctcccacctcggcgccgcctccttcggcttcgccgcatcctcgccgacctcgtccacccctccgtttcgctcgtcgaccgccggagcgccgccgtcccggtcgacccgagccgcgccgccgccttcctccgctccggccgccttttcgtcatcgccgtcgacctagggtgagctgtggaccgccgcctcgtttccccctttccctcccttctctcggccgctgctccgccgtgcctatggccgccgccggcgaccgtaggggcgcgcgcgcgccgcctcccgccggccgcgccgccgtggccgccttcgggcgcaccgagcggctgccgcgtggggcctggccgtcagccgcccgcgccctcgggtgcggctgatgcgtggggcccacggcgccggccggtgcgagcccgggtgcgcccggtccaccgtggaccgtgaggctgccgcgtgggcccc

SEQ ID NO: 12092 - DNA, 1311 bp, Oryza sativa
aactagtgaaatgataagcatacccaacagcaacctgttatacaccgtaatcatgcatctagcatttgggggctggacatgtttcttttcaaagaaccgtgcataaatattcttgtgcactttttttttcaccttttgaaactccactaataacataatgaatatcaaatcacatctttgaacaagaaagacaggcctcatgtcatgtcaacacataaaatagttagctacttaatactacagtgaaagacagccacctaaatcaacagattagtagttatatggaactgaatgaactgacattcaaaatgttttatcctttgaccaacagcttaaaagtttaagtgctggattttctagatgcgctcaacagtcaccattaagcagcaaaaaagctgcatgcttaataaacatgacttagaggttgggatttgggaaagggtgcaattgcactgatatattataaacaaccatctgacagaattaattgcgaataacagaacattgctagcaatcaatttgtgtaattccaatttgttcaaatctccaacatcttttttttttctttttcagtagcattgcagtataccagagatctagatgacttctcaaggttagatgagacattggtactgctaatttggcaatagcttcataagtctttacctttcaagagttaagacctaattattgtgactaatcctgatgtctgatggcacacatactacaatccagcagagtatgtatcacatgagacaactaagatgggacatcagctgcggcattaaacccaacagaaacccaccactcttcagcatctccaatcgaaccaacccacattatctaaaaatcgaaacaaagaaaaagcacaaaaatagccaaggtaccataccaggatgctcccaagaaccacttccaagaacagtccccccagctcaccgagatccaagatggaggtcacgcaaccgcagatctgccacctccctgcccacagcaagaacatatatcagcggagctcgaccaagcagagagagaacgccacttcaagaaacatgaaagatgagtcaccttcttgagtgagtccggcgactgtggcggcgaacggcggtgacggcgctcggcggtggcagcgaacggcggtgacggcacgcggcggtgacggcgcgcggttgtggcggcggcggcggcagtgcgcggcggcgcaccgcgcacaggcgcgtgcggggagtgtagggtttggaatggagtggggatagtccggtttgttttggaggctaacccatgggctgaatccatggatagtcttcacag

SEQ ID NO: 12093 - DNA, 2277 bp, Oryza sativa
ccccgggcgtgccgggcacttcacccggatgtcccgcttctccaagacgtccgggcggagcttcctgtcgcggcggtgcaggagcgacctgctgtacgtgtccgacccgtgcgagcacgcggtggccggcgcgggcgacgacctgggcgcctaccggggcgtcttccgcgggttcatgcggtcccggacgcgggcctgcctggtggggcgccaggccgcgctggacccgcgcgtgcgctgcccctactgcggcgcgcgcgtctggagcatggtcgccgcggggatggtgccgcgcaccgcgtggcggaggctgggctgcctcgagggccgcctcgagtactacgtctgcgtcagcggtcacctccacggcaactgctggctcgcccgcctcacctccagcgaaggcgagcacgacgccggctccggctccgactccgacgcgtcgacgcaaggcggcggcagcgacgacgatggccatgtagcgctgtgactccggtcagcgcatgggccacctcaccaccgtccaccgccatgtgcgccatggattattttgttctcaatgagtcagtgactcactcagcgttgtgtactagagtagacgagagaggatgggtccgatagttgatcacttgctctgcttgaggcagtagaggctagagccaccattccttccggccattctgcggcacgtggtgttcaggtggctcggttcaggttgctcaatgtcgttgtgaattgtgagttttgatgtggtttgacttcgtttgattcattgaggggcaaaatgttttgtcggcgggcaggcatcctctgttccatctcgaatccgccgtcgcgtgctcatttcaacgagacctcctcgctgtcgaccacgtatcgccgtgcgccgacttgtctgccgcgcggcggaaacgtgcgatcgcgggcgatccacgcgccgtcctcactcctcctgacaggacgacgatggaccgcacggcccggtgatcccgctgtgaccgagacgcccggggtaatagtaatttagtggtacagcaacgtctcacgcattggccgtattcgatacgagtatacgatagggctgtcgctgtgtcccctgctgtggtctgtggaagctgcagcagcgggtgatgcctccctcttgtctccgtgtctctgatagtctgatgggcagctacggccccggttgccttcgcaatgaaacaggggaggttgactagtgcattttcttgaagggcttgtgttcaggaattgggtgctgcacgaacgaattaaagtcgtcgatgaccggccggtaatgtccttttcaaatgcccttttcaaaccgagtgcgacatcctagagttctttcgtcatctgttcaaaaggacctcgctaggtgaaattattggccaagcattcttatcctggtgaccgacctgtattttggaccgtgtggccagaataatatcttcaaatttgaatttgaaattctaaatagacattcatggctggtcctggatccaaactggttactagccggtataattgccagtttttcgatccatggaatggacacaatattgagatttcagacacaatactccatacatgatttacatggacccttggctttatacatcatcgttcccttggggcttcgccacgatatttccaacactgtaacaacacatcttaaactctcaaagttacatattagagattgatgaaataaaaacagcagtgttatatatttaaatatgaaggtagtgcaatagtataatattgcccgtctgattattttattatattagacggtgacgtaaaaggagatgtagatggaaaagaggatatgatctcatagctatagatagattataaaattaatcatcaatagtatttttgtgtgtactgtatatttagatatagcgttcgcgaaatatattgagatataaacttttatataaaaaagaagtaggaaacttgttatagagttgtctataaaattctttccatgtttttacatactgcaattgtttgtatatgcccttagccaatggaactatagctatctataccattgtaattctaatcaccgtgtatgttgggctttgctctaaaaaaaatctattaggactttattgaagggtggaaacaacttttaaaataagaaaaatagtaaaatagaatgtcatgacttggtacgatatttctcaatattttctccatattttgctgcatttcaccccgttttccctccatttgccctatgttttttattcaaaatttccctttttt

SEQ ID NO: 12094 - DNA, 428 bp, Oryza sativa
tactaaagcaatagccatgggaaagctttatggtttgttctgggttatggccttggtattggctacggtggctggtacaaaatccgatgagggttgcagtcgtgatcttcaggacttaattatggagtgtcaaaaatatgttatgaatcctgcaaacccaaagatagaaccctcaaacgcatgctgtagcgtaatccaaaaggcaaacgtcccatgtttatgctccaaggtcactaaagagattgagaagatagtgtgcatggagaaggtcgtgtatgttgctgactattgcaagaagccactacagcctggctccaagtgtggaagttagctttaatacaaactcaacaaaagcattttgtgttgttttatgaattgtcaatgatatttattattttcttctgaattacgtttgcaggctacacgat

SEQ ID NO: 12095 - DNA, 436 bp, Oryza sativa
gggatcccccacatctattagcaacactctagaatcactctctttagttcttgacataataactgatgaacttgttgcgttcatcactgggagtctccataacttagttgagttgtgcctagaagataacccaatgaaagaaccagatttgcacaatgacctgacaaacgttgggctccaagcacttgggttatgccacaacctggcacaatttatctctgacacgtggtaagcagaattgttcgtccaccttcagaagggtaactgactttgggataatgatgcttgctgacggatgcaagcaactgaaaaccattagacttgctgggttttctaaagtgagggatgctgggtatgcagcccttcttcagtcttgcaaggacctgaagaaatttgaggtcagtactggatacttgtcagatttgacatgtcttga

SEQ ID NO: 12096 - DNA, 752 bp, Oryza sativa
gcgcctgctgcgagtcgtatgtatgaagcggtatttcagccgccagcgctaactatgtgtcttacaggagtagttggttgatgtttgctgggcaattagcaaccatcaaacaggtatacagaacaacagatccaagtcagggcagtttcttggggtgtcagttctcaaactggtgtctgcacacaacactccatctggaaaactggaaactaatactagtaagttcaggatacggagtacgttttatctggcaatggctgattttgaacgacggcgcttctggcatggagcccagtgccacagtttgcgagttggagccttggaggcatggagccctgtaagaccaggaacaatcttttggctatacgtgccacagtgcaagttgcttcttgtgtgttttttgtgggtcccactagtaccagctttactatttttttctctctgctctctctcatgtccaattttccccaccgcacagagagtgccgagcgcatcgggcggagcagccaagcgcaacggcgccgaccggaggggcgacggacctggtgctcgccggcacaccaccctcatctccctccccctcccccatgcgaaacaacagcgagtgcttgcgcgcagaagaggtggacaggtcggcggcggaggaatcggcagcgacggcggtgagggcggcgagatacaccacccctctcttctcccaaagcggtggcgaggggcggcgagatccactgcccctcttctcccccgaagcg

SEQ ID NO: 12097 - DNA, 717 bp, Oryza sativa
attaaccaaatcctacacaagtttatgaaattaagcagtgccacgcatgtactgacctttgttggttatgcgctgattttcaccccagaaggtatagccgacagcattagggtgctgttttctgaaagtatccacaaggcctttgctagaaaagtttgtctcaaatgactctctctcttcaattgtgaaacctgcagacttggtttttgcctgaaaaagggttcagaatgaggatctgtgtactgatatatgaaattctgaaacaacctaagcactctgctctcgaatgatgtaatgatagtacagaacaaattggagggagacattgttcaaaaagaaaagagagttactcactggaggattgtgaatgtcaatgctttgacgagcacagttaaggtctcctgcaacaatcactggtttcgacttttccagtatctgcagatcaaaaggtataaatcagcttagattacatagtactatttcagggatcaaatctgttcaataagatattgtggagttgcggatatgaaccatgacacaactccacatggtctattaatgtcaaacagtaaattagattgaaaagttaggcaagtgaacacacttttacatagttgctgaaacacggatcccagttattgaccctgtaattctgaaaatcaaaaatgcaagaaaacaaaattagatcaaagcaattgacataaaatactataaagc

SEQ ID NO: 12098 - DNA, 295 bp, Oryza sativa
aagaaatttgattctcgggatgcaattcaattcgttcaagaacatataatctatcgatttggtattcctcaaactattacagctgatcaggggtcaatcttcgtgtctgacgagtttgttcagtttgccgatagcatgggtatcaaattattgaattcttcaccttattatgcacaagctaatgggcaagccgaggcgtctaataaaagtttgatcaaattgattaagcggaaaatttctgattatcctcggcaatggcatactcggttggccgaagcattgtggtcttatagga

SEQ ID NO: 12099 - DNA, 4675 bp, Oryza sativa
  unsure (1)..(4675): unsure at all n locations
ctgatcaagtttggttttttcttcatgcacaagctgccgattagcttggattgtggcctcaatctctttgcgatcacggcgttcggctagtcttagcttggctttttccagcttggactgatattgctcgagataagcggctggagttagaacatcggccagatcttcgggaatcagagcttgaacttcatgcagtcgtgtcctaattgacccacagtcaactaccaaactgtcaaaagaagaggcttctagccgatgagagatgtcttcaagtgtttttctcacatcatcggataggggagctagggctttgcttgaagtgtcttcttctgcctcatcaaggtaatctctaatgtcaaaagagaagagatcggctagagcctgcagagacaatttcggaaagaataagagctgggtaaattatagctgatctaattgttgagacaaagggaaacttactgggatagcaggagcagttggttgttcttcctcttcgacatgatgactccccacagcggatggagtctgatcacttgacgattgctgtacaggtggagaaggagggggaggctgcgaaatagacaagtgttatatagaatcagttgagattgattaagtaaaagaattaaggacatcttactggtggagccgatttaacaattgttgctgctgtttttttcttcatagcagttttcttcttctgtaaccacaaagtctatgggtaattagccgaagagtgaggtgatttcagaaaaagtcagagagaggtacttactcttgtaaaatgaacggggacagaaggagttggaggcgtttgcttgggtgaagccgatggtgttatttctgtgtcactcatttcggctatagcttggtcaacatcttcaccatttcctcttcatctaaagcttgttcatagatggatccaaggcgggcagatcatcagtcgacgtatcagttggttgtggttgagttttcttgaatttggtctttttctttggagccaaggctaaggtactcagggctgatgatctggttttccttttcttgcctgcatcggctggttctctagttaggccgtgaaggagagttgaagtcttggggcatggtagccgatgaaagggggagatagtccacctccattcggaattagaccagaagcaaattcaatgttcttgccactgttactttgatggggaggggaggactctgttgtctgcaaaacaggagcaagaggttagtcaagtaatgaatcggctaactggttatgcaatttagtaatgacaaagtttacctggggcatgacgtcagggaatatatctgttatatacattgaagccgattngatgaaatagnatgcagncttccatttcaccccaccatttctgtcaaaggttttntgctttctaaatccctgccaanctcaatattatcaatgttgcccagagggggtcctggtaggttaagtagccgatccatcattagagtggaagtgatttgtcctcggcactgaatcttgtcggcaaagaataagccgattgggagttggcccaatccaagttgtctagccgagttcattgggtgataaaactcgtaggagacttggatgtttctcccttggtgaatgccaacagggaggatgcatgggttgattgcagctataagaatttctctggatttttggaatttttcatgattaatgtcttcgaatctaaagtctgacggaagttcaaggtctgctgagtcttcgtacggaaaccagattcgtgcatctttcttaaaacctttgtagaagctgcagaaccagtccttgagtagctcagccgatagcttcgctccagcatcggttggtgtggatgcatattctccatatgacatgcatctgcgatgggtgcgctcttctccgtcatcttccacaatcggctctggcaatgggaattcagcttctgccacatagggccgattgacaaccttcatgactatcaggtttaaccaagtttgcagcagccaccatggtccacctgctccaactattgagccgacggctattttagccaatgcattgttcaacatctagtacagatagccgagaaggattttgcccaaaggaaattctttccttgattctaaggcttcggctacgaattgccagttggttgtagggccacaactggatccacagaagagaaacttttgcagccacatgagcaagaaagctacatgctctcgaggggtaacagacccttggcccatatatgccgccacatagccaaaccagccacctatgcttttagtcttgaagtcgaattggttcttggtgttcatgttcatagggttacccgatgaagttacatctaatccagtaatcatggtgatgtcgattaaagttagagtcatcggctcttggttgaataagaaagcattgatggtgttggaccagaagtaggtggcggcagccatcaagggttcatccttagcagaattggctatggtgagagcgagtgcttggccgattccaatttcatcccagtgaactttcttactagccgatacgcgttagtaccagatagtccagctcttatcagtagtaggtttttctagagatggccaagacttgaaggtattcttccagtgacccaggttagggttggctagtctaaaggggatccggttagtttcaccgatgatgaaatcagtggggtcgagattgccgattgggccaagaaaatagtggtttttgtgtgaaaggctgggaatcgcgactaggttggaaaggtgctgcaaatccaaaggaattgggaagtagaaaacgtgaggtgaaaaggagaaatcgatttcatgcgaggaaaagggatctagctggtgaggacttacctcggcgtactcggccgatggcgcagtagaagggctggtggaagacgacatcgccgcgggtggagatctggtcgagaacgaaatcgcctggggatcgcctgagatgctgaggccacagcctattcttaaaattagtttttgacacgatttatttttaaaacaagttttttaaaagggtcaatttgttaaaattacggaatttttggggaaacctccctgcatgagtgtacaaattaacaaagtcgaagataccgccggccagttgcagacgtgtactcgtccaacagttctgaaacttgacgctctagtcaattcacagtatgccttaagccgagtttagtttcaaactttttcttcaaacttttaactttttcatcacatcaaaattttcctacacacctaaatatctaacttttctgttacatcatttcaattttaaccaaacttctaattttgatgtgaactaaacacaccctcagttacagcagtgaaccagtgtgcctttcacggagttttagcacgcgcctgctctcctccgcgtgcttttctgtgatgttgacacggcaaatctggaaaatgacgtctttatactacctccgtcccaaaataagtgcagttttacactattcatctccaaagtttgatcgttcgtcttatttgaaaattttttatgattactatttttattgttattacatgataaaacatgaatagtattttatgtgtgactaatttttttaaaaattttcataaatttttcaaataagacggacggttaaacgttggacacggattttcacggctgcacttattttgaaacggaggtagcagaagactgtcgatcaaccggtaccgtacgagtattacatcgaattgtcagtattaccataacaatgatgaaaattgtttccggtggctagccgccgagccagcttcactctacaaagactgtgtttagttcacgctaaaattataagcttagttaaaattgaaatggtgtgatggaaaagttagaagtttacgtgtgtagaaaaattttgatacgatgaaaaaaatagaagtttgaaactaaactcagccaaaaacccacaaatcctgagggaaagaagcagccaagccagatcaggccgtcgatgagatgggagtaggaaacgagaaatgcttaccggatgcttgcgttgcgtgcacgccttcctataaagttgagcgtgtcaaatcagtcctgcctcctggaggacagcgctgaggagtactcctactcaacttccgatataggctagggattgggtcattgggactttgggaggcaacctggctttgcttgcaaggttgtgcttccggttccggctgaatttttcgattggttgtccggcccccgttcgccgccgtatgtcgaaaatggcttttctccttcagatgtccgcggcagatacaacagtggtaaagcagtaatgcttccgtcatgtatgatgaacaagaaccagcaggcagtagagtgcacgagtgcggctcgatctggtgatgaggccgcacgtgaaacgagcccaccagcgaaggcatgcgatgtgagccaatgcggtgatgacaggtccccggcagtgtgatgaaacgacgaccagtagagactagagagtcgctggctctgcctcgcggtctgcagaactgtatcgttgggcagcgtgccacgaaaaattgacgaaaagaaatgagccctacagtaatcctgtagtagcggtgtactccctccgtcccacaatataagggattttcagtttttgcttgtaacgtttgaccactcgtctta

SEQ ID NO: 12100 - DNA, 2338 bp, Oryza sativa
cgcgccatccgctcctccgccgccatgcgcgtccgccgccacgctcctccgccgccgcggtcctaagctcaaaatcccttatattatgggacggagggagtacgaagtaggatgccgtcttgttgctgagaaatcgcgagtatatagaattgaagccaccggtggcgggggaagcttcaattctcagcggctgctaacctgccataagcggcggcgcactattggtcgccttgtattacctgcgtcgaattccgtccaccagcgaatcacaccaattctccatccctcctcccatgctgcggcggacacagccaacccaacctcatcttctaccgcggctaagggctggaaaaggctgtgactaggtacggcccatattacttgggccggaacatgtgctatcatagttgggctggaagggattgcgcacggattcgtagctgagccgacggatcgctctcggtcgcagtgacgatggtggccgcctgtcaccgtgttcgccccagaaaggtcctcctcgccggcgacccttccagctgccagatgcgcagcaagtgcatgcatgaattaaagaacaatggcctaaaaatgaaacacgctttaagttctaggagatgctcgtaaaacaagaagatctcgcatcgtctcggttcgcaaggaggaacttggaagttggaggcgacgttctatatactccctccattccaaaatatttaacgccgttgactttttaaaaaatatttaacagttcgtcttattcaaaaaatttaagtaattattaattcttttcttatcatttgatttattgttaagtatacttttacgtatacatatagttttacacatttcacaaaagtttttgaataagacgaacggtcaaacatgtttaaaaaagtcaacggcgttaaacatttaggaaagaagggagtaatagttacttccaagcaagaatctgaatcagagaaacaggtgaatgctggtaattaatcagaaatgcagcggaatcatatacatatcgatgtcaaatatctttgtccaatattgtaatcatactactaacttcctaaaattggtacttaagtaactcatgcacacgatgagtccaaatccatggagcgtcgcccccgccgtcgctgcctgattaagatgatcacgccgagaagtcgacgtggtagaccgcgctcatgtccgggtggaacaggccgaagttctgctccacgccctcgggcttctggttctcgttgaacatggcgaagatgtacgtctccacggccttcccgggccgccgcggcgtgccgcgcccgacgtggcgcaccaggttgttgctgtacgccgccgcgttctccacgctggcgccggccccgccgccgcccgacggccacccggtctccgacaccaccacctccaggccctgcccgcccgccttctccagcgccgcgtacaccgcgtccaggatggcgtcgaacatgttggtgtacgtgacaccgccgtccgtcacggccgccgacgtcgacggcgacagcagcgcgtagtcgagccgcaccgacgacgggtcggcggagtaggcgaagtacgggtacacgttcaccagcaggggcgtcccgctcgacgccaggaaggagacgatcggcgccaccgtcggcagcgcggcctcggagaacgcgccctgcgacggcgggtacgaggagcccagcaccgacgtcgcgacgaccgtcgtgaccggcacgccgagccccgcggcgcgcagcgccgactggaggttcctcatggccgggaggacgctcgccgcctcgtccccagggatgacctcgttgccggcgttgatgtagcggaagcggacggcgccggcgaagggctgcacgtacgactggacccacgacgccgcgaacgaggcgtcggtggcgaggcgtgccaggtcctcgttgagcgtgccgagcacgacgccgaggcccgagccgcggagcgcggcgagcacggtggtgtccgggtggaagaggcggatgtcggtgatgttgctggctctgtacagggcgatgaccttgtccggcgacgggaggttgttgccgatcatgccatagttcacaccgataccttccactcctgcacgatcaatacacacgccatacacgtactggtaaacaagcaaagaaactactcaacctagcttgtactactacattaccatttcatctttccacagattcactagttaattaacggcattttgatgaaagatttcttactaactatcgctgcaaaggtgcatatatgcgcatatgattacattacccttttcatgaaaggaacactcattttgaaattggaaagggcaagctag

SEQ ID NO: 12101 - DNA, 1050 bp, Oryza sativa
gcaccagccattctgatttgtactcagtttgcttacgttttaaatttcgaagaatcaactggtgggctgtaataagccctgttcattgtatacttgctgtacattgcaaaagtttcagcatatatgccgcgtttttgtgacatcttattattaccaaacattacagtcacatctcactgtatctctcgccagaaccccaatcttcaggctccggagggaaatcaattcaccttgttgtcatccttcagtatttttactgtttgtattctgtcttcctacatatatgcacatcagcacacatgcaactttaattagccttcgactaaatttagatgtctcaatcacaggctcacagccccaacagaatatagtaaacaattgtcacaggaagtgatataaatatcccaagaataaccctgcaaggcacaaaaagaaatccaaaatgatcagtcagatgggcacttgcattaatcagaagagaattgaaatacttctgaaccttaacagtatttggttaagaaacaaaccctgtgctcatgatgtctgcgtggaccttgtactcttcagcgtacacaaatgatgtcactgccagggggagagccgcctgcatgcatgtgaaaaattgtggtcagagaaatactcctgtactccaaccaaaataagttggctagatttcttaaattgtgttactactcgtattaattgatcacatcaaacgagggtgccgaaatactcctgtactccaaccaaaataagttggctagatttctgaaattgtgttactactcgtattaattgatcacatcaaactagaaagtactactctacatgaatactactcccttcgtctgctatattttaaaatggaggaagtacagctttgcaactaacttttccttcttggacgtacgtctcctcacttctacaagcgtgaacaatcatctttcactatgccattttccgttatctgcaactgaaatggcggctaggacaatccgtcaagaaaaaataaccctttttcgcgtaggcgtcctcactttgaagcatatt

SEQ ID NO: 12102 - DNA, 1640 bp, Oryza sativa
acattggcacagcgttcgttcgtaagccaggtcgatccggtggtttttcttgtccatggttttggatcatggaaaaagacaggtttttcgtcccagggaggagagaaactggaaaggcataagctggccggccctttctatgtatgtaacgcattacgcagagatggaatcgtagtttttcccgtacgttaatggtggtgacgcactgacgccacttgggatctgcaagcgcaacaaaagcgcgagttgtcttggtgctggagacactagcgcaggcgcggctagctctcgctgtgctagctagctgtactgctgtatgtacacatgatgagctatacgtcgtacagctctacagattaattttttcactggctggattccctttttttgcatacagataatcaatgcgatgcattttgctccgcgcgcgtgcatgttattatggcaaaagtattttctacccctaagtgccatggcatcacctaggtgtatgcatgcaatttaaaaagttatataaaaattttataaaatttgataagatagattatgataatataagacactatacaaacatgcaagtctaaattcgatcaacaacatatgaagaaacaaaaacaacaaattttatctacgctgtatgggtactattcactgtctgattttattatttttgtttctctagttgtaaatcaaatttagtcatacatggttatgtatagacttatatcatcacaatcgatgctactaaatttttttaatttttttctataactatttgagtcacatataattgatggataccacagtacttaggtgtaaaaaatccttgtccggaaggtcacctaaatccttgtccggaaggttaggcacaaatgcgtgcaccgtgcatcgatcgatcatcagtagcaagtgccaggtggtggaaaaaaagtcataggaggacaatctgttcgtccttaggcttttacgtaagagtatttgctttcgtattttcagctcatggtccgatgaatcatacgtttgatccgtagccacatgcacgcgcgtgttgtcgtccgtcgttgagtggtgaatcgcatggtcttcgcgaaaatcacatggaatggaaatgcatgggaacacatctaaaaactagccagcgattttcccatgggctttgctcagttttggttgtaattttgcaggacgatttagctatatgaatgtagtagtacagtgttacgacgatgaacgtacgtgaacgtgtacgcttccgtagctagcggccaagtttgacgaggaggagtcctttactataaccgcaccaaatgtgcgacctcaaaaggtcgcaatgcacgcgtgcatgcaactcgctgtgccatgttagaccaaaaattaattctgaactaaagtttttctgtcacgaccagaattaatcccagtaagagctggaagaagctagtatgacgtttcgctcaattgggtcaattctgttttctctcccttttttgtccaacgagactgtaaaaagtcactacaggagtattctactgcttcctggctgctgcgtcgcttgctgctagtggtgaaaatgcgttggggcgtcacttgctgctagtcgctaggtctgcacttcaaaaaagcacaccaagctagcagcg

SEQ ID NO: 12103 - DNA, 746 bp, Oryza sativa
tctgaccggccttctgtcggcgatctgaccggcctatacacggcggtcagaccggcctaattagaggaaaaccggcagactttcaaactttggcaattttctctattttatttctaggtgttaaatttgggtgtaaacactaacctcactttagtttcaagatgacatgaatcgagcggtcaagtgtaagcaggcaaatccgcaaacatatttataatacaaataagcgggtagtataagtatgtttgttggtctgcctacttgcaccattgagccatgtcacaggctcacagcataagctattatgaatctatgaaacatgagtagattttgttggaaatatagtcattaatcggcatattttaatccaaaaagttaaagcaatgatcatggcataagcagtgtagggtgatcttaacataaccagtagcatactatgcgcatcatgaatgtcaggaacaggaacataccagtaacgcaataacatgctagaggcatcatgtagaacaggaacaagaacatagcgcacatagtatagcgatagcgctaacaatgggaacaagaatagcgctaacaacagtaggcaggaggagaagagtataccccgagaatggccctccgctggatggtgaggcaaaattgcctccgttgttgttgtcgttcacggcacctcctggcgcaccagctccggatccagctcctgtcggcggcgtaccacctccgccagcagtagcggcggcaactcc

SEQ ID NO: 12104 - DNA, 6139 bp, Oryza sativa
cccttggtaaactgatctgccagatttctagccgtttggacatagtccaatgctatcactccggagtttttctgctttctgacagatttcagtcttctcatgatgtgtctagatgacttcatgttgtcctttgaattgttcactttaataatcactgtttaattatcgcagttcattaggatagctggcactggtttttcaaccaccggcaaatccatcaggagttcacgaagccactcggcctcaactgtcgcagtatctagtgctgtaagttctgcttccattgttgacctcgttaagatggtctgcttgcaagacttccaggaaacagcgccacctccaagtgtgaacacttatccacttgtggcttttatctcatcagcattagatatccagtttgagtcactatacccttctagtacttttggatacccggtatagtgaattccatagctcatagtgccctttagatagcgcattactctttccagagcctgccaatgatcatctcccggattttagacaaaccggctcagcttgcttacagcaaatgagatgtcaggtctcgttgcgctagccaagtacatcaatgaaccaatgatttgagagtatctcagttgatcccttactattcttcggtttttccttaatagcacgctgggatcataaggagtaggagctggcttgcagtcactatatccaaagcgacttaaaaccttgtccacatagtgggattgcacaagtgtaatcccaccctcatctcctcgttgtagtttgatgttaagaataacatcagcctctgtcacaccctgaaaattcaaaatttataaattgttgtttaaatggaatttttagaaataaatttaaaagcctagaagagaagatctaatttttaattaataaattccaatataaaaaggggccagataaaatttcattaaatactttgcttaattctataattcctagatttttctgggatttatttgagctaagaaagtatttttaataaatggaattacatttaagaaataatttaaattgaaaaaggttttaaaaaaagtcttttttggctttgggccgaaagtcggcccaaaacccctctctctctcctcggcccagccggcccagtccgcagccgccgcgcgcgcgcccttgctcgctgacaggtggggcccgcttgtcggatccatcgtcttcgtcgcgccgccgccgccgtctccttccaaaattcggtcgatcctttccttctccggccgaatcaatagaggggaaacaatctccgggatctcctctaccttttctcttttggaatcatcctctacttcggtttggaaatcgatggattcgagtttgtttcggattcgttcttcccgaagtttccttcgccgtcgccggccgccgtgggcctttgccgccgctcgctagcccctttaaaaggacccccggtgtctcctctacccgccgccaccctcgccttcgcctctcgtcgccggaagagctctagcgccgtgcaatctagcgccgccgtcgccgccgtcgctccagccgtgcgccgccgccgtctcggtcgtcgtcgtcgctcgggaaggccaccgtcgtgatcgccaagttgtcgccgtccttgtccgctccttcgccgccaccgaagaccgccggagcaccgtcgccgtcgtcgacccgaaggccgccgccgcttcttcctcgtcgccggcgccgtccgttgcccttccgccgtggttttggtcaccggtgagttcgtcgcgccgcgctctacgtcctggtgccctccgttcgcgtcctcgcgccgtcgttcgccggcgggcttgcgccgcccgagccgccgccggtgatgacgtcaccgttgacgtcatcggggccgtctgccgtgagccggtcgtgggccgaccgatctcggccgtccgttttggatagggttgatctcggccgtccgttcgcgtgaaccgccgccgtgtgcccggtccaccgaaaccctagcccgctgacgcaataaatcctcttttccttttcaaaaataattcattattgcgtcataattcaattaaaatcaaaataagtgttttaatccgattaaatcttcaaaaattcataactaattcatcttagctccgatttagttggttcaagtctctaaatttttctaaaattgagatctacatgttaaaaatatccacatgtactgttcatgcttgtttatgtgctgttttggtgattttgctcttttctgcttagattccgtcgtttccggagagtccgttttcgcaggagaagagtttgaagagttccaaggccagcaaggcaagtcacacagatcccaaacaaccctttgagcatgttgatcctatttaaagctattgtttccattcaactattgcatttattttcgaatgtcactgggtggaattaacctattgtttgttatagcccttttgttcttgattaccttattccttgataccttgggttattataatttgactagttgagctttatttatattggttcaactagatattagatataattgcttagccctgcttagaaacattagctcactattgggataacttatgactcactatgatttaatgagggcttaatgatagttcacgatggtcaatcgtgattggttaattaattaatgtgccaactaaaaccggataatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaaggtgcgctgcggtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtttcacacctctcaccatagtaaatgatgctataattggtaataaattgattagctcctggtttggaatggtacattcctggtttggagatagaactgtgcagccgggatggttgttcagaatggttgggcctatacaacagggtatgttgtatagcgttggattaatattgtttaattacttaactgtttttttaaattctcaaatgtttgctaaatgctgtttatgcaaatggaaccatattatgccatcctttgttatcctgtgcacttgcatatttactgcgtggcttgctgagtatgtcatatactcaccttgcaatcattcatcagaagaagagttctacaatgaggctgatggtgtggaggattaggtgtagccttggtcaagctgcctgtggagtggagccgtctgtgccgtttattttattttccgctgcttagatttttattgattgagaggaactatctcctctgtaaagacattttattcgcttattaattagagtaataattgtactctattatcaatttgttattgtgtgtctcggctgattcctggacgagggttcacacacatgtaagcgtttggaattttggatagaaattccgggcgtgacagcctctcccaaatccttcatttcaaaactcttggacagatagtctttgacctcctcaatcacattaaggctggtcccaaagatcagtatgtcatcgacatataagcacaagatcaccccttctcccccaccatagcgatagtatacacatttgtcagcttcgatcacaacaaagcctgcagatgtaagcgtggtgtcaaacttttcatgccattgcttaggtgcttgcttgaggccatacaaggatttcaatagtttacacaccattccctcctgaccttctagtacatacccgtccggttgatccatatagatcttctcctccagctctccgtttaggaaagctgtcttaacgtccatctgatggacgagaagaccatgagaggctgccagagcaagtagtactcgaatcgtggtcaagcgagcaactggtgagtatgtgtcgaagaagtcctcgccttccttttgggtataacccttggccacaagccttgccttgtacttttcgattgtaccatcaggcctaagctttttcttgaaaacccatttgcatcctacgggcttgcacccatatggacgctcaacgacttcccaagtaccattagacataatcgagtccatttcactgcgtactgcttccttccagtagtcagcgtcaggagatgaatatgcctcttctatggttcttggggtgtcatctacgaggtatacaatgtagtcatctccaaaggattttgcaaccctttgtctcttactcttgcgagcatctacaatgttgtcctcctcaggattttcctcaggcgtttgatcattgtgttctatcggtgcaaagtgctcatggggcatgacagtttctttactagaagtgctaggtgtatatttcataggaaattcattctcaaagaatgtagcatctctggactcaaaaattgtaccagcatgcatgtcgggtactccagagtttactattaagaatctataacccacactgtggatagcataaccaagaaacacacaatcaacagtttttggtccaagtttccgccttttggctataggtacatttaccttggccaaacagccccatgttcgtaggtatgagagatttaacttcttcctttcccattcctcgaatggtgttacttccttatgcttcattggaattttattcaggatatgacacgcagtcaaaactgcctcaccccacaattccttggaaagccccgcagtgtctaacatggcattcaccatctcagttagagtacggttctttctttcggccaccccatttgataggggtgaatagggaggcgtcatctcatgaataattccaaactcttggcaaaaggatgcaaactcattggaaaaatactccccacctctatcagacctcaacagtttgattttcctttgaagttggttttctacctcagctttatagattttaaagtaatgcaatgtctcatcctttgttttcaatagatacacatagcaaaatctagtgcaatcatctatcagtgtcatgaaatatttctttccccctttagtcaacacgccgttcatttcgcacaaatcggaatgaacaagttctagaggtgccaaattcctcgcctcagacgccttgtgaggcttgcgaggttgtttcgattgaacataagtatggcacttggaacctttgaccaaagtgaattttggaattaaactcatgttagctaagcgcgtcatacacccgaaattcacatgacagagtcgcgaatgccacacattagactcatcattctcgctaatatggttcacagcattatgattattatacatgtcattcaaagaaaagcggaacaagcctccgctgtcataaccttttccaacaaaagtcccatatttagaaacgacacatttattggactcaaacacaagtctaaaaccttctctacacaatagagagcagctaactagattcttctttattgaagggacatgctgcacgttcttcagctgcacggtctttcccgaagtaaacttcagatcgaccgtaccaacaccatgaacagccgcaagcgacccgtttcccatcaacaaggaggaacctctcccgacctgataagaagaaaacagagaaatgtcagcacatacatgaatattagcaccagtatccacccaccaatcaggtgaatgaaaaacagagagaactgtaggtaatattttaccgtaccccgatgttcctctgccctcgctaatgaccatgttggtagacttcctgtctttgcgctcaggacagtccttggcccaatgcccagacttgccacacacaaagcaatctccctttgcctttcccttgcctttcttcttaaaattggttgcagccttgggtttgacatcaggcttgactttctt

SEQ ID NO: 12105 - DNA, 2470 bp, Oryza sativa
gccggcgtcagaaactccgaacttggcctcaagtgcatcccacatgtccttcccagaaggcatgtgcatgtacacgtccactatgttgtcagcgagtacactgatcaatgctccacggaacaggcaatccgaagcctcgaacttagcctcttcctcaggagaaagaggtggttcacttcgtttgccccgtgaaacatagaagcactgcatcgctgtcaaccacaatagtgcacgtgctttccatctcttatagtttgaaccatcaaaagcatgtggtttcagtgcagcagcaaagccaactaccgaaaatgacctatcaggtttttggattgttggaaatatagtcattaatcggcatattttaatccaaaaagttaaagcaatgatcatggcataagcagtgtagggtgatcttaacataaccagtagcatactatgcgcatcatgaatgtcaggaacaggaacataccagtaacgcgataacatgctagaggcatcatgtagaacaggaacaagaacatagcgcacatagtatagcgatagcgctaacaatgggaacaggaatagcgctaacaacagtagcaggaggagaagagtataccccgagaatggccctccgctggatggtgaggcagaattgactccgttgttgttgtcgttcacggcacctcctggcgcaccagctccagatccagctcctgtcggcggcgtaccacctccgccagcagtagcggcggcaactccagacatggcgatgagcagtcgtgcgggaggcactccccaaaaacctgatcacccgcctacccggtgcagatctcaggcgaaggtgtggtttcagaggcactgctccttccaatctctcatgcgcgcaagagatcagaagcgaggaagcgagagcaactcaggcgcggagaagaagaaactaacaccgggaaataagctaagaaaacggatcggactcgcaccgggaaagaagctaagaaaacggatcggactcgcggcctccttatctatcaggagaaagaacgtggacgagctgttgcggagggaatcgtgggaacgtgggttagtgcctgcaaaaggatagcgacgtgacgcgcgccgcgacctcgcccacggcccggcgcgcgcgcgcgcgcgtggcattccgacccctacctcaactggtcaacagggagcctccaataactccctatttaggttgagatatttctcgcttaaatcctgaggtggtattattatcctcaacaattattatgggcctttgagatttaatattataagttgggcctagcccaattattctaacagatttctgaatacatagatactaaacaaaatatatgtaagacggcgacttcaggcaaattaatggcactaggtggatccggccagttatatgggcccgtcgtcgggagtatatatactctttatcattttggaacttgggaggataagtggataactgttgcctgtcaggaagataacgggtcaatgaactacggatttgctgaaaaagtgtcgccacattatgtgactgagtacagtcgaattttaacggctgggatacgctgcgctggacatcgtgtgcacgatgcacatccgtttctccacctgtttatccctttgcaatttttttattttatttgttgatccggaattgctatgggtttgtagcagtcaattttgttgttgtaattatgtatttatacaaatttactgtaattaatatgtaattttgggatttatatatgtaattttaggacaatttaataaaaaatatggcattataaatatagctagtaccatgaactatgcatagcagaagaagtagcacattctgttaccttgaatgttacgacacaggcacagagccaacgccaacgcgccgtcggctaccttaacccttcaccagctaatttgtacggacgaggaaatcgcatgggccttgaaaagaaagtacccgcaagaagaagtgcaaacctcgtgacctcgtgttgggcctgacttcaggataagaaatgtggcggttcaaattagccggcttccaacaacattcagttttgaaattactactaatttttattcttgttaaggcattcacaatgggtctccgtggcattcagcctcatcaccacccaaaaacgagtattccttgccacatcatcaatctatgcagcctccttaggaccgcgtagccaactttggctacgggttcctcgtcgcttgtgggaccacactctcactccgtgccgtcaaggatgggaaagaagagagaaaggggatagggggaggcgccgtcgtctgctgctctgctcggcgtcgccatcgttcgcgtctttcacccgccgccccagcgtggagccctgcccgacgccgctgtcgtggtcgccgccccgccaccgcggtcgctacctcgctgtcctcaccgccgcttcgggggaggagaaaggggggggggggggggagt

SEQ ID NO: 12106 - DNA, 2906 bp, Oryza sativa
aacttgcggcacggcagaaacgacacgcgggaagtggacagcgtgttgcctgcgtgggcggtgttgtcccgtcccacaaggctgacatgtcgccatctcccgatccaccaccacgggcgcacgcgcggtcgcgcgggggccgcgaagcgatgcgccggatgcgtaggtgagctgagtcggccagtgcaccctccccctcctcctagtttccccaaaccatcccccgaccggcgaacagctcgccgtccgccccccgtgcctcccgccgcgcgaattcacttccccctacgccgggggctgttcctgttgctattatagcccccaatggcggcggaggctcgggccgagagccccgccgcgcccgtcgtcgtacccgccgcggcctcccccgagaagcgcgtgctctcgggtgacgccgggagggaggaggagcggcccgagccgaagcggcgcagagcgtgcgtcgcggcgctcgacagcgtcccctgcgccgcgccgccgctggttgacggggacggctcgtccttctccttccagcacgcgcgcggcggcttcgtggtgctcgagacgacccccaagttcgggtccttcaacccgcccgccgcggctgccgtcggcccgaagcctgcgccgcctgccggtgccgggcagggctcgccggaggaggaagggggaccggctcgcgaggaggctgaggccaaagacgggaattcgcagttagtggggccgggcgttcaggggcagaagacatgagtgctgactttgttttgacttttgaccagccatgcaaagtttgcttggagcggtagccaactcgtagtttacgtctactttttttttttttgtgtaaattggtcccatttttctcttggtgtcgatgcagttgtgcatcaccattgttgctcatttctgttgcagtcatgggttgttacatttgttatggaatggaaattttcttcaaaaatgctgatgtaacatgtgtaccaaatgagcttctcccgtcggctgcggccatcactcctaacaaacacttcttttgtaaaatccaaacctggtgctttctactcacaggaagtgcaaacagtttttgcagggaggatgtattctgtcatatcaagtgtgtcacttggtatgcccgtaacaagtttctacgacgcatgctgcaaatacacacagtaaacgatcttacctacacttcaaaatcaatgattgatactcctagtcccgttaacaaatttcaaggtggaatggttcttttcctagtggaagtaccattttaaagctaatcacagtgagtgcacacctgtatgttgtatcctgtataaccgcaaaatgagatctaatatagaatccactccctcagtcagaaactgatgctacctccggaggtaaatcttcctcgctagtgattttcgatgagattggttctctgtaccactcgttctcattacgagtgaggaagcaggcctctgcaccaaaaaaaacatggaacgttaaagatgacagccatgatagctactctctctctctctcttgtgtctatttatattttagaactctgggagtgtttggctaatgggatagggaaatgatttcccacccaccaaaatgcatctttaaatcctaaccattcattctccccgttccatttaatccaaacatttcattcatttcccaattccaatcccactcctcatttcccattatctaaacacaccctctagttttgccatatattcagcaattgtaaaaccttgtcacagtactgaaatgaaaacatgaatatagtgatggggaacttaacaaacctgacacaaaagtatccttgtagtcatcatcatcatacacaaatgcaggcggatctggtgaaccaatcccaacaattgtgcttccactgcgtggtacatatacaatattatatcacgtaatttatgattgaacaatgttccataaaacatagatatacttgatatatgcaatatataacctccaccttaaatatgcttacgatgctaaattggtagaatgattaattaaacatcattttttgacttttggcattttcgatataactggtgattacacaaccaaaatttcataactaaagctctaaaataatataatgactaattaaacatcattttttgacttttaacattttagatatcaatgaaaattacacaaccaaaatttcataactgaagctctccagagacactttgaaaatggctacactatgaatgctatgtttgggaatatgattgctttcaaaattgaaaaggaaaaagaataaataaattcatgaactagcttaagcgattgaaaaatgtggcccccttaccttcctgacataaaaacagcatcataatctccccggttagcagcaattatacgtttcttcaacctctttagtgatggcaacacctcaaatgctggaggttctggaaaagatggcaagcacacgtaccatatttcactgaatgttatttttcaggggatgcttactggatgtaattttaaaaacattattgaatataacataagttctggtacgggactagcatacgacaattgctgataccaaattgcatacctagatcattaacacaggcatcctgtgatatcccattttcagtaatttccttgagcaataccaagggatcagtttgacttgtgtgctctaacctgagccgctgcagtgcaagtattttagtaaatgattcatttcaaaattcatgctatgaaaatatgttaccttgtaaacttcagctgttgagcatgcttcaggtggctttactagtaccatcggcaaatttgctggcaatggattccgaatatcttcaacaatcttcatacatttaagtccagagttggagattatgatcagacatttttggagcaaggca

SEQ ID NO: 12107 - DNA, 1069 bp, Oryza sativa
agcgaacgtggaggcttcgttttctattcctttaataagttaatagattagttaaacttttgactaagaaaaaaaatcaaataatttataatatgaaacgaagggagtagttgcgatccagccaaaattttaacggggccgggcgtgcaggcccagtacctgacaagcgacccgggctacctgggctgcaaggcctcggcgtgccagaagcgccgcgcgtccggcacctgcaaggtccggacctgcgccgccacgctggcgttccacgtcatcaacttccgcaccgacgtcgagttcgtcctcttctccggcggcttcgcgacgccgtgcgtcctcaagcgctccggtgcgctcccgttcgccaaccccgccaagccgctccacggccacctctccagcgtcgactccaaggccacctcggtgagcacatctactatcatccaaagcttttccaccttgcttttctgcagctgcaaatggagtaatttgttgcatttctgtatgatgaatcagatgaggcttacgtgggtgagcggagacgcgaggccgcagcaggttcagtacgggacgggcaagactgctacctctgtcgccacgacattcactcataaggacatgtgcagtgagtagtaattaatcatgtgttcatcactgggaaaatgcaatgtaaaagaggataattcaatatcatgtttattatctcaaatggaatgaaaattccaatgtgcaggcatcgccgtgctgccgagtcctgcgaaggacttcgggtggcatgatccgggttacatccattcggcactcatgaccggtctccagccatctcagtcctacaattaccgttacggaaggtacaggttccccccttcttttttcacttttttgctgtaaaaattagcagttgtcacttgtcagtaacatcctcaatacgggcttgccgctgatgtgcagtgattccgtgggttggagtaacacaaccgaattcagaaccccaccagctgcaggttcaggcgagctgtccttcgtgatctttggtgatatggggaaggctccactggacccatcagtggaa

SEQ ID NO: 12108 - DNA, 615 bp, Oryza sativa
caactacgagagaacgtgtgcggtataccagggcaattgcaaaggcatgccaaagaatgtcgcaaaaggagttgatacctacgataacagcaactacgccgcacctgttcatgccgttgttggagcaggggggttcaacttggatggcttccctaagattggtgtaagagtcatatctacacctttgtgtatgttgttctcctaggcaattatagacatcgtttcaaactacatagtatggtggtaacaaattgatatactcctaattgataagaacgcattaacgcctgaaaactcacatactgttaaagtgacaagcttgtctttctgttaaattgttcagctgcatagctggagcttatcaaggatttcagagtttggatatgccagggtacatgcgacgaaaactgatatgttggttcaggtcagtccacatatatatattctacctcggtttctgttaacacgctttttaaattactgaacggtgggttttgtgtaaaaactttatatatataagttcctttaaaatataaaataaatttattttttaagtttgcaacaattaaacttaattaattatgtactgatggttttcttgtttttcttacttta

SEQ ID NO: 12109 - DNA, 744 bp, Oryza sativa
tgcttaaaggtcccggttttatgtgttttcagctcgcagagaaggaaaagcactataggtgtcagttttactgttccggcacctatagtatctatagtatctatctctacgtgcttttttaagtagtgtatgcatcgacagtagccatcttgccatctcacctatcaaacattagttgtccagagtctagacgctagatgttatttttttcactactctcatccaaaacatgcaaatacgtattcagtactctaaatgagttcaaatgaagaaaaaaattatcaactaaaaaaatgtagatctcgtcaaactatataattttcatataaggtttgtctccattcataatctttacatattataaaagtttaagatgtttttgccagatgtttcgtgcgtcatctgacttcgattcctgctcggcttgcgcactatcgcccactcgtgcgcatcagaatcgggtccgtgttagtgtccgacttctcccctatacctgcgcatgttcacatcctctctcacgagttgttcgcacgcaccagccggaaaaaaagagcggagcatcgatatgtcagcaaatcgatccgactctaatccaaaccgatacgtcacacaaataataaaatcagcatgagagatatatatagacttatgctgtgttcggcagcccctcttcctaacccatctcccttattttctacacgcacgcttttcaaactgctaaacggtgtttttttttaaaagttt

SEQ ID NO: 12110 - DNA, 2066 bp, Oryza sativa
gatgtgaaaacagaaggtggcttggaattggtaggtgaacttcatcatccatagtcacaaaatgtgccaagaaaactctcctcctatggtttaactgtgcaagttggagaaaagtgccaaaagcacttcaacaactcaagaactaggtgaccttgttccataaaagcttaccgatttagcaaaatcttatgtgagcaagaacaaaactaaagcaaattcatgtaacccctagattattgattagtgatttaatagtcaaaagatcatgtaagtaccaaattcccatgatggccagaagcatgaacatatggacaactatcaccactaaatagcaaaacctcacaagatcgcaattaggacaaaacttcctgcataagtgtttggtgtccaaatgggagaaataacatcagtatatgagagcaggttattcaagaaagtgaacacaagagagttgaaaagtacccaaactcctgaactacgaagcgcatcaagaactcatattgacgaggggaaggctagaattgatggattgtcctcgcaagagaagaagccttctttgccttttccctacacttttcagtccatctcctctccaccaatcttttcttaatgtttgcttgccttctctattattttattttggatatctcagaggtaaggcaactataaaaatagagggaggaaagcattggaaagtgatgttattggaggagtagagaggatagaaagggagagaatcctagttctttgtgactattcatggcatttctttctacacagtgatttaatgttgagattcttttgctattcatttcaaccagcagcatttggcaaggtgggattcagctagtattctagcaacttgacagaattattatcttagaatatgatcccttttgaagcacgcgactattaatgggaatatttcattggacaagaatacagcaggtccaatgacaatttggaagccatgtgcattttcttttcctcctctaattccttgctatcaactgctaacaaggacttaaagaatttgccaatcaattcgttgttaattgaagattttacactgaaggtctcactaacatctgagaagggatacatgcaagtgaggcatgggctagaattctaaaatggcaacaaatgaagtggcaaattctcaaattgactattgattggttatgtgaactatgttagctaattttagttcacatttatacactagacttttatgaatctcgtgatcctaatggctctcctgtgttacttacagagttatagcccgcatggttccatgtaataatataacaaaatacagctaaaatgaaagtgacatgtgacaataacagccagtgggagtgcggcatgctggcacagtaatgcccacggcccaagaacccaaacatagattatatgcagtttggattaggatagagcaataattgaccactttattgtatgtcgtcaacagaagaagtgctgttgaattatcgacatttcacatcatgcggcattagcattagccaaagcgctaggaacacatgagattacttgtaggttctgatattattcctcaacaacatgcaagcaatcacaattcacaatagatgtaacaatatcgaatatataaaaagaatacccatttttttcccaactagtatccaagaaaagctaccaacttctgaatgggacaattgctatgcttctgccaagtgcttttttgtaaaggcgatttcactcgaatttcttactgtgctataggctcgatttcgtcgtgtgttcttctccgtctccgatgacttcttcctccaccgcgaggcttgtcgatccaggcgagcggtgcaccaccggcgcatcgcgcgtcctcatccagcgaagccggcttgccagcgcagccaacgaacaccacacaaccgaagcttgccccctactccggaacgcccccacttgctccaccatagccttttagcctctcttgtttttcgcctttggtagcctttgtttcgcgcctgtcgccattgatcttcgctgccgccaacggaggcgccttaggcagcgagcgaggg

SEQ ID NO: 12111 - DNA, 1063 bp, Oryza sativa
cgggagacgtgcgagctgctgaagcaggtgcgcgagccgggctcccggggatcctacctcaaggactcggagaagcaggagatgtaccggctgcacaaggaggaccccgagacgtacaccgtggagcgcctcgccaaggacttccgcgtcatgcggcagcgggtgcacgccatcctgtggctcaaggagatggaggaagaggaggagaggaagctgggcaaatcgctcgacgactccgtcgaggtcctcctcgacagttgcccagagtacgtgaggagtttgtttacttcctaactttgtgttggtaatactaattagatcaggttctgattggatggattcttttgaaggtgagggacaactggaatagttaaaatcataggtttaacctgcaaaagaacattttgatagtaaaccgatggcaattagaaacagaaagaggaccatttcatctataataacttgaaaagtctgctgaattattaaattattcctgaatagtattgcacatttcactggatcatatcttctgttgttaatactttagctaagattaagttagagcggtgtgatctaggatgaagcgactggtttctaatgcaagtgacagttggaagctctacgacatgtgttttgtgcttacatatgtacacaaaggaatgtgatgatgtctgaaatcttagaggggatgaggatgccaagaggtccagaacccagtatgaagtgatgattttgtttgtcttaatgttatttgttagaaatagaattactattggcatcaaatccttctgttaatcttagttgccttcaggggtgaatccagaacaaaaatgacccgctgtcccatgcatagcactaaatctctacaatactcaaaataaaagagcaccttgtatttaacggcaatcaatattacaaccctatggtttcgcttatgcttatgcatatccggacagctttttattaatcaaaaaaatattttttgggtaaaacttttatatacgattcaaaagcaaatgttgtaaaataaattaggataaaaaaccacaaaattaactccaaa

SEQ ID NO: 12112 - DNA, 1677 bp, Oryza sativa
tttattgatcaagtattccaaggtttgaataaaaggttggatttggcctatagtctcaattttgttcttttcatggtttaaaacatgaaattaattaataaatactttactattctcaaataattggcatagttgattatggttatctcactttaactataaattacgtttgaaatgttatattatgatgaattaaagttgtttggttatatttataatgccacatacatcaataatataatatatttttgagtgttaataaaatgtctgaaaaaaatacaaacaatcagttaaaactcgaatcatgcgcgtacaaattactccgtatttaggccctgtttagttcccaagtttttttttccaaaattccaactttccatcacatcaaacatttcatacacacacaacttttctatcgcatcgtaccaattttaaccaaattttcaaacttcagtgtaaactaaacacagctttaggataggaagggggagtaccaagttctaccctccgtgcaatctcaagtcgagtgttttcccgatttattaatttccaaatccaaaagaagaaaaacaaagttcatctcacaatatagattcacttttaaaactgcaatatgatcccccatatgatccagctctaagtctctaaccaaatgggcatgatggctgtgcaaattaattttaaggcatattcgccgaggggattaaaaaacaatcccccctctcattacattactaattaggaaatatacttcccccatcaatcaatcaatcaatgcttaaatattgaagtcaatcaaaaccatcgttatccaaaggaaaaccttaaacaaaatctaaaacgccagatcgaactgataggatattactactacagtactcccccgtcacataatataagcgattttgagtttttgtttgcgctatttgaccacttgtcttattaaaaaaatttgtgcaaatataaaaaacgaaaaattatacttaaaatactttagataataaaataagtaaaaaaataaataataattttaaaattttttaaataatatgagtggtcaaatagtacagataaaaacttaaaatctcttatattatgagacggagggagtgctgtactccgataaaagcgggtagaaaaagcacatggtgaaattcctgcgtgcggtcgtgcacagactccgtctcggagactctcccgctgactgacacctcaaaaccggccgtcccacgaggtctcctctctttttctcctctttaatcccctccccggggtctcctctctctccggctgcgaaaccaacgacggcaccccaaaccgcctccgcctccgccgccgcttccgcttaacctcctcgctctccttgacccccccgcctttcaatcgggcgcggccgttcggggttcgcgtttttatcggatcgcctcgttcgttccctcccctcccctccccttcgcgcggttctttgccgcgccgcgggggttccgttccgtcgtggagcggctggccccggagccggaggccaaggggcgtggacggtggagggtaatccgtggtgttgagggagccttggtgaggtggtggttcgggctctcgcggcggcgtcttccatgggggagaggcggtccggctacagggacagagggggccgctagcaaggaaggtattggaggccac

SEQ ID NO: 12113 - DNA, 2110 bp, Oryza sativa
  unsure (1)..(2110): unsure at all n locations
attgtcccgtgatgcgtcagagtttaaaaaatgtgacgaaatttgatgtgcgatcaccccatattctgcactcatttatgagagaactgcatttaatgttaaagacacaggtcagctagcagacaatcccaatttagttctaaatatgcaacccaggttatcctaaccatgaatcggctcacattattttgctaggatttaagaaaaaaaatattttattgtttcctcctgtcactctttccggtcatattctcattatgtttccttgtcagtgtttttacatcgtagtactgtgctgctatcactctaggaacaaggatattattttctgccgctcacaagtcataatatattaatacttattatgtaagaatggtgtgtatgtgattttcaggaaatggaaatttctcagttccattgtgggaaaagaaattttgcactgatgcttgtgcaatcccatggggtaaactctgtgaaaccaagaaattgatgtcattgtacaaaaatgtggttgactgggatgattcagctgcattagaaactttcaacgatgcaaaagctcgtttctgtgctgtataccatggccaaccttgtgatatcccgttacctgacccaaacatgtatattgacatggttaaccaagatgaacatgttgatcctgaattggtggccgaccttgagaaatcgcggcgttcttatcccaaaagggataatacagctcctgatggctgggactcctttatatttacaaacaagccagttccagccacagggtggggtgatggggaaacaagcaacacacctggtcagcaataccctacgaactggaataatcacgtgaaacagccgactgaagcaaattgcatgcaaagttcagtaaattgggataattatgtcagccagcctcctcaagcaacagttcagcaaagctcgggaaattgggacatgtatgttaaacaacaagatcaagctaataatgggaggcaccaaccatgcctggcacntgggacatgaagggtgactctctggatgcatggaagcgtgattcggcctggggttctgcagctatagattcatgggacaaccatagagagaactgttatgtacctgacagccagggctggtcttacggtcactggaaaaggcgaaacaatgagtcgagcagaaggaatagcaggggtagagatagagttggtcccattagctcaaaggccatgaaaccaaagtaccattctgaggagcgtaatggtgctaataatggctggaggcactgccgagttagaaataacatgcagtactcctatgagaatcctggttgcaaccagtcactagcaatgtgaggaagtgcattggacagaaaatgaggacccgtgtaggttatgtttccttttttcttgaagtttttgtagatagtacgaaccaccacaaacctagagtgacgattttgtctagccatttgcatgcccgttgtacatatctatatctatgtatatgtttttgagctcagtcatttttgtttactggctgtattgcagcttcattgttgcaaagtgggaattaattaagatggtgtctgttcaactatttcttgtgtggtggttttggccggttttgaattgttaggggtatatattgttcctatgttgtattgttgtgtcaaagtttccatcatgctataaacggtcctcgaatgaattctgaaatgaagcacttatgttctgaaccagaagtgcattcggttggcgttaaaatttctgaaagttaaccttaaaaaaattattctaaaacaaacatgcgaggcccactctaatcggtcgttcaaccatgcataccacacttgcattgaacagtttatgagaaacagataattctcttttagaaaaaaaaaaagaatgtcccataccactaggtgaagagcgccggcacacctctgccaagattgtgtatcagaataagcttactgtgcatgtttttttgcggggcaatgaacttaggttcagtttagtatcaaaacagcggaatccacactagtggaatcatatttcatgataaaatgcctatgaaagtttgcgcccagagacagcaaacaaatgcatcgcgttatatacag

SEQ ID NO: 12114 - DNA, 231 bp, Oryza sativa
aaaacatgcttaagcctacagcggtggtacaatggtgaacagagagtcctcgacgatttttggcatcgagaatccacacctgcaaaacacacaagtgcatgtccattaaaaaagagggatttcaatgcgttttttttgtgactgcaggggagaactaaaatagaacaatttcggacagagatagtacggttcagtacgtacacgtgagagatgttgctaagtgtagttggt

SEQ ID NO: 12115 - DNA, 5825 bp, Oryza sativa
tgtgttctgaccatctagaggttgtgcgaatttcgcagttgccactactcattgcagcatatgatttattgattctgcctatctagcaagtgcgtgctgctttaatctccacgaaaaagtttattccgaaacttctccgttaaagagagctcctcgaataaactaatcttggagcactcggttattaactgacgaatcgtttcatacctactgatcgtgcaatgctagatgcattggatgtacacacattgttaaacttacgaggaaacctaattatgtgttggaatcgacgtgttccccacacaagatttccccgtatttccattttttgcaagttgtttcgtacggcattgttaccagccgcctgccgccgttttgctagaataaaagaagctgtgtcggccactcgtgcgccactatatatggctgctagcgagctgaatgatgcgtgtagttcggcgtcgccactagcctctactcgcacattaatcaatcgctgcatgcattagctgaaaactatgatcttggccatccatacttggatccaatggcctagattcactgtcacaaggcaccttatacattgatttgccacagtaaaatatatgctaaggtgcttagtggatcgagcccctgatttctcgttgtgatagatgatgctagtgcaactgctgaggtagcaaatgcatcaggtcctgtacgaccagtggacgccgagatgacctggattgtccagcaatgttaatgtctgccatttttattttaatttgaagctagacttgcttaattactctgtttggaggaacatgaagtctacataagatcacatggttcacaccgtgaatgatcttaagtttccttctttgtgtatgcggtacataattcggtcccaaacaacatgagcgaacaaattttctggttggttgtttcattgttcttgccaacaatgttgaaaacaccgacacgtacaatagcctacaaacagcactgtttgactgctaaagagagagactagcatatatgcaatgaaaaaaatatgagagactatacaacacctctctgctatagcttgctggtcaacataggacgtattttgactttgccgtgtaaggttgaggggaaagacctgaccaatattttgatttgacgacgcaggaaaaaaattgactgcaattcacaattttttgggttcaatgatatttaggcacgctctggtttatttcagatgagaattatgcccccaaaagggtatcttgcccactgaacgaattcacctcgagttgtagtcatctgctggatccatacctagatttggaacctccggtcgtacgtgttagacttggaatagcatctagtcgacaatttaaagagtcgcctcgcacgtgtgtggtcttgttgaactaattaacccattgaatatatatgaaaccatgaaaatcctgaacttgcttgtgtccagtttctcattgccaaaagaatgcccagacggcaattagagatcaggcccaacaagggcaggaaggttttctctagcaggccaagtccaacagataattagacttgaactagtacatttctatgggccttttcagttttgaggctccaaggaaacgaacaagctagggatttttaaattttttttaaacattttatttttttctttaaaaataaacattttcaaaacttatttataattctgaaacttttgactacgccagccggttggtgtgataaaacaacactatcacgccgatgacgtggcatgttatttggccacgtcaaaatagctatggtaattgttctgccttgccacatcatcttgaatagcgtgtgatgtgacagtgttgttttgccatgttaggcggacgaacaaccaaaaagttcagattttaaaaataagttttgaaataatcatttttaaaaataaaaaggttaaaaaataataaaatttccaagctagcaggctactgaaaagttgattcaacctttagaaatgtcagtatgtcactgattcaacctttagtcaattacagtacttcctgtgcctgatcacattggagagaagtgtcactgttgtagctcggcttcacttctcttcctatggaccaagattgcaaacctgctcgagacggcagcctggaaaagggccttcccagatgcacacgcaagggtcacacacgcaaaagcactgaaagtctctccgtctttcgcccaactgtcagctcctcttaatttcgccgcccggtaccgtttaccggcgagcacagcggccaagtccacgaaagcaatgcaagcagcaccagctttcggttattgcggccgaacggggcagaggaattcgccgtgagctcgccaaactggcacgtactactacggtacatggttagaacccaacctggaggataagaccagatctcaatcggacagagcaaatgagcaatggagaaaacgtttctctttccctcaaaaaaaaaaaagcttctcacagttcctggctgcacggagatgtgaaacatcctcttgcagtgtcggtgccaacacgaaccaatccgttcaactgctggaggctgcaactgtcaggtagatcaacggaaacagggacaaacataacgcacagtacagtaaccatggtgccgagtgatttgatgagtgaacgtgtcgcacgttcgacgtagtcttgatctgctgcccagtttatagaggtcttgatccggactttcggagcacatgataggcaaaagaatcagattcagcttcatgttctagtaacatgcggagcacatcatagaaaggtactgtattgatatgcctttgttgtgctctggtaaagatccttacattgaaccactctgaaaaaactaaaaatttcaggttccctcaaggaatgagaaaaaaaatagaaaaacaatttctactgctttagtaatgatagtagcagtgtgagagaagtggttccttcagtactgatgtggcagtgtttagttccttcaaacttccaaaaattccatcacatcaaatatttggatgcatgcatgaacattaactgtggatgaaaaaaaaccaattgcacaatttgcattaaagttgcgaggcgaatcttttaagcctaattacgccatgatttgacaatgtggtgcttcagtaaacatttgctaattacagactaattaggcttaataaattggaaaaagtacgaattacacccacgaactatcgcggtcgtctgaattaccccccttaaccacaaaaccgaacatttttcacccctaactatgcaaaccggacgaattacccccctcggcccaattacacgtggcagtccagtcagcgcttttttaattaaaaaattgtgggacccgcacgtcatacacttcttaccctctctctctactctctctctcttctctctcgcacagcgcgcacggcgagagcgcggggactggcggtcggcgacagcggctcgcggcggcggtggcgcggagatgaggcgagcgcgacggcggccgagcaggtcgaggagtaccaccacaccgagcaggaggaccaccaccatgccgcgtaggatgacatgagcagtgatggcgacgagctccagggcaaacgcggcggcgtgctcttcatcccgcccttgggcccggtcgatgtggcggtccgtgaggtgaggcgagcgcggcggcgcggacgtcggcgcggaggcagaggcggcggaggagcggacggcgcggacgtcggcgcggaggcggaggcggcagaggcagcggaggagcgtggcggcggaggagcgtggcggcggaggcgcatggcggcggaggagcggatggcgcgggcgtcggcgcggaggcggaggcggcggaggagcgtgatggcggatgagcggacggcacgaacgtcggcgcggaggcggtggcggtggaggagtggacggcatggaagcggagtgtagcgcccgttccgtcgtggcgcctagcgggaaaattatctcttaaaaaccctaattgcgaaatttgtttctttgcttgttgtctagtgtccgtgccatctcaagatctcaatccccgatctatcgtcgagttcaattccgaatccaaatccttccaatcaaattcctccgcaaaagtctattttgcctcccccgaggtcgatgggccgaatctcgctcggtccatcttcccctcttccccggccccctctctccccgggcgcgctctctctctctctctctctctcgcgctctcccatctctccccccgctcggcctcgcccgtacgctgctcgcgcgggcgagagccgccccgagcgcctctctccccgctcccccgctcagcctcgcccgcacgccgcgtgcgcgtgcgcgtaagccgccgcgccgagcgccccctccctttcccctcgctctgccgcgcctgcagccgcgcagccgctcgtcctcgcgagccagcgtgtgcgcgcccgcgcggacgccgcccgttgcttcccgcgcgcgcgtgccgtggtggccgaccgcccggtcgccgccgccgtcagcctctgcacgcgcctgtcgccagtgtcgccgctccgctccaaaccgccccgccgtcatcgccgtcgtcatcgcccggcccccgcccctccgcgcgcaagccgccaagggacggagccgcgcccctcctccctctgccgcgatgctcccgttcccctccccctctttttctcgaatcggcaaaggggcaagcccctttctccccctccttttcccctttttcctcctcgccggcgtcatcctcctgccgccgctttggctgcaagcgccgagcgccagctcgcgccttaaccgtccaatgtcggttcccctctcccaaaccgatattgccgtccatttaagcccaagccctccccctccaaactccctcattttcgcctccgcgccattgccgccctctgtttcgccgtcgccgatcgtcgttgcgcgtgtcggaggagccggcacgagcaaggacgcggaagaggactccggccgcgccctctccttcctcttccccggcccgaggccggagagattactcccgcgccgtcggcctctcgtcacagcgccccgacccgcacggtagtgcctctctccgttcttcctcctcgctccatctcccccccttagttttcggtggtagcacgagtagcctccccgtagctagccggcgccgccccgaccgttgccgtcgctcgccgtgtgctcgccgccgtcgccgcccgagctcagtagcacccgctcgtcgccggcctcgctcggcgtagttccgtccaatccgacgctagcgtcgagttctcgacgccgcgtagatgctctcaccgccgggaatcgacctctcgtgacctcgtcgccgtttccctcttctcccgccgccggttgccgctgccgcaatccgccgccgtcgagcaacctccggcgaatccgagccgttggctcgtctccccttgtcacgtgcaaccgcccggtgtgcacgcttttgcccgtatcaccgtggttcgctccgccgctcgccgccgccgcccgccgtccattcgtggccgggtcgtcgtctacctcccgccggcccgcgtggcagccacgtaggcgccacgtcggcgccagctcagcctagaccggattgagccgaccccggtcagtccctccccgtgcgcgcgttccaccgcgagccgcgaggctgcgcgtgggcccgccgcacctgcgtccaccgggaccgcgcgcatgcaccgcgtcccttccccgcccgcgcgcgtgcgtcgcgtgctccctccgcacggtgagccgagccgctgacaagcgggtcccacccgggaccgcgcgt

SEQ ID NO: 12116 - DNA, 1878 bp, Oryza sativa
  unsure (1)..(1878): unsure at all n locations
ctatattccctccctcccttcttttctttttcttttccataaaggatttaaataaatcctttttcctttagaccaaaaatccaataatcttagaaattcaatatcttcccaaccgtaaatccgattgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctccggatctcgagcaaggcaagccacctttgaacatcttgagcctatatttgaaatttaattatattgcttgcgaaatattatgcattgataggatcacacttaatctgttgtcccgtctgcaaggcagattggcagacctacctaatttgttacatttgatccttcctttgttaattgttataccatgtccccttgtaaccacccaattgcgcctcgatattcgtgcactctgtgcgagtatcgacggtcgccttcaaacttaaaatctgagtaacaacttgggtaaaactggagttttacaaaggacttggaaaacccgacacctgggtcggtgcttgcgaactaaatgaatttccaaaaccgcggaccggggaacgtaccgggtgtacggtttcccgctctcgcacttaaggactgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtctgactactgcttgtgaaattgctgttgtgaaactgggttcgatgtttgaaaaatcagcagctgacgggatcagctaggcccgggtggccgtttgaaaagttgttggcccgggtggccgtttgaaaagctgttggccgggtgccaaccctgtttcaagatctaaagactgatacattgcacatactccgaccggacgagacgcactgtctcatccgtgtcgtttgagaagcactcacttagactttttagaaaagagttcaaacaaaatcaattacgaaaacaatagcctttccttgaagccttcattaaacacttatttcccctggcttgctgagtactcccgtactcacccttgctctatataaataatccccccccagttgctgaagaagatgaagtggatcctgctgacgaggagttcttccanggagcaagtcggcatacgatgagctttagggtttcggcctagttcccaagtcgcgcctgtgatgattggtccaagtcctggcttccgctttccttttgtaatgcagttgtgagctcgggatctgtccgcagcccaatatgactgtacttctactctataataaagagacctctgttgctgtgatactctgtctccctgtgataccagcactgtttcctgggactggtatcgattaacaggttaatttggagcgtcacgggctagatccggtcgggactagttcggggcgtgacacggaggcgcgtggcggcagaggagtggacgg

SEQ ID NO: 12117 - DNA, 1699 bp, Oryza sativa
tcgcctcacttccgcgccaccgccgccgcgagccgctgtcgccgaccgccgtccccgcgctctccccgtgcgcgctgcgcaagagaggagagagagagagagagtagagagagagagtaagaagtgtatgacatgcgggtcgctgactggactgccacgtgtacgccacgtagatcgaaaccaccgtggattgggtcgagggggataattcgtccggtttgcatagttgggggtgaagaatgtccggtttcgtggttcaggggggtaattcagacgaccgtgatagttcaggggtgtaattcgtactttttcctaataaattcgcctcgcggtttacaggcggaatctgtaatttgttttgttattagtctatgtttaatacttcaaatgtgtgtccgtatacttaggccgagcttagttccaaatttttttttcaaacttccaacttttccatcacatcaaaactttcctacttcatccgttccacgatgcaagtcattctagcatttcccacatttatattgatgttaatgaatctagatagatattcattaacatcaatataaatgtgggaaatgctagaataacttacattgtgaaacgaagggagtacacacaaactaccagcttttccatcacatcgttccaatttcaatcaaaagcctggtttagttcctaaccttttcttcaaacttccaacttttccatcacatcaaaactttcctacacacacaaacttctaatttttccgtcacatcgttccaatttcaatcaaactttcaattttagcgtgaactaacacacccaaactttcaatcttctcgtgaactaaacacacccttcagaaaaaaaaaattggacaagcaactaaacacagcctatatttaggtgcagatgcttcttatacaacctgattcttgttgacttgtgtgtgaatccaatgaatgggacaaggtgtgggagcaccaaaccggggtccagctccacggaaagcaaccttataccaacttatagatgtaatccaatggacggagatgtacttcagtagtgagtgcttggcacaagtgcaacggatatcccgtccaatatcccaagacaattaagagccacaatagattaaggtcatagcaactgaaatgcaattgatccattggccaatcttataaaactgattaactccatgttccgtactagataaaatgtaaagtattccatgatacatactcagctaacagtactccacaatgtagacaattttcatatactgtcaaagtaactacaagtggcaaaaattgactcatattttcatatgcccgacacaaagatcgtacttttcctgtatttatttgccttcctaccacaaattaagacaagaaatgaacagattttgcatcaaactagtagaggatcacacattgatgaattcattagaaccaaccaaattgcgtgtgctgttggaccagatcccacgctttaggcctggttgtcgctcttgcgttcgccgtgcgagtcacgctcctgcagcagcgagccggcctcctcgtcggcctgtgcggccttcttctgcgcctccttcgccttgagcgcctgaagcttgacgtggttgtagtagcctacaccgaggaatgcgatcccgtagccgaacaggttgatcggcgtgaccgtgtcccggatcacagaccaggagaaggcgatgagc

SEQ ID NO: 12118 - DNA, 374 bp, Oryza sativa
  unsure (1)..(374): unsure at all n locations
nnnnnnnnnnnnnnnnnnnnnnnnnnnnnnnnnnnnnnnnnnnnnnnnnnnnnnnnnnnnnnnnnnnnnnctctcatgtccaattttccccaccgcacagagagtgccgagcgcatcgggcggagcagccaagcgcaacggcgccgaccggaggggcgacggacctggtgctcgccggcacaccaccctcatctccctccccctcccccatgcgaaacaacagcgagtgcttgcgcgcagaagaggtggacaggtcggcggcggaggaatcggcagcgacggcggtgagggcggcgagatacaccacccctctcttctcccaaagcggtggcgaggggcggcgagatccactgcccctcttctcccccgaagcg

SEQ ID NO: 12119 - DNA, 811 bp, Oryza sativa
tatatatgtgttttaaattacttttatcgtatatgtaaactacttttctatttgactaaaatactttttagacatttatgaaagaaaattcgataatacctaaaagtaaattatataaataattaaagtaacttagcacaaaatataagtaagttgtcacgacattataagtaaatccgttttaggggtgaaaacatgagtccacctagaaactaaattaaatcagcacaaattatggaactgactaaacacggtaataaaagtaaacagatcaaaacattatgaatgtataagaagtaatttaatcaaatctaaaacatatatatatatatatatatatatatataggacactcatatggggcaccatggtgcccgggcaccatgatatcaaatacacaaaatcactcaaatttttcaaaattttcaaattgtgagtatatacctagttataataactcgattcatacctatacctatcaacaaaacaactcaaatttaactttatttcacaatccatgattacatacctaactaattatatgcatggatgctatatacctagaatcaaaatctaacaaaaacaagttcaaattcagttcaaacttgctttgaactagttagtaaagtagctaatgttaatatctaagtaattgaaaaagtttcatactcatttgaattaggtatatactcaatttcaacaatggtgcccgggcaccatggagcaccaaacaaatttactatatatatatacatatatatatatatatatatatatatatatatatatatatatatatatatatatatac

SEQ ID NO: 12120 - DNA, 980 bp, Oryza sativa
aaaaaaatggcatgtacatacatctctgtctcattataacagctacctgaaaagatatattagtattagtatctggcgaaaatagttctagcaagagaaaccaacatcaggaataaagttcagctcgtcttgacgcttgcagtattctgcagaacgtaaaccacattttggcatactgactattggcctcttctaatactatcatacagtacagcacatatcacacttcataataaatcataagtacccaacacttacagtcagtaacatctgcattggtagactaattttagacttttactcgtatcatagccaccattttattcgagcaggctataacaacggaaagctattacccacaaggtcgcaacatcaagcaaccggagctagcatggagaacttatgaggaacttgatagtttcattcagtcaatgaggcagaattcacaaagcttggaatgacatccactgaattcaccattttgggaatatcaagctcgtgcgaaataatgccagttccatcaatcccgcaatccacaattgttggtctagagctctcttcccggactgctacctcagtgctagtgttaaagcacggagaatggtctgtacaagtaacagaaccaaaactgcactgcttctgaaaggggaaagtaccaatctctgcatcaatcttgcctcggatatcaaacaaaagggctcttaacctcaccacctcagcctcgagtgatatatgcccctgcaatctcctcaagagctgctgatttgtggtgcgaagtttcttgacttcctcctccaagaaagctgcatgcgctttcttcttctctcggtacttgcgcactgcttctctatttcccagaggcttacgggtctttctcagctcctcttcaacattgttttcaccagaagccatgacttgaatgtgtgtgtggaggcatgtgtgagtatgcatagcaactgatggacccggtggattgcaag

SEQ ID NO: 12121 - DNA, 676 bp, Oryza sativa
cgagatggggaagggccagttgtacatcttggggtcgaggatgtacttgttgtagacgatgaccgtgaaggagaggaagatccacaccgccacgtacatgtacgacaccagcaccttccggatcaccgaatccgacatgcccccctcgccgccagcgccgccgccgccctccttccccacggccatcctcctccccgccgcccgccgctcggtctctccggctccggcgagacggtggatctgggcggggtggcgagctgtcccgcgtcggcgcgctcgcgagatggagtgtgagatctgggagggagcaggggaggaggaggaggcggatctggctgggaaggaggagaggtaggtggaggaggaagaggagggggtttcctctccaaatcaatcggcggtgcggtgcggtgcgagtagcggaggagtgggggatggatggggggagatggccacgtggagaatagcctctgcctgcatcttggggcgcccccttttataggccggatttgattttgtttttacggccttttctttctcccgtctcgggctccggcgctgtcgattctgttgttaagggccagttattctgcgctgtacgacagcacgagtagtcttggcgtggcaggccgcattgtgaatcggttttctttctccttgtgtaacgtgcagatct

SEQ ID NO: 12122 - DNA, 884 bp, Oryza sativa
gccgaggaaaaacgatatccttgatagaagctgattaccaagatggtggcccttgttaggcaggctaattgaaaaatggagctctggcttcctggagacctggacggagtacttttctcaggacaaggaaatgctagctgaaggcctgcctgaagctgcactacagacttttccttacgatcactgtatttcccgttcgattttcgagtaacctaactgtttgagttgtacgtcagtacgtgttacggtaccgcaagcgactttctggtttgtaacatttctatgcatgaacctacttatgctaggatttcaattgtcaaccgagtatcgcggcttcatcttacgcggtagagcctgttgcatccataccatataggagtacagttggttgcattctctttttgtcaggcacacatgatcacatcagagtaccatatatttctttccagaatatagtactcatgttgaatcagtatattctgttttcagtcactttattgatcaaaatttagattttagatgcttatattccttttccaagcacctaattagctgaaaatatatggatttatgtgcattggaattagtacaaagtttaaatatatccttaagatgcttataccattttggagtgttgggactagtattttgatatcttccgttgagaaaagtacagatctgtctggtgtatgaaataatgcctcgccttcgagtccacaattctgatggggacatcagactactagcacaagatgggccgctcttaagtgctaaggtatggcgtgtagtgaagtagatcagctaaaaaatggttggccatccgattctagcatgggcattagcagaacagcaggccaggaaagcatgtcagggatgcaggaatt

SEQ ID NO: 12123 - DNA, 719 bp, Oryza sativa
tgaagaaccttggactgtacttgtacacaagaaacgcacaacctgcctggattccttataatcctaaggtcatgaggtctccatctcttagcaaggatacgaaggctctaaagattctgtcatggaatgtgaatggattaaaagctttacttaaatcgaggggcttctctattcatcagttagctcagagggaggacttcgatatactatgcctacaagagacaaaaatgcaggcaagatatgattttagtttttcttatgcaaaattaccatctaaaattggacaaaaggttctttcttggggaaatggtatcttttcttctctctgaattgttttcatccttcactgctatagtttattaaccaggaattacgttattttgagcaggagaaggatgtagaagtcattaaggaaggtctacttgaaggctatacccatagtttctggacatgcagtgtatcaaagcttggctattcggggactgcaataatttcaagggtgtgcactgctattctcacatcctaccacaatgatcattgcaaaatggctacaacctctaatgcatcatatctcatgtttgttggtttgcttcgttttgtgccttatatcttgtttttatctataatgtgttgtgttctgcaaattcctttaggtgaaaccactctctatcaagtacgggcttggtgtgccagaccatgatactgaagggagggtcgtc

SEQ ID NO: 12124 - DNA, 869 bp, Oryza sativa
tcgatcagttttattttaaaagaataaaaatctgggattaaatctcgagttcaacaaaacctaggggtataaattgcgggacatattggcacatttaactttttgtcactttatgtggcaattaattatttaccacatgctgtctatgacatgtggacccttatgtgtctatgacacgtgggtttagtggcaaatcttttatcaccactcgtaaacagtggtggacccaggatttgaacccagggtaagcctagcaaaaaaaatcctaatgcaatacaatacgattcgacataaaatgtggtaaacgatacgatatataactctaaatggttcaatacaagtaaaaaataataaataagtttgaatcttatacctaaataaaaatgtaaattgttcaaatataacataaggtctttaaataaataggatattacagtactagtcaagactcaagagcttttgctttacgcttcttcatggtcatgaaagagtgaattatgtcttcctcacttgcattggagaagatatcacgctaaataaaggtgaccaaacaattattcaataacttatcactcatattatttctcactttagtctttactaaatttattgcagaaaataccctttccacacttaccgtcgccaccggtaagatcaacaccaatttaagaagcaaatacaccaaatcataaagatcatgcctcttcgtatcaacaagtttaattgagagctcaccaatgttgtttaggcatttgaatctatcatcctctctcatataatcaatatatgtatcaagttggagctcaagtttcatcaaatcggagccttcaatgtccttaaggataaaaagcttgcaagtctaagtcttt

SEQ ID NO: 12125 - DNA, 723 bp, Oryza sativa
acacagagagagattaccgagtggtttgcatacaatccaaagaccatgaggcctccaccacttagccatgataccaagtgcatgaagattttatcctggaatattaacgggcttcatgatgttgtaacgacaaaggggttttctgcacgtgacttggctcagagagagaattttgatgtgttatgtcttcaagagacacatttggaggcaagtcttggtgtttctgccataagactcttaatttatactgtacctctttggtgttatgtcatggggcagtgttattccgaacaactgtcacctattatgatgtgtttatggtcttacataatgaatttatgattaatatacatcgtgtactgtgttttcattatgttttcaggaaaaggatgttgaaaagtttaagaatctgatagcagactatgacagctattggtcatgcagcgtctcgaggcttggctattcagggactgcagtaatttcacgggtatggtatttatgtggttatgttcaagataagttactgtgcatactaattctagatagataaaatattttgatgaaaattagatcatagcatgacttatgttgtgcttccattgcctttacaggttaaaccaatttctgtccaatacgggattggcatacgtgaacatgatcatgagggcagggttattactctggagtttgatggtttttacttggtaaatgcctatgttccaa

SEQ ID NO: 12126 - DNA, 582 bp, Oryza sativa
ggggttcagttgaaccccaaacacttgttaggaatcatcaacctgttactattattaaggttaaggctaatttctagaacagaagatagggttaacgcaaattcgagaaaaaaagtgcgtgggtagagagagagagatgggaaagaggatgtaccgatgcggcggaagcagcaggatgagcgacggcgaccctcgctcgctcgcgcgatggatggggatcggagcaggcggcggtggcggaggatgtgctcaccaggatgcggcggaagcggcaggacgagcgacgaagccgtactcgctcgcgcgatgaatggggatcggagcaggcagcggtggcggaggatgtgctcaccaggatgcggcggaagcggcaggacgagcgacgaagccgcaatcgctcgcgggatgggagaaaattgacattttgccattgtcaaaacggggtttcgctcgaatgccactcccaaaagtggtttcgttaaaataccatcctcaaacaggggcaacatgttgtaatgccattttatccatttcttctcaatttaatgatttttgtagtgttttttttgctgagatgactaa

SEQ ID NO: 12127 - DNA, 724 bp, Oryza sativa
ttcttgcaattccttcatatacatgaaagtatgattgggtctgctctataatagagtccactttactttcaacattagaaccatggggagacaccttctcataaaagaaatccaaatagtctcttttccttcttggatctaacacagtggtaatgacaagtgccaaattgaagttgtttgccaatttttcatcccaatattttgcaaacttggtgtgcataggagcagccaatcgttttaaaagatcgctggtttgccaatcaggatcactcaaagcatgacggatacaaagaacatggggcaagaatgtgtgtgcagttggtgtcctatgagctgatacacctctagtagcctcttcaaaagccttaagaaattcacaaattgattcagcatgcaaccattcttcatcagttggtagaagttcacaattttcagaggcatagctattgaggatagccttgtaaggcaatatttctctaatcatcttgaaggtcgagttccaacgggttggtacatcaagagtgaaaccagattttggaggaagacttttactagaagcaattgaataaacgcttgaatgcgtgagggtgaatgctcaatgtactttaggatctcacggatcttatctattgctgcacgaatcaccctcatcccatcttgaaccacaaattgaggatgtgtgcacaacaccttacatgaaaatgttgccttccaaaacaactca

SEQ ID NO: 12128 - DNA, 1494 bp, Oryza sativa
cccggcaagctcgccacgtatacgcgtactgcccagattcccccaatccagtccccccaccaaacccaagcccggaaaccctctcccgcccgacacgtgctccccccgccaacccgtggtgcacgcttccgagcggatatttccgcccccgcctcggctgcacgtgtcggtctcctcgcccggcacctggcgcaccgtgaaaagcccagaatccggcacaaaaccgcggataaaaaaatttgtcgccgcagcagcacgcgcgggcggggccggcacgacgggggaggagacggatgcgcgacgcgcgtcgcccccgaaccgcccgactcgcgcgcggcgagcgacacgcggccggctgcgcgggcgccgtcccgaggcgggtgggggcgcgcgggcgcgggcgtttttttccctctccgggattcggcactgacacgtgtgtacctccgccgagtcggtctccccgcccatgaaaatggcctgtttcccggctcgtctaccgtctccccgctcttggggcgcctcacgagtcaagccggcagcacagcacgcccagctgctgtcgattaggaaaggtggcgatggagttaagtaatgtgacgtctgacagcggaggctcgtgtaaacaatgcgtgcgatgcttgattgatgcgtgggacgacatggacacccagaaatagagaagcaaatgcgtgtagaaatggcaactgccgggtcgtgtgacccggattttgtcaggtcgtgacgaacagtacccagattgggtatggattaggtggtatgattgagatgccacactgccttactagtgctgatgagatacatccttacgtttaatgaaagagctaatacttgattttgttgaagcaaggagattagagacgggggatatttggacgcagaaaaagttgctgctcgatgggttatgactttagctttggtcgtatctacgatccatctagcccgaggatggatatagggatcttgaagctcgagtggtccatttgtcaagcgcgcgaccgtgacacggctgcctgggcggtccgccctgccgcgacaccacgcctttcggggagcacgagaagcccccgccacggctgtatatataccgcccctcctggcgtctccgcctccgccgcgttgcgagctgcacattccgctgcttgcttggcctacgtgcgtgcgaaccgacccaagtacccaaccccaagatacctgtgcgcgcggcgctgtggcgtgacgctcgcgagggtgtgaagcgatgagcggaggcacgcggaacacgcgccagttcttcgaatcgtcgagcagcggcggcggcggcagaactagcattgacgaagggaggggcgtccgggatggtggtggcggtcgcgttgcggcggcgcggggcagcggcgtgaacacggggatcctggacgagcacgtgctgtccctggtgttccggtcgatcaactgggacccgcaggcggtgtgcacggcggcgtgcgtgag

SEQ ID NO: 12129 - DNA, 715 bp, Oryza sativa
cagcaattctctaccaatcaacagctttccaaatagagtgaaactcaacatccatacctattttttagcagctccggtgagtactctcgcgtgtgagcatactcctggtcgctcagcatgtagtaggtttgtctctcccgatcactgacaagttcgaggtcggtgtcgtttaggagtcgcctcagagcttcggcatcttccatcgagacatctgctgatgaacgagtactagactcgtcatgatgacttgatgaagagccggaccccttgaacagacgagacagtcgcctcctcattctgcacaatggaacaagaacggactaactcggcgggggttaattaggaatgacaagaatttcacccgccggttagtttcacccaagcaacttgtatatatgcaactaagtatttgaatttgagggaaaccatcaaagcttgattgaacttgagagcaaactttggagagggaatgaaaatgtgtttaaacagggtggagttccctctcccggccggttggcttaagaagtgcacccacaacgatcaaaactgacctgtggggcccactaaccattgcctcaaaaagagaggcagccgaccgttggcctggccagtcactggttcggccgaacccctggtgggcccaaccggccccacttttggccgttggattccaacggtcagtgtggtcgtggcacagcaaatttacattgaaaat

SEQ ID NO: 12130 - DNA, 729 bp, Oryza sativa
tatgctataatgcgggtggttcttcctaagggaaatgctatcaataaggattaaaagaagttctgagttccgtctgaaatgaaagaagggtgctcgatgggccagctgacgacacaacgatgatgaactccatttaggaagccagaggactaggcagcctaatatgccagggatagtatgttcaattacactgcaaacatgtataaattggaaataacatccaaggataaaatttggggtcatggcccacatgccaatgagacatcaacacaggtgttatttaccaactcttgtgatctttatggtgttattaggaaattattattgaagttcggctggctccttcgccagcccaggaaaaaaatattaggtaaataaataatcatatgaaaaatatttcagttattttttatggtatgataaagctcttgacattgagtaagtacatacctttgttggtcttccgggcattatgcctataaccccagtaactatatccaacaacattgggatgctgttttcgaaatgtatcaacaaaacctttggacaaaaaattagtctcgaatgattccctttcttcaattgtaaagcctgcacttctacgatttccctggataagagcattaactataagctaacaagtataaaaggaacgtttggggaagcaactggataccccaaaactagacatttatgttctcggatgttagtatagctacttttacctct

SEQ ID NO: 12131 - DNA, 5382 bp, Oryza sativa
gctagctagcagctcgtatcgtatgcattcatccatgactggaaagatggagtgatttaacaagaagatggcagcgaaatagatacacgatctgctagccctatagttcggcaagaatgaagcctggttgttgaagaaagtcgcacgtgagaagtttgccgtcggaggcgagccgatttggctctccctcgtgagccagttttttctcgcccctgcaggctagctcgccctcaaaagttaggattttttcacgattccaaacacctggtcttgcctggctaggctaggcttgatctagccttggatccaaacgcaccctaagtaatttacaccatttctttccttacccagagaatccatcagggctgataccaaatctttcttgttgccttttacaggaattcccatcatcctttaaattcacaagaactaaattagagaggcaatcaattatcatcgactgaaaataaacgaaggatgtgggtatgtggtaaatctaaacctcgtgatttccctgagctccttcactgtcatggattggagtcgatcggggtcattcctaagttgctctatctccaatttgctttcagcaacatcctcctatagtcaaagcaaataagtgatccaaccataaacaagttacagtggataatgccacctgtttagtacaaagggcataaaaaggctaaccttttcaaggacatgttcatcatctttcttgatatcagtattcttagaggcagctcgacgcgaataggtggctcgtgtttctgccatcatcaagcttagtcttatcagtgctagtttgctgggactgaaatttgcgcttggaagcccacagccacacctacagtcacagaaacaagtttcaagtgattcttgtgccaaggactccaaatgcagaacaaaagcacagaatttcctcaatgcaaagtggcagaaacgccacagcgtttgacagcgccctgacctatccgtactgctaatatgagcaaacaagagttaactgtgagcgattcctaaggggattctttttttttttaaaaaaatgatgcatccccacaaatgcaatgaactcaggcctagtacgtagcacatttatgcgacaccgtctagaagaaatttgggaactcggatttcgattcgtcaccaaaggtaaaccctaggagcacgacacccgtatccagaactgctgcgcatcgaaccggcacgggaagaacaaatgcgcgtaagagcggggagagcaggagaagggaggggggacgggaaccgtacccgtagagacggaagagggagccgccgcgcaggagcagcggcatgggcgggcgagctagggcgcgaggcgccgcgacgtggccgcgctaaagaagggaaggggagcgtggcgatgcgcgccgtggcggccgggccgtgccgccggtgagcccccgcggagtctctcggtgctatccgaaatggcccatcttggtgttaatcggttatccggcccggcccatgttggacgagaaagcggtttctctgctggccgtccgatggtaatcgtgtggatcgtactagctcgagattattcacacggaatgttttctttgatctgcgcgtagtgcagatagacaaccaggaaaaggctattcaattcaatggagtttgtaacaggcgactggccgcacgaggtatgtaaacagtgtatcctgatgtgttccatgggtgcttctctcacctgttgttttcaggcaaactaacatcttgttatattttggaagtgtttttatttggcagtagtagtcaagtagagccctgcctttaaagaaaagaaaaggaaggagtaaagcaccatgttttcgtctctcggtgtcatactgttagccaaggacgatgactgtcgcctacttgcctttaatgaacgatgaatgaaaggtgtggtttacagaaaagtatgttatactcgttctcaactgccatcggtgttatacaacatcaacaatttgcagcacaggctagccccgaaagatcgaggactcgtcaaatcaaccgtttgccaaaatttaaattttacaatttattttgtgtgtagttaatttcaaaatatttccaatcagtattttctttttcaaaattaacttttaagtcgctaattacatatataaaaaatatctataaattactttttatcattaataaaccatttggacttgtaacaagctcataactgaaagatcgatgagaccccgagtttccaacaatttgcaacgttgaaaaaaacaacgacgacgacgaatatttggaacttcaacattgatcccaagaagaaaatagatagctagtagtactatttaacacgatttacaatttgaagtagccacgtcatgtctgacgatcggaaggagaagaagggcgtgcgttacaggaggaagtgttgcaagtatctgagcccatcgtcgatgctcacgtacctacactgcgccatcacaccgaacctcaccttctccaacagcctctcctcgctggacacttcgaacaccacctccgcctccaccgtcgcgccgccgcagccaggcgccgggagacaccccgtggcccaggtctcccccgtcgcgccaccgaacagcgcgcgcgccctcgccgccggggccttcgcgtccatcatctcgaccgccaagggggcaaacccgatcagccccgcccgcaaagccgtccaccggacgctccagaactccccccgcccgaccgccgcgttccggccggtcaggtcgacctcgaactggaaacggccggtcttggcgatggcgtcgcgggcggcgacgacgaacgagagggtgttctcgccgctggccgcgaagatgtcgatggcgaaggtgacatcgtcgagggcgaggcgcggtggcgggagcgcgcggcggcgggcggaggcggaccggaacagcgcgaacaggcggcggtacggcgacgagctccggccgctggcgtcgtcgccattgccctgcatgggaaggaggccgagagcggatgggtactgggagcgcaagagcttggaccagaggtcctcggcggtgaaggcctcgcggcaggcggtggagacgcaggaggccgccgcgagcgactcggcgtcgaggaagggacccaccagccggagcaccaaccacggaggttcagatcccagcattggcgccgtcggccgcgcgggctccgcgctcacgccaatgcgcggccttttccgcgcacgcgagaccgagccgtcagcttccaccgccgcgcaagcaagcatatcaatcaatctggaggtggaagggggaaacaggtagcggaaagaaaccaatcgattcgccgaaacggcttgccttatatcgacaggttggtgggtacagcacgacggccaaattggatgagattacggtttcatatccgtagttcgactagtttatcaacctgtttataggcgagtccggatgctgtacgaatgcaacggatatgaatttgaacagcggcgacgggggtggaaaggtctagagatcgatcagcggtgagcgcgcgcgcgtgcgtgcgcgcgggtggcgcacacgtggtccgagaggaacacggtggcgcggcacgagcaaggcgcgtggcgcggagttgccttgggaagaaacgtgccgagaggatggtcgccaagttgctcgttcccatgcaagcgtcgacgaggcacgagggttggacatttcgtcatttcgatggctttgtgcctttgttacttgttagctgttcttctgttctccacttctgcctctctacagaagagatccaatggagcacgattcgggtacgcgacccagcccaatcaaggaggaagtttatttgtccgatttcaaagcccaatggcctgcgattgtatttgactatttgtttttggtgttacatagatacgaaacaagtactgctgaatatccagtattgttttgtgctacaattgtcattttgttttataaaattttagtctccttaattcacacgctcaattttataaacagggagggagatcatgtgttaattctaggatcggggaagagcgacatcatggtttagtgcactgataatatgatatgattgtcataggccgaagcatataaggtgagacttactgaaattaacagattatgaaactttcatgtgtaacaaaagctatcttaacaggtttatctaacggtacagctagtgttccaagttatcattgtctcatgtaagggtgtccaaaacggccaaaccggaataacttaattgccattaatatttgcatccgtagcctgtaattagagaaactattttaatctctcgagaagatatctttcgttctttgcatgtcacgcaaatggttatgaaaaaatttaaaacaatttgagaaggtgtattaacatgtgatataatactccacaaacatgtaaattcaaattcaacttctacattttgtaacgaaaaaaataaattaaaccgcagcttgttaacgtatattcagagtcaaatttgttttttcgttgcgagatgtagaagttaaattttaacttgtatatttatggagtgatatatcacatgttaatatatcttcttaaattttttaataaccatttaagtgacatgcaaaaaatgagagtagatatcctctcgagggatcaaaatccacttcctgtaattaggaggagattattgtgaatttgtgatcgctcagcaacttcacacctcctgagttgcactaccagatcgcacaaacaacaaattgaagcatgtttgtgagaggcgtatttgttgtcagttgccatgagtggtgcagtggcgccgtggcggtcctctcgttccatgtatacttccatgttcggtcattggttaagattcaaactaaaccattcgcagcgcagtttaggctgtgtttagatccaaagttatttcttttccatcacatcaacatgtcatacacacataaattttcagtaacatcatctccaatttcaattaaaattcaaactttacgctgaattaaacacaaccttactatccatacagagagattgagagagaagttaaaactaagacgacttacaaagcggtttattgtccaaagagagggataaaactaagacgatttggccccgtttagttctcaaaaagtttttcccaaaaatatcatatcgaatcttcagacacatacatgcagcattaaatgtagaataaaaaaaactaattgcacaattagagaggaaatcgcgagacgaatcttttgagcctaattagtcaatgattagccataaacgctatagtaacccacatgtgctaatggtggattaattaggtttaaaagattcgtctcgcggtttccagacgagttatgaaattagttttttcattcgcgttcaaaaa

SEQ ID NO: 12132 - DNA, 3063 bp, Oryza sativa
ctccatccgggcctccggaatcgcgtcgccccagtcatcacaaccaccaggcgcggggagccccgcgtacacgcacacgcccatgccgatctcgtccgctttcggaatctccaactcctccggcaccgggtcaatcatcatgaattccgcaggcgcgaaccccggctcgacccgcgccagcacagccgtcaaccggacgcgccagcgttccgcgcgcccaactgcctcgttcatgtcgcccgtgtccaccccgaactggaacacgctgttcttggggccggcgtcgcgggcggtgacggcgaaggagaggacgttgttgctgtcggcctcgatgtcgatggcgaggcccgggggttggagggcccggttgccgggggaggtggcggtgtggggacgagtggggtgatggggtcctctggcgtcggcgccgccgtcggcatcgagcaggtgaaggagcccgagcgcggacggaaagtgggagcggcagagctgcgcccagatcatcaaacatttggaacgcagtttattatccgcatagagaacaactaagacgatttagagcgcaatttattatccagagagagaactaagacgatttacaacagaaacacggagatcgatttacgacgcaaaacacataggtacgttctgccgatcaacaacggttcatcaccgctacactgaccctgaaggctaaaagagaaacgcgcatttcacaggaggaattgctgcaagtatctgagcccatcgtcgatgctaacgaacctgggcctgtagtcaggctgcatcacccagaaattaacctcccgcacaaacctctcctctatgctcaccatgatctccacctccgccaccagaatgctcgtgccgcgcgcgctgcagccaggtatggggagcaccccacgcaagcgaatgccgatagtgaggggcgcaggcatctccttattctccgcgtacaccatcacgaacgccgtaggcgcgagccccgccccggcacgcacggccgtcaaccgcacgctccagcgttcccccggcaaaagcgccgcgttcctgtcgctcgtgtccaccccgaactggaactgttcttgggtccggcgtctcgggcggcaactgcgaaggagaggatggcgttgccgctggccccgatgatgtcgacggcgaaggagacgtcgtcgagggcgagagcgggggcttgacctgctggccgtgggaggcggcgtggaacagcccgaagaggcggcgatgcggggacgagtgggggcctctagcctcggcgccgccgagcaggtgaaggagcccgagcgcggacgggaactaggagcggcagagctgcacccagagaccgtcggcgccgaaggcggcgctccagaaggtgcagacgcagaaggccgccgcctaggacttggggtctaggaagggcaccacgatgggaagtgctccccacggcggcgttgtcggctcgcgcattcctcgacgtgcttcccagtggagtggttcagacattggatccttgcgtgacaacgggtagcggtggccactggccagtgggggaaatgaagctggctgtcctggctgtgggccggtgcgccgggtggagcacacgtggtcaggtgaagggtggaacaaggggccgcgtggcgcgcgaggagcagctgcctcccgaatggacgtgtcggttgccactatcaatgcagttgatctctccctccaattcattttatcatcatctaagatatttaagatcttgttacaataattatcttttaataagtatctctttatttatttgtgaaataaatgactatcattaaatacactacattcaaccaatcaagattaactcttattgatataattttatataatatttaaaacatgatgtaatacataaaatataaaatggcatagcaccttaaccgactaggatcgaaaaatttgcaaggagctctacaagagctgaatgggtttgggtcccggcacaatacagatgatctctcaaacttgtgttcattattttagtgcaaaaattgtgtttatacaatgaaacagttgcactaacccctgctcaaaagggttgatagaattgcaggtaaggtcaagcctatcatataccgttctcttgtcctgtcatgcattatgaatcatccaaaataaaagctagctaaagagatttgatttgttttatgtgcaccaaatcacactatatcagtaacaattaagtatatgaatgtacttgtacatggccccgttcacactgaccatctcgttaaaacaaattaaccacccaatattctgttaatgtatgatgaccatatctttcgtaaaatggcggaataacctaagttttaaataaatgaggaaatatacttagtagcagtgcacactaaaaaccaatcaacgcccatgctgccaccattaccagtgactcagggtgtgttattttctccatttcctaattttactctagttttcatgtgcaaccgccaaacaatgcttttttttataaaaaactataggaaagttactttaaaaaaatatattaatatattttttaagttttttatagctaatacttaattaatcgcatgctaattagccactccatttttcatgctagagagaaatgttgtgaactcggaggttcaaactcagccttagaatagaccgccgatgaccaaactctcaaattacacatctcaaaagacaaagccaatatcgtctctcccaatgagatcggaagacaaagccaatatcgtctctcccaatgagatcggattattgttgaagagaaagaattgtgtagtctgtaaccataattcaaaagagaaaaaaaaagcatgataattcaaaaacacacataaaattttttcatggaagtttctgtaaaagtttagtttcacacttggagtcagcctgaaatggcctcttttagtagtcaacgacatagttgactttctccatgctcaatgacttctcaatcgccttgggtcctgtttggggagaataagattctaaaaatcagggaagtcaagaaagcttctcctccttatatagtgcccaatg

SEQ ID NO: 12133 - DNA, 718 bp, Oryza sativa
tcactagtgttacaacaacagcagcagcagcaagcataatagcacacagagcttacaggatatctagcaccaaaaaaaaaaggaagaactgcctaagctttggcatctcctttaggttgaccaagaagagatggccggtaaagtgaatggccctgcgccatctcaattctttcacgtggatcatacattgtttcatctcttatggcctgaaggatcgaatcaggaggaagttccctgtaaatacaaatgaacaaattgagtaggctgtggcacaaatacgctacgactgcactgtcagctagtagtatgagggtggagaaaaggagccccccaaaagcttgaaaaaaaatatggaatttattcaaatttgagcaaatctcaaaatattggcactgctggcctcctctatttgcacaacggagttgctagaaatatggcgccatatgctacagtcgatttttttcagccacttacacagtagttacacctcatttacaccccacctacatatgtaattagtatgtaattttcgaatttacatatgtaattttagtacttacatatgtaattttgagacttacattgtaaatatactaaaattacatatgtactttaggaacttacaatgtaaatacatgtcgactatttttttatgaaaaatatggcgccataatatagctacacccttgcacaatcctacattttagctgccactgat

SEQ ID NO: 12134 - DNA, 2266 bp, Oryza sativa
tttcctcagttattgatatttcagaaaccaagacggaagggcaaacctgaatggttcctttgccttttatgctgtcacccatctctagtgtcagttcacctttagctagtttctgcccataccatgcattacgacccttcagcaatgtgacataagtgtcagccaataatggcccagcaagtttttcaggctcttcttccaaaaggtgggttatgtaaatcatttcagatgtgcaaagagcaaagtaaacggatttgctggttgcactctcatttgttagagctgccaccatacctgcaggataacaaaatttcagaaaattaacagaagcataaaccaagaaaaaaaaaggcagatgaccacgacaagattaaaacgcgacgtaaagcatagcaacatagatgaagccacaatataccgcacatatttctatagttgtatttatggtatatttcttcctggagaaaacattgtatatatcttgatggtaacagtgcattctgaaaaatataaaacaaggcagagtacgcaaaacatcaactaaagctgaccagtgcattccaacataccccatgctaaatatcacaacagtatatgctctaccgtgattacagaagatagcaaaaacaatcaagagaggaaatagaaattaccggcaccaatggcatacacatttttcaaacctcccatgacttcatgtgtaatgagatcactattatcccatacaataaaatgaggctgcctcaaaaatttagcaagaggttttctccatttgtcagctccacatatacgagcatttgcatattctttattgtaaatttctgaagcaatgttagggcctccaagataaagaatgttttccaatggaacccccgctgcagaaaacaaaacaaatataaattgcagaaataaattggaaggatataattcaaaacagttaagaagtaaaaccaagcatgaacactcggccgttaacagtaacacacaccacaaatgatcaggtttaaacatattaacctgaattgagtttaaaataaaagggagaatctaaataattcattttatttatgtggaaagacagaaactggagttataccaattcatgtaacatatctagcagctaaacagctaaaggactattgaacaacagaggacatgaataaaggcaatgtttgtcccatccagttctttttttgccagcgttgtcattttcagacttgtgcctttgtatgttcaacatagacttacttttgtgtaaattatgttagggcatagagctgaagtaaacaaactattcatcctcaaatcatacaaagttacaaatttctaatgtagtctaaagcaaagataaactgcatttgtcaataccagattaaagaatatcctagttacggataagcacaaacaaagaacaaagaacaagttaattcaagcaaagagtgcacatgatggtaagattgtgtaaagaaaaggaaaggaatctcacttgcattgctaatcatctgtgtgggagttatgatccgtggcaggggatccagggaggcctctatccctttggccagagagaggatgatgggggcagtaatcctctccttccagtacctcccaatctccccgaagacttccctggtgtccgtggacggcagcccgttgatgacaatgtcggcgtcccagacggcctcctggaggttggtgacgaccttgagcgggcagagcggcgtgtcgatcatgttgaggcagaagccgtccctgagtatctcgtcggcgtagagggtgcggtcgccgaggcggccctcgacgtacttgaggtaggcgcagcggcggatcaggcggcggaggacgtcctcccgggcgttgatgacctcgaagaggtgctcggcggtggcgcggtcgacggcgcggcccgggcggcgccagatgcggacctgcaccttgtcgcggaggtgtccgtacgcgtcctgcatcagcgcgcagaagacgctcccccaggccccggcgccgacgccgacgatccggagcgggtcgccgtcggccttgcccagcaggcgccgcagctcgtccagcttctcctccacggtggccccattcccgtgcccgttcgccgccgccgcgcgcggcgcgtcctccgccccgcccattgctccctcctccacctctccgccttcccttgtcgtcgctgcaagcaaaatcgagcaggcaccggagagcccaacggcacacgctacataaccgactacttaattacggggatcggcgagcgaacgaa

SEQ ID NO: 12135 - DNA, 1776 bp, Oryza sativa
gagcgcgtccacccgaaataatagtgctagtagcaactgtagcacaattcggatgtgtactgtgtaccaagaagcattaggccatgaaaattggaggacactttagtagaaagacaaccgggagacaatcgccacgtacgagtactgttcatggccttagagtagtgctaaccagcacaaactgggatacgctgtaccaagaagcattggcgtcaccatgccacggggaaaaaagaactcctttccgtcacgttactgatagtgacgacagggagcaacaaaatttagtgacgcgtacatgcctaccttccccttgcgtgccaaacatgttccacgcacaggtaagaagctggggatttgttcaacacaaaaatcatataaaagaacttgaatgtctcatctcacttaccacggtagcagctactcattgatatataattcacacttgtgagtcgtgatgagatttaagcggaaaaaacgcactacgattttattaagacaatcagaaaagcatatctccccggatcacaaatgtatcttaggaagatcaccaatgtattttaggccttccatccacagctacaagcaaccttaattatggactacttccttacttgcattaaacataactgtgcatcacattgcaaaaggtgattttatgaaatgttgactacaagttgcctggcaacccaaggttatcgagtgtgctgcctggcaatgaggtgatggtgatacgccaacagttcaaatatagaagggggcaacggaacttgctacaaatgacatgaatacaataaccacctccctatgctgcaaaaggacaggaccaacactggtggttaaaacttgagacggtttcagtatttctgctttcctgaataatgccaaaagagtgttaagaaaacctgcaaaacggtaagtagagtgtattcttgttacttgaagggtgccattatcctcctccgccgttttggagtctccctcttcacatacatcttctccatatcgtttagtgggcggcttgatccatcaggtaaactggcgaacttccagccacctccagagccccgctttgactgcgctccaagtttctcaaccatgtaggtccatccatcgtcgggccgtcgtcggctgtacttatgacacttcacctcgcctgccacctgcaattcaaaaaaaaaaaaagaaggaaggaaggtcagaatcctatcactcatcacttaagggaaaacacagaagatccattaagatggtcagtaaccaatggaccttaagtctttaaacatcatgtattttctggctcatatgcatatagcttggcatgaagttatcttacacagaagatactccatagcttcgagtgttttatcttccaatacaaaaggaaacaaattccaacaaattattatcatgggtctcccatgtttgcctttccatatcaaaagagaacatcaaattcactaatcactacatataaacagcaggagctttaactgagacttaacaaaaacaaagacaacactaccaaattatttaattaaagatgatgaaagggagaaatagaaatgtaagatcctcaccttcttcttgttgaactgtaaccgttgaacaaattcctcatacagcatctgatcttccttcattgaaatctcatacagaacctcatcaggatctctggttgtgccatcccagccctcaggcataactttgaagtcaggtttataaggaagtgatgcaacatgaaattccctatcatgggaattgaaaaacctgcat

SEQ ID NO: 12136 - DNA, 871 bp, Oryza sativa
ctctgtttctctcctcagtgccgcctcatcttctgcctgaacaacatcctctggcggattgacttggttgaatcttgttgcactctctgccttctcctcaccagcctgattaacttctatttgggtaccgttgatgaaaaggtcaatagagttgtgatgcttggcgacctccttgctcactacctctactgtcctcttaacgttgggactattgatgtaccgtgcattgtagcaaatctttgcctccgaaagcttttcaaggttgctgatacctgaaggaacactcatctcgctcgctgggaacgcgtacagattcagtcgaagatatgtgagcttcggcattgcctctttttcgaaggtcagccatgggacagggcaatcaagggagaatctctcaatctctttgaacccttttgtctcaatcactattgcttcttcgggaatgaactccaagcatagtaccaggtgctgcaatttgaccaagcctgcgaggatcttgacatcgtctgccacttgtttgcaaaccgtgatctgcaagaaagtaagatacacgagcctttcgatccatcggggaacactgacaaattttccggctattaccttaaatttcttaagtccttcaggtggttttgttagagaacccagaaactccatggaacaaccgagcccacaatgaatggtgagggacttaagcttcctccatctttctatggataaccgtagggcctcttggtagtcttcgtcactgcactggtgaaaggaccatgttattgcgaggacctccaatctctccagatcaccgagagactgtattgactttgcagagaattcacttaaatcgatagttgctagcgtctttagatatcttaat

SEQ ID NO: 12137 - DNA, 730 bp, Oryza sativa
cagcggtcctcgcaccacgacttcactcggtcgaaaaatgaagctactcctggttctttaaccagtaggccgtagcgatctatcgtagcttaacatcactcggtcgagagatgaggctactcctggttctcggaccagtaggctgtagctatctctcgcacctccacttcaagtgggtaaggctacacctggttctcgactagcggtgtagcgattctcctactatttccacttcaagtggtcgagttaaggctacacttggttctcgaccagctgctgtaacgattctcccactatttctactttaagtggtcgagttacgactaccacctggttctcgaccagcggtgcagcgattctcctactacatccacttcaagtggtcgagttatgactacccctgatcctcgaccagtggtgtagcgattctcccactacctctactctagcaaagttgatatcaggtacacagtatcgccaagtgttttacccagagatcccttatcacgacaacacctagagttgaaaccaatcctactgtccctttacgccgccctggcaaggcctccgaggaacctaaaggaacttcggctggggacgcccaaagcggataaggccttgtcaggtaatgcagacacgaacgaccatgtaagatctggtcatgtaagagttctcaccatgcgtattaatcaaaccgtgtaatcggaaaatgggttttccaacttcacgg

SEQ ID NO: 12138 - DNA, 16018 bp, Oryza sativa
gtcatgaatttgacagctcttcaccttcccattgctgctgttgttgataggccgaatcaagttcctgccaatgagctcattgaagttgtcttctgcaacttcctctgccgtctgcccatgtttctcagtaacgaacccttcagcaacccatcttcttatcaatcgtttcctgctaatattgcggccctttggaaatgtactcaagtagagcaaacatgtcttaaggtcaggtggcagatttttgtagcagtggttaattatctgcactacttctgtggtgagattgtttcccaactctgcacttaaagccttctccacttcaatcaatttctgatccaacgtctttccaatctttgatttcagttcactagcaatgagccctgatactactactatggccaaaggcagacaaccacacatcttcacgacaatctcatcattaatggttcgagtgggacacagaccgttagcagatattatttgaagaaacaatttgttggagttctctggatctagctgtttgagcttgtgcacatgaccattttgacggcggcaggcttcagctacagagttaaacctggtagtcacaattacgcaactacccttatcattcttaggtaatgaatccctaatactttcccatgctgatacagaccatatgtcatcaatcaagatatggtacctgttcaagaattgtttagaagtaagtagttgtaaatagagtgtgcttttaaggtagttgtaattgtaaatagagtgtgattttacggtacttgagaaggtaccgtaaagttcctctctaaataatattttatactaccttcttagtttaatatttttatggggaatatcttcctttaatatttgaacttaaaagaacgaagggagtagtactcatcccaggcacaaaacatattgccaaacattttcaacttgggtatcaatattttttccctattatattctgcataaagttattggactttataaatactagaaaaaagatgcccgtgcgttgcaacgggaaacactaacgttattaacttagtaaaataataaaaaaatgagctcttatgatctagaaattcacatgttaaaaaataaggagaactcattgtagaccaggactctttcattttgtttttttttaaatcgcattgcccaatcgaatatgtacataaaacaacttaatataaagtataaattataaattagaaaataaataatattggatgaggactctagaatattctccaaaagaggctagggtgcatataggaatacaatttagaaaaagaattaaaattcaatatacaaaatattgaaagaagagtttagagttcatatatagaaatacaattagaaacaataaaaaaataggaatatttgaagaagaatagagaccatatagaattaaaaaataattgatattatttaattttagtctaaatttaaattttgtatcacgacaaataaataattatatttttagtcagaaaataaatccatatcatgaggaaaacaatttagttagaattaaaataataagtagtcataagcaattataatgggcccttttatggcctaatgggctaataggcctatagaaccaacgagccatcaagcccagtaggcagaatagactggaggcccaatagtgtggcggcccaatgaaggagaagccggggccgtccgatcgaatggacggtccaaattgatcccaaactatatatatactctgcagcaatccctaaccctaaaaattcattttccccctctccgcgcctctaatcccctcccccccccaccccaacacacacacacgagcggctgctgtggcgccctcgatcccctgtctctgaaagcgacagcggcgccctcctcccccctccccgagcggctgcggcagcacttagcagcagccggcgagcagtgacgggctgcggcgcctctccacccctcgcctcctctccctctccatggggccacggcccacgggagggctcgaccgtggcgggcggtggcaggcggcggcgctctccccaggaaggaagccgacggcggcctggagtccctgcgacggcgacagcggcggcgacctcattcgatctaatttttggatatatttgggtatatgctttctccaattttatttgtatgactgaattttgattgggattttttttttaggggggggggtggattgaattctgattgggatttggggggttgcgacggacgaaaaatttgcgtacgtttgaggtaacgaacggaaaaatacgaatcttttaattagttaagatatacaataaaaatgttgttgaaaagttgtgttttgtagactatttgtatccaaaacgactgttacctgtgaacggtgaaagtacaatttatccagatcagtaactatcataattcaaattcggtattgctatttaattactaaaaacttgtgtgagacttatccaaagataagttcaagtgctaaaccagaaaagtcaaggaaaactatgaaggaatgaaataaatactctgtattactccctccatccctaaatatttgacaccgttgactttttagcatatgtttgactgtaagttcttattaaaaacttttgtgaaatatgtataactatatgtatatataaaagtatttttaacaatgaatcaaataatagaaaaagaattaataattacttaaatttgtcgaataagacgaactcaaatatattttaaaaaaatcaacggtgttaaatatttagagacggagggagtatatagtaacaaagccaaaatctatacctcttgccttctagttgatcagctagcttcttcttgagctcttcaactccccattcctcaattccttggagagcatcctgagaagcgccgacctgcttctcatggaactggctaacaaggcttcttagaactgttgggagacgaaacttctgcgacgcgagcatgaacgctctggaattaaactcatctccaaacttgcggtaaaatgacattgcgagtgtggttttgccaagcccaccggatccgacaatggcaaggtaactgatttggctctgctgctggctgttgtgcttcgagaccatgaaccatctttgaagttcgttcatggcgtcctccatgcctacaggttcaacggtgccaatcacccgggggaaagaaactggatggtctctgggatcgccgaagttgttgttgcctccaccatttgcgtttgctaggaggttctccaccccgtacctcgtgcgccgctcgctgacatgctgcgccctgaccttgaggttgccgatgtcggcggcgatgcagcggcgctggtacagcgtggtgagcaggtaccaagccctccggagggtgactagcttgccggccccacggggctcgcggccgaggcggtggctgacgtcgtcgacacagtcctcgatgtcgtaggcgacctcgcgcacctgcttcatccagtcctgccgctgctcgtcgtggttgatgtcccgcttgagcctattgaggaaggcctgcatgctggcgagctcgtcgttgatgtactggatgtcgtcgtggacgccggagatgagggtgtactcctgcgcgaggaggctgcccagcttgttgacgagggacttcacggcgccgctcgaggcgccgacgaccagatccataatcagctcccgtttcagtgaataggtataggaacctgagaaagtaagaaacggtggataactttttttttttctttttgattcgaacgatggagaattggaaatttggaaccccaggggcagggatgggtcatgggcagggttttaaatcttcctctatagctatttgagaaagactctagttatttattctcatgtacaatttagctgctatagctctatttagcctattatatatagctgccgctatagccttttgagaagttaaccgctaaatgtcttaacccgttatttaaaatattggtcatgggtggtccagccgctgggagtgggattgaccgagtggggcaatcatgatgccataatgaggcctatgcaattatctaattattttaatacatgattttctttaaaatttgttaaacaaccatcatgttgtgttaggattttttaaaaaatcaagccttattgtcatcaggtttataattttacagtttttaaaagtcacagcaaccaccacctcttacttctttcctccccttgattccccactcgctatggctttatcttttatagtttttaggaatatcgtctaatgccgccatactagtacattatggcgtgtctgctgcccattccctttattatcgttaggatttaaatatggaataagtttatctgaggtcccttaacttgtcagcaaatccaattttcgtccttcaacccgaaaaccagcccctcaggtctcaactatcaaaaccgatgcaaaataagtttcaagacggtttggatagcggtttcagctgacgtgacgtctacgtggataatttgactcagtcttcatctgaggtggcattaacatggtgcttacgtggaaatttgatttcaaaaataataaaaactatgacaccacaaatcagttatataaaaaaataatataaaatggtggggcatgtcattctcaccctcttcttcctcctctctcccctccactcttcaggcacgacggggaggaagcggcgcgcgacggccggtgggagaggaggggcgcacggcggccgacaagagaggagcagtgtggcggtcgggccgacctaaggccagcaacgacgaggctgttggaatgtaatctctttcccttcattaccaactccccttccttctcctcccgatcctgtttccataaatcggttgagtgagtatggaaagtggatgcctatacatgtaatgctccgtgatcaattcattatcgcgatgagtcattcctgtctaacatggaatcaatcactcatcgatccttcgcttctgcataacccgccggcgtcgctccgccgccgtgcgtccacttccgccggtgcaccctcaccggccgtgcgttcccggcgacatcatgtcgtcctcttccaccacccctccctctccgaaatcgaccgcgatcgattctactgccggtgccgtcgcagacgctgttcgtgcggccttcgctgttcccgtcggtctggagatcgaccccactacggcaaacaccgttgccgagtctgcggcgacccgcgcctctgacgccacacgtgaggccctctccgtcgccctcagtgccctcgtcttgtcaccggttgccacggttgctgcgacctctggcgctctcggcgcgacggccattgccatgcccgcggcgacactccacgcgtcgtccctacccactgcgacgatccacgcaccgccgcccgcggactccacaccgccggcccttgccaccctgtttgcctaggcacggctcacccacggcgccgcggcgccgcccgttggtcacatccggcggccggccacgcatgcagccctagcagccctctatgcccaagccgtcggcatcctcaacatcaaggccctcgtctccgtcgtgctcgacgtcgccaccgccaaccacacccggtggtgtggactgttcttggcggttctcggcaagtacgcgctaacggaccatgttctctccgactccttccacttcgaccgtgccgattgggtccaaatggactgcgtcatcctcacgtggttgttcggcaccatctccttcgacctcctgcaagacgtcctcaccaccaacaccactgcccgtgtcgtttggctaggcctcgagcaccatttcctcgggaatcaagagcaacacgccctcaacctgacaaccgagttccacattgcaacaaggcgacctccccgtctccgagtactgccgcaagatgaaggccctcactgatgactgtggcgacctcggcaaacctgttcgtgaccgtaccctcgtcttcaacaccctcaacagcctctccgacaagttcaaccatcttcagtcgccgatcctcatgcaacgcccgttcccgatgttcgccgagctttgctcccttcttcgcctggaggagatctccaagtcaccgcactccaccaccacttcggccgtcttcctcgccggcacctccaacaacagtggcaagacctctaatccagcgcacaccaccggttttggtgcagggaatcaaggcaacaaaggcggcggcaacaactccaagaatcgttgtcgtcgcggcggcggcggcagtggtggaaacggaggaggaggcggcggcggcactccagccgccaacaatggaggcaacagcgctaagtcgggcgctggcggcgcccaacagtggctgacgccacacaacccgttggccggcacaatccacatgtggcgtgctcggcccaaggccggccgggcctcccttcgctggggctgcgcttgccggcccagtcggcgcccacccggcccaacagtggcaggccacctagatgcatggggcgcagggccaaccagcccaataggtggtctcccagccacccacccccatgggctttcaacagcctatgggttggttcgccggtgctccctatcaatgggatcaagcgtctctcgcgggctctttcaacaccacgacacttcagcagcccgccacgaacgaatggtacatggacaccagtgcaacggcacacatgacatccgactctggtaccctctccttcacacaacccccaaactctacatccccctcccacatcgttgtcagtaatggctccactattcctgtgtcgtccatagggcaaactgacatacatcacccgaagcgctcctttatacttcgagttactctttgctctccacttattatcaaaaacttgatttccgttcctcggttcgttattgataattggtgttctgtcgagtttgatcccttttgtttctcagtgaaggacttgcgcaccaggaccatgattgccaggttcaatagctcaggtccgctctaccccctccaccaagccttgtctccatctacagccgccacagctctagccaccaccaccaccgacacttagcaccgtcgtctcggtcatctcggccatgaagctcttgctcggctctcctccgttgtgcccatggccaaaggtggatcccctagagtttgccatgcttgccagcttggacgacatgttcgccttccttttgccacttctgtcactagggcttctagcaattttgagttgatacattgtgatttatggacatcccccgtcattagagtttcgggtttcaaatattatcttgttattcttgatgattgttctcactatgtttggatttacccacttcgctttaaatccaacaccttctctactttgccccacttttttgcctatgttaaaactcaatgttccaccaccatcctcaacgtccaatgtgacaatggccaagagttcgataactctgccgcccgcacttttttcctcaccaatggtgttcacctccgcatgtcttgcccccacacctctccccaaaatggtagagccgagcgcatcatccgttccctcaacaacatcgttcgctccctactcttccaagctagccttcccaataccttttgggttgaggcccttcacaccgccactcacctcattaaccgacatccaaccaaaacacttgaccaccgcaccccttttttgccctttatggagtccatcccacctacatacatttacgtgtcttcggatgcaagtgttacccaacctctccgccaccaccacctgtaaacttgcaccccgctccaccatgtgtgtcttcctcggttatccactccaccacaaagggtacctgtgttttgatcccgccacaaatagagtcatcatctctaggcacatcgtgtttgatgagggttcgtttcccttcgcgactacaacgacaagtgccactaaccttgattttttggaggattctaccacccctgtgcaggctcctatcggcgccaaccgacgacctgcagctcccttgccagccgccccaactccaccacaggctgcccatacacctgggtcagccaccgctgcatcaagctcaagtccagctccctcggcctacaggatgacgctctctcggtcggctgggccatccgtgccgcaggccacccactcacctgggtcatccgcctgtcactaggccgacgcgcgttgctccacgatgggccgctgacacatgggccacgctccaccgagccatctccttcgactggcccacgacaagactactctgctgggtcgtccaagtctcctgggctgaccgaagcagcacaagccgagccagaggttcttgcacccccatgcccaagtctgcttcctccatcgcatgtctccattcccacttggccaaggtctgctcgtgtggccggcgtcccgaagccaccatccatgctcgacgcttcccctgtcgtcaacgaccatcacatgtccactcacagcaagcacggcattcacaaggtccccgaccggctcaacctccatgtcgacacgctctccccgctcccgaggacgtacagggccgccctcgccgatccgccctggcgctccgccacggaggagttctccgctctcctcgtcaatcgcacatcggagcttgttcctcgtcctcccaacatcaacgtggtgataggaaagtgcattttcaagcacaagctataggccgatagctcccttgaccgctacaaggcttggtgggtccttcgtggtttcacgcagcgccccggtgtcgacttcgatgagacattcagccccatcatcaagcccaccaccgttcgcaccgtgctcagtttggcagtctctaggaggtggcctattcatcaactcgacgtagaacgccttcctgcacggcaccctacaggacatggtctactgtatccagcctcctggctttgtcgacaccacccaccccgacatggtgtgccagctcaacaagtccctctatggcctcaagcaagcaccccatgcgtggtacagtcggttcgcctccttcctgctgacgctcggcttcgtggaggccaagtccgacacctcgctcttcatcctctgccgcggcattgacaccgtctacctgctcctctacgtcaacgacatcatcttaaccacctcctccaccgagcttctccgctagtccatctcggctctgcagtccgagttctccatgaaggacctcggcgacttgcactacttcctcggcgttcgggtctctagcagtcctctagcctcctgcttagccagcgccagtactgtctcgacattcgggatcgggctggcaagacaaactgcaagccctgcaccacccccatcgacacctccgccaagcactccgccacagatgatgctccggtcgccgccccaacggacttccgcagtctcaccagggcacttcagtacctcaccttcacacgccccgacatcgcctacgccgtccagcaagtctgcctccatatgcatgatccaagggaaccgcacctcgctgctctcacacggattcttcggtacgtccgtggcatgttggacctcggcctccacatccagccgtctgcagcaacggaacccgtcgtctactccgacgccgactgggccggttgccctgacacaaggcgctccacgttaggctacgctgtcttcctcggcgacaacttggtgtcttggtcttccaagcgacaagtcacggtgtcccactctagtgttgacgccaagtaccgcgccgtcgccaacgccgttgccaaggtcgcatggctacgtcagcttctccacgagcttcactcgcctccgcccaaggccaccttggtctactgtgacaacgtgagtgcggtctacctctcgagcaacccgatgcaacaccagcagaccaagcacatcaagatcaacctccattttgtttgcaagaaggtggcggttggcgcaattcgggtccttcatgtgcccacttcctcacagtatgccgacatcttcaccatgggacttccttcgccgattttctcgaagttccgttccagtctcaatgtccactagcatgacgttgcgactgtggtggggtgttggaatgtaatctctttcccttcattaccggctctccttccttctcctcctgatcctgtttccataaatcgattgagtgagtatggaaggtggaggcctatacatgtaatgctccatgatcaattcattatcgcattgagtcattcctgtctaacagaggtgaatgtgcgacattgagcttgtggttggacggcgacgggagggaggatttggaggaactggcagggctatgtcaaagaacgtgagggaggacgagaaggactgtggcccttccttcaccgctcgccactgctggggagaagcaatcgtcacgcgggggtgggaagatgggtgttcgtcatgctcaaccctgacccagggagaacatccaacactggggttggggagatggatggacgaccgatgactctagatctgaatgatggccggggactgtgcactctatcagtcacggcggcgatactgtgagctggtgggcgcaagcggtttttttgctccgggagtccagggaggcaacgagcaagtcagcaaaaggaacatggaatgccggcggcggttgactttttgctccatgtcgctcactgttgaggctgatgtgtgtctcgactctcgagtagattaacgcggtccagcaggctgcaacaccgacggcaacgacttattgtgttggtggtggtgcgccgccggcatgccacgaacgtcttcgtcggcgtcggtcttcaccgccgctgtcggtccctttcgctgctcctccagcacccgttgcccagcatgtgatcgccggaagtcgagcgacagcaacaccgacggcaacgacttattgtgttggtggtggtgcgtcgccggcatgccacgaacgtcttcgtcggcgtcggtcttcaccgccgcagtcggtcccttccgctgctctccagcacccgttgcccagcatgtcatcgccgtaagtcgggcgacagcatgaggccggtaggcatgacagacttgtgagctcgacctccaccaccctctcggtctccggcggtgttggtggcggcgcaggcgacgacgaggagaatggggagaggagatgagatagagaagagagggaggagagaagagaggggatgaggtggaggaagtggggtctcactatttcctaatcttattatttaactgacatgtgggcccatatattttattttacttttaaaattgttagattttgcttcatatgccacgtcagatgaagaccgagtcaaattagccacgtaggcgccacgtcagctaaaaccaccgtccaaaccgctatgggatatatattgcaccaatttcgacaattgagggacccgttttatctggttttcctgttgaatgacgaaaatcggattcattgacaagttaatggatctcagatgaacttattcctttaaatattgaaccttatcattgttggagtttctatttttagtttctacaagcctcgtcaatcgttgtcaccctactcctttacggcctgtctgtggcccttcctctttattatcattatgattttagaaatcaaacttaattattattgggattatgttttatagttttagatgtcccgtcaattgccgcaatgctactccttgacagccaacgttttgtccatcctgattttaaaaattgaacctgatcatattggttttggtttttttattgcttagtcctttgccatttctcggtttgtcctctcaatgatataatagaattttttagtctaaattttaattaatctcttgttgtattctagatgacctcttctttttatattccttatcattttatttcaaatttcagttatatctaattatatttctacttgaactctcattttttctaattttggattttactttattttttattttgaaattaattaatcttttgttgtgttctggatatagtattctttcaatattccaaattttagacatttttaaattttattcctaattgaactctatttttttcattgctccaatcaatgtgaaattttttattcaagattttagttatttataaattatatttctactggaactcttttttcttttctaattttataatttactttattttttattttgagttttcattaatcatgttgtgttttaggtagcctgtgcaatagcgtggctagcgccaattgaaatatactttataacacaaaattatcttttcttaacacattgtcatctttttttaagaacttcatggtcatctttaaagtttgttaaatggacgacctatcttgggattaaaaaattgatacttatcatcatcgtcgccacgctcccaattttatttcttcaactctcaccagtgtcccccgtgctactcctttggcgcctctctacttgctggcgcaccacaccttatatgtattgtccttgagaccagctgagttcgtttctcagggatgctaacctctctcctttgttttttacgagcgcgcttttcaaactgctaaatggcttgttttgtgtaaaaaagtttttatacaaaacttgtttaataaaaatcatattgatctatctttttttaaaaaaatagctaatatttaatcaattacgcgcgactggactgttctatttttttcgtgcacaggacatgtgttaccaacattcagcttgtcttgctgcgattcctttttatagctttttgaaatcctgcccgttgcccctcttttccttatttttaaaagttccgccagttgttgtcgatctactccttaatttgttgccattcagcttgcctccacactgccgaagaagaggatagctagaaaatgcagcttatggcagaggcggcatgcagccagcttgggagaggagatgagaagaaagcgacgtatctggtggggggagagatgagtggataagggtggggaagaaataagatgttccctgctttagttgcgcgcaaacattagcgaaataaacttactcgcctagcttgcatttggcatgcatctgcaatcagtacagttgtttgttgcaataattctgttctgtcgtgctgtaccagctagccgtacaacaaaagaatagaagaaaacaatgggttttcagcccaaaacctgcaaagaattttcattaacttttttaattataatgtatagtggtcctaatggttcaatttattatccagcttctaataattgttgtatcactgaagaaaaaggtatttacccgttacagcgcatggatatcttttctaatatattaaaaaattgaaaaagaaaagaaagcggtatgcatgtgtatattaaataatctgaaaaaagtggtttcgtttcgtttgtcacgctagagaggacaaagaaaagagtaagggccggggaacatatggctcgtcgacacattaccgaagaagaggatagctagaagatgcagcttatagtggaggcggcgtgcagccagcttgggagaggagatgggaagaaagcgacgtttctagtggggggagagatgtgagggaagagataaggtgttccctgctttagttgcgtgcgaacattagcgaaatagatttactcgcctagcttgcattcggtatgcatctgcaagcaatacagttgtttgcttaatgctacctttttgccaacatttggaatgccctaatgttacaccatcgatccataagaaaacagtctttttccccttcttttaacttctttgttaaagcgaaggaatagaaatatatgaacacatatataaatccatatgaatttttccaagaggtgtgagtggatgcaaaatctcgtttattttctctctaaatttgtaggaaaacgaattttatataaaccaaatgacacttacgaattaatccttagaatctaaatcctttctctttggttcaaaccgaacaagccgagtttagggcctgtttggggagcttaaaattctgagaagcagttactgagaagctagctggtgagaatctggagaagctagaaaacctagcttctggcttctagttcattttacagattctacaactacagattctcagaatctgggtaaaaagctgaactgtttggaggagcttcaggcaactggagattctaggagaagctgcagccagggccgttcctatgattttgagggccctagacgaactcatcatgatgggccttctaagctatatataaaattttatgatatatatatatatatagacgctaatttttcttgcaaaatgaaaacaaatacatccatatataaatttaacatgtctggtaattattgataaaaagaagtcgaccaaaataacaatatatttgtacatgggaactaatatcattatcttaataaagaaaagaacccccatcatatccattcgttctcatgaaaagaaagttattcggacatttcttgatgcaaaatcatcaataacgggattaagatcaatattggccaaaatatccttctcgatagagcacatagctaagccatttaacctttcttgcgacatagttgatctcaaatagttcttcaacaacttcaattttgagaaacttctttcagctgaagctaccgtcacaggtatagttaagagaattcgataggcaactgaaacatttcgatagcaatctgcatccataacaaacttcagaatctcaggcacggatatcgaagaatctggcaaactcacttgcaacacttttaattctgaataaaaatcattgatctcaacatcggataagttctcatgagtaaatatttccacaaaaatcttgcaatgcaaccaaagatctacttcatctaaggattttaaattttcagagttgaacaaaaacccaaaaacattatcaaatgctttcatctgctcaaatatattagtcagtgaagcaattgcagcatcaatcataactaggaagttctataaacaagtctataggaggacgacactccaactcctctcgtctcgacgtttctgcttctaggtaggccataggcaggtactagactactagtattaggtgttggtcctcaccatcatgagcccccggcggtcgcatcggttgcataggaccagggccggccctggctgcagctgctaaaagctcctcctaacagacccttagatcctatgcatatggtgatggggtggtagaattactactcacaccacaactattctcctttaaaggagtatagagtgctagggtggaggggcccgcacatctgtcggttacatcgaccaacttaagtagtttaaactattccaagatagttttttttatcaagtattcctcgatattttggacgcataggattgtgaaatgacaattaaaatatttaagaaaattaaatataaagtgcatatttgggtaacacaaaacagacccttagatcctatgcatatggtgatggggtggtagaattactactcacgccacaactattctcctttaaaggagtatagagtgctagggtggaggggcccgtacatctgtcggttacatcgaccaacttaagtagtttaaactattccaagatagttttttttatcaagtatttctcgatattttggacgtataggattgtgaaatgacaattaaaatatttaagaaaattaaatataaagtgcatatttgggtaacacaatttaattgttttattactattttagtggagcttaacatggtcgtattagaaaattagcgcattaaaaatattcactattataagccattttaaatttgttttttcgggggaggctaattactatattttaatctctgagagtgaacgtaaagatccacacgtttatccagctagcatcaagccatcgagttcacttcaagtaattcaacacggtttaaaaatatacatgtatataaagtttgtttgtgacgtattaaaaaatggaaataaactaaaagaaaaaccgaaaaaaaa

SEQ ID NO: 12139 - DNA, 9386 bp, Oryza sativa
aaacaggccccaagtgtcaaaagtggagagctctcaaaaaaaaaaaagtgtctagccgccgggggaggggggcgcattttcacgaggcggcgtcgcggcgacgaggagggagggaaaagggtggccgttagttacgcactacgccgtcacatgggggaggccgatgtgcggctgacgcgcgcacggttgtgctcgcgcggcgtgcctaccctaatgttttacacacgtatatatacgtatgaggatatttgtatatacaaaatttatacgtatataaagtatatgcatacatgtgtatgtatatatttttgatatgtaagaaaatataaacacgtatccaaaattagtatacgtatatctttacctattataaaaattaaagatgattccgtactaatagagtgtttcatccgtctttcttcccatgtttccaaagtcaacgttcgtccatcaaaagctagtccgcatcggtcacgagcaaacgagagcacatcttccggtatttttggtcttttttttgctagtattgttcccgatcactttctattttttcttcttcccagtggtggagccaggatctcgatacgtctgggctcaaattgaaggcttgtcaggactatgaataccacgtatctaatagtagttgactaaatttcggcaggacctaccacatactatgtcttataggaaagttccgcataaagaatgatgaatagagttctacatataaacgacaaggacttacgccaagacaagcttagtagtccccatacggtacctacgactaccatcaggagggatctagcactatctttgatctcgccggacatggattcgaggaggaagactaccctgttgtcgattacgtgttagcacttcagaccgccatattgataacagatagataggctaccccaaatattgtactggtgtgattataatgaataagagcaatgaccggcttcggccaacaggagtagggttattacctgacaatttaagagctcgaacctgtataagaatcctcgtccccatctcttttacctcagtctcgcatataccttggtgccaactatccccatactacgcaaaaccgtagtcgtgacatcaaacgtcgacagtagcgcgccaggtagagggattttggtgcttcaggattttgacgagatgagttcaagagatggattcttcaacagcaaactactcaacgacttcgtatgttgagtgatatgacctgaacgaagtacgttctccggtggatcgggatctttgtcaagcttcgccaagtcgtcgtcactatggattttttgacaagggatacttcaactattttggatctggtaagtcaaacccaaccagagtacgtgccccgacaagatcggaaccatcatcgtcaacaatttggtctatcgagatcatccaagcctcaagatacgcggcgtaccaaaagacgtcagatcgtatgatgtcgaacgagtacgcagtaaggtaattggaggattggtttttaaaattaatctactaatttcatagatacatccggcatgtatctacaaaggtacgtaatattttatatgcaatttatcgtacctatacatatcgtacatcattgtcagatctataattttttatgtttacctagagcatgttttttatacaatatcaattatgcgagtgcttccgatgttaggccatctacggtttaatgctgagggctcgctctattttcttccgtataaatcatacttgtttacggtttacataatgcctgatattaaatctgctcgttatgtcatgataataatagaagattcatgcagttttctgagtacatactcaatatgacctgctatatgtcttgccttctagaaaaaaaatttcaggaacaattgagcactcgagtaggttgtggtcaaacacacacattatcgagaacgttatcgataaatgtggagttgtcgcacccaacctaccaacgaagaccgacgacctatctcatagcactggccatagctgggctatttgagaaaaggttgttaacggataattcctcgcgaacgttgtcggcttgatcacccgacataattgcacatggatatccggacatgctataagttgggtatgtgagtcatgctggccacatgagatgcacatgtaataaatcaactttagcgcccctataggtgattgagagacgcctactcgctggttctcaaccagtcaatcgtagcgatctgtcgcacctcaacttcaatcggtcgagagactcctactcctggttctcgaatcagtagtaagtagcgatctctcgcgccacgacttcagatggtcgaggtacgactacggcaatagcgtagcggtcctcgcaccacgacttcagatggtcgtacctcgacatcactctgtcgagagatgaggctactcctggttctcgaaccagtaggccgtagcgatctctcgtacctcgacatcactcggtcgagagatgaggctactcctggttttcggaccagtaggctatagcgatctctcgcacctccacttcaaatggtcgagttaaggctacacctagttctcgaccagcggtgtagcgattctcccactatttccacttcaactggtcgagttaaggttacacctggttctcgaccagcggtgtagcgattctcccactatttctactttaagtggtcgagttacgactaccacctggttctcaaccagcggtgtagcgattctcccactacatccacttcaagtggtcgagttatgactacccgtgatcctcgaccagcggtgtagcgattctcccactacctctactccagcaaagttgatatcaggtacacaacatcgccaagtgttttacccagagatcccttaccacgacaacacctagagttgaaaccaatcctactgtccctttacgccgccctggcaaggcctccgaggaacctaagggaacttcggctggggacgcccagagtggataaggccttgtcaggtaatgcagagacgaacgatcatgtaagatctggtcatgtaagagttctcaccgtgcgtattaaccaagacgtgtaatcggaaattgagtttttcaacttcacggctaggggctagggtaagcgctttttcaacccaaggcaggtcaagggtccaagagccttatcctctgagaacgattctccgacgacaaggcttgggggcaagggagagtgtatgactcaacaaaatggactgatcgaagtcggtaaaagagaagacgctcgtacacaaaacattggtctcttaatttaatttcatttttcagttttccatacatattataacatgtcaccctttgaggcgttcgctcggaggctatttctatcgaatattcttttatgagtattgatttcaggaaaattctactcgacattgtcgaagactccatgtctctatggttctacaccaagatcgactaaggcgagcacgacaaatgttgacaaggctccatcgcagactctgcgccttctcgatcactcgagaacggttgatggatatcgacaaggaatacggaatgaagaaatggtgtacccgccgagataaaatttctagacttcaatccaaattctcgattacagcaagacgggagacttagtcgtatgctctgtactttcttggttgatgtcagagattgactcagacaaatcctatacgatgcccgcacgaggctgataagggaagtctaacgttatctctgaactcagcgataatggtcacgtgagctcgataacagttattccgaggtcttcgaattgggaatatgaactcgttcatttgcgttgaagtcagggctactgtcaggattatggataccacatacctaatagtagttgactaaatctcggcaggacccaccacatactatgtcttatacggaaacaaccttcggatataggaggagttccgcataaggaaggatgaatagagttctacatggaaatgacaaggactactcggattgtattcatattggtttccctagttctacttggactagggtacacctataggtataaatacaagaccctctaggaggagaggggacatgaaacaatagatcaacatacaagccaacatacgccaagacaagtgactggatatcaacatcggagataagcttagttgtcacaccctgaagttcttctcccaagcctaaattaattaataaatggtctcgagaaattacctatgtaaaagtaagagagaaaccctaattgaattaatgcaaataataatcggaaatggcatgtgggatttttcttgagttctacatgtcaaaatatgctaacaggatttttagaggaattttcagagctctacaaataattataaccaattaaaaatgagcacgagcaattatttaatccctgaaaattcatttcccctttttctttttcttttttccctcgttttccctaatgggtcgccggcccattctctttccccctccgcctccccgctgggccggccgaaggctaaggcccagcagccggccgcccgagcccctcctcccctcgggtcaccgacaggtgggcccacctgccgggcccgtccccaaacctccggccggcgcggcccgcgcccgcaaccgccgctcccgcctctcccgtgcctcccgggccacgccgcccacgtcgccgccttccccgcgcctcccgcacccactcactctctctagcccacacccgcgccgaaacggccgagattcaatttttgaatcccgccggccactccctctctccacctccccactactccggtgaaatcgagccactcctagcttccccgagccccctcttcccctatttaagcaccactgcccctccctctctatttttccccatttcgcagagctcccccgtgccctcctcgccctagcgccatcgccctccttccgtcgccgccgccaccgctccggtcgccgctagccgccgcgccgagcctcgccatcgccgccgtcgggttcacgagcccaagggccacgctgtccgctcctccgccgccgatttctgccgccggagccccgttcgcaccgcacgccggtgagcttcgccatggccgccaccttcagctggcgtccccgccctctatgatctctctctctccctctctaatctttcccattgtgttccttaggtgatcccgaatctcgaccgctcgtcgccatcatcccgccgctcactgtcattgatcatcgccggtgaggaactcctccccttcctctctctctctcccacgccgcttagccgccgcctagccgctcagccgcccgcgccgctaccactgcgccgccgctgcgtcgagccgcgccaccgcgcgccatggccgccgggccggcttgagctgggcccgtgcgtgccggccgcgtgccgccccctccgccgtccgatccaccccgagtggattggggccatccatccggccgcccgcgtggtcgccacgtgtgcgccacgtggtggatccctcctccccggtcccgtggactcagtccaccgtggactggcgcccttgagcctatgacatgtggggctcgcatgttggcgccgcccccctctctccagggtttaattgttgcacaataaatcaattaaggatttttctgtttatagtaaaaacatagtgaatcttctaaaattcatagaaaattcatccgtgctccgtttaagcccattcaagtctcagtaaatcaagaaaaatacaaagaatccattaaaaatggttttattctctgtttcagtagtcttatagcctgtttgtattgtttgctttgtatatcgcatagattccggctctcccgacgctccagtgtactttgacatagtcgctgagtttcctccagccgcagggcaaggcaagtcatgcttgtcacttgaacatgttgatcccatattgcaaatgctctattgttttcctttaaatacaacattgttttacaatgatatcatgggatgattaccttctgtctcagccatactatttgttaccttgttcctttgttagcttggggatataacatgattagatgttgggttagggattgcttagccatgcttagttcaactagcacacaatgggggaactacattaatgcatagttttcagattctagtattggtgttggactagaaccattgctctggtgttggttaactaaaatatactaaatggtggactgtgggtgcatggttttgatggtcgctcccatggcaattaaggaccggttcgcgggatgccctggaagaacttaccgtacttactacatgccagtgtgggcaacggttgggcttgtagtgtagctttcctctagctgacgcatccaggcaagggtgagcgtgatgaagttcggatgggccctgtgacggcctatgcggctttcagattcacctaggcacgagaggggactgcccgctgccttgcgaggagtgggggtgaaacctgaggtgtggtgtgtttggttagagcgggttatgcgaagggtcctgtcacggcctctttccggtatgtcgtgttggcatgccggcgcacggtaacgtgtcgtggggctgtgtcttgtgggtacagttgaacacctttgatcagaggaaaagtattcgaatagccatgcccgcggttatgggcggtcaaccagattcaccgtgattagtctcaccctagcttagtctaatggaattgattagttcaggtggttggttggtcctgttgcaatgtggtgtagcgttggacagtggatggttaatattaactaattattacaactattttactgttttcaactactgtttataaatgctagctttatgcaaatgatcgaaagcaatattaaaaaattgaaaacaaagaaagcaatacgcatgtgcatcttttctagtatattgaaaaactgaaaaccaagtggtttcattccgtttgtcacgctagagacgacaaagaaaagggtaaggcgaacagatagctcgccgacgcattgtgaagaagaggatagctagaagatgcagcttaaggcggaggcggagtgcagccagcttgggagaggaaatggaaagaaagcgacgtttccggtgggcgcagagatgagtggataagggtggggaagagataaggtgttccctgctttagttgcgcacgaacattagtgaaagagacttatactcgcctagcttgcattcggcatgcatctacaaccagtatagttgtttcttgaaataattctgttctgcagcgctacctagctcttgagtccttaccagctagccgtacagtcttgcaggcgtgcggcggggatcatgtcgaagggagcgatgggaagaacttccatcatggagaagcaggaggaggcgttgaaggagtgggagcccctccatgagagtatctctaagctgctgaagggtggacgcatcaccgacgcccgcgaaaggcacagcttggcattcatggagatggaactgggcgtcattgtcgcatacctgaggatgccgctgccaccacacacagattgtcctggtgtcgatctcatcgataaccagatccagtaccactggagttactacagggatgtcgtgatatctctgtataatcagtacggagaagaagcacctaatgcggggctgctgcgaaaagccatgcggtgcttccgccgccgaaggtctttagagtataacattccgaggacagcgtacagtctctaccgtgagtgctccagtgatccacgcctcgagctcccaagctcggagctcatgccatcgccgcatcaagcagcccaagttgaggctggtgccctcaatgatcatcttgttggcatcgacagcatggcaaacgagatgctcagatggctcatggccaccgacaagggtctccgggtcatggccattgctggacccgccggcattggcaagaccacccttgccatggagctccaccgtcgactcaggtgccaaactcaagaatattatttccagtgccacgttgtggccgctaacttcccccggaggccttacaggagcaagcttgttcttcaaaccatcctgaagcagatcatggagcaactggatgcaccatcaccaaacagctcggaaatcaccatgtccatgttggaggacaacccggagctgttgactcgcaacatatcagaacacctcaaggataagaggtaaacagcattcagctgctatatgtatacagtacttatttaggacttctctaccagtgcagcatcagacctcggattcttttaatattttctcttcgtattctccctccagatactttgttttgattgatgatatattagacgaatcagatttggaaataatcaagggtgcatttcctaataataactgtggtagtagaatattgtttacggcacaacatgagtggatagctgggtggtttttgtctaattataatggggttgtgcataagatgaagcctctgaatgactcggattcagagaagctacttcgcacaaaagcttttagttccatggatgatttacttccagacaatcttaggctattatgtgatgaaatcttgaacaagtgtagaggaataccattgttcataactggtatggcagattggttgaaacaacagcaacacggcagctctgcagttcttagggtggaacaagtacgcctactgctgaaacagtttgaatactggctatcatttgattacagttatgaattgagcctatcgtcactctatctaagcatgtttccacagggatatgtgtttgataaggatcatcttgtcatgaaatgggaaaacgatgggttgatccgtatattggagtctagttcagaatatggagagttgtatttctctgagttggtcaacacgaacatcattaccccagtaggagagaactatggacccaatcttgatgaagatgaattgtgccagtggcaggtcaatcctttcgttctgagttttcttgcctccagagcagccgagaagggtcttgtttttaccagctcaacactcacctcattaccaagctgtggtggcaacaacactcggataaaacggcgcctagctctccaccaccctgatccgctactccccgaaatgctgcaacaaatggatttgtctcatactcgttcactactcatatctggtgcagtcgacagaacaacagtccctctagacaagtttggatatttggtgtttttggatcttcaaggctgggagaatttgaaggatgaggacctactgcagatatgcaaaatgtttatgctgagttatttgagcgtcaggaacacaagggtcagcaagctcccaccgcaaatcaaggagctgtgcaacctgaaggcattggacgtcagccaaacccacatatttaa

SEQ ID NO: 12140 - DNA, 1403 bp, Oryza sativa
tgtacatatgtggcccgcaatttgcgggctaccatcgttatattttctttcatatattagtatgtatgaattatatggtggtttaaggatatatatatagacacacacatgtaaataggtgtcaattaattgctactaattagacttctaatggcttgctagcaacatatttaatttctctctacatgtatataaacatggatgaagctagaacgaatattaacttatatcccatacatatatattacatggttaatattctaatcacatgtggtaagtccattaaaatttcttaaaatacccttaagctgccatgtggtgcactaataaattagagaaaatattagaaattctaaggaaaaaaacaaagtaattgatcttagaacaaactaaatactacgaggtcccacctctccaccttgggtacggacctaagtacgtgggtacctacgcttcccctccaccttctttttctccatgtatacgcttccctcctttccttactatatcatgcgccttcatgagacgatttaatcgcaagaattttgagtatcttgctctcgtgttttttatttgtagccatactacaagtaatagtttattaattactcgagaaaaaaacatgattcaaaagtcgtaagtacttaatctattttctactcaaaagtttgtgaatggttttttaagattccttaagaaaaatagaacccttaaattattaaaaaaatattacaaaataatagtatccgaacacttaatctataaaacaaaatttttaaataaacaataaaaatcttatctttcaataatataagtgcccgtgcatgcgtgtgggccatcttcctagttggattaaaaagaaaatttaaaggaaataccgttccttgtttttcaaattcctgcatgcgtgcatgcactccgtcggtcacgataaaaaattcgtagcatgcaatttggtggcatccagtatatactaaattcctctctagtagcatttaatttcgtggcatccagtatatactaaatccctcgttagagtactggggatttactagaacatgctaataattaacgatgcatatactggttcattactgcttcattcgtctagcttcttggtttgctccatccagaatcacgttcatcgccagcgtgtacagctaccgttggatcaaattaatatacaatcgttcggctggtaattttttaaaggtagtatagtattgttttttaagcaacagtggcggaaccaggatctcgatacgtctggggctcaaattgaaggctttttaggattatggataccagacacctaatagtagttgcctaaatctcggcaggacccaccacataccatgttttatacagaaacagccttcggatataggagttccgcataagga

SEQ ID NO: 12141 - DNA, 6352 bp, Oryza sativa
tatgttgagtgatatgacccgaacgaagtacgttctccggcggatcgggatcttcgtcaagcttcgccaagtcgtcgtcactatggattttttgacaagggatacttcaactactttggatctgggaagtcaaacccaaccagagtacgtgccccgacaagatcggaaccatcattgtcaacaatttggtctatcgagatcatccaagcctcaagatacgcggcgtactaaaagacgtcagatcgtataatgtacaatgagtacgcagtaaggtaattggtggattggttttttaaattaatctactaatttcgtagatacatccggcatgtatctataaaagtacgcaatattttatatgcaatttatcgtacatattcagatcatacaacattgtcagatctataatttattatgtttacctagagcatgttttttatacaatatcaattatgcgagtgcttctgatgttaggccaactacggtttaatgctgggggctcgctctattttcttccgtataaatcatgcttgtttacggtttacataatgcctgatatttaatctgctcgttatgtcctgaaaatactagaagattcatgcaattttctaagtacatactcgatatgatctgctatatatcttgccttctagaaaaattttcaggaacaattgagcactcgagtaggttgtggtcaaacacacacaatatcgagaactttatcgataaatgcggagttgtcgcacccaacctaccaacgaagaccgacgacctatctcatagcaccggccatagctgggctattcgagaaaaggttgttaacggataattcctcgtgaacgttgtcggcttgatcacacgacatgattgcgaatggatatccggatatgctataagttgggtatgtgagtcatgctggccacatgagatgcacatgtaataaaccaactttagcgcccctataggtgattgagagacgcctactcgttggttctcaaccagtcaatcgtagcgatctctagcacctcaacttcaatcggtcgagagactcctactcctggttctcgaatcagtaggacgtaacgatctctcgtgccacgacttcagatggtcgaggtacgactacggcaatagcgtagcggtcctcgcaccacgacttcactcggtcgagagatgaggctactcctggttctcgaaccagtaggccgtagcgatctatcgtaccttaacatcactcggtcgagagatgaggctactcctggttctcggaccagtaggctgtagctatctctcgcacctccacttcaagtggttaaggctacacctggttctcgactagcggtgtagcgattctcctactatttccacttcaagtggtcgagttaaggctacacttggttctcgaccagctgctgtaacgattctcccactatttctactttaagtggtcgagttacgactaccacctggttctcgaccagcggtgcagcgattctcctactacatccacttcaagtggtcgagttatgactacccctgatcctcgaccagtggtgtagcgattctcccactacctctactccagcaaagttgatatcaggtacacaacatcgccaagtgttttacccagagatcccttatcacgacaacacctagagttgaaaccaatcctactgtccctttacgccgccctggcaaggcctccgaggaacctaagggaacttcggctggggacgcccagagtggataaggccttgtcaggtaatgcagagacgaacgatcatgtaagatctggtcatgtaagagttctcaccatgcgtattaatcaagccgtgtaatcggaaattgggttttccaacttcacggctaggggctagggtaagtgttttttcaaccaaggcaggtcaagggtccaagagccttatcctccgaaaatgattctccgacaacaaggatgggggctagggagagtgtatgactcaacaaactgactgatcgaagtcggtaaaagagaagacgctcgtacacaaaacattggtctgtaaatttaattcattttcagttttccatacatattataacatgtcaccctttgaacagttttccaccacacatcctatgtcttatacggatacaaccttaggatataggaggagtttcgcataaggaaggatgaatagagttctacatggaaacgacaaggactactcggattgtatcaatattggttttcctagttctacttggataaggggacacctatataggtataaatacaagaccccctaggaggaaaggggacacgcaacaatagatcaacatacaagccaacatacgccaagacaagccgccgaatatcaacatcggagataagcttagtagtccccatacggtacctacgactaccgtcaggagggatctagcactatctttgatctcgccggacatggattcgaggaggaagactaccctgttgtcgattacgtgtctgcacttcagaccgccatattgataacagatagataggctaccccaaatattgttctggtgtgattatgatgaataagagcaacgaccggcttcggccaacaggagtagggttattacctgacaatttaagggcccgaacctgtataagaatcctcgtccctatctcttttacctcagtctcgcatataccctggtgccaatgatccccgtactatgcaaataccggcaaataccatagtcatgacatcagacatcgacaaggctaacaactatccatgtcaattcgtacaaggaagtacatacagtacaagaactaaaaaaaatgcaaaactagaatacaatttctaaatatgcaccgaagtactgtaaaagtgtagaaaaagtacaagactagactaaaattttattagaatacctaatgcgatatgtcttcataattttcactcttcatcaacagaaggtagagaacctgaagctaaatctgaaaaatgatattatataatgtaagtgatacaaattatgagaacttaattatttgtaggttacaaagcaatgcatgacatacctctaggtaatttgtgcttgcgcgtcctcaaagcatgataatgttctataatctgatgatcttcaatgctagtaaaaacatcccgctcaatatagcaaatcatgcagtgattcatccattcatcattcatcttgttccgcagctcagttttaataacattcatagctgagaaggctctttccactgttgccgttgcaacgggcaaaatcaaggctaattcaattaagcgatataccaatggaaaaactgtgtgtctatcagtttggaccatcttagcagcaagtttaccaaggtcagagcagcttgagaaatccaaatcagatctcacattagagataaatgtgtcaagttggtctctaaggactaaacaatcatattcagaaaagtcatctgcataaatcttagcaagttcaatgagcttatcttcatcatagttggcaaaagaattccttggatcaaggcaagcaatacatctcaatagctgagtagacctttcagcaaaacgattgtttaactcaacaataatttgatcaagtaccacattaaatatgcatgtccggccggccgctcgccgccctgcgcagtcgccactctccaatcggcaatcggtgatgtgagagacagggaggagatgaggagagctgagaacgtgagagaagagaaagaatgcgaagcggcgctcggtgatgcgggatacggcgtgatgcgagagagagaggaggtgggattagggtttgtgcatctattgggttgggctgatgggctgctattgggctgagggatgtggggctgaaacaggccatgtgtggggctgggccttggggatttggggaaatctgaaaaaagtcaaggtactagtccactaaaatttttttcacgagtggggcttgcgcccaagctgccctaggcccagttccgcccatgttaagtaagaagcagtatgcacgtactgttttttaaagttagtatagcaatacatactgttttttagtttgatagcagtacatactgtttttagtttaatagcagtatatactgttttttttgttagtaatagtacatacttttttttaagtagcagtatataccggtttttagttagttgaagtacatactttaatagcagtatatactttttttttaattagtagcagtatatactgcattgaagatgttcatctttcctttttttttttgaaggtatacgtttttttatatacctttattggtgaggaacattatataccttttttattcggtagaagtatattttttatttagtagcagtatgtacttgtcatgacacaaaacaataaattttaagcaaagcacatatacgtggtatgatatattgatttttttatgtaagccacatactgaaatagaccggttgtatacctagacctgaaatagagccggtatataccatttagagttcataagtggtatgtgctattttctttttataagtagtatatatatactacaatcctcatcggaggagtatatacccatttttttcagtatatactacccatgaagcaatatatactttttgaaagtacatactgttttttaagttagtaacctcatatgcacctcctaacaaaatgatttcattacgtaaagaaccgggtcaactttattgtagctataattaatgtaacaaacgggaagtaacccactgaatttttgaaacaatttcttgtttccacatgaaattagttgatctcgtagtaacagtaatcaacagcagattaaatagagtacaattatgacgataatggagtaaaattaagaagagatgatggcaaattagatcaatacacgcacacataccaatgactataatctgaaacgaaatcacaacgaatggaaaagcgcgtgtttctaccagacaaatcctgctattcgttggatggtctgccgtgatcttcgatcggagggggacttgccgttgccggtgctgtaggcagtgctgtgatgtcgccggcgccgcttgctgccgttgccgtatgatttcatcaagccgatggatcgtgtcgtcgcctcaggcttgccgatgggctgcgccacgcacgcatggaccctgatcgatcgccgatcgatggatcgcaacgtggccgtggacatcaatcgcgatcgagcgacggcgcccgtggacgtcgatcgaatcgctgccgtcgacgccgagttgtcgaaggatctcgccgtcagctccgacttgctgatggactacaccgtggatgccgagtcgccgattggtctcgccatcgccgctgccaccgaatcatccgtagatcgcgttctcacctaggaacccgatttgttgcgatttggtttagcagtaccgcatgggaacgagagatttattccagcgttcagtataagcgcggcttcacgccacgcccgttaatgtgcacgttttaaaagtaactaaatgaaatgctacaatacagcaatatataatcgagtagatgagtcaggtggtattccaaaggaaaataggacacttttttgggagtgactgtggatcggtcgtccgatcgaaaacttcaaaaatcgggacgtcagcgtccgatttacgtacaaaactattttaaactgatttttctcttaaattacttgtccaaatcatgatctgattgcaccattaaactcgttgcaattaaatcttcaaaacaagaccacacatggatgtattccgacgaaatttttttttacagtagcttattattgtattatttttaaattgtttgcacgatgttccactaggtatatcagaattgtttcactaagatcgaaaatgtttcactcgtttaaatcgggtgttgtttcaccttatataaaaacaatgtttcagtaaatagcgaaagaatgtttcagttcactgcaatattatatctatacatagtgaaacattgtgagtacattgggtgaaacatttttcggtggaacaaaaaaataaaccaaattctcttaatagggggtttccaaaatatgtgagttttttgttgcaatggaatgtttcgttcactgcaacattagatctatacataataaaacattgtgagtatagtgggtgaaacatttttggtggaaaaaataaaccaaatttccttaatagagagtttctaaaatatgtgggtttttattgtaaaagagtattttaattcactgcaacattacatttataaatagtgaaacattgtaaatacactagatgaaacatttttgtgaaaaaatgggagagaagtaagtgagccctgtataggcacatatggggaggggctcggg

SEQ ID NO: 12142 - DNA, 4279 bp, Oryza sativa
ttccccccacgcgccgggcgcctgacatcgagcattctcgcacttttttttaacgatagtaagaataattgtttgttagttagaaagaacaacagtaagttaaatagaaatgaacgcgaacacgcgacgacacgccgcgcacacagctgcacacaaaacatgctttaatcaaaacaagcattaaacacatgttacctgttgtcaaccaaatgctcatcttttgtttcatttataggttacaaagattgcatacaagttaataccacacttgcgcacacagtatgtcttaatcaaagcaaccaaaaaacacgtgctagctgttgctgatcaaatgatcacctttagtttcatttaggtttaaaaggtcgcatataagttaataccacatgataggtaatgaccaatccaattaagaaacaagtaatcgaaaccatgtcaaatacatagaccttatgaacttgtatcgacaacacaactgcgaacagatacaattatacaaatgaatactccttccgtttcgtaatataagtcattttagcattgtccacattcatatatatgttaatgattttagacaccccattaccagacttgagggcaagcctgtgggctgagatattttttgtcggtcccgcagacgacctacagaaataatgagtttttgtgaaggtttacttatacctacagaaaaattggtatatttctgtcggttgtggctaggactcacagaaaaatcagcgctgactggtgggccatataaccatcgtataaaacttgctcatccaaccgaagccctaagggtgtgtttggataatgggaaatggagagtaggattgggattggaaaatgaatgaagggttatgattaaatggaagaggaagaatgaatggttaggatttaaagataccttttgatgggtgagaaatcatttcccaatcccgttatcgaaacaatgcctaaattttttcccctcattcccagtggctcgccgccactactcttcctctctctctattctccctgatgccggtcctagtgtcggcgcctccgatgaacggggaaccacgttgctgccctgcgccatccacaggccctgtcaatctgccatccgtcgctgctcatctccggtcgacgacgagcctccgccgaccctcccccttccggtgaccggtcctagccaccatggactcaggtgctccagatccggacaccctgaactcggaggtcgcggatccaaccatcccgagtttgggtactccaaatcccacgaccctagcttcaccagctccagatccggcctcgaggtaagcggtccgccgtccctcacaccaccccgcgtcgtcgaggtcgacctgccatggggagagcaggcgccagctattccccttccacccgatcctcggtagtcactgcctcatctcttttaatcaggttagtggtcagtaaaagccgcccttgcctttccttgtgtccagatctgagttggtgcatcactaagatctgttgctattttccttgttagacctcttagcataagaagttttttttggtgtgtttttggatactctacaaatcccccaatttctatgctagctgaacaaattagacctagttctttctacgaatcgtgagcttcctgccagttgatgtctttccatctctttaggagagtatttaactactgaaatgcatagtgcatagggaggacactatgaaggatgggtgaaagaccaaggaatattaatgtgaggtaaatttatttttggcttctcactcagaatacccccattttattttgctgttttgaagcagcttatgttgagatctacatgcaaaactaggaaacggtgatttgtttgacatggaattaacctatcagtggcttagaaaattatgatactagctttatgataattttaaaggataatatatctggatattattctttttttatagaattggatatagaatttactccttatcatagactatgcttttattggtcacatttagttagaatttagatgttggttaatatcttccctagaaaaataaatctagttagaatgcagatgcagatgcttttcttatgctatttttgccttgtcattcatggtaatgattgtgtgaatgatgaacactatagtgttttgctttctctgtttcaggaacaaacaaaacatttatttagctctgtttgtatgtatgaatacattagtgctttccagtctcttgtactctggtagtgcatatacatacttcacacgtctaaatccatgtatatcttttggcaagacatactgatacatgtgttggatatatacatgccatctaaacaaaattaatttcagtctctttgtttttaaaattttattatgtacaaaccatttataatttaccttagcttgcagcttaaatgccgcagttaaatatctgtagaacgttgtacaacatgaaaaatcaaggtatgcctctcatccaatatctaatgagtttgatcctagcattcatgtcttatctgaattggcagagtactactggaataattgtgaggtccacttatcatttcaagtgtcgtatttcatttttcatgcttgtacagataaatttatcttgctcgcttgttatttattttgtaatgatgaagaaaattatgccaactgaacctcttttttaaaacctttttggtttcatggccaaggttgaagcaccacagaacttggattgctgctggaagacaatttccttgtacatgtatttgatgaatacaattgtaactgaacacattgaacttccttgagtaactgaacacattgtacatgtattactaactctgatttgaatgaatttgttggtactgaacttggatggactattcatgtaagctttgaaagcttgaattttgatgtttgaattgagattgatgttcatatatttatccaaattggcatgtgtattatattcttttcttttctttttttttttgggcgtggaacacattttttctgacggtgattgatggtttttcctgacgggtccacgtcacaattaacatttcacaaacctgacgccagttgatattttctgtgagccaaccgacaggaatacccgacagaaaaatcatttctgtcgggaaaccgacagaaaaattgaatttctccttggtcttttttctgtcggcgatttctgatggcgcacctacaggaatacattttctgacggtaagatcaatttttctgacggtttcactcctacagggttggtcctaagtctggtagtacatatatgtttagattctaacatctacatgaatttgggtaatgctatatgttagcggtaacactatcaattcactgtgttaacaccttgatctgtctttcatgtcagacgatgcagaaacctacccacgacaataattacctaaaatattgaaaatatttgtcataattttatccatgtcaagccttttccttagagtgcgcatcatgctaaatgcattttccttataaaagcattctgcaccaccttcgaaatctccgtaaactacaagcatcatgtcggggggaacattttttggaatattgacagcaaggaagcatactttatgaaattagtcttacctaggataatggttccaaaaagggaaataatgatcaagtgctatctagatctttcaaaaaacactaacaaatgcatcaacttcaagcaccaaatattgaatccatcttgtacgaccctcaaggataatcaaatcaatttttcaagaacaccccaaagtaaaaaagggcaaatttccaatgtgaatagcagccttgttctataaacttttcccattatatatgcagtataagcccttcccccttatatacccaacaagggcatgcttttcctgcatacaagagatccctatcctaattaccatagttaacaaatctatgtaataaacttatctgttttttatgctgcaacataagggcatgtacaatagttgtcaatagtggtcttttagcgttgctaattaggaatacttattgacatggaagaaaaagaaagaggagagacaaaatatcgttgtcatgcataacaacagcttaacaatgactcttaatcacaacaatatggaaatattgttgcatgaaggtaaaaagatggaaagaatattaacaaaaggaatattttttgagttaatgattagagcctttgtcgtctcaacaattataaagacacggtctctaaataatcttatattgtttaaaagatcatactcgtatctgccatt

SEQ ID NO: 12143 - DNA, 3109 bp, Oryza sativa
caaatcacgctatgcagctaagaaaaaaagtggaggcaggcctgctctagggcaaaaaagatcaagatgataaagtgctgctgaatagcaaatacaaactcaattagtgccagcctttatttgcagttgaaaactattatcagccgatgaatcagtcaatctgattgttgactttttcttccctgcataaaccgaatgtgtaaatcacttgaaacaattttatacactgatcgtgtcctcctaaggagtgcatatctcctaatgttttcccagaggaaaccataatgttcttgggaaaacataatgttctttcactactacatgattgatatttctggaccccgccccgcccccctcccccaaaattttgtttccatgcgatccataagtggaactgcacagaaaaatggggaaaccggcgctagtctatcgtccgcacaggaaaatcaattttcgtgtgcgggtcacttaacaggcctgcacgcgaaaataaacctattttcacgtgcgggcctgttaactgcgcacgtgaaaatactagccagatctcgatatccttcgccctccgcgcccactgggcgaccactgctcgatattctctgccacctcactctctccctctctcccactcctctcctctcctctcccagccggccggcagcgacagcagtggcggcggcccctccctccctctccctcggctgcaggcggggagaagggcggcgacagcggcggcagcccctcccttcctctccctcggctgcagacggggagaagggcagcgacagcggcgtcagtgggcgaccatggcggcgcccggcccctcccctccctccccttgcagatctggcggaggggaggcatgggggcgacggatccagcggcgcggatcttttggcctatacttgataaaccattcaaaaaaaattatatctgtgttatttaaaatccaatgctaaaaaaatacgataacaaccttagaattaattcaaaatcgcggctgataaccaagaaacgtaataggagtcgttgatgattaacctatattgtatggacataagatgaagagtcgttgatggttaatctatatctatcgaggttccggaaaagctaacgcgtgcgccagcgcgcgattccggaggaatcaacgtaactaactcggttagtttagaataatgacgataattaagaaaatattttattttttttgggaagatttttttactaacagattgaaaagaaatctatatgtgaaagaaactttcacgtaaaatttaaaacttttaactcaaaatttgaaactctaaacacaattttttatattttcaactcaaaatttgaactttcacttcagatttaaacttttaagtcaaattttgaaaattttcaactcaaaatttaaatttgtaagacaaattttgaaaactttcaactcagatttgaaaatttttaactcgagatttgaaaactttcaatttgagattgaaaactttcaagtccatgtttgaaaactttcagctcgagatttgaaaactttcaattcagattttaaaaaatcgaaaagaatgcgatcaatatggaaaatgcgccgaggggaggaacgtcaaaatagtgaaaaaaaaatcgcaccaaaaaaggaaaaaaatcgcgctgaaataaaatcgtgaaaaataaaagacacgtggcacagtggagggcgcgtgcgccaattaattagcagatccctgtaggttcggttgatctgctttacccattttttcagtttcttctttttcccataatcatatttcctatagtaatggaaataatatggattgggtgcagtgataatgataaaatcatgaaatgagcatatatagccaaatcttggtcactaagctagggacgaaaacggttagaaatgatcaaaaacagtattattttcttcattgttttatgaaaatggtatcggtatggtcataattttttctatactagcaaaaatgcccgtgcgttgcaacgggtaaaaaaattctaataataatatacgtttttcatgcataatcatgtcaatgacaatgtttctattttaatgagcggcttgtttttttataaacagtgttttttttcttgcgcgattttctcaaaccattttctgaaaaggcgcatttctttctaacagttttctcctaccatgtttttttttcgcttttttcacttacgaagaaaaccatatttttctcctttttttgcttttcttttctcgtgtgttttttcttgttttctcgcacgtttttttccttgtttttttcgaaggttcttttttgcttttttttctaatacaggagaatatatgacagatataaaaaatacagggactcaaatataaaagtacaaatctaaaaattaaaatcatataaaaatgaaatgctctcagacatgtagattccgtttttgcaaaccgatcttcaatccggcacatcaatttttttcaccaatctgagtcagacttttttttggcttttctttttctttttatgcacctttctgcctttgttctctttctcttttattttttttaacaaaaacaacctcaagtagcttgttgcaaaattatagggactcaaatgcaaatataaaaattacagggactcaaatataaaattacaaatccaaaaattaaaatcatataaaaatggaatgctctcgacatgtagattccgtttttgcaaacagatcttcaatccgacacatcaatttttttcaccaatctgagttagacttttttttttggttgatataggagtcaaacttttttttttactgttaaggatataggagtcagacttattttttttgtttttttatcagacaaacatggctttttccgtcccttgttttttcggtttttttcggcttttttttggatcggactctgtccggtttttttttggtttttttttgccttttttttcctggatcggactccgtccgttttgccttttggtttttttcgccccttttttttttctggatcggacttctttttccgttccggtttttttatcggacaaacctggttttttctgcccggttttttttacacggtttttttgacggacgatggaag

SEQ ID NO: 12144 - DNA, 9619 bp, Oryza sativa
agcccctaaatagcaagatttcggagggctatttaatagcccggaggatccaaacagagcctatgtcttattgatctaacacagtagagtttcaagtatgatcattcactttttttcacgagattcatgttgattcgcattttaggccctgtttatatttcaccccaaaatttttcaccctatcacatcgaatgtttaaacacatgcatgaagtattgaatatagacttaaaaacctaattgcacagattgcgactaatttgcgagatgaatcttttaagcctaattgttccataatttgacaatgtagtgctgtagtaaacatttgctaatgacggattaattatgcttaataaatttatctcacgttttactgacggattctgtaattggtttttttattagtgcccgaatatctcatagaacaccctatataatatccgaagtgacagtaaaaattttacacccttatatctaaacaccccctcaaacaaaaaaacatcgcaaacttttgacaggaaaactaattagcgcgtacgcgccagatgagttagcggcacgcacgtacacgtgtcgctcacacagcgcagcgctaccgttattataagtaaaagccggaaaccagaagaaaaaaaggtgatgcgtggttttttttttcagattagcgagattagtgctgattttttccagaataattaggccgtaatctgcattcaatgattttacataattcaaggatttcaatgatttttaaaaaatcgacccaaaatttgaaactttcaacactaatttaaaaactttcaacttatatttaaaaatttttaaatcatattaaaaactttgaagtcaagatttgaaaactttcaactcaaaatttgaaactttcatctaaaaattcaaaaactttcaactcaaaatttaaaactttcaactcaaattttgaaatctttcagctcaaatttcaataactttcaactcaaaattcataattttcatctcaaaattgaaaacttcttatttgaaattcaaaactttcaacttaaaatttaaaacttttaaatcaaatttcgaaacctttccacttcaaatttaaaactttccactatttttgaaaagttttcgactaaattaactatatatgctttttaaagactaatgctaatgatggtaattaacgctaattgtcgtaatttgcggcacgaatgtcgtagcactgtagcaggggcgcgcgttggtgggctgaatgcccaggagtcggaatgaggctgctccactggtgtaccgtataataaccaaaaaagtgcgcgctacatattctactcgcgaatccgcgcgaactaggtgtcgcgagaggttgatacgcagtcactgaagtccccgttcgcaaaagagcaaaaacattaaccgcacgcgcaatcacaacgaagcctctctggtcaactctcacccgcacgtacgactacccacccacccacccccaccgaagctactccaaaccagtataaccaccgggccccacgcgtcatcctcccgcgcgtacgccaccgtcgcgtggcaaaagttcgcgaccaatctatacctcgctcgctcctcgctagtccaccaccgcacctaacagccgccaacctctccctcgactcgtcgtcgtcggcttcgattcgatcgatcgaggcgaggaggaggaggagctagggtttcggatgggaggaggaggagggttgtagaagcgcgggggcaggctgcggtggatcgtcgatgggggagcagccggcgcggggggcggcgtcgtcggcgtcggagtcgtcgccgctgatcccaccgccgtcggagatcgacatcgaggccggggccggggaccagttccagtgccggatctgcctcgagaccgacggtacgcgcagatccacccccccttccgcccgcgaggcgcgaccttatcgtgcgagggggatctgagtgctttgttggctcggtgcgtgtgtgtgtgggtgtgtgcagggagggatttcatcgcgccgtgcaagtgcaaggggacgtccaagtacgtccaccgcgactgcctcgaccactggagagccgtgaaggtatgaagcttttgatccctcgggcctccccgctgatctcccgcccatttcattggttgcacgttagctgttaataaattgggggagctgctgtttgctgtgcgctgagagaagttggggggttgtggcattcttggtagataagataccatgtttaaacctcatttgttgtgataactaattttagcgttatatgaatgctgtgcctaaaatgtagtttaggtgcgatttgctacaatttaagctatgattcttcataacgtagagtatccagagttgcctttgtcaacatttacgctttcaagatacatattttaattgcacaaaaattggcaggtcaatgttattttgctaagctttgtttcgtaagaaaactaactttgcttggcattttctttgtctcatgtacaggaaggatttgccttttcgcattgcaccacttgtaaagctccttactatttgagggttcatgttcacactgataggaaatggcgaacattgaaatttcgtttcttcgttactagagatatattattcatctttgctctagtgcagtttgtaagtccctctagatactctttgttagttctcgattgtctttattctaatgaatgataaaagagtttgttttttgttatttatttgttcaggtcatatctgcattagcgtatttggtgcattttattgatggattacagaattactggttgaggacagcctgggcatttgacaatgaagttagtttttattacatatgtggtaaattactttatcatatcaaacttgttatttcttgcacttagttttgcatgattgtttgatgaaattgtaccctgattgaaataattatcatgatagttcaccatgcatccatataactcaatcacatgggcgctgtaggttttacaaggttaaatgtgcagtgcgtacacgatgaacctcaatggctcaatcttgtttcatgtatgatgggtgagatgggcttgtaaaaaggaatttaagtgtagaaatgtgatatgagagtgaatgatatatgtatcgaataggaaagagcaagctacttttccctgtttaatgcatggtaattgttgtcacttgaatatgttatagtttgcttgtgacttattcgaggcatgtgtccttcgaaaccaagcacctctgcttctaatttgctataaccctataactaacaagaaactcctgacatgagctgctcatttcacccatttttacattaatgccttcagtttgattaattctgagctcttgctgaaacatcgcaatgaacagttttatagacatctagttaactttgttcggctcaataaataaatgccaataaattaactttgttcggctcaataaataaatgccaattatatcaaccaaactacctgagtgtagctcacatggctggattaatcaggaacacatgttcgttacatggttgagttgttgaactttctttgttaatgaggtgttcacaagtgataaagatgaagattaagtatgggcacgcaaaccaagaaagccattaatacatgattaattgaattttaattattttaaacttgaaaaatggattttatcgaatattttacagcaacttctatatagaaagttttcacacgaagcacaccatttagttgtttgaaaagcgtgctaacggaaaccgagggataatctgcccctttcatcacaaacgaacggagaattgggcaagctaggatattcatctgtatcatagccaagtatgtaaagaagtggatatatgatatgcatgtcgtattctccctactgcgtgaattcattgggctctgttacttatattatgaggaactaagatttgccaattgtgataatagatattatgtggaaaattcatatatactcactaaatctgtgggaagactcgctataagattcaccgtaccttctcttgcgcatattagtttaatctggactaaatttgagtattgttcttatggttacaggggcattgctattttttgctttgcttgggttatcaggatgcttcataacttgttatgaccgaagagtacggaatgacctggcacagccttgtcgagagttatgtctttgttgctgccaaccagggtatgcttcaactaatttagcaattgtattaacaagctactaatgctgcatgcttgtttcatcagcactgctcattgttcttttctgtttcaggatgtgtgcagattgccatctacctggtacgctttgcatgtggacagattgcactacatgctttgagggctgtgcaacgacagctggagagtgtggtggttgcttgggtggtgctggagaagcagggttaccattgctctttatcatgggagtaatcgtgcttggactattcacagttatcggcattttctacagcgtcttggtagcaaccatggtgggtcagcggatctggcagagacactaccatattcttgcaaaacgaatgttaactaaggtgagttctgtttgccgcttatttctcagtctttgactttagtttatttccttctgcacttaagctgtatctggttcttacaggaatatgttgtggaagatgtcgatggcgagcgcgcggattggtgtccgccccctctcccttcggagcatgtccaacagctgaagtctctggggcttctataatctgtagcccatgattataccaatgatgaccttaatttaggacttgcggcactatccagctgtacaggagatgatacaaattaagcggtgaagcaggcgtttcggtttttaagcagccaaatgcacaacaatatcgtttgtctttttttgtacattgtaacaagggaatacctatctgaaaaatgacaacagcatttgatttttatacgatgaatggtttcacagttttatttcgatgagctcatttcttgtgcatgttaggttggtgatctgaacaagggaaaatatgtgcttctggtattaggaaaccttgcaatgagttttgtctggtagggatgcctgaatacctgatgctctgtgtttgatactttggttggtgacagcttgagtagaaacgtagacaaataattctccttttaaaccagatgacaatacggtaaaactgtatttgaatttgaattggtaccagaaaaaccaagaatgcgccttttaaaccagaatagaggaaatttctactcagtcagtagtcttcaaagtgtggtaccaataccgcaactttttaagtggtgcttaaaaaaaagataaccgaaaaaaagataattaacttcacaaaactaattaaattatcgcggaactaaatatttaaaatatactttgattaaattatcgtaaaactataaatttaaaatgatatatcacaaaactacagttttaacaataaatcacgatacatcatcttaaatttatatttatagttttatgaaaggttagtcaatatatacgtagtttgaaagaaaaatactttttttaaaaaaagctggaacagtttgaaagaatttggcccatcgggctttgatttcacctgcacccgcaacgcaacacgcaccacttcgctctttctctcgcggcgccacctgaaccggagccggaggggaggagatctcggcggccgagcagaagcggcggcgctcgccgcggttgcggagggggaagaagaaggcgcggcggagcgtagcggagggagtagcagcgaggcgagcgccgagagggagagatggatcccgacgcggtgaagtcgacgctctccaacctggccttcggcaacgtcatggccgccgccgcccgcgactaccagaaggtgacttctctcactcactcgcggaattggctgtggaggttggtgtcggagccgggcgtgctgctggatggatctcggcaccagcgggggggaatcgaatctcggttcttgattgggagtggggttgacgggcggttgattcggccgcggagcactcggctcagctgtgctgcaggcctgcagccatggattgtggaaggtagaggtaacggggaagatgatctggtaacacgacaatgcgaatttctcgtcttgggaaagggcaggcacatgtatttgggcatttagcaattgggtggtattagcttgatctggtatttggttgggatcatggggaggtttagttcataaaggggatgggttagctccagtcctgtgttgatgttgcagggtttgaagaccagtgtattccatgctgaataggagtatgctgctttatgacacctcagtgtacacaaaaacaatggcgcttctcacgtgtagccaataaacatggatcaatttgagtataatattttggaagtttagaataacaaagagttggagtggatcatgatacatctggccgttcttttacatgttcaaaatgggttaccttcttaggccacgaatgcatgtcatgtaacatttgcaggtaatccttttgatattcttcctagatttacagcaacaaaatgtggtgtttgcatcaaagtgtagaggaaggtataactgtccttcatgcacacacttgattcttcactccttgcaatgtgatttgcaagttataatcttctctgcttatttgtgtcaactgcattttatgtccttgttgtaatgggggtaaaaaactgatccagcgggttgggtcgtgaaattggctggttggtggccgtggagccagtgtgctcctggatctcggaaccagcgcgtgatcaaatcttggtttttgattgggagtgaattgtagtctggtacacctatctttagaacttgtgtctgatttgcctccactcagctttgccacaggcatggattgtggaaggtataaccatagatcaacgtggaggatgatcctggtaacacaacagtgtgattttttgtcttgagaaagggcaggtgcattggatttgggcatttggctatgggagtggtgttagctcacgtgaaaagtcttgccttccagactgctctgtcctggtgttgctgtagcatgatccaatctttggctgggaacattggggtgggggacagttcattcggaggatggattagctccagtcatgtattccaggacaacaaatagagtgatggtgcagggtctagagaccagtatattctatgctggataggagataatgctttatggcacctcagggtacacaaaaacaagggtgctcctcccatttaggcagcctataaatgtggttagattggaatatggtttgcaagtttgcaataatcaaagttgcagtggatcattctccattcgggtgttcttaacttatgtatgttgaaaatggattaccttctgatgccttttgctctctcatgaattcatgttatgtaaaatttgtaggtattcatttttctatcaaaatggcctttctgtatattgacagcaacaaactgttgggggtttgcatcgaaagtatagtacaaaaggatataactgtcctccacgcacatcactcgtttccattatttatacttgattcttcactccttttgatatgattggcgagctatatcttctcttattgtttgtgtcattttcatttatgtccttgttataatgggggtgaaatactgtatttttacactcttgttccagtgctttgaacctcttgcattttttaaaaacaaacttgctttcaaaacaggctaatactactctctctgtccccttttgttttttttcctgtatactgacatagttaacatgttaggaaattgtagctaaagagaaagcccaagcagcaaatgcaagccatgatgaggttgatcttgatgaattattggatgtgagtttaactatagtatcttctatatttctcttgttttttttccttcagtttgaagcactgattacctttttatctatcatgctgtggaactacaactataggatccagagcttgagaagttgcatgcggagagaattgctgctctgaaggtactgatctgcacattgcccttgaaggttgtgaacctgtgtggataatcttcattttaagttattcattttcctgtgcataacagaaagaggtcgagaagcgtgaagtgctaaaaaggcaaggtcatggtgaatatagggagataactgaaggggacttcctaggagaggtcactggcagcgaaaaggtcatctgccatttctaccaccgtgaattttaccgttgcaagtaggacataatttgttcttttaaaaataagttgttttataattgacctgatgataattaattgaccctgatgataattcatggacacctatctaaatcttttctaggatcatggataagcatttgaagacccttgcaccagtctatttgggaactaaattcatcaagcttgatgctgaagttagtatgctatctctattagcatccagttacttgtattttattacaaagatgatgtctaatcttgtaaataactactccagaatgctcctttctttgtcacgaaactaggaatcaaaacattgccctgcgtgatattgttcaagtaagtgcataaactttcatcattttacccatcggatttggataacgtgtgcttaaatgtttggtgctccttgctataaccttttcatcatgcgaggaccaatccaatagtcagggttctgtttttgctctcgaactgaaattttgttctttaggaagggcattgctgttgaccggttagttgggtttcaagaccttggcagtaaagatgatttttcaacaagagcgttggaaaatatactcaagatgaaaggtatctctattacatctccaacacaattctgtcaaaacattgaaatgacaaatatgataacacacaataatgtaggtataatcgacgaaaagaagaaggatgaggacgatgaagacgacgaaaccgatatgtcaatgaacaggaggattaggtcttcaaccgctcaagattctgattcagaatgaacaagaggtgatacactccactgtgtcatcaagtttcttttgcactctgtgtgtttatgtaatatgcattccgagttgttatcaacccagttaggaaacgaggtatttgaaaatgcaatagctatagaggaatttattttgtgtactgtttagttagtttttcattcatactggcaaagtgccaagctggcctatgcgagtcggtacgctttaccccaaacagtttttcttttctggccatcatgctgtcaatgttttacctacaatacctgattggttgctatacatgaagtatcacataaacatgacgagctaagagttgaaaattggacgtaactacacagctagtgatagccagctaccactccatctataagagatactatctacctatatttcaaatgcaattttctcttaaactactcacccgatctacgatccgattacaccgttgtgttcgtaacaattaaatctttacaataagatctcacatgattatattttgatgaaaaatcataaattacttttatgatatgtctaaattacttttagatttcactaagttacttcttagatatataa

SEQ ID NO: 12145 - DNA, 5538 bp, Oryza sativa
atctagaaatgaaattaatcagcacaaattatagaattaactaaaaacaataataaaagtaatcacctcagagcattatgaatgtataggaagtattttaatcaaatctaaaagtaagttatatatatgataattatatatatgtagtttggtcaatgaaaaaaaggcgttaattaaagttactttccttttggtataagttacttctataatatatgtaaattacttttataatatatgtaaattacttttaggctttacttaatttacttttatatgtctaaaaagtaacttaatgaaatctaaaagttatttaaacctatcataaaagtaatttgtgatttttattaaaatataatcatgtgagttcttggtgtaaatatttaattattatgaacacaacagtgtaatcggattgtaaatcggatgagtaatttaagagaaaattttatttgaagcatagatgataggaatatttcccctacttacttaatggattagtaatatagtaaagtaagattcttcaagttaacacatatctggataggggtcgctcgttatgactaaatcgagagtgctctcgatttagattttgcgttgaaaattaccatctcaaaagcaattaaaaaaattgcacagctacgaaaaggaaaaaaaaagaaaagaaaaaagaagcaaactttcgtgcttctagaatctattgcctagacaaaggttgggtgattatgtgactgcaacaaaattgcgaaaacgcttagtatcgtacgtccgataacaacgaaactccggacgcgtagggacccacatcagaaacccatcccttctccaaccttatcctattcttcctcatccaaaaccaaaaccatttcccccatttctctcccctaccatggacttctccggcggcggaggtggaggcggccagcggcagcggcggaggtagcgtcgcgtccgggagggtgcaggcggagcggtgattggagatcgtggggaagctcctcgcggcgagggagttcgtcaggtgcaagcggttcgcagagcgcgcggtggaggtggacccgcccctccctggtgccgacgagctcctcaccgtcaccgacgtcctcctcgcttcccagtcggtcctccccttggtccacgccgacccgctcgctgtcatccagcttccctcggccaccaacccggccgaccacgctgccgtctcccacgcctaccgctgcctcgccctcctcctcaggcaggagaccaacccccacccgggcgccgatgtcgccctcagcctcgtccacgacgcctacgccatcctctccaatcccaaccgccgccctccgcccgccgttgccatcgtcgtcccccacactataaggttggcgaaggtgaggaggcttgtggcaacgtcgacctagctagcgagcattgttgcacaccatatgttttttgtgttgcacatagtgtgtttgtgatgttgtaatccgtcttttctggatgtttcttaaatcagtactggatgttgcatttggtatcttcggatgttgcacatattgggttttgagtgttgcattcaattgaaacatcttcaataaagcgatgaaacattcttcagtgaaagatgaaacatctttaattcatgttgaaacattttttttcgagcgatgaaacattgcaacatttcatttaacatacaatgaaacatcgttcggagatttcatgttgaaacattttttttcgagcgatgaaacattgcaacattcattctacatacattgcaacaccgtccggagatttgcaaatctccggacgtccgatgcgtagcactctccacaaaattgatgacacaatccgaacatctatctatactaatataaaaagcaccagttcatcaaacacctgtcttttctatcccttagatctattcatccaacggcttgtatcaaaatttggatcaccttgcaattagcgatctcccactccgcttcgcgtaaccagcgattaaaggaaaaaatagtgatcggattagcgttcttgccgtccttgccaaaccgccgctcctccccgcgatggcgaatcaggatgtccgctctgctggacgtcctcgacatcaagatatctacaaaatacaagtactgcgaattacgtgctgaaaaacccaaaagggataattgttccgaaacgacaatacaagcctagaatgtttatggcacgaaatcaaaaagtacaaaagaagaaatttactcttcaaatagagaaggaacaatttcccctagatccaccacgtccgatatcacgtcctcgcgtgtgtcattcgctgccccctgcgacaagatctctttaagatccaagttgggctgcgcaagcctcacacacgcaaggagatggcaagccccggtgtggatcccgttggcgatctcatcagacaccttggccgcatgcttcgaaggaattacctccatcgcttgggccagggtgaacagcgaagatgtcaccgaggtctcgtcagggtgctccaggatcttggcctcaactccgcacgcccccgccttctggtgaaggcttgtgaagctctgacagagcgaagcacggatggaagcgaggtggtcctctaactcagacatccgcctttcgaggccttgccgctacgactcgttcccggccacgagttccttcatcttttgaaggtcctcgcgagccacctccagttcctgctcaagctgggccacacgtccatctgctgaggtcacgcgggcgttcgcctgctcgatcacccgagccacccccgagcaccaacgtcgaggaggcgcttcatctcggccatcatctgcgtcaaagtcagtggctcgatagcagctggcggaagaggagcaagtaaggctatgacgacgtcaggagcaggctcggccgcgacaggggcatccccgattacagcagtggcagtaagcacagccgctgcggtagtcgtgctggttgcgacttcacccctgctgtgggccaatgacgtcgaggaggccctgaagacatcacatcgtgtccgtcagaagacaatattagaagggaattcgtgaaggagaaaaaggttccatttttttgctcacttgttcgccgccagctttaccagtcttcttctcggggttggagggaggttgcccgcgtcctaagtgagatggtaaaataagaatctgctcgctccttttcacgacaacaatacaccgaagacgactcacctcggaaccgctcaccttgcgacgagacccagtgccggtgactgtggtcgcccacctcttctgtttcgacgtcctgctgcccccagcagcagcgacgtcggaagcctccttggagactttctccttaagtaaggcggaagcttggtgatccacgagtgggccaatggtgtccgttagaggtagagcctgcaaagatgaggtcatatcgttttctcggaagaaagaggaaacggatgtcaactatgcttacgttgatggcggtagctcgttctgtgccaccttgctcacagagcggggccaggatctcggccgccttcgaaggcaggctaatcatcacttggcacaccctctgggctacggtggcgctgtcaagacctacgataaggaactaaccttggttagatctgaaaaaactgtagacgcagaataaggtaacaacgcgagaacaagtaccccgctgcgagatccgggtcacatcgtccggcccagagtagtcataagcagggtgaacacgggcttgcagcggctggattcgacgacctatgaagtcgacagcaacctcatagctggtcagtccttgtactcgcagatcatctatgatgtccacgaatgcttggagagaagaagtcaagggaggtttcgaggtccactcttgagatcactcaggttggttctcgggaacgacaaggacaggctctgagttttcgatctgaagttaaaaccacctcgatcttcacttgctacgagataaggggtattggaagggaatgtatttcgccttcatgccatcctgaaggcgaaatccgtagcatccagagatcctgctggattccatccaatgaagctcgtagtagtagcagaagagatcgagaaaaggcactaccacaacagagatgagcgaaaatgctcaggaaaataatcgaattggggttgagatgaagcaaagaaagaccgtagaagttcaagatcagcaggaggaattcggaaggtggaggtagacaaccacaataaacgaaatcctctaccactaccatacgacctaagatgggatggggttcagtacctcctttgtcccgctccatggtcccgcggccgggtagagcccccttcttgcagtttcttcatggcggcggtgtcaaaagatgatttttccagatccatggccgccagaagatcgccgggaagtgaacagggaaaaaaggctagggttttttggggacggaggggtcaagagcgccgggaagatggaagaattttctcgcaaacagatttgaaatggatcccaaaattcctttaaataggcgcacaacaacacggttcgtatcctaaggaaaggagagagattgctgccgaaaatttctaaagctcgttatgggctgtagtttagacttcaatttaaattcactcacgaccgttgaacttccttcagcattgttgctggctccgtgtctctacggttttataccgggatcgaccaagcgagtacgacaacgtgctgacgagcgaagttgcgcatgacaacgtgagttcatttaagctgaagtcgggggctactgtcatggttatggataaggcataccctctttccttggacttatggaatatacggatacaacataccatcacaaatacgagctatctccgtatgcgttaaggaaattcgccagatgttatggaaaatgtctctacgggacaagcgacggacgaagtcctactcggaaaggatagggtcttactatatcgtacgagatccgatgtctccgagtcctacttggagatcaagatgatccacggtataaaagggacccctgagagggattcaaggcattgaatctcaccaccaacacacctgccatagtttacgaagccggagcacgcagagctaagtcaccgggagatctcgtcgaatccattgactacaatttcatcggtatcgtcgagttcatctattcctattgtaatatgtggtttcttccatataatctcatataaattggacaagggctattacttgataaggggcctgaaccaatataatccttgtctttgtgtttgcttgatatcatactacgtagatcctcataccagcgaaccccaataccctaatcatccggtctacgggtatcactcgtcaacagaatgagcaacatagaaaaaactgcagaactcctagcattgaaaattaaatcgagacactatacaagttgattccaggaaggtatttgtaaatacaatattttcttacggaatatttggatgtagaaacaaatacacgttacaaacattgttgactagaataaaaacggttaactagaattca

SEQ ID NO: 12146 - DNA, 2628 bp, Oryza sativa
  unsure (1)..(2628): unsure at all n locations
aaagggcagatttagtatatcaagttaacataaagtaaacataatagccaaattaggtaagatcggctgaacggnnncngggggaaaaatgcggcccttaattcttcttaataataaaaccaaactagatattatgattttaagtattacttaataggttggattcactgaatgaagcattaagtataaatagaagtataagatttaaacaagttgatgaaagtattttgagatggtagatgcactatataatctaagtcaacgttgatatctaactctatcggctgttacctggtagtagatgctagccgatctagggttacatagcaatattgatctagattatatagcacatatgataactcggcaacttacataaacaagattagagtgtcataaagatggaagcactaatcctgagaacgcaagccgccataacaagctttacctcttgtcggagatcgaacccgatgcagcccaactcgaaagcaagaactcgtcgaaaacaaacgaaagtaaaagggtggcaatgcgttgagattgttattgaactgtgcgttaattgattacatgggtttgggctactttaatacctaaagtacacaatatgtccttgtcggacacgactcctaactctattacaacttaggatacaaacaagtccctaaggcggacttttaccgactcaaagtttaaggaaattacaaaaaatattctaattaatagatacaattgtcttcccagaactcaatccatgcgtggcaatccatatgaagcacattaacccgatccgatgacgtatacccagtcatattgtcggaatcggctcaatcgacaaccttggccgactcgaactctaccgatctaggtcgcagccgattcgaacttcagccgactcttgctctgtttccgaaacaatcgatctcttagattccgcttcgattttatcttcatctccgatacttgaattaccaaatttagtcgttaacaacagaacacttgatggagtagatcctttgtcactgggtagagcagattgctcaccgtgacatggagaactctctcgacatcagaagccatggtgagtggctctgataccaagttgtcacgacccgaggccttgacgggataaacaccaccgggaggatagccgggtgacgttggctcctagagaagagatgtagatttaggctagggagaagagcattatcgggagaaaaaagactaattgatattcattgcttaacttgagatgaatacaaaccatcccttatatagagatgatatgacttgacccttaagaaactaactcagactaactctatctaatcttgtcgtatctcctaaccaactgctacagtactcgaggtactgttcatccactaggacttgggcttgtgggcctcggccttctgcccaatgcctatgacactacaacctccttttgagcagcttgtcctcgagctgcaacatatagcagacttctagacgtacacgactccctaaataaaacttaatataattgctgcaactatttgtcccggaggttgtgacccccaagatgcagccctgctcgtcagcatcactccccctcgccaacaacggcgccattgccaggaccagtggaggatcctctggaagcgtaccctgtccctcgctccctggctgttgctgcaatctaatggccacggaccacgtcgacttgaacgacaccgtggagggaatcaccacccatggctggttggggagcaaccccttcttaggtggtcacccatgggtgaccttgatccgcttgcaccacttcaagacttgtggatgtggttgcagtggagaggacagacaacgctgtctgcatgcctccaaacccgccggctgagttggaggtgtagagatcggtgacggcatcaccatgcccactgccatgtcctgctctatggcctcctgcttgctatgccattcctctttcttcaccagtttctcctgaattaaggtcgccaattccttgagaacgaccctcaactcctcgatgcttttaactccttgatcctggttgtggaggtctgttcgtactggagatacaacagccatcgtagatgttgcggccatggaaggctttttgtgcatactctgcatccgcatgagattggaatttaattgaagcctccacatctgttctcatctgctgcatgttgatcttctctgctccataagcataaatgttgatgcgaaaaacatacactggcctgagagatttgcttaactctagtgcaggacctaaatcttgcttttgggtttaagggcgtgccagttggtttgatcctgcaaccaacaagaaacaaacaaaaaaacatagttaaatccataaacggtagccgatcggccacatgctgatgacatatcgtttgtaagttagccgatgtaacgtgaattagatcggcaatgatatataaagcaaaaagaaagttaaatctagtcgatcggctgtagatattaacagtatataatctatagattgaaatatgtttaaaccaagtgattaggatagatcagaccagcttgccgagacagtataaatcacttatgtttaaaagtacttcaatgtaaagattatatatgtttatagcatag

SEQ ID NO: 12147 - DNA, 1346 bp, Oryza sativa
  unsure (1)..(1346): unsure at all n locations
tcattgttctcactaaaacataagacaaactatgtgcgaagaactgaccttgtgaaagaacttcggttcaaattttcctgcaagacagtttgtcatagtcacattcatagcatcttgaccacctccaataaccacctaacacaacgaagaattcttgtgattagtagttagaataggaatgggaacaagatgagctgactactcgttacagtaacatctcaggtgaacaattcagatgtggccaattagacatttttttcgtgttagtacaactacacatccatgacagccaacagcactcaaacaaattatatggaattagggcaaatccagggtgaaaagatgtgctggacaggtacataggtgcttttgcacttcctggtgtatattcattgttatgtatgcatgtatgcatgtaaaagtactaattgcagataagaagcatgtgaattttcctcaaaaaaaaaaagaagcatgtgaatgaatcatttgttgctctcgtcttatagtaaaactaatcatagaaggaaaatgactcaaaagtgagaaaaaacttgtgccaaccaaaatcatcaaaaaaaagcataagtaatatccatattcaactaatcaggaggtttacttcagagcaaaataaagaaacagagaccataggcatttcgatcccaacaataacatgttgggaacatatgcagttagcataacataaaacgaagtaatttaaggcatgaccatgtaatcttgtaaaaacattgcatctataaaagaacttgaggaaatgtatttaggaattaggtattgtgacataggtcgctcagtgacacatgtcttgatcagtgtcaagagttcttgtatcccatagctagccagatagaaatgtgcatgacagtaaataatcatatttgtagtatgaagtacaaacaattgaagacatgattatgctagcagcatcaacaaaatatcaccttagcagacttatccaaggagcctgtttggaaaggcgatcaatctgaagatttggaaagtgaagtaattgttttctgatgtccttgttccttgtctgactccttcaggcattgtccagtctgtacatgcataaaccaaacaaatgtaaaagcatcccatgataaagttgatggaaaaacctgttcattcccatacagttacaaagtcatcatgtttaataaaaggtaaaacggcaacaaataaccancatgcccttttaattgcccaattaaaaattgtttaagccccaaatttggngttnnnnntnattggttgtgaacagacaacacaaactaccattttgtcatttgcactatattgccagactcaattcaaatcaa

SEQ ID NO: 12148 - DNA, 1449 bp, Oryza sativa
acttgattatgctaccagcatcaacaaaatatcaccttagcagacttatccaaggagcctgtttggaaaggcgatcaatctgaagatttggaaagtgaagtaattgttttctgatgtccttggtccttgtctgactccttcaggcattgtccagtctgtacatgcataaaccaaacagaatgtaaaagcatcccatgataaagttgatggaaaaacctgttcattcccatacagttacaaagtcagcatgtttaataaaaggtaaaacggcaacaaataaccagcatgcgttatgcataaatgtagcatgtttttggttagtgaacagacaacacaaactaccattttgtcatttgcactatattgccagactcaattcaaatcaagaagcctgcaaggtatttatcaccagttcaatgactacaaacatatgtcatgttaattcatactgttgccatcaataaactgtgacagtcgcacatacgtaacagtgatttttcaaccatatctggtaattttttgactatcaaacaacttcacttgtcagtccacagatacatgtcgaatgctaaacaagagcgctacaggttcagaattatatgcaaattatcacattccggacaagcatcacacacctactagtcaagagtttctagtagcacgagtggtaagtagagataacatatggcaatgcaagctaacctcggtgatgaactgatgatggtcctgttcgacgggccctacacggcactgttaatcctccccaataatcacgagaagagactcttccggctctgcatccacaaccacacacttcagaattcacgcatccggaagcttccaagcggaaggagactgaagaggtaggaagaggagacgcgtcttacggtcatcggggtcctcggcgatgcgcttgacctgggcggtcgccggtcggcaccttctactccatgaagctgtcggtggtgatgacgacgaggccatcgccgatggcgaactcgtctgagcgcgctcttcgccgccgggcttgtgcttccctgcgccgccggggaggaagggtggtaaactggtagggttagggagagaggatggggtgggggatctggaattttggatcggtgcggaaaaaccctaaccgggccggcccaatcacttcttggtatcatggcctcgtgggccgttgggccagtgtatttacatttcgaatgggaccacctatatatttgtcgacaaattttctagtaaaaatttgacagatgtaattatagtacaatcgtagtgtaattacactataacttgtatgtaattacactgtaacttgcatgcgactatagtgtaacttgtatgtaagtttcacgtaattttgaatcgttagatctattacaagatttgttctggtgaggaagaaaaaaatcatagcacacacatatgtgaaaggatttgttccca

SEQ ID NO: 12149 - DNA, 9779 bp, Oryza sativa
gattcttgaaagttgcatacaagttacattatagttacagtgtccccccatgcaaggtccagtgtaattacactacgattgtactgtaattacatctgacaaatattagggggagaaatttgatgacaaatatctagcaaaatcgtttcgaataagttcacttgagctctcttagcttgtcatcgagtttaaatcaaattcatgaactgtaatagcagacataacgtgaccttcaaattgcaatatcgtagcattctagacaatattttatccggttttagctatcgtggtgaattcatggatcgtgttttttgaacggttcagggaaattcataagttatttttattttgcaaggacattaaggggatttcagaaattcaaaagttcttaattacacgcactgtactatgcgtgtaagagttgattcaggctgtgtttagttcacaccaaaattagaagtttggttgaaattaaaacgatgtgatggaaaagttaaaagtttgtgtgtgtagaaaagttttgatgtgatggaaaagttggaagtttgaagaaaaattttgtaactaaacacggcctcattttcttgaagaataactcaagctgaaaatatcttaatcacaatagagtaacagaagaccagacgactttattgacttgctggtgcatgggccagagcttgcagaatgtcaggaaggagggaaggtggagcaacatggtaagcgtacatgacaattgacaagttgacagtatacacgcgcgtctccgttcttaccgcgctcagctgtctcggcgaggattaattactgcctccacatcctcctcgacgccattgttgacgagcttgaccgtgtaccggagctcggcgacctgcctccggatggcgtccaccgtcgccctgacgctccggctgttgatgtaccacgcgtcgtactgcacggcgacctgctcgaggctcaggaggttggcgatgcccgacggcgggctctcatggctcgccgggcccgtggagagcttcagctcgaggtcagttagcttcggcatggccccttccttgaacaccagccatggcacccggcaatcgacggacaatctcaggagctcacggaacgggtagatgatgatcccattcttctcgtcgtcgccgtcttcttcttcttcatggatttttgagttcaggggagctctgttgcttctgttttgagagctggacatgaacccctgaccttggatcacaatggcttctcttgggaggaaatccagccccagctcgaggcactccaacctgtgcaaacgtccaagaatcttgacgccttctggggctagcttgcagaccctgatatgaagcgaggagaggtggttgagccctgcgatccaccgcgggacggtgaggaaccgggcgtgcatcgcgacgtgtcgcaggttctgaggcgcgtcttccggcgagaaatcgaggaactccatggagcagccgagctcgcagcggatcgtcagcgacctgaggcacttcaacctctggacgaggaagctcaggttgtcctggtactccttgtcggtgcactggcgaagggatagcgacacggaaagcacctccaggcaacgaagaagggaaagtttcctgacgacgtcggctgagcattcgcgtagatcgacagctgctagtgtctccaacgtatcccggagcatcccccaatcgatccccttggggatcctcgtgctcgccgcgccgtcgccagcgcgcagatgccgcagcgccactaggtcgtcgattcgctccggcagccgctgtatccgggtgcttctcaggtcgagctcctccagcgagcgcagggtgcacacctccggtgggagcttggcgatccgggtgtggctggcgtccaacgtctcgagcgagctcagcatcccgatctccggcgggagctcgctgatacgcgtgttcctcaggctgagatacctgagcaggaacagtttgccgctgctgaatatccgtggcaggtcatcgtctttcagcttctcccagccttgcagatccagcacaaccagatgcgggaacatttcaagagaaataccgtccacttctccagagaccgtgagcgagcgagtgaaggagaacatctcttccatctgcgccgggacctcctgatctgcaggctgctgctgctgctggccatggtggaggaacacccgccgtatctgcaggccggatgagccgcggagcgtgccggtgtcgcagcaactggtggtgacgaaattcttgtccgcggatttcgacgcgaggagctggaacatgaaatgattgacctggtagctgcaagggttgcattcacaatcgcacgccctcctcctcgtcctcgccggacggatgatacaccgctggacgagctgcgagaagcattcctctgctctttcctcgaacccgctctgcaacgtgtgcaccgcgatcagcccctcggccttccatttcctgatgaggaggtgcttgtcgatcacgtaaccctgcgggaacgtgctcatgtacagcgacagtagccgcagctcgcaggggagattgtcgtagctaggagacagcgtgtcctcgacttgcttcagttctctgattccgcttggcaaatatgctgcaacacaaggtctggagatatccatcgtcaccccactctgatctccttcttcgtcatcgtagtcttcttcctgcatctgcttcgacaccaggccggccatggcaattatgagcagcggtgtgccgtcgcataccctcagaatctcattggagactcgtccagaattggctggccgcggccaaccgtgagccactgccgagaacagcctctcggaatctgtcgcgccgagaggcttgacctcgtgcacgaggccgttaggccatgggtgcgagcagcaggagcgagcgacgcttctgatgcgcgtagtgattattatgcggctgtggcatctgttgctcgggaaagcatcccagatgtgctcccagtccgatgttctccacatatcatcgattacgatgaggtacctgcagcaattgtgtgtatgtatcacatcgccagcttaaaacgaacaaactggtttatagcctccaaaaacactgagggctgctttagatagtaggattgaaaaaatgaagaaatagaaaaaaaaacataggattttaataggaatgtaagtgtaaaacagatggatgcaaaacacaggaatagtcgtttgactgaaccttatgaaaaacacagaaattgaatgagagtgatagactcaaaagtaaattttttaagaggtttgagctcttgctaagttttcctcaaactctatatgcaatgagccgttccatcggaattttaagatttggaaagcctcaatcctttgaatcaaatgaccacatagaaaacattaattcctatagaatttgaatcctacgaaattcttaaaaaaaaaattcttttgattcaaagagcactattttggtacttgcgatttctcattaccttaaaaataagtcatataatgcattcacaatataatttagtccatgttggggggatggctccgggtagcggagccagcctccatcgtgtgatgcagcacctaccggagccatccaccctaggagaatgaccggaggaatctactgatctgggcttcagagctagccaaggcctccagagccgacctgggccttcggagccacctaggggctccggagtcatccaaggcctgccaaggcctccggagcaattcacaggctccgaaggaagccaagggctccggggtcgttcaaggtctctggagccgaccaaggcctccgagccatccataagctccggaactattcgagggctccggagccgaccaaggcctccgaagctctccgtacgctctggaaccatttgaggcttccagactctatcaaggcttctggggctggtcaaaggccccggaggaagccagggctcttggagccctggatataggatagaggatcaggcgcgtagtgggactacataaatacacactgcacgcctgccaaccacctctgacatcgttgacgagggcaagacggtgcatgctattatccggagcacggcattacccgagtaatagcgggcgccctcaggaatcggcgctgcttccttaatgggcgcagtcctcctatcactaggggaattacccgagagcccacaagctggcccactagccagccacttagattagttgataatatgggtagcagtgtaatttccctttgtacactctcgtataaatatgtaaacgttgcccgcgattgaggcatcgaatacaaaaaagaatacacactcaatcgttggattttgccccaacagtccaaaagcttaaaaattaaatatgtcagtgcaacaacttgacatgtgggtgcaatctactatagaaactaaggccctgtttagttccaggggtgaaaagtttggtcgtgtcatatcgaatatacgtacatacatttgaaatatcgaacgtagaccaataataaaacaaattacagattccgcctgtaaactgcgagacgaatttattaagcctaattaatccgtcattaacaaatgtttactgtagcaccacattgtcaaatcatggagcaattaagcttaaaagattcgtcgcaatttacacgtctgtgtaattagtttttttttgtttatatttaatactccatgcatatgtccaaacattctatgtaacagggtgaaatgtttttgcgtaggaactaaacagggcctaataagtgagtattcaacaacttagcaagataggtacaatttcggtacaataagcgatgcaacaactaattatttcaagcatttatctatacaagtttaggctgtgttggaaactaatccctgcgtacgtagaatggatcgacttattagcatatgattaattaagtataactaattatttttaaaaaaatggattaatatgatttttaaaacaactttcgtatagattttttaaaaacaaaacatatcgtttagcaattttgtgaaatgtacgcaccgaaaacgagggagatgagttggaaactcacacttaagaacacaaccttagtcttttaagtactcactatgtcaatatactttgctttaaaacagacgtcaatatatacttgcacacatttttataagcatacttaattcaaattgttgtccgtaactaaaattcaattaaattttacagtgtacaaaattttgtatttcatttgagatctaagaatgtgaaaaaaaaaccaatggttgggtttgctatgtggtggcagttgacatcatgaaaaaaaaattcacatagcactctttaactaaaatatagaattcttcttgtcctagatcacatccacccgcatacgatgtacgaaagaaataatggggactagctatattattataacataatttaaatttccatttatctttaaaaaaaatctggggcactaaattttccattaaaaacataagtttttaaccattcgtcttatttaaaatattactccctccatctacttttgatagttatatttccaaatctgaaaattttatttttgatagtcatatttcaatacaacaacctatcctcttaatggctttctcggatttaatgcgtaactctccattcttccacacaagattggttgcataggcatcgagaaatgtaaattttaatgaatcgcttgtttacaagaaataactagtaacatgtttaaatggatgataagtagaattacttttacttggactgtgtgccaagatgaaatatgatgatcaaaaatagatggagggagtatataactatcttgtgatttgttttatttgtagaggtactattggctgacttgtattatacatatttgcacaaaaagttgaattagacaaatgacgaaacgtgtatccaaaaatcaaatcctgtcgtatcatatgaaatccatataggacctgtttagatcacaccctaaaatttttcaccctgtcacatcaaaagtttaaacatctgcatgaagtattaaatatagacttaaaaaaaactaattacacatatttgtgactaatttgtgagatgaatattttaagcctaattgctccatgacctgacaatgtggtgctacagtaaacatttgctaatgatgaattaattaggcttataaattcgtcttgcggtttacagacgaattttataattagttttttattagtgtctgaatacccaatacgacatcctatataacacgccaaaactttacgccattgatctaaacacgggagggccattatagctgctacagcttgacagtggcaactcgtggtcagtggttacaaccgtccaatgtgagatccaaccgctcctaagcagcccccggtcacggtacaacagtagcagagtagcagtgggccccaccacttcatttgttcaccgttggatctgtaggactgtaaaaaatagctggaggcccatcagctactcaagctccacttgtcccgtactacccgtcgcaaaatacttgttgctttaaatttttatttgtaacatctgattatttgtcttattcaaaatattatgaaattattatttattttgtttgtggcctactttattatcaaaagtattttaagtgtgacttttctttttttatatttgcactaatttcttaactaaaataaaggaatagaaaaaacacatgattctaacaggaataaaagtgtaaaacagagaattgtaaaatacaagaatgaccatttgatcgaaccgtaggaaaaaacataggaatcagatgacagagatagactcaaaggaaattttccaagagctttgagctcttgataagttttctccaaaatctttataggattgtccatttccataggaatttatgtttataggaattttttctatgggattgaaatccttcaaaatttctatatgtgtttcctcctaatgaaaaggggccttaatgtgtagcgcactgataaccgactataacacatgtgttttgtaattctgatatacgctcttcttctgctcagggccagccctggggcagtgcgggaagtgcgaccgcactgggcctccaaaaattagggacctctaaaatatgtatactacggtaccaagcctgataggctactttgtgcattgagaagatgctggtaaataagattgttattgacactatcatcactgattgaatctagaactattagaagaaattggtttaaataatctagagatatttttttagtaattagtgtgaaattcgttaatgacaataagtttttaaatattatcttgtatttttatggtgaatcggggcttttatttttttttcgcactgggccaccaaaaagtcagggctagccctgcttctgcttcaactttgttcagtttggtttattgcagaattaatacatgtaaccgacaggacttatgctgtgtttagtttcacgctaaaattaaaagtttgaaaaaattaaaacgatgtgacgaaaaagttaaagtttatgtatgtagaaaaagttcgatgtgacgaaaaagttaaaaatttaaagaaaaaaagttggaatctaaacagggactagtattaaaattaaaactagtattaaaaggaagacagtgtgttgcttaaatagaagggatcgagctacagtacctcttagtttgcaggtattgtttgatgtcgtaagccagcgcgcagtcatcgccgtccaaggtggccgcgtccgcctgcgacccggtgatctgcgacatgatgtgccggaggagcttgtcgttgtgaggcggccttgcggagagcctggccaccgcgcggcactggaactgcccttcgatctggcggaagacatccatggccagtgtcgtcttgcccatcccagctggtccgacaacagagagcaccttcagctgcgcctccccatcgtcggaggccgtgagccatctggccagcttcttccttgggacgtcgatgccgacaagaatactgggagggccaacgtcgacgacgacgtcgggcgctgccggcggcgcgtcggtcacaagcagaagctgctcgatccaggcaaggttcagctcccggagctctgtctcggccttatctggtgcgtagccatcgatgaggtcatcgatccatctagccagatctatcaagtaggcgcagtggttcacggtctgggagtcgacatgccccggaccaattcgctcggccgatgccagcagctgccgcagtgctgcaacaaggctgctcagctccgtctccgtgaagacgaagccacggcgggcgaggacggagaggccggcgtgcccacgctccgaccggagcagatcggatatcctaccgggaagacgatccatcgcccttagtactccctccatctcctccttcgcggctgccgccattctggcatctcgttgtctctccaactcgcgcgctatcctgacctctctctttctcccaatctctttctccctcctcgacatccacccgttccaagcatcccaatcccgatccccctcaataacatccacctgacgagaaggcgaaggaaaacaagggaagccgactcctctccccatgaatgtgatgaacagcagttatcatacactaagggcccttttgaatcacaggaatgaaaaaacagaggaataagaaaaacgtaggatttttgtaggaatgaaactgtaaaaacagaggattgcaaaacataggaaagttatgttactagccctttgaatgggtataggaatttcacaggaaagagagtgtcaggaagtgtattaatacatgtcactttggccttatccacaatatcacaatgtatattttcttctaaaagaacaacaatgatgcatatgtctgtcatttatctccatcctacgcacacatgatggaaaaaagaggttagggtggatgttttcttttcctatgttttccctgtgaaatgagttccaaaggaaaatttcctctaactttcctatgccctactcctatgaatcaaaggctgctacagtgcccaatcctaaatcctacatttttcccatgaaattcctatgaatcaaaggaggcctaaattctgagatttgtctgtgcataagccttatccagctgtataagccggctgctagctcatacgcgctcggcacagtgccagccactgtctgggcgagcgtacctgggagagggcaccgcctcggtgagcgtgcgagctagctcttggcgtcctgttcatcgattaaaaaactctatgagctagctaagagctgcccattggagacggctttaggaaagagaaaagccagcgggctacagatttgtaatcagctatagcacagactttaagacacagtgtatgtatgacaggtgggaccaggtattaatagtgtagtatgtaactattgtatgaatgagttattaaattacctatagatgaattagagctagtagttggctgtactattgaacttgctcttaagagggggtgagcaaatgtactgtatataattttagagagggtcctaagcgtggggtccattaaagaatagtgctaggaggaatgtactatggtgggaccatcttaataaaatactgtaatctttatgattcttttctcttcaccaagctctgtcgtgatgtgttcaaacacacaggccacaggctcgcatataatacacctggatttttcatattttggttcttttcaaaaacctatttcataaatagacctaaaaaaacttatctcagaaatagtctttttaggacgccaaagtg

SEQ ID NO: 12150 - DNA, 609 bp, Oryza sativa
gtcattgtcgcatacctgaggatgccgctgccaccacacacagattgtcctggtgtcgatctcatcgataaccagatccagtaccactggagttactacagggatgtcgtgatatctctgtataatcagtacggagaagaagcacctaatgcggggctgctgcgaaaagccatgcggtgcttccgccgccgaaggtctttagagtataacattccgaggacagcgtacagtctctaccgtgagtgctccagtgatccacgcctcgagctcccaagctcggagctcatgccatcgccgcatcaagcagcccaagttgaggctggtgccctcaatgatcatcttgttggcatcgacagcatggcaaacgagatgctcagatggctcatggccaccgacaagggtctccgggtcatggccattgctggacccgccggcattggcaagaccacccttgccatggagctccaccgtcgactcaggtgccaaactcaagaatattatttccagtgccacgttgtggccgctaacttcccccggaggccttacaggagcaagcttgttcttcaaaccatcctgaagcagatcatggaagcaactggatgcaccatc

SEQ ID NO: 12151 - DNA, 737 bp, Oryza sativa
ctgcagcccagaacgccttcctgcacggcaccctacaggacatggtctactgtatccagcctcctggctttgtcgacaccacccaccccgacatggtgtgccagctcaacaagtccctctatggcctcaagcaagcaccccatgcgtggtacagtcggttcgcctccttcctgctgacgctcggcttcgtggaggccaagtccgacacctcgctcttcatcctctgccgcggcattgacaccgtctacctgctcctctacgtcaacgacatcatcttaaccacctcctccaccgagcttctccgctagtccatctcggctctgcagtccgagttctccatgaaggacctcggcgacttgcactacttcctcggcgttcgggtctctagcagtcctctagcctcctgcttagccagcgccagtactgtctcgacattcgggatcgggctggcaagacaaactgcaagccctgcaccacccccatcgacacctccgccaagcactccaccacagatgatgctccgtcaccgccccaacggacttccgcagtctcaccaaggcacttcaatacctcaccttcacacgccccgacatcgcctacgcccatttggtccagcaagtctgctccatatgcatgatccaagggaaccgcacctcgctgctctcacacggattcttcggtacgtccgtggcatgttggacctcggcctccacatccagccgtctgcaacaacggaa

SEQ ID NO: 12152 - DNA, 880 bp, Oryza sativa
gtttctactagcaattagtaactcccattttagctgataaattccttacttgttggcttttgcgagcaggggatgatgtcctcctctcctgactcctaaggggacagagttaataaaggaggacggcctgcactgcttcagcttcgattaggatttaggagcagacaagaagaagcttctgtacttttgctggcaaatggcataaaactcttgcatctcatggtcgcttctgtattgccgttggccagtttgtatctgtacattatctaaaaagtttgtatctgtaatttctgtgtgtagttgctgttggccacttgtatctgtaagttctatttctgtgtccatgttttcgttcaaacataattatgcgagtatagtcatgttgttgcaggctgcatgttcattcgtatcagactcccttgttgtaatagctatacattgtacctctctaattgagctagctcatgcatggcgtcttgtacagcgcatttggggctaagaacttgggaaaatgttggacatgacaacatcagacatggcaaatctgcgttgtataagttttgactgggactgaagctggcgagaacggtgattacgtggctgtgatgagtggtgacagtcgagattaattagaactgaatatgacgatgggattcagcggcaataacacaactggccaaacctcggtgtcgctgtgttacgtagtagtactgaactactgatgatgtgtttactgtttactagtattcagtactgcaggttgacgccccagttttgtgcacaaatattcgagactcgcaagtccaaaaccaagttaaagtaattcgttaaaatcaatgttgtttttctagtcttgccattaattataacttttttccta

SEQ ID NO: 12153 - DNA, 759 bp, Oryza sativa
ccctaacagataactatgtttcttcctagtatgccttgtggatgttgacagaaaaggcagctctcataagtattatttttcaacagctccaatcagaatagcgtataaaaccaatgtgactggttgaaatcactgagcttcgaaatcattagacatatactacgcttcaaacagccacactaagaatgcaactaaattgcgcactaacagatcaaatttaatcttggacagcatagctctcatattctcattcatcatcaaactatggtcagcatagcgtatattaccaacaaaagtgactacaatcactgagctatgtatgacacaagaaaagaacttcaacaaaacgaaaataaacaaacagcataagaattcaatagagaacaagtgagaccaatgaatcaatttaagggacaaaactagaggggtggtggggttaaaatgacaggtgaatgacggttgtacgacaatgcaaaagtcaaagcttaagtaaaaaaaggagataaatgcccatgggaacatagccagtagaaccacaacaatgtactataaatctatacactgagtaacatagaaaatagacacctgctctcataatgtttatgacatcttaatatgattcagaatagcgtatattgtgatggcataacatggcttataatccttgagcagaaaacacacagaagtaatatggaacaaaagctaatccagaacataagtacataggtaaaacttaaatatagcattcttacaataatg

SEQ ID NO: 12154 - DNA, 6249 bp, Oryza sativa
cattgcgcaaagcaccaaaacgatttacagcagcatacccatggccaccacatgattctggcatacgctaatggatttgctgtatatgaagttatgtaggctttcaatccagatgaaagaacatgcacatcagccataacatcctcatcattggttttcttcatttctgagtatttatccaccaagtaccgtgtggcaaagtgaaatgcgtatgatgatgccaacatgggcattagcttatgctggtgagattggtagtccaacacactgatttcaggcttcttaggtggaccaaattgctgtcgaagcagagcatacctaacagcaatggtcactgaaactttgagtatacctacagaactatatgcaataccaacgcgtcccccaacaagctcaccaagggttgctgcaaatcttttgttaattgttggcagactgcttgtgtattttccatctcgtgacacgtctccgaatcggttcagaagattatcacgaggtatcctcactgaacggaacctcagtgcaccattgtccacaccattcaggcctatcttgtgaccacaatcattgatctcaattccgggaagaacagcattggtgtcaaggtcccgtatgggaacaatgaatgcatgaatgcccatatcagcagggtccccaccttttccttggaggggcaaaattaaccttgcaaaaacagtagcgaattttccatgaagtgctgcattaccaatccaccacttaatagctccatcattgggtgtattgataatgaactcatcagtaactggatcgaatgtagcagtagtttgtagggcctggacattagatcctgttaagaagggaaaataaataaaataagatgaaatagtaacgtgtggaggacttaactattatcatgatgggagctaacaggctgcatgggcatgaatattcattctcaaattattgagaacagaacagtgttgtttggtgcagggttcagatccgactgtgtaaggaagaaccaaaataatatggtacataacagtaatgggatggaggttgaactatgaggtttggactgataaagtgtaaagcaaccaagcagtgataatgattagttagtgagtaaatagaagtaagaactaaccatggtgcagctctgtcatagcaaaacagccaggataatccaaattgtcgattccgtcaaagaacctatctctgtgctttttggttcccagatttattatagaacctccccaaaggctgcattaacaagcaggtcatgtagtgaatttccaatgcaaagctcctaaaaaataactttgttaaaaaaagggtaaaagatcatctgcatttttggagcttggcatgctatcattcatcctgtaaataaaatggcctaaaaactaataaccaacaaaaatgctttccaaaagcaagctcaagcacgttttgatgcttgattgagccatcaaaatcaagaattaattagctctctttatcatagcaagtaagcaggctgacactcgacggttgcaaaagacgaccatcatttaatatcaaaccattacaaaagagaaacaaaaaatttcgtattataaatgaactgttgcttttcatagcccttataactaacaacccaactaacaatagttgccctcgtggaagagtgcaaatgcaatattggcatattgttgccaacagccaacagcagcagtactgtatctcgttgagctatcgataggtacaagcccccctttcgcaatcacagcaataatgctttaattattgcgaaggtgaaaacacaattagcatgtattacatgattacatcgcatggtcgctttgttttcctcaattattcatctcggtaaaaaaaaaaagaagaagaagaaggaaagaagatcactaccagactaccagtaaccagctaactattaccaattttttttagatttattgagttcccattggattggaacacacgaactcttcgaggaagcatacatttgattgagtttaacaattagtataagtgtataacaaattgcagttgagcgtgaaaaaaatttgaagagaaaccatgagacgtgcagaacattcagcaccgacaggaactagtcaattactaattatttagtattactcaatttgtaatcctttacctgtactggacgccgagcttgacgccgagggagatgtcggcgccgccggcggcctccatgacggcgaagtactcggcggggtcgttcgccatgaggctgagcgggcgcaccccggcctcccgcaccagcgcgcacagctgccggaagcagagctcccggtgcgcggcggtggacatctcgacgggcgtctggaggtcgggccgcgagaggaagaactcgaacacccgcgcctgcgtgtcccggtgcctccccctcaggtacgccgccagcgccgccgccgcgtccgctccccccgtcgcccgccgcctccccgccgccgcgcacgccgcgggcgccagccccgcctccgacgagggggacggatcctgcaggtggagggacagcacgcgcagccgtcgcatcgccgccgtccggtcgtcttcgtcgtctccgccgccgcgtcggcggccggagcgggaggcggcggtggccatgtcgtggtcgccggcgtggtgttcgacgaaacgcgcgcgcgacggaaagcgaagcggtggtcgttgccgttacgttaggacgttgcttttttatgggcacaaaaggttgacctctctcacagattgacccctaacaaaactaatattttcatatatgcccctaacctccgaattctgaggaaatctgtgtaataatgaagaaatctgtgggcgtttttttggtaattttggtactgttaagacagcgaaggcaaggaagcgagaggagatatggggtgacgtggcaacaagcagatggtgatgtgtagataaggcttacctttctttgactaactaccttctcgtgacccactatctcactgacaggtggggccacaacctcctttgcattttctggtcccacatgtcattgggttaataggaaaggatgggagagataaacggtgcgtgtcgagcttcgtttgctcgtcatgatgacgtgtcgatccgcggactttctatcgcacgctttacgatgtgagaggattggatgaggattgtgacgtggaatccgttcgtgtcggtttttttctttattcgtttttttatttactttgggagttttttcgtgtgggtttgaaactttgagctaatgaagcaatcgatctctcatgatttttttagtccaacgaagcaatgtctctaatctttaaataaacgaaatacagtacgtagtatttgatttgatttccctcatggtgtgtttagttctaaagttttttttttcaaacttctaactatccatcacatcaaaccttttatacgcacacaacttttcagtcatatcgtctccaatttcaaccaaatttcaaactttggaccaatctaaacacaacctaatatgatcacagatgcaaatcatatatatatgagaagaaatcgtcttattattattttattctgagataataaggagattgttttccttgaacgaaagaacaagaagatttctatgattaactgggaatctagtatatgggtatagtgtaaagtgttcctttatgcacggttttgtatagtttaggggtaaagatttttggtattagagattagagatgtcatacaaactcgatctaaagttgagggacgtttggtgaatttgttccatatgtacttagccactcggagttgcgcgttcccgcgaccatgagatgccatctttattgaaagatcttaagaattattagtgatagtacgagtcaccgataacaagtaaaaaggaattgagagtttttttttttcgaaaaaatcactttacactacactggcagttcacaagtctcttcgtgaaacgtcgattcagaacctgggatatataccaatagactacatagctgttcccaaaattcaatccaacgaggactactagttactaaacaccaagatctgcaggccaaaacatatttacatgtttcctctgtgatggtcgaagccgtgtggcaatttaaaatgtaaactgtgacagaacggtaaaaattatttcttgtgaatacagaaaaacacgaatatcttttgtattaaggagaagaccaaaagagcaacaatttggagtgcagagtgcagagcataaccaagctaaattgaaggggggatacgctgttggataatgaaaatgttctccctttttttatccgacaatttgcacttgaccccaaaaccagctcaagtgactagttctagttctagtagtactaagaacaagtcaactactagtcaatttaatactagtcaatttaatagataattcatacaatagttatctataatactccctccattttaaaatgtttgacaccgttgactttttagcacatgtttaaccgttcgtcttattcaaaaaattttatgaaatatgtaaaactatatgtgtgcatgaaaatatatttaataatgaatcaaatgatatgaaaagaataaataattacttaaattttttgaataagacgaatggtcaaacacgtactaaaaagtcaacggtgttaaacattttgaaacgaagagagtatatagtacacaattaatacatggtctcacttatcatacatacatgcatcttagagcctgtgctgcagctggctacaaatctatagcccgctactcttctctctcctcttttatcttctcaaaatgtcgtatagctagattatagtttgctattgtatctgctctaatactactccctctctctaattttaagtgcaaccataagtttctgcgcaaaactttgaccgtccgtcttatttgaattttttttataattagtatttttattgttatgagatgataaaaaaatgaataatactttgtgtttttaattatttttttaaaaaaattaaataagacagacggttaaagttatacacagaaaatcatggctgtactcaaaatggaacggaaggagtattaacttattgcacaagctccaacagagatattgctgtgtttagttccttcaaagttggaaatttgggttgaaattggtacgatgtgactgaaaaattatgtatgtataacaggttactgtgatgaaaaaagttgaaagtttggatccaaagtttggatctaaagtttggatctaaacacaaccattatcgaagtaccgcgtattccaggtcattatcgaagtaccgcgtattccaggtctcccatgtcgatgctagtagtagtcaaagacatctagaaatacgcgtcacagcatgagatagctcaaaaaataaactagaaaaaggagaaaacccgtaccagtaggattgttatttattttgatgattcaggcacagtaaaaatgacatgttcaaacaacactgcaatctgcaagaataagaaggggataattgatcacccgtagtattcatcaactacccccgtaggtctgttgggatgcaagctgactgaacttctgatatcagacacctgcaccttggtagtttcaggagcttgctggctaactctaagaagcacctgctggaggctagctaggttttccacaccatgagcaccttccaagatcctaaaccgcagctccagcctctgtagcttcggcatcgcgccatcaaggaagcttagcagtggcagtaacggtgccgagaaacggagcagctggaggctgtgaaatccgtcagaagggatgaggattttcccccctgaattcatcgtgttcttcgtcaggatctccatgacaccgtggtcctggcttgctgcactgaccgaaaacgcaagggagaagagcacgggaagttgggcaatgataaacaaagcatctgtgctcagtgatgtcaatgataaagtcaatttctccaggttttgtagctcactgatccatttaggcactctgggtagttcgcctgaaagctcgagtgtgtggatgtattttggagtggatagagaatccatcagattaagaatccggtgaaaccatcatcaattgcaagagacttgagcgaacagccagttaggtatgatggcagacagcaattcatgactcaggttcttgctgtcgaagtctttgacgttatagatgctgagcttcttcagcttggtgagattgtgcatgtctgcaagtgctccagctgagctcttgcagatcccaat

SEQ ID NO: 12155 - DNA, 647 bp, Oryza sativa
gggagcaccttatcccttcccccacatctttcccccccactagaaacgtcgctttcttcccatctcctctcccaagctggctgcacgccgcctccactataacctgcatcttctagctatcctcttcttgggtatgtgtcgacgagccatatgttccccggcccttactcttttctttgtcctctctagcgtgacaaacgaaacgaaaccacttttttcagattatttaatatacacatgcataccgctttcttttctttttcaattttttaatatattagaaaatatatccatgcgctgtaacgggtaaatacctttttttttcagtgatacaacaattattagaagctggataataaattgaaccgttaggaccactatacattataattaaaaaagttaatgaaaattctttgcaggttttgggctgaaaacccattgttttcttctattcttttgttgaactgctagctggtacagcacgacagaacagaattattgcaacaaacgactgtactgcattagcacgcaactaaagcagggaacaccttatctcttccctcacatctctccccccactagaaacgtcgctttcttcccatctcctctcccaagctggctgcacgccgcctccactataagctgca

SEQ ID NO: 12156 - DNA, 1258 bp, Oryza sativa
agccatgggacagggcaatcaagggagaatctctcaagctctttgaacccttctttctcaatcactattggattttcaggaatgaactccaagcctagtaccaggcgctgtaatttgatcaagcccgcgaggatcttgacatcatctgccacttgtttgcagaccgtgatctgcaagaaagtaagacggtcgagcctttcgatccattggggaacacgggaaaattttccagctattaccttaaatttctcaagattttcaggtggttctgttagagaaccgaggaactccatggaacaaccgagcccacaatgaatagtcatggacttaagctcccaccatccttctatggatgatcgtagggcttgttggtagtctttgtcactgcactggtgaaaggaccatgttattgtgaggacctccaactgcttcagatcaccaagagactgtactgattttacagagaattcacttaaatcgatagttgctagcgtctttagatatcttaattggtggatcgtctcgggtatctttgttagcactgtttggtcggaatcaatcattccagatccagctccagcagcaccaacaataagatttctcaaccactttatccgcacaatttgatctggcaactggcttattagtgtgcctcttaggtctagcgtctccagattaggtagccggcacactccagaggggagatcacttatcttggtgtggcttatatccaatctctctaggctagtcaattccttgactttctctggaagatgtcttatccatgtgcctcttaggtccagcatcttcaaatgctttagctcccacacttctgatgggatctcacttatggtggtgtggctgacgtccaatgtccccaggatgtgcagctccttgatctgaggtgggagcttgctgacccttgtgttcctgacgctcagatacctcagcataaacattttgcatatttgcagtaggtcctcatccttcaaattctcccagcttgaagatccaacaacaccagataggcaaacttgtctagagggactgttgttctgtcgactgcaccagatatgagtagtgaacgagtctgagacaaatccatttgctgcagcatagctggaagctgcggatcaggatggtggagagctagacggcgtgctatccgagtggtgttgccaccaccgctccgggctaaggtgagcgttgagctggtaaaaacaagacccatctctgctgctctggaggcaagaaacct

SEQ ID NO: 12157 - DNA, 12075 bp, Oryza sativa
  unsure (1)..(12075): unsure at all n locations
tctacacatgttcaagatttcatcacataatagcctaagattgtctggaaggcaaccatccatggggactaaaaaagtctttttggtgcaaagcagcttctctgaatccgagtcattgagaggcttcatctgatgcacaaccccattataattagacaaaacccacccagaaacctgctcatcgcgagctgtaaacaatattctgctactgcagttattattaggaaatgcacccttgatcatttccaaatctgatccgtcgaatatatcatcaatcaaagcaaagtatctggagggagaatacgaagagagaaaatattaagagaattcgagctctgatgctgctccgtaagagaagttctaaatgagtacagtactatatagcagctgaattaagcaagcagtacatgttgtttacctcttatccttgaggcattctgatatgttgcgagccaacagctctgggtcgtcctccaacatcgtgatttctgagctgttaggtgatgatggtgcctccagttgctccatgatctgcttgaggatggtttgaagaagaagctgcttgctcctgtgagctggcctgcgggataatttagccacaacgtggcactggaaatgagtttggcaccggagtcgacggtggagctccatggcaagagtggtcttgccaatgccggcgggtccagcaatggccatgacccggaggctcttgtcggcggccatgagccatccgagcagctcgtttgccgtgccgtcgatgccaacaagatgatcatggacggcagcagcctcgacttgggctgcttgatgcagtgatggcatgagctccgagcttgggagcttgaggcgtggatcattggagaacacacggtagagatagtacgccttacccggagtgtcatagttgaaagacattgggcggcggaagcaccgcatgggtggttttcgcagcagcgagcgaggtgcttcttctcggtgccgtttacacagaagtttcactatatctatggcgtccctcgtctcgagcttcagcatcataagccaactttcgtgtctatcgatgagatcgactacacaacgatctcatcataagttacacagaagtttcactacacaatgatggaagttcttcccatcgctccctccgacatgatccccggccgcacgcctgcaagactgtacggctatctgtatctggtaaggactcaagactgtacggccgtacgcctggtaagactgtacgcctgcacgactgcgcggcagaacaaaattactgcagcaaacatatgtattgcagatgcatgccgaaatgcatgctagacgataagacgagtactccctccgtcccaaaaaaaaatccaatcctgagtttgaatctggacataatgtatgtctatttcgctaatgtttgcgcgctactaaagcagggaacaccttatctcttccccatccttttgcacccatctccccaccaccagaaacgtcgctttcttcccatctcctcttccaagctggctgcacacgccgcctctgccataagctgcatgcgtcttctacctatcctcttcctcggcaattcgtgggcgagctatctgctcctcttgccgtttttttcctcctctctagcacgacaaacggagtgaaaccgctaataatggtatacgggttgttttcttcttccctttcggtttttcatttttttcagttttttaatatatacatatatcaaccttgtatacgtcttttttttctctcggtttctttgttgtttaaatatgtacgtatacaaacatacaaactttaatttgtatatgtatatatttttttcttatacatcaagattgtataaataaataaatatgtatgtatgtatgtatgtatgtatgcatgcatgcatatactttacatacatacgtatatatgtatatataaatatgtatgcatgcgtgtatgtcgtgcctaacacgcaccgaagcggatgcgtggggaagtgggcgtagtggccgcgagaaatgaggagccgggcacggaggagggaaggataaaaacgactaggaggggttctcttcccctcctttaatcacttcaatacgccgcgtttctgtgccctagctctctccgttctgtgcctcccttgcgccacacgctctcgctcttctcgcctttccttcgccaatgccatgacgtggagctccgtgccactggatggcagaatccagcctccctctcgcattaccaatgagaggtttgtgccagctgttggagggtgaactcctcaagcaggggactaaggagcccccttctagttcggtcggggggcagcgggtgataatcgaggtttggtcgaaggagcgatgcagaaggggtcgggcccttaaagaacgatgagacaaaaggggtttatacaggttcgggccactaagaagcgtaacatcctactcctgtatttggttgattctgtgaggaacacaatgtatcagtcggttgaaatctgagaaatcatcccccttctcactaggcctggatctccttatacctcaaggggttaccacaggggcccaaaaacccacctagagaagaaggaaaacattatttacatttattacatgtcttatccctctgacttggaagaccatgagcacagcgcctcggcatggcccccatcaaatcatgctgaacgatacgggggacgtctgtatcattctgcattaattactgaaaacttccgagcactcgttcccaccagggaacgggtaccctcctccatcggtacacgccatgtgtccattcgcgtggggggattaggatcctctgacgtgaagtcagagggatgtggtcactgacatatggaccccaccactcgcggaccaacatgtcagtgattacgccagggagtagttcacgtcagaggatccggttccgcgcgggagagggacgcgcagacatccgctctaaatagcttttccgatcacccctgggggttgtcctggccagtggccactggggttccacttgcaattcttcaccgctcgaataaaaaaaaaatctccatcggttcttccttactcaggtatctattccctcagtcacagccactggcgattgttttctcgccgaagtcatgccctacgaggaggttacgactagagagagaattgtggcgtgggggagtcactgaaaccgtgaaacgaaagctgattatggatctggtcgtcggcgcgtcgagcggcgccgtgaagtcgctcgtcaacaagctgggcaccctcctggcgcaggagtacaccctcatctccggcgtccgcgacgacatccagtacatcaacgacgagctcgccagcatgcaggccttcctcagcaggctcaagcgggacgtcgcccacgacgagcagcgtcaggactggatgaagcaggtgcgcgaggtcgcctacgacatcgaggactgcgtcgacgacgtccgccaccgcctcggcggcgagccccgcgggaccggcacagttgtctccctcaagaggacgtggtacctgctcaccacgctgtaccagcgctgctgcatcgccaccgacatcggcaacctcaaggtcagggcgcagcatgtcagcgagcggcgcaccaggtacggggtggagaacctcccagcaaacagaaatggtggcggcaacaacaactccggcgctcccggagaccatccagctcctctcccccggctgattggcaccactgaacctgtaggcatggacgacgccatgaacgaccttcaaagatggttcatggtctcaaagcagaacagccaaatcagttaccttgctatcgtcggatccggtgggcttggcaaaaccacactcgcaatgtcattttaccgcaagtttggagatgagtttgattccagagcgttcatgctcgcgtcgcagaagtttcatctcccaacagttttgagaagccttgtcagccagttccatcagaagcaggtcagcgcttctgaggatgctcttcacggaattgaggaatggggagttgaagccctcaagaagaagctcgctgatcaactgcaaggcaagaggtagaggaatggctactatatattacggagtatttattttcattccttcatagtttttcttgacatttctggtttagcacttgagctaatctttggatcagtctcacacaagtttttagtaattaaatagtaacaccgaatttgaattatgatactacctccgtttcaggttataagactttctagcattgcccacatttatatagatattaatgaatctaggcacacatatatatctagattcattaacatatactgtatatgaatatgggcaatgctagaaagagttataatatgaaacggaggaagtagttattactgatttggataaggggtactttctccgttcacaggtaacagtcgttttggatacaaatagtctacaaaatgcaacagcatttttattgtatatatttataaaatccaataactttatgcagaatagaaaaacaaatattgataccaaagttgaaaaggtttaacaacatgttttgtgcctgggaggagtactacttcttcattcttttaagttcaaatattaaacgaagaagctaggtagtataaaatgttatttaaagagcaacttttacagtactttctcaagtactgtaaaatcacactctatttacaactacaagtaccatcaaagcacactctatttacaactacttacttctaaacaattcctgaacaggtaccatatcttgattgatgacatatggtctgtatcagcatgggaaagtattagggattcattacctaagaataataagggtagttgcgtaattgtgactaccaggtttaactctgtagctgaagcctgccgccgtcaaaatggtcatgtgcacaagctcaaacagctcgatccagtgaactccagcaaattgtttcttcaaataatatatgctaatgatccgtgtcccactccaaccattaatgatgagattgtcgtgaaaatgtgtggtggtctgcctttggccataatagtagtgtcagggctcattgctagtgaactgaaatcaaagattggaaagacgttggatcagaaattgattgaagtggagaaggctttaagtgcagagttgggaaacaatctcaccactgaagtagtgcggataattaaccactgctacaaaaatctgccacctgaccttaagacatgtttgctctacttgagtacgtttccgaagggccgcaatattagcaggaaatgtttgataagaagatggattgctgaagggttcgttactgacaaacatgggcagacggcagaagaagttgcagaagacaacttcaatgaactcattggcaggaacttgattcggcctatcaacaacagcagcaatgggaaggtgaagagctgtcaaattcatgacatggtccttgagtacattgtctccaaatctggtgatgagaatttcatcactgtaattggtagccactggcagacaccgtttccaagctacaaggtgcggcggttgtctgtccataaaagtgataggcaagaaactgatctagtagagaggatgaagttgtcgcatgtccgatctttgactgtgttggagagtttcaaagctcttcattctactatgctcaaattccagatactgcaggtgttggatcttgaaggatgcaaggacttgtcgtcaaaccagctcaagaaaatatgtaatatgcatcagatgaagtacctaagcttgcgtgggacggacatatacaagataccgaagaaaataggcaggctggagtatttggaggtacttgacataagggacacggatgtcacaaacttgcctgcatcagtggagaggcttcaacgaatggtccatctattggctggcaataaaaccaagcggagagcattgagattaactgaaggaatcacaaagatgaaaactatacagacactgtctgggattgagatctctggaaggtcaaccaggacagcagctggggagcaggcaccagttcttgaagtcatcagaaatgctacaaccaccgatgccaaggatggagatatcgcgggcttgcaaggtacccgtaaggaaggcagcaaggtggatatgccaaaacaattgcgtccgctagcagccttggagaagctcaccaaccttaagaaacttgccatttacaggcttgttaatttccaagcgaaagatgatgaattgttgctctctgctattgagcatttgagcagttgttctctcaagtttcttgcaattgatgacagtttcacaggctttcttgacagatcactgagttcttcacaagcacaaccagaacacctttacacccttgagctttctggcagcttgtttaaagtgccagaatggattgaccgcttgcacaaccttgagaagcttactctgtccatgacttcacttacgacagatactttggtgactcttagtaggcttcctgagcttttctctctcattttttcacttgatgcagcaaatggtatttcaaatatcctcaaaactgtgcagaagaatacattggagtcaggtggtaaaatctttgtgccggatggggggtttacaaagttgaggttgctccgttttacggcaccagtgctaccacctctgagcttcctagaaggggcaatgccagagcttcagaggcttgagctgaggttcagaatcattgagtttgtatacggcctggaaaacctttcaagtctccaacaggtatttctgacctttagcagccaggcacctgaagatgcgaaagagaaggtctctcagatcaaaggactggcaagcaagattcgaaaggctgattcctccaacattagtgtggtgatagatgagtacaacgaattatcaaaagaacaatagattacctagtcatgatctccacagttggagggaaccagtgtgttatcgatgtgttgtacctactccatctacagtctgtttttgttttatgattttcagatctatttacaattttttgtactgtttttttgttgagctgtggcatctttgttttgtctgctgtactcccaaaactctgctagtgaaaaaaaatatatcttctgttttcctaagaaaactaatcaatataaaggtgtttcaccaattctaataccattggcctacttaaagatgctatttatttgcctcgcaaatttcaacttaaaacaaatatctgttttcagtctctaatggggttcactgatccctgacaattaattattgcctgtagaaggattcactaatccaagttactgccaaaatttttttaaaccaaatttaatttctagtaattccagaattctaattagttcctgtcaagaaaatgaattctagttaaccatgtacttgtgtttattctagtcaacaatgcgtgtaacatgcatttgtttctacatccaaatattccgtaagaaaacaatgtatttacaaatactctaccttactggaatcaacttgtatagtgtcttgattttattttcaacgctaggagttctgcagttttttatttcattggagtgtaacattttttagtttatctattcctacacacaatctgttttacatcctcacagacgtgactaaatcaaccgtcttaactaaatatcaattttagtttttctctgcaattttaatcaggtggttgtggtcttgtggaactgccaacatcaccaattcatttcagttattttttttatgttgctcattttgcaatttcagttcatgtggtgtgtagtttcctagcttgctctgtatcaacctagtcgattaaattactcccttattattctttcgataatgacctctacatccagcatgtatcagaccataaattacccccttgtgttcctagccaccacttagagtagacaagcaaaataagagaactgaatcaatcatgtgtctgcatcgagatgaaaaacctagtaagccgtggtcctcctgatgagccatggtgctcgacctgccgatggttgggtggaggccgacgaaggaagacgtgaaaaggggatccgacctcggaggaggaggaggtgcatgcgcggagatgtagcggcgacgccggcgtggacggcacagggatgccgcgcccgcgcgtgggcaggaggtggagaaggggggcgccggcggggaggacgtgcgccgtgtccctccggtggccggagcggaggaggaaggagaggcggagcagatctgacggcccagattgatcttgcgatattgggccttcaagtgtctcctggcatgatggcagcacccttaaacgggcctccttcatgggcttttgttttggttgtctatgtgggctgtaatttctgtgggccttcacatttgtgggcctctaatggccatggccgtcatgtaatccgtgtggtgagagatgctcgctctcgccgttgccatggcctccaccgccgccgctctccccttatttttcacgaccccacctcctccagtccggtgaccggagaaggggaagaaagaaagcctagaagatccgacggcggcacagattggttggcgctctctcacgcgagtcatacatggtcgccccgctttgcaatgcgtcgagtgggcgaacaggggtgtccggatcgggctggagacgtggagatttgactacgcgcacaaggtgtttgacggaatgacgcacagcttcctagcagtcgaactaccttctgttctggaccttctggtcagtgttgttctacttcgattttactctcagttttgagttgactttatactgcaatgcattccacaagtttgaactgtgtaggtagattttggaacttcaggtttggtttggactttcatgtagaaaattacgactcaatgacagtgtaacacactctagggaatgtaaatcaaatcatagtttacaacagttaacatgatattgaagataaaaaaaatggcacaacagcgacacgcatgactgaacatttacgatatatatcttttttttaagggaaaacagcatatgtgccttttcattaaatatatatcacaatgacataatttataactatagttacatgacacaatttaaagtttatagatgcaagtggctaacagtaatacagaagcgaacgcgagtggcaagttgtgtttcttggctgttcttgtctgcaggctgctattattgtcccggacgtccaatgtatagcaaatcacaataacacaggaatctgttacagattattgacttattacacacgcaatctgcagcatacagctccgaaacaatagtattactcgcagaatcaactttgaacgaacacagcgacacacaaataaaaattacatatacacagtttgctcctgatcatatgtaattacatatatacacagcgaccaacaacaatacagaagcgaccatgagatgtaagagttattatctcaccgctctgtgagatgcattgccatttgccaacaacagtacagaagcttgttcctgctgtctgctcctgaacgagctgaagcaacgcaggctgtcctattgtcttttgacatctctctcacctcaggagtcaggagaggaggacgtcattccctgtggcaacaagtaattaagaagaagttcatcaactaaatttggagttagtttgcaggtagcaatgctagacaggttagcgtgaacagtgattaccttttcaataggagctaggcatggcactctgtttcaccttcatcttctatctcgctctgaaactctgtttctctcctcggtgccgcttcatctgctgcctgaacaacatcctccggcgaattgacttggttgaatcttgttgcaccctctgcctcctcctcaccagcttgattaacttctatttgcatgcctctgatgaaaaggtcaatagggttgcgatgcttggcgacctccttgctcactgcctctactttcctcttaatattggggctgttcatgtaccgtacgttgtagcaaagagctacctctgaaagcattttaaggtttccgatacctgaaggaacactcatctcgctcataggggatgtgtgcaaattcagtcgcagatatgtgagcttcggcatagcctcttcttcgaaggtcagccgtgggacagggcaatcaagggagaatttctctagttctttgaaccctttgctctcaatcactatagcttcttcaggaatgaactccaagcctagtatcaggcgctgtaatttgaccaagcccgcgaggatcttcacatcacctgccacttgtttacagaccgtgatctgcaagaaagtaagatgctcgagcccttcaatccattggggaacattggcgaattttccggctgttactttaaattcatcaagaaatttaggtggatcacttagagaacgcaggaactccatggaacaaccgagcccacaatgaatggttaaggacttaagttgcctccattttcctaaggatgacaatagggcttgttggtaggctttgtcattgcactggtgaaaggcccatgttattgcgaggatcttcaagtcgtgtagatcaccgagatactttactgacctttcggagaattcacttaaatcaatgagaaaatgtttcaacatttttagccgcacaatttgctctggcatgtgctttatttgtgtgcctcttaggtccagcatccgcaaagatcctggctcgcacacttctgatgggatctcacttatgtgggtgtggctgatgtccaatgcattcagggtgcgcagctctttgatttgtggtgggagcttgctgacctttgtgttactgacgctcagataactcagcacaagcattttgcatatctgcagtaggtcctcatccttcaaattctcccagccttgaagatccaacgacaccagatatccaaacttgtctagagggactgttgttctgttgactgcaccagatatgagtagtgaacgagtatgagacaaatccatttcttgcagcatttctgggagctgtggatcgggatggtggagagctagacgacgtgctatccgagtgttcttgccaccacctcttggtgctgagttgagagttgcgctggtaatgacataacccttctctgctgctctgtaagcaagaaacctcagtatgaaaggattgacctgccacaggcacaagtcatcttcatcaagattgtgtccacagttccttgctgctggggtgattatattcctgtcaaccatctcagagaaatgcaactcagacaacagcccttcgtctagccatttcatgacaagacgatccttctcaaacacatatccctgtggcaacatgcttaggtagagtaacgattgtctcaactcatcactgtaatcaaatgatagccagtgttcaaactgtttcagcagcaggcgtacttcttccaccctaggaattgctgagctgccgtgttgctgttgatgttgtttcaaccaatcagccataccagttatgaacgatggtattcctctacatttcatcaatatttcatcacataatagcttcagattttctggagggcaatcgtccatggaaccaaaagcttttatgtggagcagcttctctgaatctgagtgactcagaggcttcatcttatgcacaatcccattataatttgacaaacaccaccctgctatccgctcatcgccagccgtaaacaatattctgctaccacagttattattaggaaatgcacccttgatcaattccaaatctgattcgttgaatatattatcgatcaaagcgaagtatctggagggacaatacgaagagaaaatattaacagaattcgagctctgatgctgtactgtaagagaagtcgtaaataagtagtgctatataattatagcagctgaattaagcaagcagtaaatgttgtttacctcttatccttgaggcgttctgatatgttgcgagccaacagctccaggtcgtcccccaacatcgtgatttctgagctgtttggtgatgatggtgcctccagttgctctatgatctgcttcaggatggtttgaggaannnnnnnnnnnnnnnnnnnnnnnnnnnnnnnnnnnnnn

SEQ ID NO: 12158 - DNA, 11943 bp, Oryza sativa
caccatgtccattagagcacggttgcgtctttctgctactccgttctgctgaggctcgccaggtgtggagtactggactagtatgccattttcctgtagaaaccttgcaaaaggtctaggtatttggccataaggggtatgccgaccgtagtactttcctccacggtcagaccttactactttaatctttagatcatgctgattttctacctcagccttaaaatcttgaatttatccaatgcttttgattgttctttaattggataaatatagccataacgcgaataatcatctgtgaatgtttaaatgaatcataaccatccactgtcttaattggaaaagggccacagatatctgtgtgtatgatttccaatttttctaaacttcgtatggctccttttttttatttgtttaacatactttccattaatgcaatcgatgcaatattctgtatccgcaaagtctaatggatgcaaaatttcttcttttatcaatcgttcaattctccccctcgaaatgtggcctaaacggcagtgccacaattttgccgaggtttcctcattgcaccttttgtgcttacttcttacattcgtagataagagagacacactattgcacgcaacattctcttcattgcatacaacattcgcattctcatgttcagacaccatgtaaagttggccttctcggatggcaagacccacacacttattcttgaatataattgaacataaatctggttcaaaatagcaattatatccatcatccgccaaacatgaaacggaaactaaatttctacttaaggagggtacatagagcacattgtgcaaataaagtgtgaagccattattcaactttaatggatattctccaatagcttcgacttcagcttcgacaccatttgcaactctaatgcatctttctcctcttgctagcatcctcctcgtatggaagccctgtaatgaatttgcaacatgaatagtcgcacctgaatcaacccaccaagtggattttgaataacttacatacagggattcatctacgaatgtaatgatgtctcacccttttttaaaagatgcttcaggaattcagggcaatccttctgaaagtgccccttctgcttgcaccacctgcaagcgtccctctccacttcttgtcgtggatttggatcaacctgtggtgcctttccacgtgctttgggagaggcgacattctgactgtggttgttcctcttcttgttcttcacataatttgcagaatcaccacgagttttgggtctatcctcttcttgcacacacatggcaatcaacttctcaatgttccagttttcgggcaatgagttgtaattcacagcaaatgactcgaattctgaaggcaaggaggcaaaaatgaggtgaactaggaagtcgtcagggagaaccaagtctatcttcttgagctttgaagtgataccgctcatcttcaaaatatactctctaacatctccgccatggtacttcatagtaactaagctcttgattaaggagctcgcataagcctttgaagaaatagtaaactgattctccactctctgaagatactctgtggcggtggtgcatactgggattgctccccttactgcctccactattgagctcttgattaccatcaagcacttgcggttggaagactcccacttcgcatgatcagtgtcgtacttctatactattggagcatggtccaacgttctctgcttaaaagcatcttcgctctcaccctccgccctcactggcgcaactggcgcagtgggacagggctcggtgagagctaaatctatattagacagcgcaagtgctatctcaatcttctctcgccatgagccttaattattcccattaaggggctcaacggccgagatatacacaagtgggttagttgttcctgaaagcaaatttaaataaatcaagaaacaaataaaactcttgtatgttttaatttaacgttggtcaaaattaaaacatacaacatactaccacattaattctacatcaccgttgggcagaaatagaactaatgcatggaaaacttgtaaacatcattatagcagcggaaacttaaaattacatacatgttcagaagcaattcttacaattttttactccctgaacaattttcacgttggttaaaattgcttagaaataaatacttcaataaacataaataataaaagcttctaaaatagggatccaaatctaacttctttttctttttttgcttcggccacgaggaaccaaaatcagactttggccggcctggcacgttcggcccacagccaccaaccaagcgccttttttcagccatccgatcgctagggttacgatcggacggctgaccgccgagatcggggggaacaaaaccctccctcccggccggccgaaaaaccctagcgccatttctctttctccctcctctcttcgctgtggccacggtcggtggcagctggaggtgatggcggcgccgccgcagggcccctcgccggcgcgcacgctcgccctaggctgagcgcgccaccgtcgtgttaacaaccaaatttggtagcatttgtgtcaggaaaggggatttgatcgaagaagagttggaggcggagatcgagttctggaacaaagcaggaatcggctggagtccagatcggctacggctaggatcggctgaggttgagctaagctaaataagctgatatagccgattctgacaatacgacttgtgcacggcgtcgggctcaggttgatgtacttcaagatgattgccacgcatggatagagtcctgggaaggcaattgtatctattaattaggatgttttatgtaaattccttatagataagtgtgggcaaaagtctgccgcaaagacgtgatatttagagtttgttagagataatggtcgtgtccggtatgggcatatcttgtaatcctcgggtataaatagaccctgagccctatgtaatttttaacacacacgttcaatacaattccggcgcatcgccatccttttactttaattttgtttcgacgagtttttgctttcgggttgagctgcatcggtttcgatcttcaacaaaaggtaaaattcgttatgacggatcgtgttattaggattagtgcttccatctttatgacactctaatcttatttatataattcgtcaagttatcatatatcttacataatcttcagcaatatcgctatctaatctactatcgaccaacatctgtatgcagaaggcatccgattaggttagatcttgatgttgatccagattatataagatatctaccattctatgaatcttctagcggcttgattgtctagatattgttcttcttttcatacttaatgctgcatcaattgagtttgatctattaagtcgtgcttagaatattgatctctagcctgccacctagttgtcgattagaatagcatcagagtttcagccgatcgtatctgatttaactacagttatcctatttgcttcattaatatgttaaatctgccctttatgtcaagatactgccataactaaatatgttaaactcttgtttgatatattattattgcttcaatatcttaatatagagtagtatcggagtattagccgatacacgctagatctatctgatcggctacgctataaatatatatatatagtcctgttgtggatgtatatttcggtctaagtgatttatactgtctcggcatgatgaccgatctattccaatcacctgatttaagtatacatcgacataagaatcatatatcgttaatatttacagccgatcaagtagatttagttcttctttacttatttacgattgccgatcgatatacagatgacatcggctcagatataaatgatatgtcatcggcacctggctgatcggctatcatttatagatttaaccacggttctcttgtctttatttcttgttgattacaggatcaaatcaactggcacgctcacacatatgaaggcaagttttggacctgcactggagttaagcagatctcccaggcctcgtgttttctgtcaacacgtcgagcggcattgcgacggtgcccttgacgccccttgcggtcctctccccgcttccttcccgcgcgcgtcggcgacagccggcggcagcggcggtggactccccgcgcgcatcggtgtcagccggcggtggcggcgtactaccctcggcataggcgaaagccggcggaggtggtggaacttcccgcgcctgtcggcgacagctagcggcggcggtaggacttcccgcgcagcgtcggcgacaaccggcggtgggagaggtaggttttttttttttgcttttgttttaattctttggcttttcttcgggatctgagaccccttcttctttctctttctaaccctaccagatctacacctagttaaggctctgataccattgttagatcttagtgtttgcctaggtgtggatctagaggtagactaactcatggcaatagtagtgatgcacttagagaatgaacggggaagagggagagagatgtgagggacgtacctttgcccttagaggttgatgcggccatggcgacaatgtagctttgcctgtgggtgctcccggggtcggcggcgtggacaacgtcgatgatgatggtgaggtcgaccggtggcgtggacggtgtaggcgacggcgatcccgacggtaggcttcccctcacttcagcgcctatcccggatcggtgggttctagggtttgtggggagtgcgtgtgcacgacgacgaacgtttgtttgcgtgcgccaacagctccccctcttttatatggcacttcgtgagaggggcccacagccattgaacggcgggcgccccctatcagggcgcgtgaggcggagtggggatcggtttcacgatcccctgctttatccttctctcaatcaaagaaagggaatgcaaatgttctgtcgccctctcttcgtatgccaccagccttcctataaaaaaagattcattccttgaacataggcctctctcttgcggctagcgagattggtctcggtaatatggattggtcttgttaggggcacttgctttacaggcacaccttgtttttcaatgagaaggagaacttcgtatttggtaccaccacaatagatctagtctactcatatttgttcgacgaggtttcccgatcagtcctaacgcacgcaccctggagatcgcaactaacaaagggctctctactcaagttggatagatgctagtagttttcttgcaacaagatcgcattgacggtgcgctgctcctgaaatcactgaaacaagcagcgaagctgcgaagcaaacacacaacaatctttgctaaatcaaatcaagttgggatgaggagagagagcataaatgaattttctgcatatacgaatagatgaatttatgcagaaaatgaatagtagtggcacggatagaatttctgcatttacgacggaaaagatgacggtagtggcacggatagaattttctgcatataggaataaatgaatagtagtgatatttatctaaattgatatatttacagtggcatagattcaactaaaccaactttaatagtatagccaatataatagccaatttatacaatagttgcttactatactattaatacctgattctacctgtcacacacattacatcttagagtccgtactgcagctggctacagatccatagctcgctgctcttctctatctttctttatctctttaaaatatattccctccgttttaaaatgtttgacaccgttgactttttagcacatgtttaaccgttcgtcttatttaaaaaactttgtgaaatatgtaaaactatatgtgtatatgaaagtatatttaacaataaattaaatgatataaaaataataaataattacttaaattttttgaataagacgaatggtcaaacatgtacttaaaaagtcaacggtgttaaacattttgaaacgaagagagtatatgtatagctgagcctgctattatacctgctcgtccccatggagtcctctgcaggctacagtgcactccagcgtccgttgggttgggcgtagtgccgtagtgtagcttcatctcgtctcgtcatcgaggtcgccggcggtgaggggcaggcaaagaacaagatggagctcgccgtaggcgcctcggacagcgccatgaggtcgctgctgggaaagctcggcagcctcctggcccaggagtacacgctcatcagcggcgttcgcagcgagatccagtacatcaaggacgagctggccagcatgcacgccttcctcctcaacctcggccacgccgccggccaccaccatgacgagcagacccggggactggatggagcaggtgcgcgacgtcgcctacgacatcgaggactgcatcgacgacttcagccaccgcctcggcggccagccacgcggcgagggcctcctgtccggcctccgccgcgcgaggtacgccgtggccacgctctgggagcgccggggcatcgccgccagggtcgtcgacctcaagaaccgcgcgcagggcgtcggcgagcgccgcacgaggtacggtgtgaaggaccccggccggccggacgccgggaacgggaaggccgccagatccgccccttcctaccacgtcaacgaccgcccccagcctggtccgcagctcgtcggcgccgcggagtcggtggggatggaggacgccatcggcaagctcggggcatggctgaccgaggggctgcccgacctgagggtcctcgccgtcgtcggattcggcggcctcggcaagacgacgctggcattggcgctgcaccgcaagttcggggagaagttcgagtcccgggcgtgcgtgcaggcgtcgcagaagctcaatctcgcggcgctgctcagaagcatcctcaggcaagtcatgcctcaggtccctgacaaggagagcacagatggagactctcttgcagggatcgagagatggacagacaagcagcttaaggagaagctcacagcacatttggaacaaaagaggtactcctttcccccttcggctccatgattcttaatgttttggataatattaaagtcatcaaacttttataactttaaaactatttagtttaaatgcacttaaggctatgtttggagataggtgttagaaaccatctcctatacatgaaaaacggagcggttcattaacacgtgattaattaagtattaactaatttttttttcaaaaatggatcaatatgaatttttttgataacttttgtataaaaactttttgtaaaaaaaacacactatttagcagtttgaaaagcgtgcacgcggaaaacgagaggagagtgttgggaacttgctcttgcaaacacaccctaaatcaacacatatatagatttatcttacaaagtattataataaaagtaaaaatatgttaatttattatatatattattattaaaaaaacatagtcaaacatatatattttgaagatcgtgttattgtccaaaacttggaattatggaacagagggagcatactactatacatagtttgctatcatctttacttctttagtgctgagttattacttttataatccagtcaatgattaaatgcggagaatatagaggtccgatttctatccattatagaaaaataactaaatgtggagaaacacagtttttctctggctttttttctaataaaaatttcgtaattatgtatttaattatatttcctgccatggtaatgtgttattaatcatgtttttcttttggataaaagttgctagaatgccctcaattttattagcaaatctgcaaaataacttcaggctaccactacagcagattgatcctgatttgtgaattctgatgttctgtgtctaccatacatgcctaaggctaaacccaagttgcaatttaccatttctaaaatgataactgcattctcaactaacgtaactaatggagatgaataccaactttgaagttcattctccaccatatatgaatatgagcaagaaattcagcattccgcttaatctttcggaattgttagtactaggacaccattgaagcacagtcaaatgaagtacttcctagtattcaaaatttatggttctgtctgtccactaatctattatatctttaaagtaatagaaaaagaagcctccatgttcgctctcacaacctagaaattctcacattaatcaaaaaaataagaaaaaggaaaaatagaactagattaggattaggattagttaaaaactaaagaaaggagaaaagaagatgaatcggacaatcagtcaaaacgaaaataagattaatccaaaagaataaggaaaaagaaaaatagaactagattaggattagaattagttaaaaactgaagaaaaaaaaagattaatcggacaatcagtcaaaatgaaaataaggaaaaccgagtcatacaatacattggaaactgacaatgttttgggaatccgcatgttcacaccacttttagaaacattgaaagacaaaccaatcctaattaaactctaatcaaactcttgccgtttccgaatcgtataagtacttgtcatgtcaataaatacttcaacaagctaaccaaagcaaaccagaaatcttcaacaagccaaaaaaaaacttcttgcagtgaccgtcgccgtgatcatcaacaagcacgccacaaattagcaaattcaccgggttcttgccgttcaaacttctcgccagcacgccacaaatctgcaagccagaagttctcaccggaatccacttcgtcaatcaaaaaggcacccaggaattgttcttgctggaatcactatggcatacaagaagattagtgagttgacaacaaaaggtcaaacatggagaatcaaagcgatattgagaatgtaggaatcggtaaattttgcaacagatgagattatgagttttgatatgctattaatggatgaagtccgtacatgcagaacaaggtccgcgaaataaaatggactggcacatcctatctaagtccaacaggattagattaagccgacattccagaaatgcaaaaatcattaaaaaaataaaaaaaagaaaaacggactggcacatcctatctaagtccaacaggattagattaagccgacattccagaaatgcaaaaatcattaaaaaaataaaaaaaataatcactgaagcgctcaccatccggagaggagttgagaggctgttgggggaggatgcgtcgatgctagcgcgtgcataagctccatagaagatcaggacccgacgcggccatggacgcccgccgtcggcggctggggaaggagcagcctcgatctacgcctgcgatggcgtccagggagggagccgcctcaatccgcacctacggtggcggccggggacggagccgcctcgatccactccggcggcggtgccggggacgcgcgctggcggccggagaaggggacacggtggggaggggaaaagggcggcgccgctcggacggggaagagagggcggcgccgcatcgatgtgttcgatgggggaggagagaagcgaatcagtgagagaagggttgggctgacatgtgggtcatagaagttcaagggtacatctgtattttttttttatgttctcatagggtctaaaaacatacaagtttcagtaataaatatttcaatgactaaggtgatcagcactaaattttaatcatgtcataccggatatttgacactatttagtagtattaaatgtagcaccattactactactaacaactactgctccttattatgggtaatcactagatatactactacctccatatttttaatgtatgacgccgttgactttttatccaacgtttgaccattcgtcttattcaaaaaattttatgcaattgtcatttattttattctgactagattcatcatcaaatgttatttaaacatgatataaatatttttatatttgtacgaaaattttgaataaaacgaatggtcaaacgttagtcaataagtcaacggcgtcatatattaaaatacggagggagtattaagcaagcaatctaaggattatttaatggtcagctttgttcataacttttgtgcgctaggtacagcgatcgatccaatatctcacttactttttttttcaaaatagtaaaaaacaataatcttttgagttatccatttattattttcaatagaaaaaacatatttttccagggggtgtttagatacaggggtgtaaagtttttgcgtgtcacatcgggtattatatacggtatcgcatggggtgttcaggtactaataaaataaactaattacagaatatgttagtaaactgcgagacaaatttattaagcctaattaatacgttattagcaaatatttactgtagcaccaaattataaaatcatgaagcatttaatcttaaaagattcgtctcacaaattagtcgcaatctgtgtaattagttattattcaccctatatttaatacttcatacaggtgttcaaacgttcgatgtgactgggtgtaaaatttttatgtaggaactaaacagggcctaaaacacattagccaaccatttctaacatcaaaacaatctcttttttagtttaacaatacctcctaacaattatctttcgagtccatgtagaagtaaaaaaaatataaaatgtaaattcggaatttaaaaaaataataaatattataagaggagtagagttatgctcccattttactatcttttaaaaataaaatatgaaaatatatgtttcatgtgtgaaaaaaaaatgacgctagccgcgcaatctgcgcgggtcaccttactagttcattgtgtaagaagaggaattatcatgaaaaacaattgtgatgtgtgcatcattgtgtcataatgatcctgatttgatttgtgcatgttgctccaacaggtacttcctcttagtagatgatgtctggtctgtatcttcatgggaatacatctggggatctttgcccaaaaataacaatggcagtagaatagtggtgacaacaaggttcaaatctgtagctgacgccagcactcatcagcaaacaggtgacatccacatgctagatcggctttcagatgagaaatcaaaacgactgttcaatgaaagaatctttagtggtgatgattcatgcccggacgagttcagggaaaccaaggacaaaattctgaagaaatgcggtggtctgccactggcaatagttgcggtggcaggacttctggccagagacccaaggtcaaagagccattggacaaaggtgcaagattcttttaagttcagagctggagatgaatcttaggccttgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatatgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccatgatgtaaacaccaccttactcctgaaggagtaacacagatactcaatctctgttacaatgatttgtcagctgatcagaagaactgcttgctttacttgagcatatttccaaagggctgcagcatcaacaggaagcgtttggtcaggcgatggatagctgaaggtttcattgttgagaagcatggaaaaaccgtcgaagaggttgctgacgactactttaatgagctcatcagtaggaatatcattcgtcaagtggaccacagtagcaatgg

SEQ ID NO: 12159 - DNA, 3281 bp, Oryza sativa
acactggcgccgtgcccatgccaccgtggcactagggctgtcgtggaggtgctgactgggcagaaagggggcgccagccacactggcgccgcctctcataccacggcgccagcatagctggcgcgcccctcctctgtgccttaaaccccgtgggccccaccacctttctcctccccactcccattttcgccattcccagcccgagcagcgagctgctgttcttctccctctctctccccctcacctctccacctcaaatccacttaatttgaagccgtttttcgcgggattttttgtggaaatcgaagagaaaggtagactccttcattcccccctcttttttttcatttttattggttgaatttgtagatcggtgggtaaccctagaaccccttttttacccaaatttgtgatttttagcatttgttcttaggattggcttgttgtagtgctacatgtttgcaatgtactcattggtgtcatgatttttttaaccatatatgtggtaatgttaatttttggatgggggtttttggggttggatgggatggatgaaaaattatggttgaaggcatgacggaggtttgggctgtatgataaagtatttgtaatatttcgatgtgtaatgcagtagtaaacttgttgatagttgtaggtggattaaatatttttttggagtagtagctttgggacaatttaagttatgcattggttataatatgtcggtttggactacgtttaggaatgaagatttaatttttgttgcaaagttacatttgattttttggtgtagatggatagacttgttcgtgtttactacggtggtagagtggtggaaccttatgttggtggacatgttgagtttgaggatatgtcattgaagaccattttgtttcccacccacccaactctagatgaactaaggtcacgagtgaaagaagttcttggatggaccgaggataatgtggagattcgtttttatgggagatacgatgttggtcaagggcataagtatatattaaatgtgataggtcagttggaatgggaagtttactttgatttggtaaaagatctcagtttagatctctagaggtgtttgcatcaaagttagttcgtaccgtagaaaatttggatctaaacaaatctccttcttatcattacgttgagaagaattttgtgacatattattctcgtcgtggagggggtgcaagtaagagtgagttggtacgagaagacttggagggggaaggagagaagaagagacctttgcttggaaatgatttatgggaggcaggaccatcaaagagacattgcggtactgatgatgtggatgcagcgagggtgatgaaaagggagttagtacaagaggggcttgatctaagtgaacatttgtcggcgagtgttcattggtcgtcgtacggagtcaaccctgaatacccgacagaagtagcaggccaatatgtgaatccagatgattactttgatgtcgaattgagtggtggtcacgattctgtctcagtagaagtcaatagagatgatgttgacgaggaggcaagtgttgagcaatatgatgttgaatttgctgaagactctgatgatgaccgtccattccctccacttagtaataatgacaagttagcattagaggaatgccgtgcgtttgagaaggtgtttgggaggaagccgggcattcctgagtttagggacctaacacatgcccatggtgcactactagatggcggcatcaacctagatcagttgccagaaccattccaggtggatggtctcagaaagggtttagagttcccatccatggtcgcattgaagctatggcttcaggagtacgccatcgtgcaccatcgtccataccgtgttgtcaattctgccgcaaatattaaatgtgaaaacccacggtgcaaatggaaggtccatgcaactaagaggtctagtggcacgtggaggatatcacgggtaggtaaggaacatagttgtgctactgccgaaggttcagggagccaccggcaactgacatcaaagttcatagcaaataggttatgcaatgccataaaactgcaacctacactctctgcttctgcgttagctttgtatatatttgaggttttccagtatagagtgaagtatggcaaggcttggagggcacgagaggaggctatgaagctcatttacggtgaatggggtgaagcgtatgtccgtttgcccactttgctgcaagccattaagcagaggaatcccagtatggtctaccacatcgatactcatcctgatagggttgtcaacgttgatggagtgaccaagaaaatttttatgcgtgcattctggtgctttggtccttccattgaggcttttaagcattgtaggccagtactagctataaatgcaaccttcctaactgggaaatacggtggtgccttgatgactgcattatcagctgatgcggaggaccaacttgtacctttagcttttgccttggtggagaaagagaattcacgagactggtgctggtttatcgatcttttctgacgggttgtggttgggccgcatagggaggtttgtattatctcagatcgacatgctggtataataaatgccatgatgactcctgttccaggattgccatcggttcaccactggtggtgcatgaggcacttcagtgctaatttccacaaggccggtgcggacaagcatcagacaaaagagctcctaaggatatgtcagattgacgagaagtggatatttgagagggatgttgaggcactaaggcagcgtattcccgaaggtcctcgtaaatggcttgaagatgagttgttggataaagataagtggtctcgtgcatacgatagaaatggccgccagtggggttacatgacaaccaacatggccgaacagttcaatagcgtgctagttggtgttcgtaagcttccagtgacggccatcgtatcatttacgttcatgaagtgtaatgactactttgtgaacagacatgatgaagctttgaagcgagtccagttagggcagcgttggtccaccaaggttgacagtaagatgaaggtgcaagaaagtaaggcgaacaaacacactgcaaggtgtttcgataagcagaaaaagacatacgaggtccagaaaggggtggtataacgcgtggtggtgttagattcggcgccagagcctttaaaagttaaaggtaaggggaactcatgttcttgccaaaggccattggtccaccctatgccttgctcacatcttatacacgtttatctgat

SEQ ID NO: 12160 - DNA, 4347 bp, Oryza sativa
aatttgaagattaaacaagagggaagaggagatcaaaacgattcaagaacgaaatggactcgggtctgggtggttctggaaggaaaccaccttcatgcgttcaacttgatgctgcgccggtgcaaaatagatgctcgttgtgtcaccaggagggtcacaagaaaactaagtgtcctaagcgtccaaaaaagaagaagtccaaaaaaaatttaagtgttagggaggtaaatattttgttttcctactcatgttctcgcattcattttcttttaatatatgtcacattggtaactaacggtgaatttattactttttcatgtaggatggccgaggagggacaaccgccgacttacccagccttagaggcgtactacgaggcccgtcatcacggggctgcgatcgaggcggggagggtatgaatcggcattgattcacttgtgcataagtatcggtagcgtgtatttgacattatattaactaattgatttacaattgctaatgcaggtacttcaaccgctccgagtcagagctcatgccccccagtgttcgacgataggtacatcccgtacctaagggctgtaacgccccgattttcgttcgggattaaaaatcatttaataatgcatttcctagaaattgaataaaaagttaagcaatttaatcaagtgaaataatgggagaattaaaattttcccttaaaaatcattggccgggaatattttgtaatattctttgtgccttaaaatactctccggatttttctgtgaattttcggagctcaagaagtaattataataatataaagttcatttaatcaatttaaataaaaagaaaagaaaataatcttccccttccaccctttcgggctcggcccaaatcccttcccccttcccctccggcccggccgccctcttttccccctttgggccgccggctcagctcctcccctccctctccctctagtcctcttttcctcccccaaccggtctcccctcttcctctggctgacaggtgggacccgcggccccacctgtcatctcctacctctagctccatccccaaccgccgccatggccgccaaatcctcccacgtcgccgcctctcccgcgggactccctctcctgcgcgtgcgtggacgcggtcatcgccacgtcgccgcctcccgcacctctctctcctcccacgtcgccggccagtttccacccctctcgggctcgatcccgcctcccctcccctataaagagcatccccggggcttcctctcccgtttccccctcctccccgagcccgcggcgccttttcccgctctccccgcgcgcgtcccagctccgccgctcctcggcgaactccagccgcgccgcgccgccgctctcgttcaccccgcactgcgccgtcgccctccccggcatcgcagccgccgtgcgcaccccgtccaccgctccatttcccctctccaccttcgaagcgccgcagccacgcgcaccacctctttccgccgccgccgccggctccagccgcctcttctcgcagcttcagccaccgccgtgccgtgccgtcgccaccgtcggcatcgccgcgccgagctccaccccgtcctacacctcttttccctaaatctcccaccaaaattccacctccgctgtccacccgagccacctcaactataccgcctccagccgccgcctctcaccgctctagccgtcgtcgcgcagcgtcgccgcgctccaccgcaccctggctgccactccactccgtccagaaccccacgggagccgcttttccaaagtcaaggtcagctccactccgtatcgccgccgtcggccgtcgtttttggtcgctccgtgccggctcttccctccctaaccgctccaatatcttccccaggtcttgccggccctcggccgcggctccgttgtggccgggcgtcgtcggaacgctgttcccgtcgcctcccatcccggccgccgccatcctttccgccgccggtcgtcgccgaggccgcccgcgccgtcttcccgagaaggcgtcgccgccgcccgttgtcgtcgtcgtccttcccgcgtcggtgagcatctccctcctcctcccctccctttctttttctctctttgcccgccggccgccgcatgcgtgtcgccgtcgcgccgcgccgcgccgccgccggtgtcgccgccagtggccgtccggccacgcgccgccgtctggtcgggttggtcggcgagccaacccacccctccgccttgcacctctaccgtggactcggtccacggtgggctagatccttttgcccactgacgcgtggggcccgctcatttggtggacccggtccaagcccgcacctccttgacgcgctgacgtgttgggcccacctgtcggcgccggcgccccttgctgacgtcagcgagtgccatttcccttgagaaaataaataataattgcgcaataaatcgagtttaattctagaaattcatttaaatggctcaaaatttctaaaatccatatctaattcattcgaactccgaattgagccattcaacttgcaaaattcatctaaaattgagctctacatgtttgtttagtttttatgtactgtttccttggtttttattagagtttttcctcgttttgcgtgccagcgtgtagtttccgtcgtttcggaagtccgcggtcgcgaggaaaaaagttcggaagatcaaagtgaagaagcaaggcaagtcacacattccccttgagcatgttgatcccaatttacaaatgttttactgtttgcaaacaaatatgcatgttttgctaattacatggggtcagggttttacctatctgctcgcttgtgccatgtttacttgatatctgttctttgtcaaccttgggtaatgaatcgactagctcatgttacttatgtgacctagctagaactatatgcttagccatgcttaattaccactagctcagttgatgggataattgcagtattagacctttttagtatcagagtgagctgcgtgctcgagacacctggccatgcttcatggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcactgtgattagtcccaccttaataaatcgacccaatgcactgtagtacaggtgggttggttgggcctgttcaacgtggtgtagcgttgatcagtggagattttaatgttactttaattactcaacagttttactgtttgctaaataaaacgttttacaaccgcctttatgcaaatagccacaaaccgtccttgtgttccccttgcacgtctgcatcgttggtgtggcttgctgagtacggtggttgtactcagtcttgctattattcccccttttcagaagtgtagtgcttctgagctgaagacgaagttagaggaccaaggctcggaccccagttgagttttgcctgtggagtggagctgaagccccgctaggatcgccttttttccgctgctgctgttttcgtttcggtgcgaggactaagtgcctctttaagtattttacgctttatttacgtttggaactgtatattacttgtcgttttgtgtaccctggctggtcctggacagggatttaatacacaaaatagtctggaaatttgggctaaatttctgggcgtgacaagggctgcgggttgctcggggtggccttggtcgtgagcagaggaatgccagtgttgacgctcctgcgttgacagcacttgtggacagaggaggcctgagacacacagttccacctccccagtggtgagatgaccatcactctacaggatgtggctatgatcttggccctcccattacgggggcatgctgtgacgggcaggacagagactcctggatggcatgcacaagtgcagcagctgtttggcattccactgaa

SEQ ID NO: 12161 - DNA, 1212 bp, Oryza sativa
aatggaatccctataatgtccgaactagagttggatatcaaatggagcacgccccacttagagacagagtggtagttttctggcatttgtcaaagttacttccatttgcaccctagaccctaacatatatcttttaacgctttcagtcgagagagctccttaggagtgtgaatgaaatggggcatgccctccaagctccgaggggtggtgaggacacggagaacacgctccgcaatgttttagaggtaaaatttatttagcactttgcattacttgagttatgcctaacaaacttctttttttttgaaatgcagaaagttcgtcaaaggtgccggaaacttgtagcaagattaggttgcaggtcggttggattggacgacgtgtaccaaccggggagactaccaccaccactacctcaatccgcgcgttcaagtactgctcgacactccatcaggatagaagagcgtgaaggagttggtggctcgtcgtcgtcacgcattaagcaagggaggggaaaggggaaggcgccggctccacctagcgacgacgatgacgatgaggacgaggaggatgaggactatgtcacaccagacgccgaggagatagacatgtcacagcttcccgacgcgcctcaggggacgcaacccacgcaatacaacttgcgatccactcgggcagcgaaaaagaggtaaaatgaacttaccattctcaaatgttatttgatttcccttattttgtttttaaaatgttttaaacattggattttcaaatgtaggtacactccgggctcgcaagcaattcggcgccaacggaagaagtaatttgtatgaagttaatctattggttggtagtatgacatatatggtgcactatgtgatataaaatgtgatggactatgtgaggactatgtgatggacttttgacattgttttttgtgtggaatataggatggactttttgcattgtttgatgtgtgggatatgtgatggacttttggcattgtttgatgtgtggaatatgtgatggactatgtgaggactatgtgatggacttttggcattgtgatttgtgcaattggaatctgttttagtctgtacgaatctgtgaattgtgatttgaattgcgaactgtgaattggtacatttgtgcaatatggatcttcaatttgcagggagcagacggcggcccaaccaccctggcgccaggttggga

SEQ ID NO: 12162 - DNA, 7140 bp, Oryza sativa
  unsure (1)..(7140): unsure at all n locations
aaaaataaatataagggtgaattagatataaccataggaaaaaatactttttttcaccattttgaggtatatttttgctcttgcatataccatatatttttttaacattttccttttgttttttattttcctatgcgtaagggtaaattagacaaatcatatagattttgcatagaaaggtgacatggcatgtccatgtggcaattttggtgggaccaaggactatattagcccacatgacaaatttaaaggacttgtttggacaatatgaaagaataagaactaaaatgacccaggatcgaaactttaggtaccatattagctattctcccaatgtatttttgtgttgtttcatgtatcacaaatttataattaagttgacatgcatgtgtctatataatgtagcgtatgtgttcatgcatgcacgatgattaagttggaaacgatgatgttcaaattagccccaaatttctagcatgcttaacaagagtaacgcaagttattagttagcaagttcaaatatttgggacgaagatgtgagaataagatcaggatcccactaattaacacagttaattactatagaattaaagagaaaacattttttcttaaaagaatttcctccattgtagcgattgcaccctaatcaacacaataataaaaaatgacacattttttttgtccaaaataacatggctgcatgatcaacaaaacatatcaatttccttcttcacttactgtcatatatgttgtactttgatattttttttaagactttgtactttgaaattatagtatctacctatgttcatgttattgagggagaatatgcaaagatgaacaaacatgtaaatatagcgtattgacaatgaattacatatgaacctacaaaccgatgatcttttactgagtttatatgttctttgtgataaaatatcaattttaaaataaccacacgaacattcggtcatattttatccgattgtgttattagacacaaaatatcgggggcgtctaatgggcgggtgatcgctcccccgtccctccacctatcacccttcccccccctcccttatacaatacactcctccctcctctctccccttcctcctccctttcttctttttctactacactaacccacaaaaaaaaatttaaaaaaaaagttaaaaaaatttttccttacaactattatttttaataaatttgaattcaaattcaaatttgaatccgctttttaaacttttgacttataacctttggttctttaacctttaggtttataaactttacatttttaaaaatcctatttataaaaactttttaaatccaaattcaaattaaatcgcatttaatctaaattcaaatttaaaaccggtatgtaaacttttgacttataaactttaggtctataaactttaggtgtataaactttagatgcttaaaaatactatatatagaaaatatttgaattcaaattcaaatttgaatcaaatataattcaaatccaaatttaaaacaaggtatgtaaacttttgacttataaactttgggtcattaaactttaggtgtataaactttagatgtatagaaatactatatataaaaaaaattgaattgaaattcaaatttgaatttgaatcgaatatataaacttttgacttataaactttggttctctaaactttagatgtgtaaacttgaggtgtataaactttagatgcataaatttactaaaataatagagtaatacggtgccaaaaaaggaaaccaggtggagggagggagggaagaggggatcgatcgctaccccatagccaaggcgatcgattgcccattagaggtttcgcaaaatatcaacttaaaaaaacatcacgatcatactcttaaaaagaaaatgtaaatctaagaaaaaaaacacgtaaattttttttaagggaaaccgaaaactttattactgaggcaggccagccaaatcgctggtcaccaaatactcaaggcccggcggagtgccggcccagctacaagggtcaagcaaattacaacccagtttcgccagttcatgcactacttgttacattccctggggcaataattaaccaagaatgaaataaatcttctagaaatgacattcttgatctccagaatcacaccccccatgacagagagattgaaagagttctcctggagtgtagacttcagcagcagcgagcctatttcaaactctaccttcattatccccctttcacttgccgcccctacagccgctgcacaagcaataatctcagaatggaatgcatccatcatgttatcagctccgccagctccagcctgaaccacccgtccatgatgatcccgaataacatatccccatccgccttgtttggtgctgctgtggaaggccccatccgagttgatgttcaggacatcagaggtgggttttctccattttgccattctcctctccttcaacttcccctctttccaattcaacttcaagaattcctctccctggttatcaatgatatacgccaagtcaattgggtctctggctttacctccttccctcacttcattcatctgcttccaccattgccacaaacaaacgacagctctcatctgtatattctctgggcacccccaaatggtctccagcacacttcttgcattaggttgttgcgctagagataatctcaggtcttccaagttcatcgcctaccaaactttcttaacaagcttgcacttgaaaagcacttgaaaaacacgtgaattttgtaatgcaggattaccgacgatcatgttcctaggaaggaaatgtaaatctttttagaacacgtaaataacggaaatgagaatcacgggtatagtagagatgaggtaccgatgcggaacctgtgtacctagaactaagaagacaattatgcccttctccatcttaaaaaaaatatccttttacacttactacctaagtacctatatcagtacttaaatatcttttaagtggtatcttttattatggaccattagatttttaccaaacaccgtaaaatctctccttcaacatatagggaatgccttggctgtactctcgagcttccgttccatgaagcggccgttgtagaacaccggcctcgtcgtcactggtgatgaggacgcctattcacccattattagttgcaggcattcattgccgctaggtaagctggccaccctaccaatgccagcactccagccggcgccaccaacgctgctacgccgccctcagcaccctccattacgtgccccttcgtccacggaatcgccgccgcccatctcaaaccccttcttgcccagatctgtcaccctccactgcttctgcagggactccaccaccaccacgccggtcaatgtggccgccctcccctggggaggtctcctaggtctcggaaacgccagatcggggctctagcagcccttaattaaggcgttgtttaggcctcgtttacttggcaaaaacttttgcctatacgtaccacatcggatatacggacacacatttaaagtattaaacgtagtctaataataataaaaaaaactatagattccgctaggaaattgcgagaggaatttattaagcacaattaattcttcattagcaaatatttactgtagcaccacattatcaaatcatggcgcaattagacttaaaagatttgtctcgtaatttacacgcaaaatgtgtaattgattttttattttgtccacatttatactccatacatatgtccaaacattcgatgtgatgggtgaaaagtttttgttttggaaactgtggccttgtttagttcgcgaaaaaaaattttaggtgttacatcagacgtttgaccggatgttggaagggtttttgacacgaataaaaaaactaagttcataacttgcctggaaaacgcgagatgaatctttttagtctaattaatctgtcattagcacatgtgggttactatagcacctatggttaatcaggtgcaattaattgcacagtttgcatggaaatcgcgagacgaatcttttgagcctaattagtctatgattaaccataagtgctacagtaacccacatgtactaatgacggattaatcacgctaaaaagattcatttcgcggtttctaggcaagttatgaaattacttttttcattcgtatccaaatacccttctaatatccggtcaaacgcccgatgtgacccccaaaaattttcttttcgcaaactaaacaaggccgtaatctagacacgacgctccttcaatccgctctgccaaccagctcgtctccgcatcccatcgagccttcaaggagaagacgcaaggaaggtgctttatctaccttgcgcatgaccatcaagtggtgactatcagggcaatagcaatgcgtcccatgtatataccgaatctcagatgccacatgggctaaggaactgtggtagtcacaagattcacaatgtagcaactccaaagtggggtccacaaaaataaagttctccttttttttctccacttttccccatctccttctccctttcctcgggaccaccgctatccttcttctcccccatctctcacgccttcccctctctctcctctcatgctcgggtggcaacctgactcagtcttctctccttacaccgtgttgggtcggccaggcggagcagcagcctgcggaaacggcgccgaggtggccgggcagagtggcagcctctgaggcaacggagctaggcggagacagcgccgatgcggccgggcggagcgccggcctctgcggcgacggagccggacggagcgccggcctctatggcgacgaagccgggcaaagaggcgacggcaaccgagtagagaggcgaccgaagcggtgacggtgcaggccggagcagcggaggggtgggctcgccggatctagcctcaggttctctctggcgcggatgcggctccctatccctacccccacctcctctctgtctctctcccgctttctccccacgggcggatgcgatttttttagcaaaagttgattttttttttgacgaggttcttggagccaatgttgatcacgtgaacccggcgaaggaatggtcaccacttccctctctcctccacgcaagcactttttctacctggacaaacattgacacatgtcacgtgcgtgcaccgtgaatggcctcagagacccaatctgatgtttctcctgccatcgctcaggttattgtgcctatgaatgcactaaggccattcacagtgcatgtatgtggcgtttggtctcgatgcaccagctcggcgattcccctctacacaagcgttggtcgtaaccctgtgaagtccgcggaaccaattttgtgcactcgttcttctcacaaaatcaaggtcgcgtggcatgggggagaacggtgcagacgcattgtgaggttgtggccttacgggttcgtggctccgcgcttcccctccccatcccccgagctggcgatgaaggaagaagaagagatggcggcggaggaggaagaggaggcgacaaatctggtgcctacctacttgacgccccccgagccatgttgtcactcattgtcgtgtgtcgctccaacccaccggacccatcctcgttttctgatctatgctgctgctcgtcatcatcgcccactccaagccgcaacgacctctccttgacccctccacagcctcaatgggagcctccacgacccatccagatcgatgcgccaccgaggagagggtagaggccgcgctgccgctcgtccttgttgcccatagccatgggcgccgacgaggagagagaaaggatttggcaccgacgaggagaggggtgaagggatttagcgccagagaggggaggagagaggggagatctggcgagcttcgggcttgttttggccgcccggcgctgtcgcttcatggggaccaccgctgcaaacaaccctccgcctggctcgccgtcaccgcttctgcctttcacgagagcatgtgggttggggaaaggggaagcatcggttttggggagagagacggaaaaaggcgagaaaaatattgttttttcatggaccccagttaaggctacatagcacggtgaaacttgtggctaacattattctttggtgttcttggacctacgtgacatatgaggtctggcaaaattcgatgttgcactgctaatgccctaagcagtggtccctaggcaccacctgccgtcaccccccatctctagtgcaaccttcaccgcagagcacctggacggactggcagcgctcacttcgatgacaagctatgcccttgccaccaccacctccaagaactatgcatggaaggcaatggcacttctcggcgacacgcccaattgatgacgagtatctcagcccaacctcctacgcccttgatgaggagcactatgtgacatcctggccctattaggatatggactgtgtggctcatgagagccgtgtgctcctgtttgataccaccttgctaatgtagtgaaaagctggaaccaacttataatggtttgtccctctagtcgtatcactcctaggttaaccattttacacaaagcaaggatgaaagtatatgtgtgctatgtgtaagtgggcccacccataggatggactaggttgcgcggttccaaagggcgtgttgttacatgcttaatttttttccattttggttcgcgttaccataacatatcccattctctaattttatttattcttcaggagaatccaatgatgtgtggttttactttatggatcaacaccgtcagcccgacgtatgatggcagaagagtaactaaagctgaatgcaaacaaagtacaagagaatgaaggagcacaaagttgcagtacgtgctaaacgacgtagaagggggtagtagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12163 - DNA, 698 bp, Oryza sativa
attcctgcagccctgggtgatggtagaagtggccaatgtgggaacaaagtcgttcatcaataacaatgaagacaccagtcggcggcgacgatggcggtcgattgtgaaagcgaagacgcccaacagcggcggcataataggtcagccgtgtaggcggaggcaccactcggcggcgacggaggcaggccggcggtgaagtcgtagacgcccaacagcggcggcataataggccagccgtgtaggcggaggcaccactcggcggcgacggaggcacgccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccgctcggcggcgacggaggcaggccggcggtgaagttgtagacgcccaacagcggcggcataataggccagccgtgtaggcggaggcaccgctcggcggcgacggaggcaggccggcggtgaagtcttaaacgcccaacagcggcggcataataggccagccgtgtaggcggaggcacc

SEQ ID NO: 12164 - DNA, 29794 bp, Oryza sativa
atagatgtaacaattgaatcccgactggcgcaagtattcagttgataacccttacggggaataataaatagtccagtctttgagcatataaaatagacccatgatcatgaattcatgttgcatgtatccggagcaagtccaaattgaagatataatacttgtatttgagctagtaagcccctgagcacgtagtcacaattgttcattgatggtagctgacgcagttggcatagagacaagacaaccaatatagagagaatattgcccaccagaggtggcaaaaatattggtggtagtgaagatagtgataccaatcaaaagtactgaagtcgcatagccatggaggcgaagaaaccagtcggcggcagtcaggtcagccagcaatgaatatgaaggcgctcagcgataaagttgtgtagttgacgacaacaaacgcaaccgacatgatgaagatgacgatgtcggtgatccagccaatagcagtgtagcaaccaatgaaaatgacaaagacgctcatcagcatttgcatagtaggtcaaccgtgaaggtgaaataataagtcggcgaaaacataatcatccattagcaacagcagagatgtcagggtcgatgaagcagaggtgctggtgatgatgtcagtgacaataatccatcaaattaatgttatagctgttgtagatgcttcacttggaggagagttgatgttgttgtccaactcgtctaaaccgaaatatttgaagttgttgaagtagaatgtctgctccgaagcaaagatgaagataatgactcctggagttgactcgtgggttgatgaattgatttcttcagcttgacataaaatttgtcaaattttgagccttgtatttgtgtagcccccgactctttgattagttgggaaacaactgaacatagagtcgagaactgtagcctcttgtcgtcgaatagttattgcttgattgaagatatgtgttgaagatgttcaagtagaaatcctgaatattggagagcctcttgttgtagtaaaataacatggcatcgcatgccgagatgtcgaggctcacaaagacgtcgtggttggtgaagtagcaaaacttgcgaagtagcatcaatagagtttgccagtgccgaagataataaagatgaagtcgctctaccatgatgacaaagttgcattgccgtgatgaagtgaacacgagtcgtcggcaacagaagcaaactggtagtgaagacgcgcagttgtgaaaataaaagcactagtcggcgacaacataaccagtcggcgacggaagacgatgatgttcatcagtagtgatagttgtataaaccagatgtagaagcgagggcactagtcagcagcagacgagacgaccggcgatgaagatggtaaggccaatcaacactggcagaatcatgcagccatggaagtgaagaaaacagtcggcagccatggcaaatgtaggcagcttgtgttgaagatactgatgcctattagtagtgacagcgatgtagccagccgtgaagaagatagcatcagttggcgttataacaggccagccgtgcaagcggtgacaccagtcagcggcggatgcggcggccggtcggtgaagacgtagacgcctaacaacggcagcataataggccagccgtgcaggcggaaacaccagtcggcggcggtcgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataataagtcagccgtgcaggcggaaacaccagtcggcggcggcgaaggcaagccggtcggtgaagacgtagacgcccaacaacggcggcataataggccagccgtgcaggcggaagcaccagtcggcggcggcgaaggcaagccggtcggtgaagacgtagacgcccaacaacggcggcattaaaggccagccgtgcaggcggaaacaccagtcggcggcggcgaaggcaagccggtcggtgaagtcgtagacgcccaacaacggcggcataataagtcagccgtgcaggcggaagcaccagtcggcggcggcgaaggcaagccggtcggtgaagtcgtagacgcccaacaacggcggcataataagtcagccgtgcaggcggaagcaccagtcggcggcagacgaggcggccggttggtgatgttctgactgatccattcctggagcgtaagagataagcttaaaaccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcataaccatcaagcaccgggagtcggcctaggcacttcccaaacatgcatatgagtgacatgagttcgtcattaatggaataaagtttcacggatcagaatttactactcgggtacttttgcaattattaagagcagaaaataaatttatctcatctctatgcttttgatttattccgaataatatttagcaccttgcgttactcggtccatccaacgagcccccgggtgctaggaatcggcccaaaggcaaccatccattggcaaaccaaacggaaagcagaggaagatagaactccataactcgataggtacttttgtactcagattatgtcgcaagcaatgaagataaatattataaaaaatatgatataacatctgtagcccccgactcactactcaatggaagaccaattggtgtagtgaggcagagaaaaaggaaaaatatcatataaagaataaaataaatgatgacttagctttgtaatattccccttggtgatggtagaagtggccaatgtgggaacaaagtcgtccatcaataacaatgaagacaccagtcggcggcgacgatggcggtcgattgtgaaagcgaagacgcccaacagcggcggcataataggtcagccgtgtaggcggaggcaccactcggcggcgacggaggcaggccggcggtgaagtcgtagacgcccaacagcggcggcataataggccagccgtgtaggcggaggcaccactcggcggcgacggaggcacgccggcggtgaagtcgtagacgcccaacagcggcggcataataggccagccgtgtaggcggaggcaccaatcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagttgtagacgcccaacagcggcggcataataggccagccgtgtaggcggaggcaccactcggcggcgacggaggcaggccggcggtgaagtcgtggatgcctatgaacggtggtgcgaccatccaaccgtataggcgagaacaccagtcggcggcaacgaaggctagccgatcggtgaagacgtggacgcccatgaacggtggtgtgaccaaccaaccgtttaggcgaggacaccagttggcggcgacggaggtaggccgacagtgaagtcgtagatgcccaacaacgacggcataataggccagccgtgcaggcggaaacaccaatcggcaacagcagtgccacagcattacatgtaaacaacaggaaataccaagagattaatctgatatttagagatcaatctaataaacaacaataagttgaaaaggaaaaaacccggcggagtcggagatttaaattgttgaactcgccgagattgattttctcgaccggactgactccgagacggagaaaattggttgctggtgttgcactctgtcgctaggactaatcaagcgatccatggctcggcgtgcttacagaacaagacaacaaaccaacttggttaatgataaaaatatataggcatgattaagtaaattaatggtgcttgttgatcggtaagatcaactttctgcacgtgttctctcctgattagccataggctggctgttcccatgtgtggcccgtggtggccatagcccgcaggacgtccatcggtgatgctccgagattctcatggaaacaaataaaataaatctgattaatatcagcaaattaaatgtataaatctcagcgattgaatgcatgtatggctggattaattaatccatgcatggcggttgaatcgacacatcctgtacatctccagcgatctcgttatgtgaactttcgtgcatgcctgtccagcccacgagttggattcgctcagagagtggacggcttcgccttgcgtagcgacggcttaatcataccgtgcctaattgaacaccttggtcgccggcaacatgcatacaccagaagaaagagcaaagaggaaaaagaccatcaatcaatctgatttaataatcaatctaattagcaggaagaagattagatgcatatgccatagtcttgctccctgcttgaccctcgtcatgtgatgcacatgcggatcgatctgacgcgtggactatacagccgcatggatgtagattgatcgaggtggtcggccggattgaattagaccaagcgacgtcgacggagatcatgcgccggcggctggttgctgccggtcacgcgtagctgctcgccgatccggaagtccaaacagcacacgaccgatcggcgcgatctctcgatctggcaggcgctcaacgctctgatgagacgcgccctccgtgcttcttgcggcggtgaatgacgcgcgtgtacgatccggtcatgttggtgattgattccaacgcactttaccgacgggaatctcgacgcacccctacctggcgcgccaactgtcgaaacatgaattcggcaataataaaagggggtagcgcacgagacctaaaagtggatggatgcgaagacaaaggatttagacaggttcaggccctctcaatgagaggtaataccctactcctgtttggggatttgaatccgccgagtgtgtattgatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatatcccatagatataagttatcccctatgactagtcggataaccatgccgtatgggtatggggtacccataatatccacacagggtttcttgacacagacacaaaagcagaacaatcgaattgctccctcagctcctcaaagatgaggtttgcgatcgttgtcttccctaatcccccaattccaacaatggagatggtccttagatgctcggatgccacatgcccatcatctttcatcaacagatcgatgagctccttcttcggctgatcaaccccaactagagatgacacatcctgaaagatggtaagagctctttggtctacggtcgcattagctgtcctcatcaaactgatcccaccattcatatatcgcgcattcctctcccccacttctttgatttgtgccttgaactcagcaatcatcttggcaatccgacgccgggccatggtcttggtcagcaaattcctgcatttgacgatgaacccatccggattagcggatccgtcgacgacatggagcatgaactcgtcgaggctgtcctcgatgtcgtaggagagctcccgcacctccctcgtccaggccttgtcctgagggtcagcgttcccctcctccgaatccgacatcctgaggaggaacgcgtgcatggcggcgaactcgtcggcgaggaaactgatctggccgcgcaccccttcgaattcgccggccatggcggcgagcttcaccaggacggacttgagtgccccggtggccgcggtcaccagaaacccctccatatgctcctcgaccgtacgcaaagaaagatcctgcgaaacagaagcagaagcagatctagatcagcaggtggggaatcaacacgaaccgcaaaagacggcgggggcgaatgttgattgatggccggagctcaccgccgtgatcctggggaagctcggcggcgagctggaagagttccacgcagcagcagcagagactgatcagtggtcagtggagtggtggtcaactggtcatagacgaagaggacgagaacatgtttgactcgcagcagacggagcaggtggagaagtcgataggccgggcccacagcgagccagcgagttggttgctttgctctctccatttccaaattttactcatcgttttttattttttatttttattttctagcagtgcagaccatgggtttgagatgaaatgaatatactgtgagtagagccctataagggctaattgagtttacgattttctgttagcacgtttttcaaatactatttctgtctcattttaagtatagttatagtttttatgtccaacgtttgatcgtttatcttatgtgaaaaaattataaaaacaattagtcacacataaagtatcatctaataacaacaaaaatactaatcgtaatttttttttcaaaataaaacggacggtcaaacgttaaacataaatacaaaactacagtctatctaggaaagctaaaaacaaagagtatgagttaggaaagctaagtgccaaaatcagccttattgcacctgctctaatacacttgttgatttcggcaatcaaaatgtctttatttgtgggcgagcatacataacaacttcatgctcctctttaagtggacatttcaaaaagcttttgactctataaagtggaactacatcaacatagttttccacaaagatatgatgactgggttgtggggttgttgacaactttcggttttaagatcccgcaaaatagcatccccgcaaatgtgatacatcatgccatggacctatttcaaggagacccactttctatcatcacagcaatagacctatagcaacgactgctatatatccaaagcaacggaccttgggctgattagtaatccttgaggaaggtcggtgcgtttccgaatcttaatatatgcatatgactggcggtcttcatcgacctaaaaacaagaagatgtccaggcattgcaaaactttgggcaggcaactgggttgtgcgccaacatacaaaagtcacaggttgccctattagatgcagtgacatcggcctcgatgagatcctagaaaacatcctagtgaccagacctttgttcccaatgaaatacctcggtctaccattgtccattggaagactgcagaaaatagaccatcaagctttgttccacaagtcaatagggcggatggcgggatggcaaggcaagaacttcggaatggctggctatcacaacccgccctggcaccacctaatagtgacaccaaagagggtgcgccataggaaattggcgtgaactgaattccatggaaccgcattgccaataccagtttcagtacacaattattggtactcgtggtcaaccaagatatgcatcattgcaacttaggataacataaatagataattccaaattgccttaatcgagttttatctctaattggcaatgacggatattccaatctgggcccatatcgaacccaagtcaggccgtatcggccacttgccatatcggcttagtcaaactccgactctgtttctagctgatacgatgcctagacgatgcgcagtccgactccaaatccaactcaattccgcacaaaatccacttcaatcttgttccttcttttccaattctgatgcaaaattccgttgttaacagatggttaatttaaaaccgataccttccaaaaccgagccgagtcaagtggtggactacaaagtgcacgatgcaataggtcatcgagattctttttctcctcatcctctccgcgatcccctctctctccccctatctcttcttcttcttctcctcctcttacccctctctctctatccactctatctctctggtgatggaggtcggggagtgttgcaggggcggcgtgcttcccacggggaggtggcggcaagcggtggcgccctctcctctgccagatccagcgggaggggaggcggcagcagggtcgccacaggaaggcagcgctgtcgacggtgggtacccgtagaccagatatagagggtattggggtccattggtacgaggatctacatagtacgacaacaagcaaacaaaagacaaggattatactggttcaggctccttggtaagtaatagccataatccagttggtatgggattatatgatgaaaaccacagattataaagggaatagcagaactcgatgataccgacgagaccgtagtcgagttggtcccactagatctcccggtggcttggctcctgcgtgctccggctccgtaggctgtggtggatgtgttggtggtgatattcgatgccttaggtcctacccagggggtatcttatataccgcgggtcacttgatctccaagtaggactcggagatatcggacccctcacgatatggtaaagacccagtcttgtccgagtagaactccttcaatccgtagataccatccaaacaacgtatttaacaaccccacccctcaaacttccattcttttctaactattccagaaaccaaacacacacagagtggaggagaatttttttttaaaattacacagtacaatgcagacacatcgaatctttaacacatacatggagcattaaatataaataaaataaaaaactagttgtacagtttgcatggaaatcacaagacgaatcttttaagcctaattagtccatgattagccataagtgctacataaacccacatgtgctaatgatggattaattaggcttaataaattcgtatcgcggtttctaggcgagttatgaaattagttcttttattcgtatttgaaaatatcttttaatatccggtcaatgacaaaaataaatttcttttcaccaactaaactgttcgtctccccactaaaatccctaaccccatcgatcccagccaacaatcgaagcaccggcgccgccgcctcgtgaccggccggctgacggcggagagcgaagcgggaccagcgacggtggagagcggctggacaacttttcctgcctcaatgcgccgcctctttgccgcctcgtcctctccttatctcctgtctttcgtggcatctccatggtggtggccatcagcgcttgcgcgacgagttcattgctttgattccgcagccaatcgacctacctgtagtgtttcccggtgagcccttctcttctcacggtaatgtttgtgccttttgttgctactatatagattttagggcatgtttggatcaatgccaaaatatatagtattttttagtttaaatagttagtaatgtggtggcttggtttcaagccaaaggttggtaatgcccatgctcaatttgacacaattctagaactttcttcaccataatataaattttggctcctaattgacatcaatccaaacacattcattttcaatgttaccttaccaaaacattgctattgtaaaaaattacctagattttgattattttttttggtatgatagtaaaccaaacaagcctttataaaggatctggattgggaccaagtctgggtttttatttacacttcttgtgttgttgatttcttttataaaaaaaggcaaatgggggaaaaccacgcaattaatccatgatgatttccaaacacagagaaaagaggctcacagatagaaaccagaaaccaatttcaggcttggatatactagtattctatatgacttcattcctgactgataatacttaccatcttatttatgactttgatgctctttgtgatagatttcttcatggatatcgaaatatggctagcagcaatatagtaaatggcgaggagttgggtgaaccagaaagaagacctctcaacccttctgccaagggtttcattatttccttgggcaagcactctgccatttcccaaggcacgaaggatatagagaaaagcaatactgacacaatgaacaagttcattactcattgtagcgggaatggtgcagaagatgggaggacatcaagcgggaatgtcatttctggttacgaaggtgtttgtgggacaacctttggagtcatagacaacaaagctgatacaacaggagaaattgtggatgttactggttgtgaactgagcagtggagacaaaagagagcttggctgcaggggtaccacagctaattgtttacccaattgaggatggtgtaccccctatggagatactcccatatagcagccattgtgacggttctatatacaggggcacagattgctggaaaaaagagtatcatattgctgaccgtaatgaaagtaagtggtcgatctctttttcttatttttattcattattagggcgttttccaagctatagggtcaactgatatattctctccgtaaatctcgacttaatttttctttcctctgtttacttataatttttgattgcggtgcattggcatatataaatggaaatcttctgaaattaacaactcatggtttcattgcttggtgtgtgcaaaagcacgaggcatctaacgatcatacctttagcagattgcagcctgtgctgacatcgccctgggtgtaggacatcatactcaaggttgtgatctcactagacattgtatctcctatctatccaaagttttctgattgtccagataactccctaagccatttttttgcctggaaatttgttcagttaactccagaatgttattgatcttcttgtttcttataaaagcatgttttattttgaaaatttgtgaagtgatagatgtaatcatgccctgtgctatggcttttcattctttttggtgcacacatgtgcatactaagtgttgaacaggtctagctacaccctactatgcagatagtcatggaaatcacgaaaataattataatatagaatgtgttgtctaccatcgggaaaagatcaacataaaagaggatttctagaaaacgaaaaaagaaaatatatttcattacggggtgaaatgacctgtcttgctagttctgggagtatagtgaactgaggaatagtttagggggttataaaataaatgaaccttttcccttctggggtggttagagattactctcgttttagagttccagtacatttgcatggcatcaagatgaaaataacatcatatatgccaggttttccagagcacattccctctgcatcatttgcagaagaaaagctagatacaaccgtgcagtgcagctcagcacagcaaaaccccccttccagctcatcatcctcgcactgctctgattcttcaggctttcgttgctctccagtgagcaggaactcactgaaaggttcttcactgatttaaaactaatgcctacatggactccgatcttgtcaggttagctatatctgcgttctttctacttttctagtggagacaacacactggaagaacagatgttggataggttccttgcctgtacagaaaaaaaaaaacatgatcaatcccggactcctgatatggctctctttatccttgggatttcctagaagaaaaatttttcaagggagcggatagtttttcatttagatgagaggggaactttccaatgggactatggaatcctcaagaagcatgtttacattttgtatcgccagcatttgtttattgtgttattttaattttaacagaacttgtatttttctgtgaagctcggtgggaggcaatgatgttttcaaagcccacggattgcaacatcgacagcaatggaatttgcatgtcacacggaacttgttgtatgttgcaatttttctcattaaggttggctaaagtacctgcggaccatggtttggtggagttgtatggatacatagcagtgcgggataggctggatacatttcttaattattttgtcaattttagcagggatgatcccattgtcgtggagcaggcgtgcacatttatacatgtatgcaattattttatagttaataagtctgttaacatgttatcatcggagcaggctctggtttaacctagtcttctgacagtagttggatagttagtactgggccgaatatttggccccatgcttatcatgccattacaaaatctggcccatgacaataagccactaccttacaaagtcttatatatattgtgaaatgatgatttacaacaaaaacagatctatactatgaaactaagtatcatgtattccaaacaaaatcaaatagaataattctggactcttggttgctagcaagtaaacctcacaaaactgaatcatttgtttataggcatatgaacatgcatagcatgaatactaagtcttataggcacatgaatatattacatgcttatttgatttagtacctgtgattcagaacaaaatcaatttccctctctaacaccgttatgtattttgtacattctgtttgatacaggacaaagttcttggccatcaataataaaacatgtcttagatattccttactttcatttgattctgtagggtataaaaatattgctacaagtgaaacatcataagggaagcattcagctttagatatttcttactcttatttgattctgtagggttctctcatccacatggctggccctaagcgagggatccaattgatcggcactaatctaatcgaatatgacatgaagatcaagactggtgaatatatatatgaaaatgaagatctacagctgatcgatggtgtatcaatcatagatgacatagacaacatggaattatagctcgtttacatgccgcatccatggttattgtggcgcgattgacatacctgcaatatcacaagtgagtcgaccatagaggttgcaatatcacaagtgcaaagcagttttgctatgcgcgtgatcggttgttttaccagtgggttacatgaagaaatccggctctttgatggcactataggtgagttccgtacgtggcttgaagtggcttgtggttgctgtagtgatgggtgctcaaatggatttgaagttcaaggtagccacagactcatgcatccctgctgaacatttgctgttccgtcgaggagatagagactgattttgcattaatcgcagtgaaggtgacttggtcgacttttaatatgaaaagttggctctgtgatgagtgggctaaaagtggggcgggttatgcccctaacccaacgggctggcccgcatcactaaccatgcctgccttgactgatgcgggccaaagcggcagcctgcactaacccaacgggcaatgatgtcgcattgctcaccattccagtccaggggaagtccatatcgctgctagcgagagatgatgcatggctagctcccttcgctcccctcagctaccattgtaagtttgtaagtggatcttgcttggtggtagtaaaaagaatatggccattgcagccatggccgcccgaggaaacgatgacagcatcgatctatatgcattcttcacgaatcagccgggttttttcagtgcttttgcttcaggagttccaagcacaggcggatgcaaaagcatgacctggcgataatggcatggtgttcgaagaacgctagagagcaggaagatgacattttagtgtgataacaaacacaaaaatgtaatgcatgaacggcaaggaatgcatcgaatgcatgtcgcagacagaatcacactgattttgccatgaacttcatcgaacacggaataatacagcaatgaaaggcttcgacagcagttcttgcctggttttatgtatcataaaaaaagcgctgcatctgacagcactgatgatggacgtccatcgtttttgccctgattcgtgtaataacccaaaagagaaggtcaaagtggctgcttcaaagctccagtgtggagatccatttgctgcaattttgttgcttgcctcaacaagcgccattgaattctgttactgcctcacttaggaaaggccgtaaaaacttcaatgataaatcgtactagcatatttcaaacacactgcaattaccaacattgtccagagcaccaaacttctcattgaaactaagagaaagtcttgactaagtactacccccatcccatatatttgaaatttttcagaaatatccacccaaagtgcttcagcaaacacaaccagggaaaaaacaaagagagaactttgttccgcaaatcaataggcacattatgaactcctaacagggtaaccaagttctcttaagtagactttgaacggatgaaatcaagaatcgtatcatgaactcagcaggatttcacctcaccaaacttgacgttatacctttggttcgatcgaaaatgtattgatcacccataaaggagcaggaaagatgatgtgagcgaattgaagagggagattgatcacccatagaggagcaggaaagatgatgtgagtgaattgcaacgcacgggtgtggagattatgggtaccccatacccacacggcatggttatccgactagttataggagataacttttatctatgtaatatgtaacagatcatgacttgggtattacgtttccttgtatattacggaacggcctaaagttctggtttgataatattgtaaagtagatttaggaaaccgataccgtattggttaaggtttctatcttgtaatcctgccccccatcctatataaggtgggcaggaggccctctagggggcatataagacaactagatcgtcagatctatatacactcggcggattcaaatccccaaacaggtgtagggtattacctctcattgagagggcctgaatctgtctaaatcctttgtctcggcatccatccacttttaggtctcgtgcgctaccccttttattattgccgaatttatgtttcaacagttggcgcgccaggtagttgtacgccgagtttcctattgaggagtgcgatggaatcaattttatgagtcgccagcttcgcctttgcctcaggagctttgacttcctcgccatcgacaacttcaacaagcctcgctctttgactttgattcaaatcagtcggggaagatctaatctagctaaggaggataacaaccactctaccacggcgagtttaagattcgatctactatggccgccgccagcgtcaccttcgtcagcacgctttttcgcttcagagagaaactttatcgtcaggagaataaccggatactactgttaacaggatcgtcgatagcatgggccgcgtgccttggacgatacacggcatgctacaaagtttgcagtcctgatcttgcaacatatgtggtgtacggttggctacgcacgcgcatcatggtctggctgactacttcgatcgccaaacagtccggccagcatctttcctcgatctcacagcgacataatcaggggcttcgtagcagctctcttattacatgcatctactcatcatcaccatgtattgcatggctgcctgctacaagccaaccaatcaagattccttaatctacaggctgctaccaacaatcgtaggcttgatctactggagcaaatacagatgcatgcttgcacgttcttttatctcctaatcagatatgatttgtatttacatgtccgactatgcgacagccatataacaggcacgttgtttccgatatcactgacacgatcttcatggacatggacttcatcgctgactggtttgttcgtcctcatggccagcctactacgctgctactgatagcaacatcatcttcaccgactggctcgcctccgtcgccgctgccgactggtttctccgcctacacggctggcctattatgccgccgttgttgggcgtttacgacttcaccaccggcctgccttcgtcgccgccgactggtgtcctcgtctatacggttggttggtcacaccaccgttcatgcgtgtccacgtcttcaccgaccggcctgcctccgtcgccgccgactggtgttctcgcctatacggttggttggtcacaccaccgttcatagctgtccacgtcttcaccgaccggcttgcctttgccgtcgccgactggtgtctctgcctacacggctagcctattatgccgccgttagtgggcatcttcgctttcaccgtcgaccgccttcgtcgccgccgactagtgtcttcattgttattgatggacgactttgttcccacattggccacctctgccatcaccaggggaatattacaaagctaagtcatcattaattttttttatatgatatttttttcctctgcctcactacatcaactggttcgccgttgactaatgagtcgggggctacagatgttatatcgtattttttaaacaattttcataatatttatcttgattgcttgcgacataatctgagtacaaaagtacctatcgagttatggagttctatcttcctatgctttccgtttggtttgtcgatggatagttgcctttgggccgattcctagcacccgggggctcgttggatggactgagtaacgcaaggttctaagtattattcagaataaatcaaaagcatagagataagataaatttattttctgctctttacaattgcaaaagtacccgagtagtaaattatgattcgtgaaactttattccattaatgacaaactcatgtcactcatatgcatgtttgggaagtgcctaggctgactcccgatgcttgggggctatgactagtcggacagagtgtttaaacgtacggagtcatctgctcggggaaatcaaaattgacaagaggagaaatacatatttataaatattttaaaatacttaaatttttctcgagtattatatttacatcagatactactcatcctatatgtttgttctgcaggatccagatccagatatgcataatagggattcatggctttcaaagcttatctcctacgcttcagaaatggatcagtcagaacatcaccgaccggcttgccttcgtcgccgccgactggtgtctccgcctacacggctggcctattatgccaccgttgttgggcgtctacgtcttcaccgaccggcttgccttcgccgctgccgactggtgtttctgcctgcacggctggcctattatgccgccgttgttgggcgtctacgtcttcaccgaccggctgccttcatctgctgccgactggtgtttccgcctgcacggttggcctattatgccgccgttgttgggcgtctacgtcttcaccgaccggccgcctcgtccaccgtcgactgatgtttccgcctgcacagctggcttgttatgacgccaactgatgctatcttctttacggctggctacgtcgccgtcaccgctaataggcgtcatcatcttcaacgcaagctgtctacgtctactgccgactagtttcttcacttccatggctgcatgattctgccagtgttgattggccttatcgtcttcatcgccggtcgtctcgtctgctgctgactagtgccctcgcctctacgtctggtttataccgctaccattattgttggtcgccttcatcttcattgctggctgacctgactactgccgattggtttcttcgcctctacggctgtgcaactttgtcaccggcaccgacaaactctattgccgctacttcgctagttttgctacttcaccagccacgacgtctacaagagcttcgttatatcggcatgcgtcaccaaatatgatgccatgttattttactacaacaagtggtattccaatcttcaatatttctactcggatatcttcaacatgcatcttcactcaagcaatgactactcgacgacaagaagctaaagttttcgactctatgttcagttgtttcccaactaactaaagagtcgggggcaacacaaatacacggctcaaaattcgacaggttttatgtcaagatgaagcaatcaactaatcagccaacgagttctatggaatctacttcagcaactcttattatttcaccagtaattttggtttctccacgccgctacaatctactccaaatttctcaattatcaagtttgagatttaatctacatgttcgggagttgtatcagtcttcattatgcacacgctcgcatcaaggaaactacttgagcttcaatatcttctcaatagtttgatggattattgtcactggcatcatcaccagcacctctacttcatcggccctgacgtcttcgccgttgctaaggggtgactacgtcttcaccttcggttgcttctgtcatcactagctttcatcgccgacttgttatttcgttttcacggttggcctactacgcaaccgccgaggggagacctcatcattatcattaactgctacattgctatcaatgggcaacttcatcatcacatttgatcatctctattgctgccaatcgtcattaccatcggttgcatttgtcgtcgtcgactatttcctgcattttcatgattggaggatttcgccattgtatttgatgcacgtctacgtcttcatcgttggcttgttttcatcgccaccgactgatattctcgccttcacggctggcttattatgtcgccactaatgggcattttcatcttcttcaccagctgtctcgtctgtttctgactgattattttgtcaccatggctacaaaattctgtcgctattgctgggtgccttcatcttcactgctagttgatatgactgcttccgactggtttcttcgcttccatgccgattgcatcagctattaccgatggacaattttgactatgacagaaggacaagctatatgctcaggggcttatcagctcaaacacaagcgcgaggattatatcttcaatttggacttcttccggatacatgcaacatgaattcgtgatcatgggtctattttctatgctcaaagactggactatttattattccccgtaagggttatcaatcgaatacttgcgctagtcgggattcaattattatatctatttaggagtatcccataagggataatcactcagatcagaagctattcatatgagctacacttggtctatatcactcggaagatttattactcgggagcatgttacatgcgtcatccttcaaagggtgtcgaaggcatattttttggcctaggcctaatatgtctgcagcccatattttcaggtgtggcctgtcacgttcttttagggacttaggcatctttttgcttaggcaaaagtgcacgtgattatgtgcccaataccttaaaatccttttataccgcagttactcaactttttaggagttggtacaatgcatcttaaaaggtgtcaaacagtaaagctttatatagctgctccgctgacttttttatatagtcatgacactgtttgggtttatcaagcaattgattagatacaatatcattgcttttcgccacgtaagtgtgcatttttattgaccaatattatggcttaagctgattatatatcttggtcattttccaggcggttggtaaatcctttatgagtttatttactcggatttcacaccacatatgccatatatttccaggtgtggtgaaaccatgtgtcttttagggacttaagcacatctgttaaagcagtgtgcgcatggcgtatgcccaatacattagaaatttctttattcgcaacatacaagcttctttatagctgttttgctatgtgaattttcaatgatgtagccaactttaggttacattcatcatattttacaaagcagtcggtatatcactcggatcatgttattcagggattcacaccgcatatgctacatattaatatcaagtcgcttggttgactataattatcgaaaccacttggttagttagattatttattccttgactatatgcttagtttgttcagctaaccacatagtcgggggctacacctattaggtgcatctagtcgatgcacctaactttatttttcagccctccacagtcttcatatttggaaaaagtactcgggagatcatggcgaagatgattgaagcactcggctttagagtaatctggttcgagagaagattatcttttcgactgtgaaggtctcaggggctactgtggagattatgggtaccccatacccacacggcatggttatccgactagttataggggataacttatatctatgtaatatgtaacagatcatgatttgggtgttacgtttccttgtatattacggaacggcctaaagtcctggtttgataatattgtaaagtagatttaggaaaccgataccgtattggttaaggtttctatcttgtaatcctgccccccatcctatataaggttggcagaaggccctctaagaggcatatgagacaactagatcgtcagatctatacacactcggcggattcaaatccccaaacaggagtagggtattacctctcattgagagggcctgaacctgtctaaatcctttgtctccgcatccatccacttttaggtctcgtgcgctaccccttttattattgccgaattcatgtttcaacaacgggttagccactagttttttactaatcacaattgcttagagaggtttaatgacatacttgaaaaaacaaatatatgatgtaggttgagtgtgaattcacttttcattggcaagttttaaatgtttttcctccacgatatttgcggtcagattatattgttatatactccctccattaacctttgttatgatgtttgaatattcatcctatttgctagtatgctaccaagtcctatatagaatcaaatgttatatgtatgacaaaattcctaagtagataagtaaggtgtcccatataagaaagagaagtagagtgtaaaatcaaaggtgtttttgattattattctgtgatgaacgattggcattgcagattattggttttgttatttggaatttattcacaaagtggttttggagatgattggattcacaggtgatcgcagatttatcattttatgtgaccggtcagaccgggctatgtatgccggtcagaccggcggtgatcgagcggtcggaccggccagtccgcggtcagaccggccgacgctgtgtcagtttcggttttgggttatttgtttggatatccgtgattatttcatgattatagcttctagatggatactatacgtatgtaatactgttgtttgctactaatgagtcaagttggagatagcttggtcttggaatatggtttctttgtttaattcatatgtaggtgactcgatgtctcggaagagtatttgcggtgatggaccgggagtcggcttggggataagacgacgtccgtggtaatcagagatcatgcgggatactaaggctagagttgatgcatgtggttgatggagattccatatgtcatacgatggaggtattgtgtgcgtatgggatgcggagtcgaatttggaaggagtccaaatttggtacgattggttatgtaaagtttctttcttgtattagagggtttcctaaggtgtttaggactcttagtatgagtttggtttgtggctttaggatgcctacctcgggtataaatagagggggagcgtgaggcttctcggtatcgcttttcacagcaattgagttgagttttgagttagggtttcgagtttagtcgaaatttttgtaaggattgctgttggtgcactttgtaaacacagagagaatcaataaagtcgtcatccactttaagagttcttcgatttgtgtttcaccgggtttcggcggtgtaatcggcggcacaccagcggtcagaccggcggcatcgcggcggtcagaccggtgggtgacctacggtctgaccggcggcgacatcaggcgcgacagggattccagggctgtccaaccggtcagaccggctaatctactttggtcagaccgatctcatcgaaattgagggtaacttttatttgcgctaaaagtttttggtttttgggtataccaaccattcacccccctctgattggcttagttcttgtgattcgatcctacaagtggtatcagagccttgttttcttctttggatttttatcgatctagagtttttgccatggctactcctgctaggttttcaactaagcctcatgttttcgatggaacggatttttctcattggtgtagtaggatgcaatcttacattttggctgaagattatgatatttggagaaaagtttctcatccttatgtaattcctgaagctattaatactgctgctgaaaaaactgcatttgaacaaaattgcaaagctcgcaacattcttttgagtggtatttctcgttcggattatgatcgtgttgcgcactttcgaactgcttatgaaatttggaatgctttgagtaactttcttcaaggaacaaataacattaaagaacttcgtcgtgatattttcaaaaaggagtatattaaatttgagatgaaacctggagaagctttggatgactatctctctaagtttaataaaattttgagtgatcttagatctattgattcttcttatggtgctaattatccacaatatgagatttctcgtcactttttgaacggtcttgatatgtctatttgggagatgaaagttacatctattcaggagtcagttgacatgtctactttgactttggattcgctttatacaaaattgaaaacacatgagatgaatgttctttctcgaaaagttgattctaagtcgagtgttttggtttcttcttcttcttctttggatgttgaagcttcttcatctaagtcttcttttgttgctgtttttaatgccacatccgatgatcaactcgaacagatcgaggaggaggatttggctttggttgctgacagaattgctcgagctatagtgccaggaacaggaaaagaggtggtccaaatcgttgctttgaatgtggttcaattcatcatcttcgttcgcattgtcctaaggtagggagaggcaaaagagaagacaaagatggcgagaagaccaacaacaacaagccgaagggttcatcccaagggaggaagctggagaatcttagtaaggcttttcaacaagtttgcgccgccttcgagccactaagtgatgtagatggtgaaagtggagatgatgataagggaaagaacatctccgatgtttgcttcatggcgcgtggtgaatctgacacaaagtatgaagataatgaggtaagtgcttttgaggaagctattaatattttgagtgaaaaaaaataagaagtgtgagaagatgtatagaaaacaggaatttatcattgaatctcttaaacaagaatatcattgaatctcttaaaatctcttattcctaatgatgatgattgttcaaattgtgaggttttaatgaatgagatttcaaaaattagagatgttaatgctgcacatgatttgaaaaatagatcttctcttgcttgtagttttactttgcacacacgcactttggatgagttgtttttaactaaaaagttgttgcaaaaatatcaaattggtttttatgctagtttgatgtttaacatgatttctgctaaaaaagttaaaacaacctcatgatgttttggattgctcaacatgtaatttgaataagttgaaattgaaagattctttaggttgtgttgagtacatggaagatgttgtgaaaaacaatgaagtgctttattgcaccaaatgtcgtaaaagcaaaggtgtcatggtgattgtgaaaattgtgctaatttggaaaaagaggtttcttatttgaaaaattctttgctaagattttctgatggtaaaaagaacctcaacatgattttggatcaatcaaaggttagcacacataaccgtggtttagtttttaatccttatgctcataattctagacatcctcctattgtgttaggtgttggtgctagaagtggtgagattttggttaaacctgattctaacaaaactgtgtttagatctgctggtatcatatctaccttgaatgcatctttttcaaaatccaatgttgtgcattcaaaatctcctgttgttgcttgtgttgctaaatcttctaatgctaccaatctgtctaatcatcgtgaaaaatatacttgttctttttgtggaaaagatgaacatattgttggtttttgtttcagattagctcataaacagaaaaaggagagagagattgcttttgcaaaatcaaagtggcaaaaatcgggttttccctcgaggaaaccggtcagaccgcagtgggtcccgcggtcggaccggtgaccggtcagactggctactgagcgtcggtcagactggcggtacagaggcggtcagaccggccactgtacctcggtcagaccggcctcggaggaaattttccgaaaattctataattgattttgcacgtggatatatgcctattggatcttctagtcatgtgtctcagtactggattcctaaatttttattatcatctaaccccagtactgaggcttcgacttctacttgtgtgtaggctttggtggcaaggaaggagaacgtgtggatcgtggatttcggttgttcgcggcacatgaccggtgataaaaattggttctcctcactcaaaaaggcatccaagactgaatcgattatcattggtgatgcttctacaagtgccgttctcgctataggtttggttaaggtaaatgaaaaatttgaattgaagaatgtaactttggttgaggacttaaagtacaatttgctttcagtttcacaaattgttgatgaaaattttaaggttcactttaagaaaactagaagtaaagtttttgattcttgtggtgattttgtgttgaatatttctcgctatggaagagtgtttaaagctgattttgaaaatcctgtttcacctgtgataacatgtttggttgctaagtttaataaagatgtgatgttttgtcatcgtagacttggacatgttggttttgatcatctcactaggttaagtggtttggatctagttcgtggtttgcctaaacttaagaaagatcttaatttggtttgtacaccgtgtcgtcatgctaaaatggtttctacttcacatgctcctattgtttctgtgatgacggatgcaccgggacagctattacatatggacattgttggtctagctagagtgcaatctgttggaggaaagtagtatgtgttggttattgttgacgattttcctcgatattcttgagttttctttatggcaactaaggacgaaacttttcaaccctttcgtggtttgtttcttcgattggatcttgaatttcctggttctttgaaaagaattcgaagtgataatggtggtgaatttaaaaatacttcatttgaaaaattttgcaatgaaagaggtcttgaacatgaattttcttctcctcgtgtccctcaacaaaacggtgttgttgaaaggaaaaatcgtgttttggttgagatggctagaacgatgttggatgactataaaactcctagaaaattttgggctgaagcttttaacacagcttgttatatttcaactcgggttttcttgagatctaaacttggaaaaacttcttatgaacttcgatttggtcatcaacccaaagtttcacatttgcgtgtttttggttgcaagtgctttgtcttgaaatctggaaatttggataagtttgaggcacgttctaccgatggattgtttcttggttaccccgcacatactcgtggctatcgtgtacttattttggagactaacaaaatcgttgagacttgcgaagtttcttttgatgaggctagtccaggtactagacccgatattgcaggtacactatcacaggttcagggggaggatggttgtatttttgaagacgagagcaacgacaacgacgatgacgaggtcggctcggccggtcagaccgggtgccaggccggtcagaccaccggcacaccttcggtcagaccgacggaagacgtgcggtaagaccggccagggccgtcggctgagggttctgttgacgctgttcgagatggtcctccggagattacaacttcgactagtactgatacggaacgtggatcaacttcagaagtcgctgctcctttgcacattcaacaacgacatccgccggaacaaattattggtaatacaggtgagcggactacaaggtctaaggtaacgactcatgatgtttgtgtaaattctgcatttgttgcttcttttgaacccaaagatgtttcacatgcattaactgatgaatcgtggattaacgccatgcatgaagaacatgaaaattttgagagaaacaaagtttggactttagttgaaccaccttctggacataatattattggaaccaagtgggttttcaaaaataaacaaaatgaggatggtttgattgtgagaaataaagctagacttgttgctcaagattttacccaggttgagggtttggattttgttgaaacttttgctcctgttgctagaattgaggcaattagacttttgttggcttttcctgcttcaaaaggttttaaattgtatcaaatggatgtgaaaagtgcttttctaaatggtattatacaggaggaagtttatgtcaaacaaccaccaggttttgaaaatcctgattttcccaaccatgtttttaaattgtctaaagctttgtatggtttgaaacaagctcctagggcatggtatgataggcttaagaactttttgcttgcgaaaagtttttcaatgggaaaggttgacaaaacgctttttgttcttaagcatggtgataatcaactgtttattcagatttatgtggatgatatcatctttgtttgttcgactcacgctttggttgtagattttactgagactatgcgcagcgaatttgagatgagcatgatgggtgagttatcgtactttttgggattgcaaattaagcaaacacctcaaggtacttttgtgcatcaaacgaagtatacgaaggatcttttgagaaggttcaagatggagaattgcaagccaatatcaacacctattggttctacagctgtgttggatcctgatgaagatggtgaagctgttgatcaaaaagagtatagaagtatgattggatctttgttgtttctaactgcttctaggccagacatacaatttgttgtgtgtttgtgtgcacgctttcaagcttctaggccagacatacatcgtcaagtggtcaagcgaataatgaggtatttgaatcatacacttgagtttggaatttggtattctacttcatcttctatatgcttaagtagatattcagatgctgattttggaggttgtagaattgataggaaaagtactagtggaatatgtcattttcttggtacatcattgattgcatggtcttctaggaaacaatctagtgttgctcaatcaactactgaatctgaatatgttgctgctgctagttgttgttcacagattctttggcttttatctactttgaaagattatggtcttacttttgagaaagtacctctcttttgtgataatactagtgctatcaatattgctaagaatcctgttcaacactcacgtacaaagcacattgatattcgttttcactttttgagggatcatgttgagaagagagatgttgaattgcagtttttggataccaagttgcaaattgctgatattttccataaacctttggatcataatcgctttgcttttcttcgttgtgaattgggaataattcatccttttggcatggtttgagggggagtttgtatctcatggttttatcaagcaataatatgacaatgagaaaaaattgagaaaagagaactttgtttatacatatggtattttcttgcgcatgctagcaatactttgaaggtttatttgtctctagcatagcttgtatgtattctagtcttttcatgagatttagattttgcttttaagggagatgatgcatgacacttaaattctatacttgaattaagaaaatatgcaatgttgatgctagcatgtggtttgatttataaatgctctatatatatatgctttattgaattgttattcctcaaatagctttaattgctcattgtgaaaaagagaataaaaaatatgaaaaaaatgaataccgaatccttggaaacagtcttgacgacaaggacgtattcgatgtgagcaaaataatgggtgccgaatccctagaaacagtcttgacgacagggacgtacccggaataaaagagaaaaatatgagaaaaaaggctcaagaaaagaaaaagttaaaaaattctcttggttattttgtgctaaaggttatttgagaaagagtgataaatgtaataggtatatgtgtttagtgtttattcttcaacctatgtgcttgttcagatgttgcattataaatcgtatgaaatcatgaatttcgattgttgattcaagcttaattgtaaaatctttggtttatggttatactttaatacatgcttgttatcttatagataggtttatcttctttttattgcaacaaatgacttgatatattatatgtatgctaagctcttgaacattaatgaacataattcctatgttggatgaaatcattgtcaaaagggggagaagtattgtgaaaatttttggatttttgggagaagcaaggtgaattttcggagttgttgagaagagcatgtttttgttcaattgggaatttctttcttttaaaaagggggagaagttttcttttggatttttgagcacgatgtgtacgtttgtacgacgtgtgctttttaccacttttgtttttatttttccaaacaccaaaacatttttgataggtttgccaatgtgttcatcaaaggggagattgtaaaaccaaatgtgtttttgattattattctatgatgaacaattggcattggagattattggttttgttatttagaatttattcacgaagtggttttggagatgattggattcataggtgatcgcaggtttatcattttatgtgaccggtcagaccgggctgtgtatgccggtcagaccggcggtgatcgagcggtcggaccggccagcccacggtctgattggccgacgctgtgtcggtttcggtttcgagttgtttgtttggatatccgtgattgtttcatgattatggcttctagatggatactatacgtatgcaatactgttgtttgctactaatgagtcaagttggagatagcttggtctcggaatatggtttctttgtttatttcatgtgtaggtgactcgatgtctcgggagagtatttgcggtgatggaccgggagtcggcttggggataagacgacgtccgtggtggtcagagatcatgtgggatactaaggctagagttgatgcacgtggttgatggagattccatatggcataggatggaggtattgtgtgcgtatgggatgtggagtcaaatttggaaggagtccaaatttggtacgattggttatgtaaagtttctttcttgtactagagggtttcctaaggtgtttaggactcttagtatgagtttggttcgtgg

SEQ ID NO: 12165 - DNA, 1284 bp, Oryza sativa
gtcatccactttaagaattcttcgatttgtgtttcactgggtttcggcggtctaaccggcggcacaccagtggtcagaccggcggcatcgcggtggtcagaccggcgggtgacctgcggtcagaccggtggcggcatcaggcgcggcagggattccagggctgtccaaccggaagatctacaccggtcagaccggcgactacgcttcggtcagatcggctaatctactccggtcagaccgatctcatcgaaattgagggtaacttttatttctgctagaagttttcagtttttgggtataccaaccattcacccctcctttggttggcttagttcttgtgattcgatcctacacagagtcctactcggacaccacaagatttacttagatagtatctgcacttgtttatgtggttctgcttagacaaggggtcatctaagagtataaatagaacacccctaggaatagagggtacaaatcttgaccaaggcgatcacaaaaccaacatgagccacaaaagccaacaagacaatacaagtcgactccaatctggccaagttcctgttcaagaaagccgacaatagctaaccgttgatcacctgctcgagctttacgccactattctgacatagactagattatggtctcctatacgtcattgcacttgtaagatattgacatataatggtaataccggcttcgatcaataagagtaggctattacctatcagcagggtgtcttagcctatataaaaaccttgtctccgttgcttttaccgtagtctcgcatataccttagtatcagtacactattcaagaaatttatacaaatatcagttattttgttatgacatgttttattattaaaaataaactttaagtatgtcttatactttagcatatttacattatttttctaataagatgaatggtcaaacattatttaaaaatcggtgacatgatctattaaaaaatagaggttgtatcttacaattaaatacataaagagattttctcccattcttgaagaggtatatgcctcttcatacttaagatatacctttacttttaccctacataaaaggaggtaccaaaattatttttacatgttggatgattggaaatgagtatacacctccggactaacaatatgagttatatatacctctctatacctcacaacaatcataataatgttgcaggtgcataatcataaacttgttttctaatcagtttaatcggtttaatttttacctctcaaattatgaataggtatatacctct

SEQ ID NO: 12166 - DNA, 8828 bp, Oryza sativa
  unsure (1)..(8828): unsure at all n locations
atgattatactttaatgcatgcttgctatattaatgatgggttcatcttctttttattgcgacacatgacacgatatgctatatgtatgctaagctcttgaatattactgaacataattcctatgcatgatgaaatcattgtcaaaagggggagaagagtttgggaagagcatgttttttgttcaaggggggatttctttatttttaaaagtgagaaaagttttctttttgattttgagcacgatgtgtactttggtacgaagtgtgctttttaccacttttgtgctctctaccacatttgtttttatttttccaaacaacaaaacatttttgatgggtttgccaatgtgttcatcaaggggtagattgtaaaatcaaagtgttttttattcttattctgtgatgaacaattggcatttgagatttttggttttgaaatttggagattattggtgaagtagttttggagatgattggagttacaggtgatatacaggtgttactggtttgtcaggaccggtcagatcgggcatgtgttgccggtcaaaccagcggtgatcgagtggtcagaccggctcagcccacggtctgatcggcccagcccgtggtctgaccggccgactccggtttcgggttgatttgttcggatagttgtgattgtttcatgtttatggcttctagatggatactatgcatatgtaataccgttgtttactaacaataagtcaagttggagatagcttgatctcggaatatggtttctttgtttgattcatgtgttggtgacttgatgcctcgggagagtattgccggtgatggatcgggagtcgacttggggataaggcgatgtccgtgatggtcagatatcatgcaggatacttaggtgtcacaccccgaactagtcctgagcggaattagcccgtgacgctccaatttaacctgttaatcgataccagtcccaggaaacagtgctggtatcacaggaagtcagaatatcagagcaacagaagtctctttattatagagtaggagtacagtcatgttgggctgcggacagatcccgagctcacaactacattacaagagggaagcggaagccaagacttggaccaaacatcacaggcgcgacttgggaactaggccaaaaccctaaaactcatcgtagccgacttgctcctggaagaactcctcgtcagcgggatctacttcatcttcttcagcaactgggggggattatttatatagagcaagggtgagtacaggagtactcagcaagccatgggaaataagtgtttaatgcaggcttcaaggaaaggctgttgtttttgcaattgattttacttaaactcttttctgaaaacaactaagtgagtgcttctcaaacgacacggatgagacagtgcgtctcgtccggtcggagtatgtgcaatgtatcagtcttttgaattgatcaaggttggcacccggccaacagctttcaaacggccacccgagcctggctgatcccatcagccgcagattttccaaacatcaatcccaaacctcatcagcaaatttcacaaagcagtagtcaaacaaaactacgctagaaatcacctcacatccgcccatgaccgtgggcacagctgttcgaacagtttaataacctctgcagagggggtacactttacccacacgacattactaacccggatcatccagcccgtgtagtacggccacgtctagagaccttaaggctttcatgacaaggcatttcgaaagccgacacaggttcaccatatgctgacgagaggggtcccagaccaacaacaggttaggtcccggaccatactgtgccaggaagcccaggggtcctccccgacaccaccccggcgaatccacttgtctctcagcatcaaggctcccctgattagctaattactcagccaggggtgtcccattccacccatgtggtcgtacttgtcttatgttcggatgaaattccaaggaaacggtccttaagtgcaagagcgggtaaccgtacacccggtacgttccccggtctgcgattttggaaattcatttagttcgcaagcaccgacccaggtgtcgggttttccgagtcttttgtaaaacccaagttttactcagaatgtttctcagattttaagtttgatggcgaccgtcgatactcatacagagtgcacgattaccgaggcgcaactaaggggttgcaagggaacatgatataacaattaacaatggaaggatcagatgcaacaagttaggtaggcccaccggtctgccttgcagacggtgcaaacagattaagtgcaatcctttcaatgcataatattttgcaagcaatataattaagttcaaatataggctcaatatgttcaaaggtggcttgccttgctcgagatcttgagcttgatcctcgaaatcctcgcactgcgggtcttcgggctccgaaactacacgcgaaacgggacaactcaacaaacggcgaaaaataaagccctattattgacctctaagcgtgccattagatagatttcgagatttgaggaattttggaagttgaacggagtcaaacggacttacggttgggaagatattgaatttctaagattattggatttttggtctaaaggaaaaggatttatttaaatcctttttaaaaaaaaagaaaagaaaggaaaagaaggagggagggaaattagactttcctcgggcggctagggcgcggcccgagagaaaggggcggctcggccgagcttaatgggccggccggcccaagaaggcggcccaaagcgcgcgcgcgggcggggaggagagagtgagagagccggtgggccaggtccatcccgcgtggtcccgggtgggacccgcttgtcggcgactcggctcaccgtgagcgaggtgcacgcggggcgtgctagggtttttggagggaggcgcggcgcatgcgcgcggttcgcggaggacgcggtgcggcgggcccacgcgtagcctcacggctcaccgcggaccatgcgcacgggggggggggaacggagggagcggctggcgggtcagccgatccggtcgcggccgaggtggcgccgacgtggtgcctacgtggcagccacgcgggccggcgggaggtagacgatgatgccggccggaacggatggcggacggcggtggcgattggctgagcgaaccacggcgatacaggtgaaagcgagcacaccggggggttgcatgggacgaggggagacgagccaacggctcggattcgccggagggaactcaacggcggcggattgcggcggcggcaaccggcggcgagggaaggggaaacggcgacgaggtcacgtggggccgattcccggcggtgagagcatctacgcggctatgggaatccgttgctagcgtcggattgggcggagctacgccgagcgaggccagcgacgagcgggcgctatggagcacgggcggcgacggcggcgagcacacagctagcggcggcaacggtcggggcggcgccagctagctacaggaaggctacacatgctactaccgaaaactaaggggaagagatggatcgaggagggagaacgggggaatgcactaccgagatgaggcggggcgctgtgacgagaggccgacggcacgggagtgatctctccagcctcgggccggggaagaggaagaaggcgagcgcccagagtccccttccgtgtcctcgctcgtgccggctcctccggcacgcacgacggcgaacggcaatagcgaatagagcacgggaggcggcgacactggagtggaggcgaatgggagaggaaaggaaagggggtgaagcttgggtttatatgggcgacaatgtcggtttgggagaggggaaccgactttggacggtcaagccagtgagctggcgctccggctagcggccaaatcggcgacagggaggaggggaatgacgccggcggaggaagaaaaaggaaaaggaaggaagaaagggggcttgccccttgccactttcggaaaaggaggaggggatgggggcgacgcgacagaggggggaggagctctgcctccgtcccttggaggctagcgcgcggagtggcgggggccgggtcgatgacgacggcgatgacggcgggggcggtttggagcggagcaacgacacgggcggcaggcgcggcaggcgctgacggcggcggcgactggccggtcggccaccacggcgcgcgcgcccgggtggcgcggcgatttgggcggcatcggcgggaacggcagcgagagcggagagggaggagggcttggcgcggctcacgggcagagcggggagagagagagagagatggggagggagggagagatgggccgagaggaattcggcccatcgaacccgagggaggcaaagtagacttttgcggagggatttgatttgggaaggatttggattcgggattgaacttgacgatagatcggggattcgagatctgagatggcacggacactagacaacaagcaaagaaacagatttcgcaattaggatttttaagagatagttttcccgctaggcgccacgacagaacgggcgctacattaggctagagttcaatgcacgtggttggtgaatattccataaggcatacgatggacttattgtgtgcgtatgggatgcggagtcgaatttggaaggagtccaaatttggtatgattggagtttgtaaagtttgtttcttgtacgagaaggtttcctaggtggattaggacttctagtaggagttttgttcgtgcctttaggctgcctacctcatgtataaatagagagggagcgtgaggcttcccggtatcggttttgagagcattgagttgagagttgagttagtgtttcaagtttagtcgagattttcgtgaggggtgctgttgttgcaacttgtaaacacagagagaaacaataaagttgttatctactttaagagttcttcgatttgtgttttctcgggttcagcggtctaaccggcgagacaccagcggtcagaccggcggaatcgcggcggtcatactggggggtcagcggctgtcagaccggcggcaacttcaggcgcggcaggtgatctcggcggtccgaccagagttccaatcttggttagaccgacagcttccaggcggccagaccgacgcaactacttcggtcagaccgcgatccgtcgaatttgagggtaacttttaattccgcataaagtttgggtttttgggtatgccaaccattcaaacccccccctccttcggttggcttagttcttgcgtttcaatcctacgtttatatcataatctagaaaagaaaaaggactaaacagactcatctcgttggtcagacacatgttaactgatttgaaagtagttcaaacaaaatttatacaaatttgaagaattcaagtagacgtgaaatttttagcttgtgcagaagatctcgagagtacctgagatagacagatttcgctgagaaactgatccatcgtactacctaaacaatcttggaagtctatactatagagccatagagggctaataataaagaaggaaaaacgattcagtaagccatccatttcttgaattacagtttatgctccttctagtaaattttaaaatgtatttatctacaacctaaatatacagtttaagttcataaaaccctannnnnnnnnnnnnnnnnnnnnnctactaaaaaaggatttttcctgtacgaggagctatttagattgtagacggactgtttttgcgttcgcacggataaattggcgtcccattttcgcatgtggaccctttaaaagcccgcncacgaaaatcgattttcgcatgcgggcctgttaaccatcacgaagatataagggtattttcacatgcagacccttaaaaggcccacaggcgaaaatcgattttcacgtgcgggcctcttaactgaaccgcccgcgaaaatacctctcctccttttccctcctactcacttcaaaattttcaacttctctcctccttttcccttatattaaatccctcaattactctcacccctctctctctgtctacgcacctacttttccactttcctctcctacttttccctttcctctcctctccttccctctcctccccaccgatcgcacaaggaggagtaggaggcagcccgcaggagctagcggcaaaggtggttggtcgcggcgttgccagcagcggcgggctcaatcgggagcggcggtggcgcgatcacggcgacgacgagcggcagtggcggccagcaggcgcgggcgcggatggcagcgaggcaccgtgtggctctaccgtgggcacagacggcggcggcaactggcccctgcccgtatccagcggcggcggccgtcccccacccggatgcgtgcggatccaatggcggtggcagccggcgcgacggtggtggtctcgggcgtagacgacggtcgctgcggcgtcacgacgacagcaacagggtgcggcgacggcgcgatgatggcagccgggagcggcggcaggcgattctagggttaggattttttattttttttattttgtttttcttttacgtgtgggcggtatcccatgcagtccacttaacctgactgcactggaagatgattttcccctgcggttgagctgcccgcacgtgaaaatattgattttcccatacttctagtgcagacaggcaattcctccgcatggaaaaacctattttgatcgcatgaaaaaatgtttttttagtagtgaagaatacaagggttgactaccgggtagtatatatgtaattatttgctaatatactatttttatagcaatttaatactggaaccaactactggcataggcatatccaataaagccagctgccacaaatagtttagcgaaaattgcagagactaagtgttattctcagaagaagcattatacaattattactatatatgtcaatcatcgcaaggttctggttgttgacctcatgtaaactagatgcaagtgtgaaatatatagatgaacttacgttagacattatacacatgatggataaatatatgttgaaatatcatgaaaatagtatggaatgatgatttgacattcttacatgttgagctctagtgtgtactaactacttaactacataaaagttgtagaatgcacgatctacataaaattttgtctgtgtttgagggagaggggattaagaaaattgggaagatacgcaaaacgagataagccattagtgcatgattaattaagtattaactattttaaactttaaaaatggattaatatgattttttaaagtaaatttcatatagaaaatgtttgcaaaaaacgcaccgtttagtagtttgggaagtacgcacgcggaaaacgaaataaacaaactccctttgttctccaaacgaatgcaggtaatcatgaaaattcctcaatgaccaaccgacattttcgtataagagctactatttttctttattattattattattattattctatatatatatataatttgatttttctatgttcttgtagcatcttattgctgtcagcactgaataataaaagtgaaaaatatgattaattttctcaaccaaaggagaatcatttccggagagatgtcgattttgactgtttccgtccatttaactatatattagaaaaatcgacacatcagcatggtttattgttgggtcaaatcaaactaaaaacactaagtttaagccggaaggcagcgatgaatgagcaaagagaagaggatcacactgcaaaccggtttcatcggatgaattcagacgcactggaagggcatccactgggacttaatattgtttcctctttttttttttatgatttgtattgttcgtgccatacaccctaacacccatacagctggccagccacggagaagcattcattggagccaaccatggtgtgagctagattctgatattcatgatttcattaaacttgaccctattcacaaccatggttgctgacctgtggactgataataaaacctgggatggtgagaaacttaatttaatctttaaaatcaagctgtgaacaaaattttgcaggtccagatcattcataatgataatgaattgctttgttggaacttggaagcattctaagaatggaatttgtaatactaagagtgcatataaggagattatgaaaagtgatcagattcataactttcaacaggtaaatcccctggtgacttctatcatcaaaatcatctggaaggacaagcttactcctcccacggttaaagtttttgcttggagactgctcggagaaagttctgcattcagcgcaaaagttaaatcacagaatttctgatatttcagctaattgctgtaggtgcaatcaacctgaaacatatttccatcttttctttcgttgttcctttagcagaataacgtggagaatttctgaagcaaatctttctactgacattttccctgataatgtttctctggctcacatcattgcttacatttcctcaaatggtcacctcctaaaaggtgtagaggccgggttaatttataatcctttatctaaaaaaaatagtactaataaaattgatatccataaatcttttcattatcttgtggtagctttggaaggccagaaatgatctgaaatttcagggcatcttaaaggagccgacccaagtgtgttttgtgttttgcggcagaagctatgataaatacatatactctacaaatcataatttgcaggtggaatctcaggaggaggaaaacaaaagaagaatggaaaccatttcggagggcaatagatgttatatagat

SEQ ID NO: 12167 - DNA, 10009 bp, Oryza sativa
ctcgtaaaggaagtcgttttgggcagcaacacggtctccaaaacacaacttttacttttttgtttctacaaaaatatttattgaaaagtgatatatgtatacttttataaaagtatttttcaagacaaatcttttcatatattgaaaagtgacagacttcctttaggagtacaggagtacggagagagtatatctaggcaattagagacagattagcaacaaacataatttaccataatgatctagtcctgatatagtacactactagctatagtaaatacttccattatattgtattgtaaaagttctctaagtgtatgtgcatgcacttaatttttggaaagctagcaactcaagagatataattaactaataataagaattaaaatgaccataagttgtaatccacgtgttcaattttataacatccatagtgaccaaaatcaatttataagaaataaatatctatataaggaatattatctccgttctcaaatagatatatcgttttcggttttctaggtgaaaatttccagttggcacacagctaaacgcatggttctttgtagcaatccaagacgaaaagtaggtgattggagctaataataatgcttaattaggggcaaactggcaatttttgctgcatctaacacaatttcattggtctgcgcaataacatctttttccgaacggaggtagcatgcatgtcatttgagcacatacccctctcgttcgcatggcatccgaataactaaatactgtacaaactatatattggcaacgtatattatgtcgtcatacatcattctataaacatgcatagctaaattagatcatatgtaaataaaaattacaaattcaattgtgccaacgttttcatgtaaaagaatattttttttgagggaaatgtaaaagaatatttatctagggaccacactattaccttttttttgaaagaaaattggaaattttaataataagttgttgttcatctccagcttcagtcacagcataatcacgttgtgtcacctcacttaaaatagttctcagaattctcatcatgtctggatttcgtgatactgatacgaaaaccgaacaggaaaaatttcccttgagctgttggtatacttggtatgcaagagtagttttaccaagtcctccaaaaccaacaaccgagacaacctttggatgttgttgctttgactcacagccatcatcatcggacaataatttgattacttcatttttcggcccttcaatacctacaagatttgaagcatgctcaaagatagagagagccctgtggtcaatgattgtattgctggtcctgcagatggtcttctctgatctataccttgcatgcctttctccgacaatgttgatttggctcttgaaatcttctattgccttggcaattcgacgtttagtcttcatatttgcgagcgatttcttacacttactgatgaacccatctggagtggcagattcatcatcaacatggaccatgaactcgtcaataatgtcctccatgtcgtaggatagctcccttacttccgtcatccaagcctggtcttgggcatcaggattctcctcctctgacatattgagaaggaacgcatggatggccatgagttcggtagagagagacttgatctccttgtgcagccccttgaagatcgtgtacttatcaccaagcagagcggctagcttcgcaaggacgggcttcaaagccccggttgctgtgctcactagagctccctccatctcttaaaactctgtctgttttgagggcaacaacaaacccgaaaattattttccattaggaacagaaacatgaatctgttgctagctgatacagaatacatgtacgaatcatatacagggacataattaagcttgcttaagccacaagcacgcaagacagagccttaagccggagggatatagtaggcatatagcacacaaacctgaaagtgatctgtataaagaggagatgacagatcagggtcagaagtcaccacagagcagaagaaaactcaacaaaagctgcagatatatcggtatatatgctgtactatgctattagccttctagagaatggtgtcgctggaaccgatcgaatttgccagggcatatatataccgctgagcagcgagacttgacgcgccttgccggtacgacacggccgggcaggaatgagtttttgctggggacagaacttgttgattcaggtgtgtcaggtttccctaagtgatcgacaaacaagctgtggaaaaacacacgcgaacacgaggaaacacgctgagttttgtggtgcgatgaagcttcaccttttcggttttttttcttctccttttattatgcaaataacagacttaggattcgatcccacgtcccggttctttcgcgtccatccccgcgatccgagagacgcgttcacgtcccgttgtccaggccagtcgcgagttaatctcgttgacagccactacgtgcacggcatccacaacccggagctcgcgcatgcaacaacagaaaaactaacatgcatgggcatccacaacccggagctcgcgcatgcaacaacagaaaaactaacatgcatgcagcaacagaaaggaacgtaaaactagctactactagatacatcgtgtaaggtttatttccaacaaatctccccctaaaccttgcacgtccctttaacttcgacgaggccaatccttgtgcacagtttattgaaccgatcacgcccaagtgacttcgtcagaatgtccgccagttgatcgtttgtactgacgaactcgatcttcaccctgtcctcctcaatgcattctctgatgtagtgatatctggtctctatatgctagctgcgatcgtggaaaacagggtttttgctgagttgaattgccgactgattgtcgacattgagtgtgacggcgtcggcttcttctcccttgagctcggcaagaagacgcgccagccacacaccctggcaagcagctgttgtcgccgcaatgtactccgcttcacaggacgataaggcaacaaccttctgcttctgagattgccaggtaatcaagttgtcaccgaggaagaagaagacaccggtggtgcttttccgcgtgtcgacgtcgccggcgagatcgctgtcactgaatccaacaagatgaacagctcctttcttcctccggtagctgcagccgcgattgatggtgccggcgacatagcgcagcacacgtttcacggctgccagatgctcggtagtgggtttctccatgaatctactcacataacccactgagaacgccaagtccggtctcgagttcaccaaatagcgcagcgacccaacaattttcctgtaatcagttgcatccacgcaaggagatgtgctcaacttactgagtttgaggcgtggctccattggagtctggctcgggttgcatccaaccatgcctgctgcctcaagtatcttctttgcgcacgcaccctggctcagggtgatgccctcgtcggtctgactcacctccaggccaagatagtaccgaagtagcccgaggtcgctcatctggaacgtctcccgcatctccttcttgaattgatcaagctcggagtggttgccgccggtgatgacaaggtcgtcgacgtacaccccgaccaccagtcgacgtgcgttagctccgcgcatgtacacagcgtgctctgaggcactgcgatggaacccaagtgacagcagcgacgcgtcgagcttggtgtaccacgcacgcggggcttgacgaagtccatacaacgccttcaccaggcgcagcaccttctgttccttgccgtcgacgacgaaaccgggcggctgcgcgacgtagacttcctccttgagctcgccgttgaggaacgctgatttcacgtccatatgatggacggcccaaccttcgctcgccgcgtacgccagcagcaaacgaaccgactcgagccgtgcaactggggcgaacacttcgtcgtagtcgattccctgccgctgcacgtatccttttgcgacgagccgcgctttgtgcttggtgatgttgccggcggcgtctttcttcgtcttgaagacccacttgagtcctatgggccgctggcgaggtgggggatcgacgagcagccaggttccgttttcttcaattgatttcatctcatccagcatagcttgacgccaacagtcttgctgttgcgcctcggcgagagacgctggctcttcagcacttgccatcatgagttcgtcatcgaactcgcgcacagccagtcccggcggggtcgccggtcctaatatctcgtcgacgcggcggaaccgaagcggagcatcatcatgatcggcgtcgaggtcgtccgcggcgatggttggtggagtcgcgaattccgccgatgtcgcagttgtgcccgccgtggcggcaggtgtgcatggacttgtcgatgtcgcgggcggagtcggtagctccggctgctccgagtcagctcgtggcacgttcgccacagctgggtggtacacagtggtgtactcgatggtgaagtccagctcactcgccgtctcgccgtcccacctccattgcgcctcttcgtcgaatgcgacgtcacgtgagatgtgcacgcgccgagaggcagggtcgtagcagcgatacgccttcgaccccggctcataacccacaaagatcatgggcttactcctgtcgtcgagcttcttgacattcggcgtggtggtcttgacgtgtgccaaacacccgaacgtccgcaggtggtggacggccggcggcgatctgttccacagctcgtatggtgtcttcccaccaatacttttggatgacgacctgttcaggagataaacagctgtggtgactgcctccccccaaaacatacctggcagccctttggctttgagcatgctccgcgccgtcccgaccaccgattggttgcgacattccatgacgccgttttgttgcggcgagtagggcgccgtcgtctcgcgtcggactcccagctcggcgcagtaatccgcgaagtggtggaccaggaactctcccccctatccgtgcgaagagcatgtagcttcttgccgctcttgcgttcagccgcggcttggatgcgcttgatggctgccgccaccccatccttggaggggagcagcgacaaccacatgaaacggctgtaatcatcgacgagaaggagaaagtaccggttgccggtcggagttggtggcgagatcgggccgcagaggtcgccgtggagtagttggagcggctccagggagcgctgttgagcctgctgtgggaacggcgtccgacggtgcttgccggcgaggcaagcctcgcaaagctggtcaacttgcgacacagccggaagaccgcgcaccagctgctctctggccattttccgcagcgcagtgaagttaatgtggccgaaccgtgcatgccacttccatgcttcgtcgccgatgcgtgccgtaaggcagaccgggcgcgcgagctcgacgtcgaggacgtagagacgtccaggattgcggtgaatacgggcaagcaggcgccgctgctcatcccatatccgcataacgccatcctcggcctccaccttgaaaccggtctcgtctagctgcccgacactaatgatgttagcagcgaggcgtggaatgaggtaggtgttggcgagggttcgatgctccccattcttacaggagaagagcacggtgcctcgcccttcgattcggacgacggagccgtctcctagtcggacgttgccggtgatgcctgtgtcaatgtcggagaaggccgtccggcagccggtcatgtggttggaggcgccggagtccacaatccagctgcccggatcacgctccgcggcgtcgtcgagcgccgcgaacagcttcttttcctccaggtagatgggatcggatgacggagttggcgcagacggcgctggtgcatgctcctgttcacgtgcatgtgtgattactcctcctgtgaggagaagcaaggtgggctcgtcgtcttgggccacgtggacctgttcatcccgcttgggcttgctcctgcaatccttggcccagtggccgtatttgccacagttgcggcatttgtcttcacgacgggccgctccggagttcgtattctccgcgccgccgactccagcgccgccgccgttgcggcctttgccgcctcgccgcttgccacggttgcttgggctgcctgagttcttctttgcctcctgctcctttttcttgtggcgctctagccattcttcctcggtgaggtagagcttgccggcgttgtctgaggacgaagatggcaatggcatggcgtcctcacctgccttgagtctgccggtcacctcctccagggacagtgtagagatatcaaggagagtttcaatggaaaggacgagttgggtgaacctgggacgggcgacgcgcaggtacttctcgacgaccttgtctgccggctcgggatcgccgagcgtcgcgagttgattgacggtggaggtcaggcgcatggcgaagtcctccacggtctcaccgtcgcgaaggacgagcgactcgtactccatgcgcaccttctgtgcgcttgctttgcgaattcggtcgtcgccgattcgcaggatcctgatgcaatcccatgcctccttggccgaggccttggtggccaaggtcgagatcatctcggggggcaccgcgctgcaaatggcgtcaagcgccatcctatcctcatgaagctcgacaccgcctggatcgatggcgccccacaggcaccgggcttgcagtttgatcttcatcagcaaagaccaatcgttgtagttggttcttgtcaacagcgggtagttcgccgcacctcctgcttccttgaccacgcggtggatcaccagcccgcggtcgctcccgccgctgcccgaggcgcggccgccggaacctgaaacatgcacggacggtgacgccgaccgccggcgcggggagtgcgtgcgtcctcgaggcatgaagacaccctcaagagcgcgatctcgcgtccacgctctgaaccgagctctgataccacttgtcaggtttccctaagtgatcgacaaacaagctgtggaaaaacacacgcgaacacgaggaaacacgctgagttttgtggtgcgatgaagcttcaccttttcggttttttttcttctccttttattatgcaaataacagacttaggattcgatcccacgtcccggttctttcgcgtccatccccgcgatccgagagacgcgttcacgtcccgttgtccaggccagtcgcgagttaatctcgttgacagccactacgtgcacggcatccacaacccggagctcgcgcatgcaacaacagaaaaactaacatgcatgcatcaacagaaaggaacgtaaaactagctactactagatacatcgtgtaaggtttatttccaacaaggtgggcaacatgcggggagcagtgggatgatgacgaaagctgatcaatgagcttaattgtgggacaagggatagaatgcatcttcgacctctcagatatatatactccctccttactcataaaggaagtcgttttgcacagcgacacggtctccaaaacacaactttgacttcttgtttctataataatatttattgaaaagtgatatatgtatatttttatgaaagtatttttcaaggcaaatctattcatataattttaaattttcaaactcaacaacttaagagttattcatgatttaatgttctcaaggtttgacttaaatattgtcctaaacggcttactttacgagtacggagggagtatatatctaggatggctctgtacatccattttagatgtaaaggcctgggttttaatttattatctaaaaactataatagacgtagaacgacagctacaggttgcatccaacaaaccctagcgtccaccgccgaacacctccctttagggtcagaagtgatgtgtctaggaaaagcttaactttaatcctaacgcaatacttcaggcactggcaacccgttgttctcagatttcgctctactacgtacccggacagggaggacttaagtgctcttgagggctgtcaccacctctagacccacctcaaacgtactgtgggatatgcatcaaccactggagattaattacccaggcaccgcatctacgcaattaataactactttagtgccgatcaaacactaaagcaatcactataaataaatggactatagtgaacaatgatcccgtatgctaattaggaactaaccaagaagtaattctcactaagtaaatcttaattactcagaatgatatttctattaaatcagagtaataaataaagtacaagagataagagaggattaccgacaactccagaattctttatatagctaccccactgacttttttatataagtcaaggcactgtgtgggtttttaaagcaattgattggatacaatatcgttgctttttgccacgtaagtgaacatttttattggtttaggctgattatatattgtggtcatttttctaggtggttggtaaatcctttatgagtttatttactcggattttataccacatatgccatatatttccaagtgtggtgaaatcatgtgtcttttagggacttaagcacatctgttaaagcagtgtgcgcatggtgtatgcccaatactttagaaatttctttattcacaatatacaagcttctttatagctgttttgctatgtaaattttcaatgatgtagtcaactttagattgcacgcatcatattttacaaagcagtcggtatatcactcggatcatgttattcgggaattcacaccgcatatgctatatattaatatcaagtcacttgattgactacagttatcaaaaccactcggttggttggattatttactccttgactatatgtttagcttgttcaactaatcacatagtcgggggctacacctattaggtgaatctaattgatgcacctaagtttacattcagttatttttcagctctccacagtctttagatttggtaaaagtactcgggaaaccatggcgaagatgagaagatgattgaagcactcggctttggagtaatctagttcgaaagaagattatcttttcgactgtgaaggtctcaggggctactgtgaagattatgggtaccccatacccacacggcatagttatccgactagttataggggataacttatatctatgaaatatgtaacggatcatgacttgggtattacgtttccttatatattatggaatggcctaaagtcctgatttgataatattgtaaagtacatataggaaaccgatatcgtatcggttaagatttctatcttgtaatcctgcccctcatcctatataaggtgggcaggaggccctctagggggcatgatacacaactagatcgtcagatctataatacacacggcgaattcaaatccctaaacaggagtaaggtattacctctcatcgagaggtcctgacctgtctaaatctttgtctccgcatccatccacttttaggtctcatgcgctaccccctttatattgctgaattattgtttcgacaaaagctggttttgaaaatcctgtttcacctgtgataacatatttggttgctaagtttaataaggatgtgatgttttagcatcgtagacttggacatgttggttttgatcatctcacgaggttaagtggtttggatcttgttcatggtttgcctaaacttaagaaagatcttgatttggtttgtacacagtttcgtcatgctaagatggttacttcttcacatgctcctattatttttgtgatgacggatgcaccgggacaactattacacatggatactgttggtccagctagagtgcaatctgttggaggacagtggtatgtgttggttatggttgatgattttttcttaaaattcttgggtttttttcaaggccaataaagaataaggcttttcacccctttgggggttggtttcttcgatgggatct

SEQ ID NO: 12168 - DNA, 999 bp, Oryza sativa
tcaaaagcatagagataagataaatttattttctgctctttacaattgcaaaagtacccgagtagtaaattatgattcgtgaaactttattccattaatgacaaactcatgtcactcatatgcatgtttgggaagtgcctaggctgactcccgatgcttgggggctatgactagtcggacagagtgtttaaacgtacggagtcatctgctcggggaaatcaaaattgacaagaggagaaatacatatttataaatattttaaaatacttaaatttttctcgagtattatatttacatcagatactactcatcctatatgtttgttctgcaggatccagatccagatatgcataatagggattcatggctttcaaagcttatctcctacgcttcagaaatggatcagtcagaacatcaccgaccggcttgccttcgtcgccgccgactggtgtctccgcctacacggctggcctattatgccaccgttgttgggcgtctacgtcttcaccgaccggcttgccttcgccgctgccgactggtgtttctgcctgcacggctggcctattatgccgccgttgttgggcgtctacgtcttcaccgaccggctgccttcatctgctgccgactggtgtctccgcctgcacggctggcctattatgccgccgttgttgggcatctacgtcttcaccgaccggctgccttcgtctgccaccgactggtgtctccgcctgcacggctggcctattatgctgccgttgttgagcgtctacgtcttcaacgaccggcttgccttcgtcgctgccgactggtgtctccgcctgcacggccggcctattatgccgccgttgttgggcatctacgtcttcaccgaccggccgcctcgtctgctgtcgactggtgtctccgcctgcacggctagcctattatgccgccgttgttgggcatctacgtcttcactgtcggcctacctccgtcgcccccaactggtgtcctcgccta

SEQ ID NO: 12169 - DNA, 1275 bp, Oryza sativa
ctaggcggttggtaaatcctttatgagtttatttactcggattttacaccacatatgccatatatttctaggtgtggtgaaaccatgtgtcttctagggacttaagcacatctgttaaagcagtgtgcgcatggcgtatgcccaatactttggaaattcctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatatggttcgagagaagattatcttttcgactgcgaaggtctcaggggctactgtggatattatgggtaccccatacccatacggcatggttatccgactagtcataggggataacttatatctatgggatatgtaatagatcatgactcgggtattacgtttccttatatataacgaacagcctaaagtcctggtttgataagattgtaaagtagatttagcaaaccgatacggtattggttaaggtttctatcttgtaatcctgccccccaccctatataaggtgggcaggaggccctctagggggcatgagacaacctgatcgtcagatcaatacacactcggcggattcaaatccccaaacaggagtagggtattacctctcattgagagggcctgaacctgtctaaatcctttgtcttcgcatccatccacttttaggtctcgtgcgctacccccttttattattgccgaattcatgtttcgacaccctgacatctctggaatcttgagaattattctcagtgaagttagcgccgaaccttatggcaacactgaatcaggggacatacaacaactcattagaaaaatcactacttcccttaagaacaaaaggtatgcaaaattctaaccttcaatcatatattcttatctccaaaatatatggtgtgtgtattataaggccagaccttcaagattttaagcctttagttcattctttgccggtccaacttgctaagtagtccgtgtttt

SEQ ID NO: 12170 - DNA, 2791 bp, Oryza sativa
  unsure (1)..(2791): unsure at all n locations
caaacctgaggaagcttagtatatttatgcctggccatcacgctgatgcggcagaaagatacaagggtcatatgaaagcaatgatctcttccatatgtaagctaggcagagacaaccttcattgtctaacaattcatatttcatccgtatcagcagatgacttcatccaggaaccatggtgccctcctccattgagtcttcaagaacttgtcatcaatcaggcgccaatgtctagggttccaagatggattggctcacttgtcaacctccaacgattaggtttatatctgaaggaactctcgcaagaagatgtcagtacactgggaggactgccagccctgctctctctcattctctatgtggaagaagtaattacagaggagggaggaaggcttaggatcagcagcagttatggattcccatccttggaacgtatccgaatcggtggggaaagttgcaggcttgagttgacttttgaaattgggtgcttgccgaagctacaacaactgaacctcgaatgcatggtagcagaagaaaaccacaccagcagcagtaatgttgtgtttggcatagagcatctgtcccgcctcacaaccatatattgctgtattcattacaagtatgaaaccagactggccaaggtggctatgctggctgcattggagagatcaatcatcagccatcccaaccaacccacatttacaaaggaggaatatggtgattttgtagatgagtcctgttgaaggcaaaatttttaatgtggatcagttcaaaggcgtagctcttgctaaggataatcatgttacagcaaaatggaaagttggtaggtaatgtgattttttgcaatatggatgaggcaatacattatttgtttcactgcccttctttttctatggcggtccctttacattttttctaatttttctaccttcaatagtcaatactgtcagtaacatatttggaattcgatgcagaagctcaacagaaagctcaatcatgcatgttttaaacaggtacagaatgttctaatttatgttggtcagttaggctttattgtaataatgctgttcttatagaaaaggattgctattttgtcacacttattatacaagtatacaaattggctccatttgtggtctattatgcattgctgggtaaggaagcccaccatttgtttgcaaatcgtgggctctaaccacatatttgaaatccatcactgggaaactcttatcctaatctgggttgcacaaagtccaataaaagattaccattgacgtaggcaacttcccctgtttatagatgttttctagttcttgctgaccaaatggttgctagctagaagctcttttcctgatttggatggctcaatagtccaataaaatattatcatttgcataggtaattcccttgtttacagatgttctagtactctttcttaccaaaggttcacgaggcttgtcgcggcccttggagatgctctctttaggttcactcacatggtatagggtctggaggattagtatctgatttattggtgtagagaactttgttcaggaggaggttatgacgatgatcaacaaagttataagagggctctggaggtatcccatgtgcccatatgcatcatccaagcaagcttcaggaccaattcttattctcaaacaaatcagtttttttttagcttcaaccacacattcttattactgggtagattcagtgagatcacgaatcaccaaaacatttacaaaatctgtgagggggtctacccaaagagtgacctgggtcccaactcacacctagctgggcaagattatgaacaacgctattacgagagcgatggggcaaacgagaccttggagctagcaaagtgaagttgcagaagcagttttatttccgttaagattgttgcaaaagcagtgttgacctgatagttccctcttgcattcactcacatcatctctcttgatgttttttcctcctctttttgtgcatgaatttaagcagggaactggctcctgcaatttcattgtttttatcattggactggtcaatctttctttgtttattcaccctgattgtgtttgctgaagcacttttggtggatatttctgaaaaatttcggataataattagtcaagactatcttttggtttcttgcctctgataaaacaatgggaagtttggtgatctggaaagtgttggtatgcacagtgtgtttaaaactacactaatatgttttatcatctggactttttacagctttccctaagaaggcagtaacagaattcaatggcgcctgttgagccaagcaacagaattgcagcaaatggatctccaccctggagctttaaaagcagccaatttgaccttttctttttgggttattataagaaattcagggtgcacacaaacacaatggacgtaaatagtcggtgctttatttatgatttatgtattgtatttaaaccctggcaagaattgctgtcaaagcctttcaatgctctatagtgcacgtgttctctgacctgtgaataaaaaaaactccaacgaataaataaaccaactcgagtattttcacggaaatctattatatccgccatgacgattccgtttggtgagttatttttgcagttctttgctgaagttaattcgcaaatcaaattttcattgtgtaaaaattaaatcatgagaattatattgtgattgtggttgaaacgnnnnnnnnnnnnnnnnnnnnnnnnnnnnnnnnnnnnnnnnnnnnnnnnnnnnnnnnnnnnnnnnnnnnnnnnnn

SEQ ID NO: 12171 - DNA, 227 bp, Oryza sativa
ctggcagccgaatcatcacaaccacacgtataaatgaagtacctgaatcttgctgcttcccacatgtgcatcgggtttataaataaaggccttttcattttgttgattcaaaagggtggttctgaagaaaatttttggtctggaggaatgtccattacacctgactggagtttggtgtaacatattggcaaaatgtgatgggttacccttggcaactattgcaatat

SEQ ID NO: 12172 - DNA, 514 bp, Oryza sativa
aaatggcgctcgatctccactgcactctctttcgcctgcctgtcgtactcggcaatggattcttgcaagctactcctctgttcattaggcaacccacctaggtgtggccagatgatggcagacatatttgggaaggtgtacgccggcgccctgatggcttcaaccattggccccttccccttgccgggttgcttgatagcataacaagtgctctccaacggtcgcagctgtgaagtacaaacagcgcgttagtaaaaaaaaatgtatatgcaggattaccaacgaatatacgataataggggtgcattgaaagctatatagaaatgaaaatgcaagtgcattgttcaggagccctcatgataactttatgattgggttttagtgtacaaatttagtgatcattaaaaatacccgcgtacgccggccccagtgtatgtgagcacatgaatgtttattaatggaaaggaaaatggggaagaaagaatgtgaaacacttacagggaggttgcaaaac

SEQ ID NO: 12173 - DNA, 4096 bp, Oryza sativa
aattctttaaattttctgtcgatgtttcgccactgcgaaccatcggcggggtgtctcagcatcccgtcctattgaccctctttagcgtgccatcgcaacattctagcattccccttgttcctgaacaaacgccttagccgtggtattatagggaaataccacatcaccttagcatgaattctcttctttgttagctgcccgtcaacttctcctggatcgtcccgtctaatcttgtatcgtagtgctttgcaaacagggcatgcttctaggttctcatactcctcaccgtggtataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccagtggtatccaactttttgtgcccctgctcgcaacctgggtacaacgaagttctgtggtcctccaacatcttgtccaatttatgggcctccttttcactttcgcaatcatccctggcatcctgcaacatctgactaagatcatccgcaacgtcgttaccatcagcagctatttcctcctcgcccgtttgatttccttcaaatccaacatactgagcaaagtccggaatattgtcgtcttcacttcatcttcttccatttcaacaccttgctctccgtgggatgtccaacaattatagcttggcatgaaccccgactcaaacaagtagaaatgaatagtcctggatgcagaatactccttctgattcttacacttattgcatggacaacaaataaaacccctttgcctgttagcttcggccactctcaaaaaatactgcacgccgtcgataaactctttggaccgccggtcagcgtacatccattgccgatccatctacatgagtcaaaaaaaaccgtacacaaataattattcttacaataatgacagtcatacaataattataagatatctttattcatacaaaaatcataaaatattacaccaaataattattaaaaactatttgtaaagtgttaaactaaatttaatgtgttttacttcttttaattttcattttagtttggtttctattatttaagattaactttcactagagttttccttctcaactattttataaaaccttgtttagcaaatgaactaaatttctatatattctttcttccccacacacattttctctctcatcaacttacaactaaattttggagacaaaaaaaagtgtgcaaaacataggtgcaaatgtagtatgacaaaaaaaaaaacattggaggatgaagttgcaaaccttttaggcacctccgatttctctgtaatcaccaaaataaatttaatagaaattttggcatgacctcccctcttttttgaagaaattttaaagcttgctcgggcagctggaggaggaagaagacatatatataggggtgggactttagtcccggttattagcaccaaccggggctaaagatcaccgggatctttagtcccggttggtataaagttacgactttagtcccggttggtaatgattccgggggggcctgacatgacctgacagcattcgaaccgggactaaagatcatctttagtcccggttggtaacacaaaccgggactaaagatcaaatatgcccgttacccttttgaaccgggactaaaaatcatctttagccccggtttttattgcatccgggactattgtggaaatcggccgaccgacgaaagatggtttctccaccagtgaggcttcatgcccttgcacggagcctatcattgcttttggacatcctcgacatggattaacgattgactctgtacttaaaatcagcaattcaatgtctctgaatccatgacacattgcggaggagcgcagactggaactaatcaagcaaaaaagatgtacttgaaaaatacacatatgatctagtctaatgaagcaacataccttctagtttccagttctcctccaacccctctcctttaaagtgattccaattttcactgtaaacaggttaatatggatttgcaatctctaatttaccccctatggaaaatatgaagagaaagattttgaagaagagaatcaccttgggttaatgcacatgttgagttcaaccagcccacgtgtggtgatacgttgtggtcaacagagattgcaggcgacatcaacaaccggattattaacatgactaaaaagctaagggtgtgtttgaggagaaggggattgaggagattgggaagattgggaagatacgcaaaacgaggtgagccattagcatatgattagttgagtattaattattttaaattttaaaaatggattaatatgattttttaaagcaactttcctatagaatttttttgcaaaaaacgcaccgtttagtagtttgggaagcgtgcgcgtggaaaacgaggtgttttctctcttaatctcccagatcaaccaggaacgaacgaagcctaagtagcctcctcgtgattgagagaacattgcagattttgcagctgatttgaaatcaaattcggcactgtaaattccacaagttagcagggctcctagatgatctaccactaatggtgtaaagagttatccatatgtgagaattgttcataatgcagtataatcattaaactgaaattgattcacaataaatctgaaagcaagttcttctccataatacttgtcatgattaccttgaccaacggttgaaattgattcataattaccttgacctctcatgagataacttccatcgccatcactgtatattatagccgcttgtcacattagcacattattacgggcctgcagcgacggccccggggcggctcgtcgacggcgtgcggcacggtcgacggctagcagcgccggcttcctccccgctcaccgcgtccccagactggccggtcggcctgcgcggctgcaccgtgcccgccacccgtcgccgccgtgcccgtctcgccatcgccccgccgccccagtcagctcctccacgcagtcacacgcgcgccgcccgcccggctcggcagccgccagcggcacgcgccctgcgcggccagccgaccacgccgcggcaccagcgatccctccaaaagcaggcaggctgccaggctccagtccaccggccggccacacgccagcgatgccgcccagtcgtcggagtccgacgaaagtaactcttccctagttcccttcatcccctgtcctgcgcccttgctgcccgtagatgtcatgtctgatgttgctcctgctaggtatgaggccatatgctctggttcttttttaccgtgctctcagtaagcgccgccgcctcttcttctccccccgttagatgaccacgctattagaggattgatgaagtattgggtttagcagtgaatttaggtttctttgaagtttcgtacatactgcaagatgggcagatttgggtgttttgatatccagatcttgctttacacatgtgtttgcagttaaattgtttcttttcttgatttcttgaaggggcagctttggatgttttgatgttcaaagatgtactcgcctttgtgtttgcttttctttgttcggtttagcagcgaagccagaagaagctgaagtgagggagcaaagagggccttaggtgataaatcaagagacagtagaatgtatataatttagtaactgcaaatctttgtccagagtaaaaatattgatacacttgacatatagataaaatcagattttagatttagccatggacttggaaattattatctgaaccctagcacagatttaatttatcatgaagcataagaagtataacaactctgtcaattaggctagttcaattatagatcaattatagttcatataggagtccatgagtagcatatttttaataaagagatcaatttgaataattaaggagtctatgaacagaaacatagacctttataataaaccatctggagcaaatggttagggcatgacatgggggaccatgtagcagtatgggtaatagttaagataaggggcaactgt

SEQ ID NO: 12174 - DNA, 11467 bp, Oryza sativa
gtttgtgattttaccctcactttttcaaaacgaaactttgatttgcccctactctgttaaaaccacctaacggtgtcaatgaaactaaaaaagacaagtataaccctgtacacttgcccctacttttctaataggatttgtgtattttctaaaaaaatatgatcgcacttggacaaattttgaaagaacttcgatatcattgataggatttcacagaactttcaccaggtgcgaaaatttaccaaaaagatccatcgcattcaccagtaaaaaatcaccaaacaaacaagctcctcataaagtagcacaagatcggaaaaagaaaaagaaaaataagaggcggctgcagcacgaccggagtcgccgccttctcgtgcgatgccgctgctgcgggctcgcacgtgccgccgaagctgcctcctgcttgcggctgccgtcggagccgccgcctattcactcgctccgccgaagccgcggcttgctcactccgccaacaccccctactcgctttgctgatgtgggcatctgctgctgctcgctgggcatcacagccttgcccagccgccggcctatctcgcctgtgcacagccgccgacggtgccactagggttaggctaatcaagtaatcagaatggggatcgggtggtgggatgaaaaaggcaatgcagggtgttgttctttgcactggggtataatggtccattgtttttctcttagtaatttcatctatattttttacactcttattttgggtccaccaaacggtcatccaatataggggcaaacggcagcttcgttcgaaaaaaatgagggcaaaattacaaacaacagaaaagaggggtaaaattacaattagatatgaaagtaggggtaagaacacaattgccccttaagaggaatgaataggacgcatagaccttgttaccgattatttagaaatcagtttcatctttttatatttaaggtcaggcttcataggtgataattaaattagttatagtacagatcttctcatgatattcaaagtgtaggatcatgtaattttcagcatcattcaataaaacttatcctaggttctaattatgttactgtgccagaaatttttcagaatttatcctaggatctaattagcagttattcccagaacttttacattttagaatataatgaactgatttcagtatctgattcataaagttagtgtggtctgagttggccctcccaagtttcttttaagctgtttgtctcacaggtgtgcctttgtatttgtctagtgtgtactagaataatataagttggaccgggagcaacaaaatctctgcttttgacagtgtagcaatacttatgcctctaatagtatttctcaaaaacattgcaatcaaaagctggcattgtcttgtttcacaaaaaaatgttcatcttttggaagtgttataatttttcaattcaaatatgtttgttaagttgagacaactgagctggtatcattgagtagactggtagattatgcaaccatgccaaacttggcatatcttcttttttttatcatggtacagtcggcatatcatttaacattttctcttgtggtgatctagcagaacatagggttttatcttgagaaattctagatttctatctataagttcaataatctttaccacaagtatggattgaactagatgcaaattaattaagctgtggttgcaaattgaattatgtgagtgcatactatcatttagcaatgtcaacagattaaattttgagatatttggatgtagtattgaagtatcaattagtaatatagacaggttggattttcagatgattatgtggcatatcatgcattaacgaaaaaactattactcagcagtcgtattatgcttaaaattttcactattcaagattatcagtttacactcattactgctttcagcatgtttgcagagctgatacttcgaggctatctatcttctgttgtacagtgaagtttagtagtaattaagaaagtgtaagtcataattttttgaagttctctatttccattagctaaagctagcttcctctgtcgaagtatattgtagctgcacatatatgttaaactgattcatactagtcagctaaggatgcatatcttcctgccatgcatgtctgtttcatggcaaaagatatgcaagaagtaaatgagaagaagcagggcacgaccttgtcctcccactagtagacgaatttggctggatttggaatgtggttggatttggctgttaactgggttgtaagttttgtgttgtattggatgtttgtcgggttgtgttggatgctaattgtgctttgacctttgtgctatatgggttgttattgtgtttcattgttggccctctatgggcttagccgatactaatgtaaatgaatacaacatgacgggcagaaaatggtgtggtataatatttgggcctatatgggcttttgcaatggacatggcccatttattatttgatattaaagcaaatggatataatagaattgtgttgacaatatgctacaacatggatggactaggctaaaatctagtcgggtttgccattgggctaaacccataaacaaggtgctaaatacatgaattttaatgggtcatcagctattttatgacgttttttaggctagataatgaaaaatatgagcgtcacaaagctatgacgacggaaggattgtcactagattaatagaaaaaaatctttcgtcatagaacgctattagagatgcatgatatgtcatagcctgaattttcgtttcaggatttataaattatttaataaattattaatagaatttatattaaatgttcattaatttacaagtgaagttaaatgtgggaaataaaatttcctaaatataaagcatggttggatttaatttttgttaaattctccatgattaattatactctctggaattttctcggatttttcagagctcaattcctaattttaataatataaagaatatttcagtaattattcatattaaattaatcatttaatgagctggtttcaattttgttaaatacttagagtgtccaagtatgttcaagatttttcttggaattatttgagtattgaaagtatttttaacaattgaaagatcatctcattggttaatttatttggaaaagcaataaaatcttccttcctagtcttgggccgaattcagcccattctctcccttcctctcagcccggccgaaagtctgtttgtggtccctgccgctacagtactccatcttcaagctccagccgtctcctgcctgtgcacgctgtagcagagcccgatgccgccgatccccttccaaaattcggcctactcgttgctcctttttccaaattagtttcgggaatggaatcctctcaatctcctcttccttttccccaggaaatcccaaaagtttctatggaaatcctttccaatttcgcggttcaatttttcctttttccggcgagaaccctagactttcccgagtttttcccgtcgatgtgggcttgatcccgagctcccgtgcctcgtcgtcctcaagtcccgtcctccgccgtcgccggaaacgctctccccgcgctcgccttctctctccacctccggccgccgctccagccgcagtgcgccgtcgcctcggccgtcgccagtcagcgccgccacctccctcggctccgcaaagtcgagctctatcccggccgctggttgtttttcgccgaatcccaccggagattggccgtcatcatgaaccggagcgccgccgtcgccgccgtgcctccagccgagccgttcgtcgacgtccgtcgtcgccttcggtcgccgtcgtctccattggattcgcagctgcgaggagaagcccgtccgccatctgtcatccgccgaagatcgccggaaagccatcgccgccgtggacccgaacctcgccgccgtcccaatctcgtcgccggccatctccttcgccgttcatcgctgtttaagtgttggtaagcatcgccattgcctcctctttctcccggtgccctccatttgcattattgtgccgtggttcgccggcaaccgccgctcctatgccgttcccagtgtagtttatccctagggtcttaatcccatctaatctaatcttgtatggccctagcgtcgtcatcgtctccgtgtgttgccgccggttcaccgccgtcatctatctctctccgatcgctttggttcggtgggacgtctatccgtgtctccttggtttagatttcaacccatcggccgcgcttgccaagccgctttgtcgcagccgtagccgtgcccgttgcgttgttgttcgccgcactgctgccctagcctgtgcaccgtcgctactggttgtgccgctgttgcttgccgtcaccgctgcgctagtcgcctagctgccattgtgccgctccctgccacagtcgtgttgctgctgctgtgcgttaccgcttgccgctagctgctgtttggccgctgctcgtgtgtgccaagttgttgccgttctgctactgcaaccaccgagccactggccgctgtgctatgccgtgccgttgctgctgtaccgtgtcgcagccgtgcgtcgcttaaacctagccgccgctatcccgtgttgtcgttgttgtggtttgttcgctgtcgttgcccggtagccgagttgcaaagcctaaggtgcatcccttaattcctaccggcctatcgtttgtcgtaccgggactttatcgtgaaccgtgtctagctcaccggtttagtcgcagccgttattgagtcgttcgctcgttcgttcaaacgaggtgttccccttgcttcgttcgttcgtccgtgttgagtcgtcctttagtttagagccgttcagagctgccggttccgttcgccggtttcggttgatcatttgggtgatcccgtgtcacgtagaattgactcgttaagtcggtatctcgtgaggctcgcttgccagatcaatctaatccgttgaatcttggtcaactctatgtcaagattaatcttagccatccaaaatcaatataaatccgttctctcttttcaatggcatattagttcttttttatcatatggcatctaccaaatataatctaatctttttccggaggttgttttaatcttttatctcagttataaattatttgtaaattgtttaattaatttggaatagtcttttctttaataggtttaattggaattaatcttgtaaaattcataactaattcatatgaagtcggaatgaggccgttcaagtctcataattcatctaaaatcatgatctacatgtttgtttactttatgtgtactatttatttggtttttattagtctttttcctcgttttgcgtgttagcttgtcgtttccgtcgtttcgaaggatcgcgtgtgcgtcggaagtgttcaagaagattaattgaagacccactattgcaaggcaagtcacacagatcccaaacacaattcttttgagcatgttgatcctttatttaaattctctatttttttcaactgtgcatttattttcgaatgtcatcgggtggtgtgaaactgtttctttgttatggccaatttgcattgattatcctatttcttgattacctcggattataatttgactagttggatttatatcttggttcaactagatatattagatataattgcttagtcatgcttagaaatattagcacactattgggataactaatgtttcactattacttaatgatgtacatggtaaaggtagctcacgatggtcaatcgtgattggttaattaattaatgtaccaactaaaacttgataatggtgggttgtgagcatatggttttgatggtcgtgctcatgacaattaaggaccggttcacgagtttcgattgtgaaacattaaccgtgccaaccacaagctagcgtgggtaacagctttatcttttgtatagcatggttcattgcggggcaccagactgagaagtggcggagataagcccacggggtcgctgggaagtccatgccttgtttataagggggtgattatgatccaggaatggtgcgctgtggtggattgtattgtgcgaggggtactgtcacagctcctttccaaggaaccgtggtggtattgaggcgcatggtgacatgttgtggggctgtgtcttgtgggtacagtggtacacctctggccagagtaaaactattcgaatagccgtgtccgcggttatgggcgggtctaacaatgcctttcgtgattagtctcacacttctcaccataataaaagatgctataactggtaataatttgattagctcctggtttggaatggtatattcctggtttggagatagatctgtacagccaggtatggttgttcaggatggttgggcctgtgcagcagggtatgctgttcagtgttgattaatattgatgattaattactctactattttacaattctcaaatgtttgctaaatgctgcttttgcaaatgagccctatattatgccatcctttggtatccttgtgcacttgcatatttgctgtgtggcttgcggattattccatgtactcaccttgcaataatcaatcaaacctcagttgaagagaagtcgcaaaggagaagacgtttggcttctaccccagttgagctgcctgtgggagtggaaccggagcttcgctagaccgtaactccgctgttgttttctcttttcttttgtaagtatgtaacgttattattatgatgaatctgtaaattaaattgtcagtttgtgtacctcggctgattcctggatgaggattttgcacaaattagttcggaaattactagtgaatttctgggcgtgacatgataggtgacgaatgaatttttgtcacgcaagcgtcacatattatgaaacgtgacgaaattttatgtgtttgtgacgtaaatgaagcgtcatctatcataagatttcctgtagtgatcgccgctgctgcctggctggccggcctcccatcccgctgcctcccctccggccggatctggcggagggttcggcgaggccgccgccccacgcccggccgcgccggccggcttcccatcctgctggatctggcggaggggaggccgaggccaccgctgcggccaccgagacaagagagaacgagagagagatacagagagcagaggacagggagatcgacagagatcgggagagatagagagagcgcgagacagaggatcgaggagatcgagagaaaggcatgggacattataaataggtgggagagatttcttgtcacgcccagaaattcgctaacccaattttcaagcagaatgtgtattaaatctctgtccaggaccagtcagagtaaacaaacgacaatttgataggcagatccacgtcttacaaaataacaaaataaaactcacatacgcagcggaaaaacaaaataaactagacttaatcttcactaccaaagtgaagcttcctccgtaaaccacaggcaatcctcgacgtccgaaacaagctcaatcctcgaaaaactcaccatctgaaccaacctttacttctggggggcggggataaagcaagactgagtaccaatcaccgtattcaacaagtcataccaacgggaaggtacgatgcaaggatattcacaaagaaatggctcataggataatttgcagtaaagcaacatttataaatcatattttgaaatagtaaaaacaatatatatggttaaacagtattaaatcatcactgtccaacgctaaatccacgttgcaacaggcccaaccaaaaccacctgaactacaccaattctataagtcaaattattatagtgggactaatcacgttgagctggttcaccacccaataaccgcgggcacaactatttgaatagttttaactctgattagaggtgtacaactttacccacaagacacgattctacacatgttaccatgcctcgaagtatcgccacgataccgcaaagggggaaatcgtgacaaaacccgtcatataactctccctaaccaaacatacccacctcagatttcaccccctccttctcccaagttgggaagtcccctctcgtgcctaggtaaatccagctacagcagagaccaatgtccacgtccgaactgcaccattgcctctacccttgccatggtatgtcagctaggttaagttatactctagattcagcctagagcccacgctggtatgtggtaagtaggagtatatcttccaaggattcccgagaactggtacttaattgtcatgggcacgactttcaaaatcatgcatgtacccacgacccactattaaagtatattttagtttaattaaaccataaccatggtggtacaccaataataaaattcaggattaaattatgatgaatcccattgtaagctaattgatctaagcatggctaagcattcctaaaccaatcatctagtcaattataacccaagttatgatcaatgattttatgaaataggctcaatatgatcaatgatgtacgtatgacttgccttgctcttgagctgactgaaccttggcgaccacttcgaaataaactggatcaccagaactaacagaatctaaatgacaaacaaagcaaacaagaaatacaagcaataaggctactgaaacagcaaaggaaactaattttaatggattctaaacatttcaacaagttcactgcaatttgaatgggctaaaacggagcttggattttttagttatgaattttacaatatgagctacgttattactaataaccaaaaaaacttaatcaattattacatattaatgcccatagataaatagatcaatgtaaataaatctccggtaagcaagcctcacaaattaaccactcaacgagccaatcctttgtgtcacgggaccatccaaacagtcaacggaaccagcggcttagaacgactacggaaaactagacatggtttacggcagaggctcggtacggcaaacaataggccggaagggggttagggatgcacctacaggtttgcgactcggctaccgagctacagcacagtggcaaaccacgatgacgacgcggtagaatggcggcgatggcatctaaagcagcggctagggcacgtctcggctagggtggcaacagggcggcggaggcgcggcacagggcacggcggcggcggctagggcacggccggctagggcagctagggttttaccggggctaaacaactagggtttcaatgatgacactaaaaagaattaacaccctaatcaggagattatggataggttcctcaccaaaccgagacgatcggcaaggaggtgacggtgacgacggtccgatggcaacacgcggagacaacggtgatgttagatcgaaacctaggacggaaaaaaattagatccggatagataatggcgatagccatgacacagagagggaaaacggattaccggcgacgctagggtgatggcggcgacggcgggaggtggtggcactgaccggcggcggcggaacagcagcgggcagcagcgcggcacttgggctaggcggcggcagcggctagctaggactagggacaaaacaaaaacaaaaacgaaaatagggaggggctctaacttatatatgagaggggaaaaactaaaggagatggggccggaggggaggaggccgactcggactcgaacagggggagggcggcgcgcgcgcggggagaggaggaggtggcggccgagtgggaggaggagagggggaggaaaaataggaattgggaaaataggataaggactttcccaatggaaatgacgtgcggtaccgttttaggaaaagaatggaaatggatcccgcgaacgaaaacggacacggctcgtcatgcaaaacgaaaccgcgaacaaagggggcagtgaatagtgaatcgggcacgattcacgaccataggtgagagagaaaaaatattattactttaaaacttgataatttagattaacatcattaactccgatgctctgaatattctgctttaagtcctgttaatgattttagagcaaagagaattaaaaaaaaattctccttgacaattccgattattaaacatatcgttaatttatgttttctcttggttaaccaaagtaatttctataggcaattcattagtgaattagaaattaatgaaaaggggaaactccgggtgtgacatttctaagaaaatttggttgggctttttaatcgggacaaaaaaagatgttcagtcccggttcctattcaaaccgagactaatgtggtttttggccaacccagcaaagatggtttgttccagtagtgtctacctattgtgcaatagtgattagtaaggcataagatgccacgtggttaagctttaatgtctcatcacgttcaccacatgggcagccaaagttttccatgaaatgggagttacagtctacagaaggcagttctcactctgctggaatataattaagttagctagctaaatttgtattatctatgggtacaaccatctctaacttttgcgctgctaattttgtaatttctatgggtacaaccattcatggatgcactaaattagttttacatgaatctaacacacgtatgcttggttttgtagaggaatcggatgtacttgatttctgcaagctgggatgtacttcctccgtgtgcagcaccattaacatttgtaaggctagagaaaacatcaaacaaaattactcctgattttcaaagaaaatgtaaaatgtatttgttttatatacctagctaatgtatagaatcattttttttcagttgctgtcaatgaagaagggaatggtgccgtggatagttgcaacaatgcacgctaccgcttctgctccaaggaagctgaggtcgtcactgttgcttcctaagcaagtgcaagatgcaagcataaggtgcttcacacatcgaagcctatatatgcaaggctatgctatcctcgagagtagccataaataagttggatattatgatgcccaagccagtgtgccgtcaacctcttttgtcttgtgctcttttgtattccaataagccataataatcgcaatctgccatcttgtcttgaggatgtgaccatatcaagagtgacgatatcattggctaataaatatagcatctttgaaattggcccatcaaaaaaccagaaacatacattatttttaacgagccttttatgtatgggactgtttatatatctgttgactgaaaatctcacctccaatctttaaaaattttgactgttggatatgctttgagattcgtgcacagccttaaccctaactttttcctcccgttcctctcctccacgcgcattccgccgccgccgccgccaccgccactggcccaacgcgccgctacctgcctcgccggcgggccgaagggagtcaacggtgccggcgaggccgcccgcggtgcgcccgtcccgtggc

SEQ ID NO: 12175 - DNA, 7031 bp, Oryza sativa
gggttctccggcgccgaagaagaagaggtggtcgctggagttggaagaagagcacgaatcttgaagcacatccagttgccggagtttgggttcaccggcgccggagaagaagaggtggtcgcactagtacaaaaacccctataggtgctggttgggaactggctataggtgccggtttctttgtcggcacctttgtctcaactttctttgtgccggttctaaaacccgcacctatactattaaaaaaataaaaaaaatggcacctacactgccgccggccttctccaccgccgccaccaccacctcgcccggcctccacgccggcacctagccatgcccgcctccgtgccggcggccaccacccaacgtagtgctggaggggggaggtcccccgggagagagggggctggccagatccagccctcctccaccaccgccaccccagggtcagctgccgcgcccgcgcccgcgctggccagccctctccaacgccctgccgcgctggaggaggagagagcccgccccggccggccttctccatcgccgtgccagccgcgcccgcgccggccggccttctccaccgccgcgccggccacacccgtgccggccagccctctccaccgccgcgccggccggccttctccaccgttgcaccgccctggaggaggagagaagagggagggcgtccgggccagaaggccgccgccgctactccgtcgccgctgccgcgcaaagggagagtggcgagagagagaggggggttccaattatgatccgtcacagataaacataaccaacgatgagttaaaataactacccgtcacatatgaatgttacatacgacggattttggttacagtccatcaaggttaactcttaccattggtgggtcttttaatccagagttatcagtgatcacttatctgtgatgaggacctaacgcatcgcaggtaagggtatgagtccgtcacatatgacctgatcgtatagtgtgaggtcatcctctagtgtactgcacaggccggttccctcgtgggctgcttgtgaagtaaaacaatcgtgttaagcatagttttttggtagtgtgtttcatatttatttttcacgcgttgaaataggacaaaaagttgtttctcacattaattttcacataaattgtatttcactgtgattttgatccatatagtggttttcactaacatgaactcattgtgggcctgatcgattgagtgacctgtacaccggtaaaaaagggttaattggatccatgccactacaaatatgtgaaattagaaaaatgccactactattcacgatattatagttgggtgtcactgcaattttagaaaattagatccatgcaactccgtcgcgtttttccatccactctctgttaacaccgtctctccgcggtgccgcttcgcattttcctgtgtatggacgccgccgccgctccactcgatggaggtcaacctcgccgtcgacgacaccatcgcggagatcgaaggcggttgcggccggccggggcccggggtctggacgcagccatcgccatgtgggacgggaagacggggccgatggcggcggcggcgccgctgaccacgcgaagctctagaggtcatcgtcgctgccgatggcgccgccgagcagcctcgtggcggcgacggagtagtaggggaggccgtcctgttcgaatgaatcaatctccctgaccccgtcatgtcgcgcgggctcacgcccttcttgccgaatgccgcgacgatgttgctgttcaccgcagtgttgctcgccgtcatcgagttgcgccggcccggcgacacctcccagctgctcccgcgcaacaggacagagcacattagttacttgcgtgtgcagtgcagagcatcatggccatggagatgcatgtacacttagcgccatggccatgcaggtttatgcatgtatatatggaccggcgtgagcagcgagagcgaggatgtcaggaaggagaaaggagacaacgctggggcaagatgagcctgatagtcgccgccgtgagcgtgagagggccgcgacgctggtgactacaacgcccgtagctggagctcctcgtcatcttcgtcggttcatccgcctcctcgcgtcattgctgcagtgctggaagaggtcgatcggcgggcgaggtgcggcattcggctgccgcaccatgagggcgtcggacagtctggcgacagccgcgcgcgctgtcaaattggcttgcggccgtggccgtgacgaggcggccgcgcgggctagacggcgccgtggagtacgggctcaccgccgtggccgccgagcacggtgtcgattggccggaggtacctcgacgccggcctgctaccgctgccgccgccgccggcggcatgcggcgaggtgagatcgtgctcctcgtcctccacccaaggcgcatcgtcgccgcaccatgacctcccggccggcgtgcacgagccctcagggacggccagtgggcgcccgtgggtggcgtcgacggtgtagacgcagtcgctggcgctgcagtcgacgtcgtctgggaagtactcatcatcacaaaagtcgaggttgccggcgtcggagtaggcgcccgtggaacacaggaaggcaaagccaggagtgacgcagagagacggcgtcaacgtggagggatggaaaacgcgacggagtggcttggatctaatttactaaaattgtagtggcacccaaccgatatcgtgaatagtagtggtatttttctaatttggcatatttgtagtggcatggatccaattaacccgtaaaaatatgcacgacgctgtgtgtgtatttttcatttctaataaagccagggtggtacttatctcgatataaatatttggctgaaaaatatcgctgttttatattctaggattaaaaataaactttgatcaaaatttaacttgtaaaaaacagcgtactatataatgctaaattttctccgagagtaggcctcactacttagaaaaaagatttttacaagcggccaagatcattcttactatacggacggctgttccacctgtagggcctatgaaaattgacgattttcgcagacggtccgcctgggaagattattttcctaggtggattgtaccatgatgcgccacctgggaaaaaaagggagagcacacctgtgataagaaggagccgccaccttgggaaatatgcgccaacttttgatttttcccgccaaatttttaataatatttttttatcaataatgttgcaattaattaattaactaatgcatacacaatattaggaactaacaaacatttaataccgacaaaaatacatatattgcattagtgaaaagtatcgtgaatatgttacaacattttttacattgtcactgtggttttcactaacatgaactcattgtgggcctgatcgattgagtgacctctctatatatatatactcctagggaaatggttctatactcctagggagtacgtactcctgctctcatccaccgttcatcaaaagcagtaccgatcctggatgttagcggatgctattgttgaaacccgttttgattttcggtaaaaacaattcccgtaatactttaattatcccatgtttatcggatcatgaaaactgaccgcatatatcaaatgagtcccagccattcgtctttcaccggcgcgacgacgacggcaaaatctaggtgggcatctccatcgtcggtggctggtttgctgatcgccaccacgagcggcgtacccctcgtcgactctccacgacgtgcaggttcgtttgtttttaacgcgtttgttttcattcggaatttcggatgatcacccgatcgcttgttctgattccgtgccgtctcaggatcatggtcggggcaacgagacatcaggcgctggtgacatcctggcactgcttgtagcagaggcaacgggagttcaccccgatcgcagatcagagcagcccatccaagcggtggagaaattataagtagtgagggcaactccccacaattgtctcgatgatggtaagaacaagactttccagtccgatatttcatttcatattcatcaatggcggcgacgacaacacggcatcgatcgatttgcgaagcctatgcatcacggcatcatggtggcggcgacggcaccgccgcagcaatcgaaggagcagagaggcggctgcaccacagtgcgccgctacgactcctcgctaccgatgtggaagaagaatgatgaagctcctaattaactagttctttgctccatacagatgcatgacaaatacaccattgatggtggccaacaccgggcagtattcgcatagttgcatcgattagctgatgtagatgcagaaaatgtggatttggcagtatgaaaattctgtccaaagcagcttgtgcaggtcaagaattgggtgtactgtacattcatttttcttctttttcagaatggctaaatatgtatgaatccatatactgcctgcattattgcaagttctcttgtgatcagactatgcttcaatttaatctaaatcgaggaaagaactttctattctttaaaatttcatgttcacacctgaaatcagaaaatataatttgtggaagaaattaaatagtatatcagtacactcattgaaagaagagtagtacaaacttgtttagaaaagaactcgggatatactcgttccaagaaattaaatctagtatatactcagttccaggaaaaaaaaagtaagtatatcagtactctttgaaataacagtagtatatactgatactcacctaaaaaaatatactgatactaacataaaaaaaaggtactacttacttaaaaaggtatatactgctctactaatttaaaaagtacataccgttactaattgtagaaaaggtatataccgcttctaacctaaaaaggtatatactgctctactaattcaaaacagtatataccattactaacttaaaaaagtatatacttaacttaaaaaagtacatactgtactacatatatacatactggatattacaataaaaaggcatatactccagcaaacaaaaatctagtacatgctagatcataaaaaaaacaatatatactagatcctgaaaaagaaaaggtatatatatactccttcaaccttggttctggtacgtacataccgaaatgcatggatgaattattgactagatacggatgcacatcagctgatttatgtgccttcgttgcccatgcatgcgggaaaaaatattttgatttttgtttttcgaactagctcatcagttagctattggataatccactagggggagggagtacctgcacctgggtgtacagaagagtcatcatatatatatatatatatatatatatatatatatatatatatatatatatatatatatatagtaaatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgcccgggcaccatggtgccccatatgagtgtcctatatatatatatatatatatatatatatatatatatatatatatatatatatatatataaggaaggtgacaataggcatcgatccacagagagtaaattaacatgagatatgcatgcacatattaattattgatcagataggtagctgcaggccagcacgacacactcgatttgcatatgttctcgtgcagttgacggcactcctgatccaaagcactgtaagttcagacttcagagtatctatcgctagctaccagctccatcgtttctttttaaatatctgtggttcagctagctagaaagaaattaagatcgaagcccaagtaccgtatcgaatctgatataaggggggaaatcagtgatgcaggcgctgcagtcatttcagcgtgtctggtggcatatttgtaggtgtataactgaggtgcacatagtagttgcaagtttcttgcctggccaactatggtaattctccatggcatatctatggaaataagtttaaatgtgttcaaaacaacatgataagtatgatccatatccatgataagcttgtcaagcaaggcaaagtatttggcatatataaaaagataaatagatccatttgagtacaaacaaggtattctaattattccttcattagaattacatgtgcaaattttgtaaaacaacatgtttgccgaaagcttgagtttcaatatattcaaagggagggagggtacttgccttgattatgatccttaatcgggttaactatttactcaacctccttattgatgacatccactagtacagaaaccccctataggtgtcggttgagaaccggcaataggtgccagtttctctgccggcaccaattggttggcaccaatgacactaggttattggtgtcggttatagaactggtacctttgtgctctccccgaatttcttttaaaaaaggaaaccacctccaagccgagccaatgctttctatgtctcacatatcacagaacgtttttgatcctgaagatttaggccccgttcaaacattcgcaaccgaaacagcgtgtcagcttgagatgcttttcgctccatcttatttcaatatgatggagcatctgattgtccacatcgtccctcagattatcgaaattggtcccctatacgtacatcagatgtgggcgtctgagaggtacatgtcagttctgaaagggtatgtcagtaacccaggtcatcagaaggaattga

SEQ ID NO: 12176 - DNA, 634 bp, Oryza sativa
tgggcatctccattgtcggtggctggtttgctgatcgccaccacgagcggcgtaccctttgtagactctccaggacgtgcaggttcgtttgtttttaacgcgtttgttttcattcggaatttcggatgatcacccgatcgcttgttctgattccgtgccgtctcaggatcatggtcggggcaacgagacatcaggcgatggtgacatcctggcactgcttgtagcagaggcaacgggagttcaccccgatcgcagatcagagcagcccatccaagcggtggagaaattataagtagtgagggcaactccccacaattgtctcgatgatggtaagaacaagactttccagtccgatatttcatttcatattcatcaatggcggcgacgacaacacggcatcgatcgatttgcgaagcttatgcatcacggcatcatggtggcggcgacggcaccgccgcagcaatcgaaggagcagagaggcggctgcaccacagtgcgccgctacgactcctcgctaccgatgtggaagaagaatgatgaagctcctaattaactagttctttgctccatacagatgcatgacaaatacaccattgatggtggccaacaccgggcagtattcgcatagttgcat

SEQ ID NO: 12177 - DNA, 7355 bp, Oryza sativa
atctatttttaatattatgaacactagacatgtacatatgctatgtaatatatatatatatatatcgatgtttctaattgtgcttgtataatttatatgtaactttacgattcaaaaatacacaaaaaataatgagtacgtacattttcccaaacggttagcaattgctagggtgactgcacgaatctattatcccgtgcggtcggcctagcacatgctagccgactaggataatagattatcctgtacggtcgacataactgaactgcacgggataatctactatcctgtacggtccacttaacataacgcatgggataatctattatcccaagaggtcctcttaactcgatcgcacgggataatcgattatcccgtgcagtccacgtaacccggccgcacgggataatagagtatcctgtgcggttgggctgcccgcacgcgataatgttgatttttgcaaacacctaggtgcagatggcgctacctccgcatggaaaaatcggttttgactacatggaaaaatcgaatctgtagtagtgtgacaacactctatttgctgcccgctttagaatctccgggtgcataatcggcagtgaaactgctactagcacctaatgttacagtactacaagaaaaatgttttgtaagagacatttttctagtataatagaggcacttttcaaatgcctttacaacaatatagaggcattttaaaacatgtctaataataagtgtcttatggtgaattctctctataaacgaagagagattttataaaatgtctataagattgtagaggcattttctagagacattaaattgtaccacaaccatataaaaccagtccaaaaaagagaatataataatatccttgcttttgtcaagccttgatctcttgggtaaatcattttaatcttcaatgcactaaccaactcacctccatgtcattacttgtatgtttgtttctttagttacacattatcattctaaaaagtatctctacatagtttaaaatgtctcaacaaaatgcctttacatattaaacgcattttatagtgccgaaagaatgcctctataagataagatctaacaaactgagctaaaattgtctctagagtaaaagttttctagataatttttgaagtgtctctacactataaaacttatgatcttagaagcaatttgcaaaactcctctacaaaagtgcctctatacgaggtttttgttgtagtgttaataccacttaagctgtgttcgtacatgtgagtttccatgcgcacgtttcccaaactactaaaaggtgtatatttttgaaaaaaaaaatcttgaaaagttgcttaaaatcatagtttttaaaaaatccattttagctgatacttagctaaacatgtgcaaatgagtcgctccgttaaatgtgcgtgggggaaaagttccctaagtgagctccctgaacgcacatatgataatttgctttccacaaacattaatacacattggcatatgtgaaatcaaagtgtgttttgattattatttcatgataaacaattggcacgagagataattgatactgatatttagagatatatggtgaaatggttttggtgccagtcacaccgggtgtcacgcccggaatttctatccaaaattccaaacgcttacatgtgtgtgaaccctcgtccaggaatcagccgaggcacacaataacaaattgataatagagtacaattattactctaattaataagcgtataaaatgtcattacagaggtagatagttcctctcaaacaataaagatctaagcagcggaaaataaaataaacggcgcagacggctccactccacaggcagcttgaccaaggctactcctaatcctccactccatcagcctcattgtagaactcttcctctgatgaatgattgcaaggtgagtatatgacatactcagcaagccacgtagcaaatatgcaagtgcacaggataacaaaggatggcataatagggtttcatttgcaaaagcagcatttagcaaacatttcagaatttaacaaaacagttaattaatttaacaatattaatccaacgctatacaacataccctgttgtataggcccaaccattctgaacaaccatcccggctgcacagttctatctccaaaccaggaatgtaccattccaaaccaggagctaatcaaattattaccaattatagcatcatttactatggtgagaagtgtgaaactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaagagttgtgacaatacccctcgcataacacaatccactgcagcgcaccttcctggatcataatcacccccttataaacaaggcatggactccccagcgacccccgtgggcttatctccgccacttctcagtctggtgctccgcaatgaaccatgctatacaaaagataaagccgttgcccatgctggcttgtggttggcacggttaatgtttcacaaccgaaactcgtgaaccggtccttaattatcatgagcacgaccatcaaaaccatgtgctcacaacccaccattatcaggttttagttggcacattaattaattaaccaatcacaatcgaccatcatgaactatcattaagccatcatgaaataacagtgagtcattaattatcccaatagtgtgctaatgtttctaagcagggctaagcaattatatctagtatctagttgaaccaatataaataaagctcaactagtcaaattataataacccaaggtatcaaggaataaagtaatcaagaacaaaagggctataacaaagaataggttgattccacccaatgacattcgaaaataaatgcaatagttgaaaagaaacaatagctttaaataggatcaacatgctcaaaggattgtttgggatctgtgtgacttgccttgctggccttggaactcttcaaactcttctccggcgaaaacggactctccggaaacgacggaatctaagcagaaaagagcaaaatcaccaaaacagcacataaacaagcatgaacagtacatgtggatatttttaacatgtagatctcaattttagaaaaatttagagacttgaaccaactaaatcggagctaagatgaattagttatgaatttttaaagattaaaccggattaaaacacttaaatcggttaaaattgaattatgacgcaataatgaattatttttgaaaaggaaaagagggtttattgcgtcagcggctagggttttggtggaccgggcgcacgggcggcggttcacgcgaacggacggccgagatcgatccaatccaaaacggacggccgagatcgaacggtccacgaccggctcacggcggacgaccccgatgacgtcagcggtgacatcaccgacagcggtggcggctcggcggaacggacggctcgggcggcgcacgctcgccggcgaacggcggcgcgaggacgcaaacggagggcaccagcacgtagaggacgacgcggcgaacacaccggtgaccaaaacggcggcggaagaacaacggacgacgacggcgacgaggaggaaacggcggaaaccttcgggttgacgacggcgacgaagctccggcgatctccggcgacggcgaaggggcggacgaggacggcgacgacttggcgaccacgacgacggtcttcccgagcgacggcgacggctggagcgacggcggcgcacggctggagcggcggcggcgacggcaaagctagggcacacggcgctagggcttttccgacgacgagaggcgaaggcgaaagtggcgacgggtagaggagacaccgggggtccttttaaaggggctcggaggcggcggcgaaggcccacggcgacggcaacggcgaaggaaagctcgggaagaacaaatccgagacgaactcgaatccaactctttccaaagcgatttagccaaagattccaaaggagaaaaggtagaggagatcccggagaatgtttcccctctattgattcggccggagaaggaaaggaacggccggatttggaagggaaacggcggcggcgcgaaactagggtttcgggcggcggcggccgaaggtagacgacgactgacaggtgggccccacctgtcagcgacagcgagggcgcgcgcggctgcggcggactgggccggctgggccgaggagagagaagagagattttgggccgactttcagcccaaagccaaaagaggactttttaaaacttttttcaattaaaattatttcttaaatgcaattccatttattaaaaatactttcttagctcaaataaatcccagaaaaatctaggaattatagaattaagcaaagtatttaatgaaattttatctgggcccattttatattggaatttattaattaaaattagattttcttttcaagactttttaaaattatttctaaaaattccatttaaacaacaatttataaattttgaattttcagggtgtgacaaacctaccccccttaaacagaatctcgtcctcgagattcggaagaactggcgaacaattgcggatgagctgacttcaattcatcttctcgttctcaagttgattcttcttccgagtgattactccattggactttataaaaacggataactcgattcctggttcttctctcacttgtttccaagatacggattggtttctcaacataggtcagatcctcttggactcctatctgttcaagattagcttcttcggtaggtacccttaaacacttcttcaattgcgaaacatggaacacattatggactcctgccaaagattgaggtaactccaactgataagcgacttctcctcttctactgacaatcttatagggtcccacaaaacgcggtgccaattttcctttggtacgaaaacgatgaactcctcgaaaaggcgtgacacgaagatacacataatctccttcttcaaaactcaaatccctacggcgattgtcggcataactcttatgacgagattgagccactcgcaatctttcctgaatgattttcaccttttcttctgcttcccttaggatatccgtcccgaaaacctgacgttctcccgtttgatcccacaaaagcggagtgcgacacttccgaccatacagtgcttcgtaaggagccatctgtagactagcttgataactgttgttgtacgaaaattctgcatagggtagattcttatcccaacttccaccgaagtctaaagcacaagctctcaacatgtcttccaaaatctgatttaccctttcggtttgtccgtctgtctgcggatgataagcagtactaaaattcagcttagaacccatctcttcgtgaagtttcttccaaaaatttgaagtaaactgactgcctcgatcagacactatcttcttagggacgccatgcaaacacacaatccttgccatatacaattccgccaatcgacttccagaataggttgtctttaccggaatgaaatgagccactttggtaagtctgtcgactattacccaaatagagtcatggcctgatgacgttctaggtaaaccagtaataaaatccataccaatttcttcccatttccattcaggaatcttcaaaggctgcaacaaaccggcgggtttctgatgttccgccttgactcgctgacaaacatcacatactggtacgtactctgcgatttcacgcttcatacttgcccaccaaaatctttccttgagatcctggtacatcttagtactaccagggtgcatggagtataaagtatcatgagcttctttcagaattgcatctttcaaatctttgttatcggggacacagattctttcacccaaccatacagttccttgctcatcctccaagaaaccgatagcttttcctcttctcatattcttcttgatttcttgaatatcaggatcattaatttgggcttctctaacttgatcaattagagtgggcttcgcttctaaggctgcaacgaaacctctattgacaattcccaaatttaatctttcaaattccttgcataactccaatggcaactgtcgtccttctgtagcattgcaataacctttcctgctaagagcatctgctacaacattagcctttcctgggtgataatgaattcccatgtcataatccttaattaattccaaccatctccgttgtctcatgttcagatccggctgagtaaaaatatactttaaactcttgtgatcggtgtacatctccgtacgagtaccgaaaagataatgacgccaaatcttcaacgcatgaactactgcggctaactcaatatcatgagtagggtagttcttctcatgcggacgtaactgacgagatgcataggcaaccaccttgccatcttgcatcaaaacacaacctaacccaagtttggatgcatcgcaatacacttggaaacccttctttggatcaggtaaaatcaaaataggagctgatattaagcgacttttcaactcttgaaaactctgctcacattcttccgaccacttgtacttcacatctttctgaagcagtcgtgtcatgggcttagcaatcttggaaaaattctctataaacctccggtaatatcctgcgaggcctaggaaactgcgaatctctgaaactgtctttggttgtttccagttggttacggattccacattactaggatcaacggcaactcctccggctgagatgacgtgaccaaggaacttcacttcagacaaccaaaattcacacttgctaaacttagcatacagttgatgctctcgtagcttctccaatgcaaggcaaagatgttcttcatgctcttctttggttcgagagtagataagaatgtcatctataaagaccactacgaacttgtctaggtattccataaacaccttattcatcaagttcatgaagaaagcaggggcattggtaagtccaaaagacataacagtacattcgaacaacccatacctagtggtaaaagctgtcttaggtatatcttcctctttgattctcaactggtgatatcctgatcgaagatctatcttggagaaaacagtggcacctttaagctgatcaaacaaatcatcaattctgggcagcggatacttattcttgatagtcacatcatttagtgcacgataatccacacacattctctgggtatggtctttcttttccacaaaaataaccggagctccccatggtgatgaactcggtctgatgta

SEQ ID NO: 12178 - DNA, 7074 bp, Oryza sativa
cggatttgaaagggaacgccggcagcgcgaaactagggtttcgggcggcgcggccgaaaggtagacgacgactgacaggtgggccccacctgtcagcgacagcgagggcgcgcgcggttgcggcggactgggccggctggcccgaggagagagaagagagattttgggccgactttcggcccaaagccaaaagaggactttttaaaacctttttcaattaaaattatttcttaaatgcaattccatttattaaaaatactttcttagctcaaataaatcccagaaaaatctaggaattatagaattaagcaaagtatttaatgaaattttatctgggcccattttatattggaatttattaattaaaattagattttcttttcaagactttttaaaattatttctaaaaattccatttaaacaacaatttataaattttgaattttcaggtgtgacaccgggcaaatattgtgaacgctgatctgaacgcagccttagatgcatttttagcctaaacaaagcaaatgataatttgctttccacaaacataaatacacattggcatatgtgaaataaaagtgtgttttgattattatttcatgatgaacaattggcacgagagataattggttatgatatttagaaatatatggtgatgaagtggttttggggctgggcagactgggcaaatattgtgaacagatatctgacgatgaacaagtttttctgctggagtggaccggtcagacaggacccttgctaagcgagcgtagctcaactggttaggtttcttttagtggaaccaatccacccgagttcaaatcctagatttgatacgagtggttgcatttatgctaattattctttgtttctcaaaagaaaaaaaaattacaaaggcaccctgtaaacaaacctcaaaataatagtatgactaacctcaatattccgagtaaacaagagtaaagcaagtacattgcatctcaactattagttgatggagacgttggtcagttcaacatcatcttctctattaccacatgtatatatcaaacactaatttcttggtgcacaaaaaagtacactattttgctccgacataatgaaaataatttcctgttgcagtgtgggtgaactgcaatgggacatcaattgtgcagacatatatacacaatgcatgaaaatgtaaaataagtttcggttactgttgtaatgttactttaatcagaacatgtcatccaactttcaaaagaaaacatgatttctaaatgatttggatttttcccatccccaaggcttagtccgaaatagctgctcagaaaatccataactcatgtttatagatcacattagagactacctatatatgtatttttatatatgtatttgttgacaaattttcactactatgaaaaccgtttttgtaaacgggcaaaacgtatttccacagacgatggcatggaagaaaaggtctgcaaaaaacacaattttcgcatgtggacacttgagccggccgcatgcgaaaaggataaatcacgaaaaaaataaaaattccaaaaattgaaaaatatacccaccgccggtccgccgtcgtcctcctgtcctcatcctccagctatcgctgtcgttctcaagccgccgctgacgccggtggatctgggcagggagggcggcggccggcggatccaggcgggggagggtcgccgccggtagatcggggcgggggagggcagccgccggcagatctgggctggggagggccaccgccgtggccttcgcccagcgccgctgccggaatctgcgtcgcagggtggcatcgctaactcctggccgcccgcactgcagcggagcccactcccagcacttcctcatcggccgcgctgcccgccgctcctggccgtgaatgcagcggcggcgcccgctcccggtgccttcttgtcggcctcgccacccgtgatagaagtgagagaggagaggaagagaaaggccttcgttagttgctagacaaaaacttttcaccacgtcacgtcgaatatttggacacatgcatggagtattacatatagacaaaaaaaactaattacacagattacgtgtaaattgcgagacgaatcttttaagcctaattgcgcaatgatttgacattgcggtgctacagtaaacatttgctaatgatcgattaattaggcttcataaatttgtctcgcagtttacgagcagaatgtgtaatttgttttgttattagacaacgtttaatacttcaaacgtgtgtccatatatccgatgtgatacgcaaaaacttttcacccctgaacgaaacagggccaaagagagggagagaagagaatgaaagagagatagaggtgaaggaagagagggtggaaaatatcagaggggagagagaggagaggatgaaaggtgaaaaattttgaagcggtgaggaggaaaatttttttgctagcggacccttaaaagatctgcatgcaaaaataaattttcgtatgcggacctttaagaggcccgcacgcgataataggctcatttttatttgcagccccttaagaggctcgtctaagaaaatagatttttgcatgcgggtctattaagtagccgtatgtgaaaatggaggtcatttttgcagacgccgccaagggtcctcgtacagaaagtttgttgttgtagttgtgaatttctttcaaaaatttgacagatataaattatagtataattgtggtgtaattttattttaacttacatgcaattatatttgcacatgtaactacaatatatcatgtgcaaccggtaaatattttactcatggatatacccaatatataaatacacatgtactacaggtaaatgcagcatattaattaattgaacacggtgtgtgttataatattcatatagaccggcaactaatacttttattttacatcatgaagtgatgaaacacgcggatgggatttagaagtagatgggggtttcagaagtggggtaggatagacagattttagtattgtctataacaaacacacatagatttagtgatcaatggatatgatagtataacatatccagctaataattggctagatatttttattaacttggaagcatctagtaaatatcatgttagtataggtacatatatgtaaacatatcagtagcattagagcccactcgagcacaacagtagcgatccatgagaacatcaggattgggtatttgcaagctaatgcaggtttctgaccaacgtacaacttcttgtcatcaacaaactttataactggacgcggccgaatccttgaaatgtgccacgcactactagaaaaaatatttttcatggcggtactctatttgttttactggcggttatataagaaatctgcttgtgaaattgtaactaagagatggagagtttaggaccgccagtgaaaatgaattgtcgctagcgtttgcttaaagtccgcttgaaaaaatacctatgtttttacaagcgatctcttaaaagacagccagtcaaaatactgattttcgctggcggttactaggcagcatcgtccttaaaaaaaatccccgcacattaaaaaaaatcaccgtgcgcgtttcccttaaaaaaaattgccgcccacctccttatccatccactcgcttctcctcctcctcctttttttctggttcctctccatccaaatccatccactactctcctctcctcctcccaccccaccggcagcggcggctcacgtaggcagcggcggcggccccgacggcagcactcggcggcacggggcggcgggggagggggtggctcggctgcggcacggggtggcggtgctcggctgcagcggtgcaggggagggggtggctcagcagcggcgcggtgacaggcggccggcaaactgcgatggcccacgcctcctctccctccccccccccccccggtctcccaccggccttccttcgctgctggccgccacgacaacgggggaggctggatccaccgccgtgacgatgggggtggccagatccaccaccgcggcgacggggagaccggatcagccgccgcagtgaccgtggacgccgaatcagccgccgcgacaatgggggaggccggcggggagggcagcgacggtgacaggagggtgggtgcggatccggtggcggcgttgctcgggctgtccttcacaaccgtgaaggaggtggatccggcggcggctgccacaatgacaacgatgtctaccgcgccgaggacggcaaccacgataacgatggcaaggctattccaaccccctcccctctacggtttggaataccgtggtgcgggcttcggtaggcggcggccatggtgaggtgtcgcgacggcagccggcggtgcttccggctgtggcggccggcggcaccgattttgaaatttttttatacccaaaattgttttcactggcggtccattttatctagccgcttgcaaaaatggtatttttgctagcggttgtcttagcatatccacttgcgaaactcgattttggctggcgacgagccacccgccagcgaaaacacaatattctcactggactttactcatgtcgcaccataaaaatcttaaatatataaattgttgtttaattagaattattagaaatgaattttaaaagcctagaagagaagatctaattttaaataataaattccaatataaaattgggcttcataaaattttattaaatactttgcttgattctatagttcctagatttttctgggatttatttgagctaaggaagtatttttaataaatggaattgcacttcatgaataatttaaatgaaaaagttttaaaaatctctcttttggctttgggccgaaagtcggcccaaacctctctctctcctccccggcccaggtcagcccgcagccgagcgccgcccgcgcgcgcgcgtcccgctcgctgacaggtggggcccacctgtcagtcttcgtcttcctcgcgcagctgccacgcccgaaccctaaccgagccgcgccgccgtctcgttccaaattcgttcatccctttccttttccggtgaaattaatagaggggaaatgatccccgagatctcctctatcttttcacttttggaatcgtcggctaaatcgtttggaaatcggtggattcgatctcgaatcggattcctctctctctccgaaccctaacctttccatcaccgccgccggccgccgtgggccttcgccgcggccccctagcccctataaaaggacccccggtgtctcctctacccgccggcaccctcgccttcgtctctcgccgccggtagagctctagcgccgtgtagcctagcgccgccgttgccgcagttcgtccagccttgcgccgtcgccgctccggtcgtcgtcgtcgctcgggaaggccgccatcgtgatcgtcaagtcgtcgccgacctcgtccacccctccgtcgtctctgtaggtcgccgaagcaccgccgtcgtcgtcaagccgaaggacgccgccgcttcttcctcgacgccgtcgccgtccgttgatcttccgccgctactttggtcaccggtgagttcgccgtgtcgcccgcaacccgtaggtgccgtccgttcgcgccgccgcgccgtcgttcgccggcgagcatgcgccgtccgagccgtcgccggtgatgacgtcaccgctgacatcatcgacgccatccgccgtagaccggtcgtagaccgtttagatctcggccgtctgatttggatagatcgatcccggccgttcgtttccgtgagccgccgccgtgaaccctagccgctgacgcaataatctctttttccttttcaaaaataattcattattgcgtcataattcaattaaaatccatataaatgatttaatccgatttaatctttgaaaattcataactaatttatcttagctcggattttgttggttcaagtctctaaatttttctaaaattgagatctacatgttaaaaatatccacatgtactgttcatgcttgtttaagtgttgttttggtgattttgttcttttctctttagattccgacgttcccggagagtccgattttacaggggaagattttgaagagtttcaaggccagcaaggcaagtcacacagatcccaaacaaccctttgagcatgttgatcatgtttaaagctattgtttttattcaactactgcatttatttttgaatgtcattgggtggaaataacctattgttttgttatagccctttttgttcttgattaccctattctttgataccttgggttattataacttgactagttgagctttatacattggttcagctagatattagatataattgcacactagtgggataacttatgcttcactattatttaatgatggcttaatgatagctcatgatggttaatcatgattggttaagtaattaatttgccaactaaaacctgataatggtgggttgtgagcatatggttttgatggttgtgctcatgacaattaaggaccggttcacgattttcggttgtgaaacatttaccgtgccatccacaaaccagcgtgggcaacggctttactttctgtatagtatggttcatagtagagcaccagactgtgaagtggcggagataagcccaccggggtcgctggggagtccataccttgtttataagggggtgattatgatccgggaacggtgcactgctttgaattgtgttatgcaggaggtattgtcacaatctctattcgggtacttgttaagtatcgcgacgcatggttgacatgatgttgaggttgtgtcttgtgggtacagtggtacacctctggctagagtttaaactattcgaatagccgtacccgcggttatgggcgggtctaacaatgtctttcgtgattagtttcacacctctcaccgtaataaataatgttgtaattggtaataacttgtttagctcctggtttggaatggtatattcctggtttggagatagaactgtgcagccgggattggttgttcagaatggttgggcctatgcaacacgggtgtgttgtatagtgttgattta

SEQ ID NO: 12179 - DNA, 4084 bp, Oryza sativa
actttattttttttactggcggctatataagaaatttgcttgtgaaatcgtaactaagagatggggagtttagaaataaatattgcaacattaattaacagtacaaaagaatagagaaatagagttaatagttaagtccgttttacccgagttacggtgaagggtgaaatgattgtaaggtggctggcaactcccatcaacatttttgcagccagagagtttagcacaagcgtccattggggcacggtatcagcataagttgaagacttttcttgccgaggtggatgggcagcaggtcgtagcttccacatggaatgtttcctgctgcaggagtaagcctagcaccgcagtaggggcgtagctagctggtggtccatatggacacaggactaccctagattctagcctagagaccttaatccccactatcaaaataaatttctttggccacaaagtttgctaaagcatttcgtatttacctttgagatttatactcttaaattgatttgctcttattcagtctttacaattcatggatcatttgcaaaacgaactatacttactgatatatcatgcttcttaaacttgtagttaacctaatactctagagtgttatatatttgttattgcatttttgtcaagctttgagtttgagtttgtttatacgattagattagagctagctgtctttttttctgtcatggtgtttatgttacgatggtttattcgaattgggcggtctttaacaaattttgtaaatgcatattagatagtatggcgatattaaaattgtagtataataagttggcacaagcagggacaaattttgtaaatattgtagtataacttgtttttcatcattctttttctatctactagggacttggtcacacctatttttttttacttggtcacacctatttttttcctccctcacaggaaataggactacccaacaaaaaaattcctagctacaccacttagcaccagagcacacatgatcaaactcttcgcaccttccatatttcctatctagttttaagtgatgtttactcgaggatcaacaaactaaaccaaaatggattcaaaggctactgctaatttgttgctctcgtctatgcggatattgggagtgaggcgcgtatttataggcgcagccaagcatctcacgaccaagctacactgcatgatgcagtgattatttaactaattggatcattaataactatatatattgtgcgccatatatattgtttgtttgcattagctgtggtacgtagtagctgcccatgtggatcgagcatgtacggtgttctgtagactgcaagttccgatttctgaaatattttagctgcacatgaggtgaacgtactggtatattaaagccatatcttctgccttaccagcatgtagctagtatattactggcctgatatagttagatgtttgttaaaaattttgctgaaaaaataattcaatcactactgctaccacgtaatgggctactgctggcttatcactgccggtcgggcgtgagcaacaccgctggttcatttttaataaaaaagcaatcaattaatcgctactctctcgctctctccaaatatagctttgtagtcttaaattttggaatggacggagtactacacaatacacaataggcagagtaggtaacactacacaaatcattttcctaaacgccggccctgtttggttctaggagggccgtaactagcgccgcgtgaaaaaaactcgaggaccggcgccgggccggcgcccgcacgagaagatgcattatcctgtgcaggccatttaatccgactgcacgcgatgatgtcggtctatgtacactctagcccgaccatgccgcttttattccggcgttttctctcgtaaactttgaaaaattaaggggaaggttttcgacctcaaatctttgattttgatccatatataaggtgtaatgcttgatcttctccttcatttgcttctatttttgttagtttttatcggtgcaatgcgaagaaatttacagttttataaatggagagtgtaggcactttttgttttttatttattttttgagctaatatgtattgtttgtatcacatgtttttcaaagtattccgtagtccgattcctttttaggtttgcctccattaatttaatttgtcattggataaaggctaagaaaatttacaattttttggaaatggacagtttttattattgattacaaatgttgcatgcatgtttaaattctccgtagaactttaatttaatttttgtttagttccctctgtttatttcaaattttttcagtggaattcgacaaatatattaggtttgcaaatctagtaattctaagtaatatttaatttattaatttaattttattggaacccctagaccatgaatagcaatataatgtccgtttaagttgtatttttttcatatgttaaatatagtacaattcgactcatgaaatatgttcttttggtagatggaccagcaaaaagaattcatctggcgttcttgaagaaagcatccaattttgttgatcaggcaaatgcacatgctttgagggagaacaagagggacattttctgtccatgctttgattgcaggaacgaaaagatgatgcaagacccaaatgatatttgcacattgtagagcgtggatttatggattattacaagatatggacttttcacggggaagtcgcgggtcgtaacgaagaggctgatgatttttgctttgatgcggcaaaaaattttataatcgaagacatgtcacagggaacgatcccagtgaacgtgcagagatgtagcctagagggggggtgaataggctttcctgaaattttctcaacaattgcatcgggtcaattgacagggcccggaacctcctggtgatgaacaccggaacttccgggcagcatgagtagcccagaacttccggagttcttgagccaggaacttccgggcagcagagataaattaaactgagatgaaaaacaggtcctagcaagagaagtttaggcacataggggaacaagataaagatcgcagaatatcagcagattcacacaaagatcatgcacaagagagacaaagacgattttttcccgaagatcggatcacacgaatcctactctccgttgaggtgctccaaagagccgggtctcgattaaccccttggctcacttatgcaaagatcccagaagagatccacaaccttcaactcaacacttctaggtcattttctagaattgagtgaccaccaagatccaactcaaaatttcttctagaaaagaccacaagtgcaagttgctctgcctaggacaacctctgaaaactcagcacaagaatctttactcagttacctcgtttccttccggaggtgaggaaaatcttcacaaactttcccgggacatccacaagatctttggaagctcacgggaaacacctaaccgtctatgagaagatctccaagagtaataagcccaagtgacagctcacaaggtatccaaatgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaagcttctcttactgaaggggggagaaagatagagcaagaatgagtacaaccacagtactcagcaagccacaccggagatgcataattaatgcaagggagtacaaggggataataatataggggttgagttttgcagtaacagcctttaaaagtcacttaggtgcccaaagccattttataaagacgatcctagagctacacagtattattaaacaaggtcgttaacccttacgaacctgccttaacccaaagcctacgatgattcaaaccgaactgcaaccccaccctgggtccc

SEQ ID NO: 12180 - DNA, 20789 bp, Oryza sativa
gggaaccgggagagggaatcacgggggtgattttccccctctttaatgcgcgcggggacggcggatgcggcgaaatccgcggcgccgccggcgttagggcacgggcgagcgccggctcggcgcgagaagaaaaacgacaggtgggacccacccgtcagcgagggcggcgggcgggcccgcctgtcagcggcgcgcgcgcgcggaagaccgatggtccgcgggggaagagagagagagggagggactgggccgagccggcccaagaagggagggggggaaaaggacttcttttagggatttttctttttataaaaccttttcaactttgtttatttcttaataattattatttgtgctctgaaaattccactaaaatttgagggctccttttagaccaaggagaatttaacaaaaattctccgggccacatttgaatttttcttgtacgtattttagtgtttgccaatttcttttcgaattttaattaattctattattccttttagagaatgaattttaattttgggatgaatttatcaggacgtgacaaatccaccccccttacaagaatctcgtccccgagattcgaggaggctagcaagaagataggttgggcggtcttctcttcttgtctgacttcttccgctccgtcttctataacaaacttgcctaacaaacttcttcactctggactgcttggctcgatctcctgttgcagatggaatcttctcttcacctgacttggaccagggtgcaccttttggctgactcagactaggttgcggtagttcagtgatgcttccgttccagaacttctcatgattcatatcttcggagtcaacctcagacaagttaccacttcacgtcatgcgtcaacactagcttgtcattactaggatactatgtttgtcatcataagaatatcatgcttgtcattcacttctaacttgccatcaactgtctcatattagctttcctggtctccggtgctaggtacttcggctattcgatgcaagggtcaaccactctaactataagttatgcttcccaagagaaccaatttatcccacttgacatactttgacgtcttctccaatggctttattgctggatttgttattgtctaatcattaccctgtcaaatctgaggcttcgttgttagatgtgcttttaatctgacctctgtagattatcttcgaacatatcacttgattcataactgggaatagccctcacgaacaagcaactcggattcactttctttacattcagtttacttccccttattatcttcaggttgtcctcagttagcattcaacgtattcctttacacctttaaccttgatgtgttctttcccattggatcatctcccaagtcatggcattgcctggtaaccggtgcttgcacttttcactccgtgtagcatctgataccgagttgaagatttcactctttgccttcataaaaacacttttacctaggtcatcttgcttacttaatgacaaggtgactgctgcggggcaattacaatcaggggtcttccttgagcggtgcagagcatgtttctgtttatcaatcacctttcggcctacttctttcatgctggagaacatctttgccaatctcttttatcaatcatcttccggcttatctctaacaggtggtattctttgatgtggattgcggacgcttctggggacgatgaggtcctttggcttgctgcctttccgtgaaaccttgatgtggttcgtcaaagactagactgacgattgttgcctttgatccgaagagacacatctgaaactcttagtccaaacaaatgcctctttggttgatcacttgattttcttcgccatcaatcgctagactatttgattcctaacagattttgggtttacggaaatgagaccctaggtctccctaatcaacaacaaaatgtgcacaactcacagcacttgcactcttaacatggatccttcataagcttatcaaactcattcattatctcatgtttctctgttattacatgattgacggggaacaactataaaacaaaagtatttgaacactgatataagagtattatggttgcttctgactagcgctaggcttatcaggtactgtatttgctccagtgaccacttggcgattggcatgtctgcttccttaacaggtactacagtttgtaacagacaataactttcttacgctcgggttcttcatcttgaacttgatttctttggctgctgtgctggaacatccaaaggtacaatgccgatactggcctctgtcttgtcaactgatggctggggctgaaattgagcattgacaacttgtggtaatgcactcgctggagttggagctgttgcaacgcggtctataggactgcttcgggatgcatggatgacaattcgctgaggagcaagcttctgattgcaaggagttgcgtggactgacgtgctggcagctatgtttctcggtctggggcacttgtcggcgaaatgacccattccttgacaattgaagcaacagatatcttcccggactcggcattttcttttctatcatcaggttggttattaactcgaggttggaacatagttcctttgaaatgagaccctaggtctcctttgacagtaaacacataatcccatatcagcatcttccgaaagaatcctcttagaacttgtttttattacaaatttctcccattttacatgaatacaaggcactgtcttaaacaaaaagggaaggtgcttaacatcggtacattgtatcctcaacaggaatcatccataaacatagcaagctcactgttttatagtcatgaatatatttatttattacatgattgctgcaaactttctattacacaatgataagtagcgaactgaaaaccacaaacggggctgctcattttgattcaggagagatatagctggcattgtcctagtgactgcatccttgattggttctgtgatgatgtggtaggactgcgtattgctatcattcacaggagaaaaattccttctgattgctggttgaagtgggtaacggtcttctgcttggtatcaccctcctgatgttgatttcccttcgctcggcctggagtagttcggggagagaaacaacttcttccatcgacgacaattcattgctgaggctgtcggtgccgagaatggttggtgctgaagggtattattgctatgatttattgcagagtcaggtgcagcaggaggagcattggtgctgtggatgatatcgtcgatattgctgttggagctgactagctgacgagacaatcgtagggtcgttcgttggatttctgcggtcttggtcaacaacacactgagttggcatccctgggcacatggtttgtaccttcgcatagaaaacatgtgaccttgcgggtggacactcccctggtggatggtcttcttcacaatgagggcagagtgtgagacacacgccaccaatgtgtccaatttctccacaacgggggcatgcttttgattccatctcttcctcgccgagatgtgggggggactcatcttcataatccgaggagacttgatctgacccttcactatcagatactctgccaccatggcttaggaggtgctgggtcaactgtcgtgcacctcggaaggtatttcctcattgacgtctaagaatacttatccctgctgtagccattcggtgctggtaatagtcatcttacgtacttcttcttcaattcgcatcggcgcttttctcttctgattcttactcttcttgcctttggcgtgcttaatacgtgaccccacatggtacgaaaggctaagaggagagcaattcccaggattcaatggattctcttcattgggctctctgctttgcacactatgctggaagcttgtcttggtgtgaggaggctggtttagcgatgtcttgcctgctaaaccaaaagaaggggcttctttggcatatacccatggacaactcagggcataatgtccttgttctctacaatcgtgacaaaaggggacattctcttctggcattggaagctcattgacctgtgtggcttatgctcgatcaaacacatactgattttggtcttgacttccaaccaatggtagctgtgaactaagcggcatgcttggaatggaccaagggtgtgccctggttaactctcttgaggccagtggtggattgagttgaaaacttgagttacttgaggcatacccgctgacattctttcctttttctctgttaaacatctgttacagggattgaggtgagagaggaaacaagccaggaaagaatagaccagaactagagacaggaccttaaaggaactaactcttcttgctgatgtgttgtttgtttcacttattctgcaagttgattaagcaatcaacctagcatggttacatcacaacccaccgatgcaaaccacgcgctacacacacaagcaaggaacacacgactaacaacactaccctacagggtggcttaggttctgcgacgggttcccaagatcttcactccttcacagctggcttcacttcttccttcgcttcgctagcggatcctgcagtcttccggagcttcggcaaacaactgacgacatcttcttcttcgcaaagctgaccatctagtactagttgaaatttgaagaaggaagaaaagggaataaacactttgcaaatagcacaggggaaaggaggaaaaagggactttcccaaatagtttcatttttaaaaaatggccttaagttttatccacttggcttatcctacagtcgagaaggctctgataccagcttgtcgcgaccgggaaaattgccttttcccaaacgctagtgtattaatccccggcccaggaaaagccggggtacaccacacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaagcttctcttactgaaggggggagaaagatagagcaagaatgagtacaaccacagtactcagcaagccacaccggagatgcataattaatgcaagggagtacaaggggataataatataggggttgagttttgcagtaacagcctttaaaagtcacttagttgcccaaagccattttataaagacgatcctagagctacacagtattattaaacaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaatttgaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaatcctgcctacggccggaacccccgggacaggcaggcaggactgagccccaagcagcagggcaccaaccctctgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtacccgaggtacgactagcaaaacccaaccacgcacctcgagcccagcctaaaaccaatttggggattttgaatagaaggagcggtgtgaagccaattccacaataaccaaaccattccatagtgtccaggtgatatgaaaattcccaaagtctaaagttataaaattacctaatgttgcctaattaaattgcgaagcatctacctaaaattaaactagtggtgccatgagtagagtgtccactagttggggttttgtttactctagggtgaacaaggaaataataacaatagcaataataataaggtcataacaaaggtaaataggcatggctaaataaaacagtgataacgcgggaatttaaataaagcgataatgcattaatttaaattaaaaataattttgtaaactgggattcaatatgctcaaggatgatgtgacttgccttgctcgctttcccaaatgccggcttcaacttccacgaagagcggatcttccgaagctgcagcgtctacacgaccgacggaaaagaaaaggcttttacgctaataaactccacataacagcagaaacaaagcacaaaaatgggttcttgacttcttaaggaaaaattagagacttgaacggtccaattccgagttcaaatggccaagttatggccatttgaagtttatatgctctttaaatggatatttacgaatttcttcatttaaattttaattaaaaacccatttattgcgtcagccgagggagagggcgcgcggaccgggtccacgggagtggggcccacgcgtcagcctctcggtccacggtggaccgggtgcacgcggctggcggcggccggcgccgtgggtcccacgcgtcagccgcacccgcgggcgcgggcggctgacggccgggccccacctggcagccgcgggaggcggccgaaggcggcctcgccggctcgaccgacgggagacgcgcgcccgcgccccgatggtcaccgccggcgaccaccggcgcggcggagcggcgcccgagagagcggagaggagagggaagcgagagggacggtccacggctcaccccgggacaacgaggacggcggaaacgacggccggagcggaggaacgcggcggcgcggttcgggacgacgaaggcgacggagctccggcggtcggcgggcgaagcgaaggggcggacggggtcggcgacaacgcggcgaagccgatggaggtggcgccgagtcgggaggaagaccggagcgacgacggcggctaaccgaaggtcggcggcgacggcggagagagaggagaacgtcgcgagcacgaatccgaaggcgagagcgagcggcaagcggcggaaacggaagaacggagctcggggaacgattatatagcgccgagagggggagagcgcggccggagagggaggaaacgggcgcggagatctcggccgccattgattgcgccggcgaggattgcgggcgcgattcgaacgaatccgagggagagagagggaaaagagggggaaacgggagagggaatcacgggggtgattttccccctctttaatgcgcgcggggacggcgggatgcggcgaaatccgcggcggcggcggcgctagggcacgggcgagcggcggcgcggcgcgaggaggaagacgacaggtgggacccacccgtcagcgagggcggcgggcgggcccgcctgtcagcggcgcgcgcgcgcgggaggccgatgggccgcgggggaagagagagagagggagggactgggccgagccggcccaagaagggagggggggaaaaggacttcttttagggatttttctttttataaaaccttttcaactttgtttatttcttaataattattatttgtgctctgaaaattccactaaaatttgagggctccttttagaccaaggagaatttaacaaaaattctccgggccacatttgaatttttcttgtacgtattttagtgtttgccaatttcttttcgaattttaattaattctattattccttttagagaatgaattttaattttgggatgaatttatcaggacgtgacaccaaagtgctcaatcaaacctaatcttcaagccatctccaaaacactcctacactctcatctaatttcccaatctcacaagataggctctagatttgagtggaggaagcaaaggaagcttgggagtagctagaaaaccctagaacatgaaagaactgaagtggaatggaaaaagggtgacctggggatgaaatccatatatataaccgctaggtgacgtcatctagccgttactcacatgtttgaactggaaacctgccatgaggttccgggcaaaagtgccaggaacttccgggcagcacttaggaaaatttttgcaattaaacggcgcccggaagtttcggccagaacctccgggtagccctctctgtcctggggagaaaatcatttttcaaaaatgattccaaaaatcttttgactcatggatatgactaagagcactttgtataccatagaaccacacttgaaacccctcttaatagtacggtttttcctaaactcaatttcgaaagtgaaaaacctagtctaatcacctacggtgattttcgcacttaggaacattcgaattggggggtctccttgcattcttaaccatcacaacttgctttgggactaaactcctgtgaataaacttgataaacatgttagtcccctttaaccaccttgtcattaatcaccaaaacccactagggggtttaagtgcatcttcaatctcccctttttggtgattgatgacaacatggttaaagtacacaaaaaaataataggatttaaatttagaatgatgagagaagtgtgaagctccccctaaagatatgcatataatgaacttgaaatgaatacattatgcataagatgaaggaaagctcaaaagaaacttcacactatcctcatcaaataagagatgtagataaaagtgcttgaatgatgagtgatgcaaaaagaaagactagatgacaagccaatcactcaaaaagatgaaaagaacacaacatcacatcaaaatgcaacatccatatggtctaacttactgacataaacgaaaataaagcatctaatagtcattacatccaaccataatagaatacgattacatgtccatatagagagagataatagagaggaaatctgcctggccggaacctctggatcacaggacccggagcttccggccaaatgaccagacaatagtcaaggtagcaaaaggatttaaatgacccccttcaattcacaatttctccccctttggcatcaagacaccaaaaagcgagaaactatgagaggaagaggatcactcatcttcatctccatcagagggaacaatctcggtatcgccggaaagatgagactcatcggactgagcagcggtatcaccctcatcaacatcagtgggagcatcctcagcagctgcctcggtgtcaccctcatcaccatcatcatcattatcatcatcatcagaatgagaagattcttcattgaagtaggtggaaggaccttcaccagcaacgttgcgggctgcctcataagcctccaatggatcaacatagacctcatcctcagaatcatctgacacttctttgctagcctctcttctatcttccttctgacgcctttctatcttcttcactttcttggcagtcttagcacacatacagaagattgcctgaagtgccttcttgatgggagaagaactcgaggaacttggtgaggcactagaagaaagaccagctgaagtagaaggaacagatctaggtagcactggagaagaggaaggtggagcacgagggcgaaaaggattgtggcgcccatctttgatgtagaacaccctggtgactgtctcaatcatcttcataatgaaaggagcatagatgcaaccccgcttaggctcaagaatggtgttggctatctcataccaaatcaacttcatcacactgaagggaggctgatggtagcgtatgcgactgagaagatgagcatgcttggatgacaaagcagtagcatctccaacctttggaagcaaggaccaacgaaagatggaatacaacaccttatagttgggatgcaaaccatgagtagatcccatgcaagtcctaggagcatcctttgcatacatgaacatggtcttgatcatggggaggggtgcttcactatgaatgttgggcctattgagatcctcttcatctaaccccagcatctcagcaaactgtgccatggaaatcttgtgcctaacaccctcagtcaaccacttcacatatggggttcccttccttgtagtaccaaagaatgctgttgcatagaactgtgcaatgacctcctcattccaatcatactccaaggcaagaatatctccaagattcttgttgtgtgtcgcgaccgagaaaattgccttttcccaaacgctagtgtattaatccccgtcccaggaaaagccggggtacaccacacaaacatgatataaaagacacatctttattatatcgataatatttacattattacaaaggcacttcaggcctgacaatcaaaaataaacagcagcggactagcgggcctacggctccatcttcatggcgctcaactagggtataagccaggactccacctaagacttcttctccaaagcttctcttactgaaggggggaaaagattgagcaagaatgagtacaaccacagtactcagcaagccacaccggagatgcataattaatgcaagggagtacaggggataataatataggggttaagttttgcagtaaacagcatttaaaagtcacttagttgcccaaagccattttataaagacgatcctagagctacacagtattattaatcaaggccgtgaacccacacgaacctgccttcacccaaggcttacgatgattcagaccgaactagcaacccgaccctgggtcccagctcgtcccaagccaacccaggccaaccattccacattttagttattaagcaggttttaagaatttaaaacactaacttgggtacattgctaggcttgcccataaccgagggcgcggctattcgaataggttttagtctgatcagatgtgtacatctttacccacaagagacgtcttcctcacgtgcaaccacgtgccacataccaccacggcatatggacggaagacatgacatagtttccaacccatcctagccatagacaagagtaccaacccaacccacctacggccggaacccccggacaggcaggcagaattgagcccctagcagcaggacaccagccctgtgccatgacatctcgactaccgggccgcagcccgtgtagccttcatttgtcctagagatgtccatcaacccccgacttcgtccatctccatccgtgtacttttgtttataaccagactgagccacaaactaagccttacccactagacatgtggaagtacggtagtgctttgcaacagaggcccgaagaccggtccttatgtggccgaggtgctactaacaaaaccatgcaccccgagcccagcctaaaaccattttgagggttttgaatagagggggaggtgtgcatccaattccacaataatccgaccattccaatatgtccaagtgatatgaatattcccaaagtctagagttataaaaaccacctaatgttgcctaattaatcagcgaagcacctacctaaattcatactagtggaaccatgaatagagtgcccactagttggggttttgtttattctagggtgaacaaggtaataatatcaataacaataataaggtcataacaaaggtaaataggcatggctaaataaaacagtgataacgcgggaatttaaataaagcgataatgcattaatttaaatcaaaataattttatagactgggattcaatatgctcaaggatgatgtgacttgccttgctcacagagaacgaccttctgaaccttcggtgacgaccgcgaaccacgcttcaagaacctccggaacgacagaagctacgcgaagcacacaagcaaagctacaagcctataaagaagcaataacaatacataaaaagaaagcacacggttctttaggttataacaaacattaggagacttgaacgggtcgattcagagttcgtatgaccaagatatgatcatccgaagtttaatgctgttacatggagatttacggattattgtaattaggctttgcaactataaaacatgtgtaagcgctagtctggaaaagacaggaaggctgcgctgttgacatgcagaccccacatgtcaacctaaaggaccgtggtagaccgggtacacagagacggtccacgggtcgacagaagcagatcccgtgtgtcaaccgaggcgagtggccgacaaacgaactccactagacaccacacgggctgcacacgtggaaaccacgcggctaccgagcggacacactaacacggtcaccacacgcacaagcgaacgactgccgacaccgatacacgggtaccggggccgacaaccgcacaacgggcatgggcggcaccgaaaggacgaggacggggcagcgagggagagggatccttaccaccacgcgacgaggcatgggaacgacaacgacgaacgggcgcggcggagacagctcggggacgatggaggcgaacggcgagggaacgacttcggcggtgatccttggacgaaggcgagacgcggccggcacaaggcttgacgacgcggagccgaggacgaagacgacgacggggatgctgcacacttgacgaaacgcgggcggtgaacgcgaacggcttgacggaaggacgaacgccacgacgatgaggacaacaagaggaggacgacgacgacgatgaccggggccggcgaggaggcgacgagggcagccggcagcagctgcacagatgcgaggacggcgtggaacacgccgcagcgatgccgacgacggaggtggcgccacgagacgacgagccgggcgaccgacgggacgtcgacgacgagaacgaacggaggcgacgatgatggaccgcggaggggtttggatggaggggaagcgatgccgaggacgaccttgccgctgcgatgccggagaagacggcgacgcggtcgaccggggaaattccggcgaggaggatggagaggccggcgcggcacgacggtggtctccggacgaatcagagggcaggccggggtggaggtcgacgcggcgacgccgagggaggagacggcgcggccggcccgcacctgagcggcgcggcaggggcggctggaggtggtacagtggcggcaacgccactggacgacggcgggaacgcgcctccggcggtcaccgcgcgaaacggagggcaggccgggggagaggaggcggctgcgacgccggggaaggcgacggcacggccggccggcgcacggtcgaggagggagaggcggctggaggcgcccggcgtgggggaaagagaagggcgacggcagggaggggtggtgaggccacgggagatcgcgggagggggctaaaacgagagaacggagtgagggggttccattttataggagaggagagggagccggccacggggaaggtcggaacggaggcgggaatggcggccggcggccatggaaagcggccgggaaagacgcgtccgttcccgacgattgggggcgccattcaagggggaaattggggggaattgaagaggaaggaatggggattaattccccccaatcaatttggaaagaagggcattgattcgcgtggatttaggggaggaacggcgctaggtttccggggagagagagacgaggccggctgggggaggaagacgggtccgacaggcgggacccgcctgccaggcgcggtcaacgcgcgtgggcgcgtgcgtgacaggcgcgtgcgcacgcgggaggagggcggctcgggcaggggcgcggcgtgggccgggcggccggcccaggaggagaggaggggaggggggcccgggggagagagggaggaggagggagtgggccggggaaggaggaggcccaagagaaggagggagagaaggagagggagagaaagagagggaggagagagggacttcggccgcgggccgagagggagaggggagaaaccttgggccacacttggcccaaagggaaggggagggttatttttaggtttttctttttaataaactctaataattatttttgttgcttaataattatttccggtgctctgaaaattcaagtaaaatttgagggctctttttagaccaaggagaatttaacaaaaattctccgggccacattcgaatttttcttgtacgtattttagtgtttgccaatttcttttcgaattttaattaattctattattccttttagggaatgatttttattttgggatgaatttatcaggacgtgacattgtggcacacttgcatcacttggttgaacacttcattgtttttcttcctcatgtaagcccaatcaatacacttcatctcaaccactggattctctctagccataatcactgagttataccaatccaattgagtgaaagtcctgaagcgaggatcctgtgactccttgtcacgcccggaatttctacccaaaatttcaaacgcttacatgtgtgttaaaccctcgtccaggaatcagccgaggcacacaataacaaatcgataatagagtacaaataaacagctatttaatattcgcaaataataaattattacagaggtggatagttcctctcaaagaataacattctacgcagcggaaaaaaaataaaagcaaactacggaacaactatggagactccactccacaggcaacttaacccggaccaagcctagtcctccagatcaccttcactgaagtactcctcctctgatgaatgaatattgcaagaatgagcatatgacatactcaacaagccacacagcaaatatgcaagtgcataggataacaaaggacggcataataaagctcatttgcataaacagcatttaataaatatttatgagaatagtaaaccagttgaattattaagcagtattaaataaacaccatacaacacttccgtgttgcatgggcccaacctcatctgaacaaccaaccccggttgtacaaatccaaactccataccaggaatataccattccaaaccaggagtcaaattaattatcacaagtaccattaatgaatagtgtgggattaatcacgaaaaacattgctcaactcacccataaccgcgggcacggctattcgaatagttttactctgattagaggtgtaccactgtacccacaagatacaatcccacaacatgtcaccatgcgcctcagcaccaccacggtacctcggaaaggaactgtgacaatacccctcacacaacacaactcaccacagtgcaccactcctggatcataatctccccctctaaaccagaggcaatggactccccagcgacccccacggacttctcgccgcttcacagtctggcacaccataacgaatcatgccatacaaaagataaagccgttgcccatgttggcttgtggttggcacggtaaatgtttcacaacagtagctcgtgaaccagtccttaattgtcatgagcacaaccatcaaaaccatatgctcacaacccacctttaatcaggttttagttattaattaattaacataacacgattaaccatcgtgagctaccattaaatatatccataattaataatgtgatatatataattcatcccttaatgagctgatatttctaagcatggctaatcaaatatacatatagcatctagttgaaccaatccaatatataaggtccaagctaatcaaattataacccataggaaaataaagttatcttcggccattaattaattgggaaaaggttcaccacccaatgacattcgaaaataatgcataagttgaaataaaacattagctttaaacgggttcaacatgctcaaagggttatttgggatctgtgtgacttgccttgagcttccacaaacacctccgaaccttcctcaactgaaacgctctcctcgggaacgtttgaaactagagcaaaaaaataaaatcaacaaaacagtacaaaaacaagcataaacagtacatgtggatatttttaacatgtagatctcaattttagaaaaaatttagcaacttgaaccactcgaatcggagctacgacgaattagttatgaatttccgaagttttaatcgatttgcatctaataaagaaaacttaaaaaaaggtttataacgtcatcacgtcatcgtcgccggccatggctcgggcggcacaaccaccggcgctaggaggctcggccgggctattagagggcatctacgcgtagaggacaacattgcgaactcaccggtaccaacgaacacgacggacgacgtcgaacggcgaccggcggcgaggctcgacggcggctcggctcggacagcggcggcgacggcgctacggcggccggcggcgatggctaaggggcggccgagcttcccctcttccatgcgcacccgacggcggtgagaggaggtggcggcgacggctaaaacgacggcgcggcgcggctggacgtcggccggcggcggcggcggcttggttggcgcggtggcggcgctacggggcacgagagagctcgggagatggggcaaacgaaagagggcgactagggggtgctatttatagccttatattggagagatcagactccaaccgcgagtaatcggaccgagaaaaactaggtttaggttttggggataaactcgaaaacgagtttgattcgggtaagatacgaagcgattagccccgatttttgggggatagatagaggacaacaaggggaccaaaacccctcaaacaatcggactcgatcgcgaccgagggcggcggaatcggcgggggatggcggcggctcgggcttgggctggctggccggaggttgaagacaaccccgacatgtgggccccacatgtcggcggctgtgaggaggagagggggccggcggctgcttgggccgcttgggccggcttggccttgcgcggggagagaagagttgggcccgaatcggcccaacgacttaggggaggatttttaagactttttcaataaaaataatttgtgaaatgatgtttcatttattaaaaatacttcccttgctcaaataattcccagaaaaatctagaaaatagataaacaagcaaagtatttaatgaaattttatctagctcaattttatgttgataattttccttgattattagagtttaacttgtaggcttttaaaataatttctaaaaatgatttaaaatacgcattattaatttagacgatttttagggcgtgacactcctcaggctgtgactctggatcaatcaaacgatctcgtctacacttggcaagttgatgaaggtagttggacttgggtcttccaatgtggtgcataggagtggtgtcaaaaccaagagtcttgtagagccgaacgggattctcacgagatcctacagggaaatcatgagatgcccttccagccccagaactgcgaccaccacctctcccgtgacctcttgtattaggggcatcacttccttgaccactatcaacatccctaatctgaacaggacggttgctggattgccttgtaaatctgggagaagtacgagtgccactgccactgccgccctcaaccactttctctttacccaaacgaccacgaggataccgaataggaggactctcatcaccggacacatcctgagaggctttctgtcttttctcacgagtcatagtacttactgcaacaggaatcaacaaattggagtgcagtagttaggcaaaatttgagagaaacaagaatggcaggctgaatggacagcgcccggaggttccgggtgcaagaacaccggaacttccggccggcaaaaatgaagaacagaggtttcaaaaatagccagtgcatgtgaacaaatcctatagatcagtgatcaacaaggtagcagaaacaagactatccaagtggttttctcccaaggttcacagatttagagatcgggataaaaacacaatgaaccgagagagggaatccaaaagttctaccttgagagaagaaactgcgaatcgatcacagaaagaacctcccagccaccaatgtggatgaatccacggagaagaaacgaatttgattggacgaaagtgaaaatcgccactaggagcactatagcggcggctagggttggcgtcggggagagagaagaaatgaggagagagaatggggcttctaactccccctgagtatatatactccccgataccccgaggttccggacaaggaggcccggaacttccggcctgacagataaagggcagtcaggaccaaaaacaaggaagagatgagaattcaacgcggggaaatagggaactatggacatgcagagacttatgacgtatatgaccagcctacaatcaacattacataaccatggtcaatatacaccacaagaaggggataaaagccaaattttcgcaataaaaggcacagcaaggaatttgcaaaaattttcacaaaaggggtttttggatatagggtgaatgtttgagctttattcctggtatcaagaccatcttctaccaagaagtgatctcaggatgtcacaccctgaaaatttaaaatatataaattgttgtttaattggaatttctagaatttattttaaaagtcttgaagagaagatctaattttaattaataaattccaatataaaatgggccaagataaaatttcattaaatactttgcttaattctataattcctagatttttctgggatttatttgagctaagaaagtatttttaataaatggaattgcatttaagaaataattttaattgaaaaaggttttaaaaagtcttcttttggctttgggccgaaagtcggcccaaaacctctcttctctctcctcggcccaagccggcccagtccgccgcccgcgcgcgcgccctcgctcgctgacaggtggggcccacctgtcagtcgtcgtctaccttcggccgccgccgcctgaaaccctagtttcgcgccgccgccgtttcctttccaaatccggccgttcctttccttctccggccgaattgatagaggggaaatgatcctcgtgatctcctctaccttttctcctttggaatcttcggctaaatcggtttggaaatcgagggattcgagttcgtctcagattcgtttttgccgaaccttccttcctcgtcgccggccgccgtgggccttcgccttcacctccgagcccctttaaaagcctccccgagctctcctctacccgccgccaccctcgccttcgcctctcgtcgtcggaatcgctctagcgccgcaagccctagcttcgctgtcgccgccgccgctccagctgtgcttcgccgccgttccagacgccgccgtcgctcgggaagaccgccgccgagccgccgccgccggggtgacgtcatcgctgacgccatcggggtcgtccgccgtgagccgccgtggacccgatcgatctcggccgtccatcttggatcggatagatctcggccgtccgttcgcgtgaaccgccgccgtgcgtccggtccaccgaaaccctagcccgctgacgcaataaatcctcttttccttttcaaaaataattcattattgcgtcataattcaattttaaccgatttaagtgttttaatccggtttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgccggagaagagtttgaagagttccaaggccagcaaggcaagtcacacagatcccaaacaatcctttgagcatgttgatcctacttaaagctattgcttcttttcaactattgcatttattttcgaatgtcattgggtggaattaacctattgtttgttatagcccttttgttcttgattactttattccttgataccttgggttataatttgactagttgagctttatttatattggttcaactagatattagatataattgcttagccctgcttagaaacattagctcactattgggataacttatgactcactattatttaatgatggcttaatgatagttcacgatggtcaatcgtgattagttaattaattaatgtgccaactaaaacctgataatggtgggttgtgagcacatggttttgatggtcgtgctcatgacaattaaggaccggttcacgagtttcgattgtgaaacattaatcgtgccaaccacaagccagcatgggcaacggctttatcttttgtatagcatggttcattgcggggcaccagactgagaagtggcggagataatgtcacaccccgaagttttcctcccaagccaaattgtaaattacaaatgaccccaagaaaatgcagaggaaatcaggataaaaccctaagaaaacaatgcaaataataatcggatttgacatgtggaatttttcttgaattctacatgtcgaaattcattaacaggatttttagtggaattttcagagctctagaaataattttaaccaattaaaaatcactaaagtgcaatttttaattccagggaaaatccttttcctttttctttttcttttccctccctttttcctcctttttcttttcggatgggccgccggcccattccccttg

SEQ ID NO: 12181 - DNA, 8346 bp, Oryza sativa
ggttatgggcggtcaaccagattcaccgtgattagtctcaccctagtgtaatctgttgaatttggatagtttaggtgaatggttgggcctgtcgcaaagtgggtaggcgttggacagcggatgttaaatactgttaattattacaactgttttcgcattcaattcctgtttataaatgccagtatttatgcaaatgaacctgcttagctatcccttgttaaatccctgcatcatacctctattccggtatgacttgctgagtacagtgggtagtactcagtcttgctctacttttccccccaacctcagagctcgagtatgtgtccgatggcaggttctccgaggagtaggcttcgtccgtgccgtcgaggatgcctgtggagtggtgttcccgctgcagttcaagtcaaggattagctccagttatcttttgttttccgctgcatttctgtaagacctttataatgtttgtaagacgtggatctgtatgtcaacattgtcgtttgtgtaccccggctggtcctggacgggggttttaatacacattctgcttggaattctattcgggaatttctgggcgtgacaagttggtatcagagccgaccttgaccgtaggacaagccaaatggaaagacctaagagccctctgaatccttttcattgcatatgttctttgcaattggattttgttccgggaaaatggggatctgttcttgtggttcaagggaaaaatcttggtcgctcgtttaaagtgagtttttcaaaacgagtcagtctagggttttagtaaaattattgggatttattcgtcagtcagttggggtttgaggggtgaaatgcattaggtcctagctcggtaacatgggttgcaaggtgtttatgctttgttcgttattattattatgtatctaatttcccattattttatcgttatgtgagtctgtcttatttattcgcgctcatgtaaaatgatctatgcataaaattttgctcttatttgattcctttatttgagtctttattgctttatttaaatttggatttgagcatgcattgatcctactcctttgtcttctctagatggccggtcacccacccaaccaccgcggagaaggcatgattgatttcgtggcagagttggcacgcatgaccctggtggtgggctaccccgacgcgccggagtacacgacgattccgccgctcagtggcgagcttcctcaccgtgtccgcttggaggtccatggttacgtggggacttgcctcgctaacatggcggtcgaggcatctggaggcacagcagatcacgcctgtcaggaggcagcctacttgatgatggccagactacgggagcgccacgactacatcttccacgacacggcgtaccgctaccacccccgtcgagcccatggtgatggcgtcagctccttccgtccgacagctggcgagaacgacaccaccttcggtcacatgtgtgctgtgatgaggggattggaccagatgcactcggacctgcacaaggcgaccaaggccttgaatgatgggaagctcatgaggatcgtcgctctgaaggacgagatagcgcgcctgaagaaggagaatgctcagttgaagggtcttccagcaccaggaggagtccggatccgcactacgccccgtaagaggacgactgcacccgtgcgcatccagcttgcgcccaggaacccacctccaccagcagctcccgcagcacctccagttccgcccgcagctccggcagttcccgcagttcctccagctccagctcccgcgttcactctctccttcgctccagcatcagccgccagaggtccagccagtggtaccggaggttggttgtccgctactcccagtggcagcggcgagactgatctgtcaggctccaggagtcgttcagagggaccaggtgacgagcaggaggacgctttcgactccaccggccgcaggagccgttccgagcattaggctcgttttcccattagtttatcgattgtctagtttctgcttgttagtttgtgtgtttaggttgcttgtttggggtcagtcgacggtcgatatcatgtgcctatgatatggctgtcttaataaggatttttgtttgctctttttaagtgttttaattcagatcagaacaattgcagttttaattcctatataataaagcttagttcttgagcatctgtttttcttcttctcccccgtctgcttttccctccagatggtctacaccaggactggcaaccgcacgacaggcgagggcagcaacggtgaagaacgcgctgatggtgtgcaccccaacagtgattctggcaatggtccgccaccacttcccgagaatccgacccttgcccaagttatggcacatcagactcagatgatggcagccatgatgcagcagatgcagcagcagcaccagcagatgcaccagaggatgatgcagcacgccgaacagcagcaccagcagtttggtccccctccccctcagtccaagttgccggagtttctacgtgtcaggccacccaccttctccagcaccaccaacactatggaggcaaatgactggctccatgcgatagagaagaagctgaatctcctgcagtgcaatgatcaggagaaggtcgctttcgccacacaccagcttcagggtcctgcgtcagcttggtgggacaaccacatggccacccgcccaccgggtactgaagtcacatgggcagagttctgccgtagcttcaggaaggcacaggtgccagacggggtcgtggcacaaaagaagagggaattccgggcgctccatcagggcagcaggactgtgacagagtacctccatgagttcaatcgcctcgcgcgatatgcaccagaggatgtccgcaccgacgccgagaagcaggagaagttcatggcgggtctggatgacgagctgaccaaccaactgatatctggggactacgccgactttgagaggctggttgacaaggcaatccgccaggaggatcaacgcaacaagatggataggaagaggaaggccgcgcagttcagggcacatcagggaagtcaccagaggccgcgcttcactcccgggcagcagggtggacctaccaccatgattgttcgtcaacaccgcccattcaaccccagcaacttccaccagggctccagtggcagccagaatcaccatggaagtcagcccaaccgcggtacagctccacgcccaccgatggcaccggcacagtcaggccagcccgcacaagccaagaaggagacgggagcaaaaccagggtcctgcttcaactgtggcgagcttggccacttcgctgacaaatgcccgaagcccaggcgtgccggaccaaggtttatccaggctcgtgtcaaccacgcatctgcggaggaggcacaagcagcaccagaggtcgtactgggtacgtttcctgttaactcaatccctgcaacagtactttttgattctggtgcaacgcattctttcatctccaagaaatttgtcgggatgcatgggttaataagagaggaacttagcacaccgatgcgggttcataccccagggaatagctccacttcggttcaattcagcccttctataacaatagaaattcaaaggtcacccggttttgccgagttcagtggagtcatcattcggaagaggaagcgacctgggaaagggaagatgagttgaaagccgcccatccgtacctcttcaccagctcctccgaatctcggggccgagattccgtttaaggggggtaggtttgtcacaccccgaagttttcctcccaagccaaattgtaaattacaaatgaccccaagaaaatgcagaggaaatcaggataaaaccctaagaaaacaatgcaaataataatcggatttgacatgtggaatttttcttgaattctacatgtcgaaattcattaacaggatttttagtggaattttcagagctctagaaataattttaaccaattaaaaatcactaaagtgcaatttttaattccagggaaaatccttttcctttttctttttcttttccctccctttttcctcctttttcttttcggatgggccgccggcccattcccctccttcctccccctcctccttgctgggccggccgcaggccgagggcccagcctggcagccgccgcccgcctcctctctcggggtcgccgacaggtggggcccacctgtcgggtccttcccccacctcccgccgatcccgccgcgccgccgcgccaaaaccgccgccgcgcccacgccttcgtctctcccgggccacgtcggccacgcccgcgcgtgcgccgcgtctcccgcgccctttcccctctccctcccgttcgcgcccgcgcccgagatggccgggattcgaaaaccgaatcccgcctctctctcctccccactcccccacgtcggccgtcgaatcccgccgctcccggccacgtccggctccctctccccctttttaagcatcgccgtcctcctctctcgctttttccccatttcgccgatctctcccgagctccccatcgcctccgcgccgtgcaaccacccgccgccgccgtttttgctactccgtccgccgctagccgccgctaggctcgtcgccgtctcgcgccgtcgccgccgttagcttcgcggggtcgagatctacctcggccgccccttccccgtcgaggttcgccgccggagacccatccccgtcgtgtgccggcaagtggcaccatggccgccgccttcggccggcgctctcgccctcccacgctctttcctctctctctaatccctctccttttgttcgttaggaggttccggagctcgtcccgccgtcgtcgtcgtcctccgtcggccgccgtcgtcgaccgttgtcggtgaggcttccccctcctctttctccttttccccgtaccgggtagccgcgtgcgcgccgcttagccgcgtagccgccgctcctcctctagccgccgctccccgccgccggtcggtcgccttcggtcgccgccttgcgccgctgccgcatgcgcgccgccgccgtgtgagcgccgcgccgccggcgccatggttgccgccgtctcgcgccgcgcccgcgcgccccggccgcgaggtcccgccgccgtccgatctacccttgggtagatcggggccgtcggttcggccgccacgtggcgccgccgcccctcctttcccccgtgccgctgacccgtgggcccgcgcgccgccaccccctttctctctctcccggtcgctgaccggtgggccccgcctgtcggcgccgcgccccctcgctgacgtcagccctggttaatattgcgcaataaattatttaaggatttcttttatagtaataaacacagtgaatcttctaaaattcataactaattcatccgagctccgtttaatcccattcaagtctcagtaaatcaagaaaaatgtgtagaatccattaaaaatggttttgttctctgtttcagtagtcttatagcctgtttgcaatgtttgcttggtatgtcgctagattccgatccctccgacgctccggtgtacttcgagatagtcgccgaggtccctccagcagcggagcaaggcaagtcatgcttgtcacttgaacatgttgatcctatattgcaaatgctctattgttttctttcaaatattgcattgttttataatatcactatgggatggatacctattgttacagccatgcttttggatatcatgctcctttgttagcttgggttataacatgattagactttggactaggaattgcttagccatgcttagttcaactagcacacattggggatctcatttaaaacctagactataggtttatatgataatgttggtttaataccaccgctctggtgttggttaaataaaatgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaatttggatagtttaggtggatggttgggcctgtcgcaacgtgggttagcgttggacagcggatgtttaatactgcttaattattacaactgttttcgcattcaattcctgtttataaatgccagtatttatgcaaatgaacctgcttagctatcccttgttaaatccctgcatcatacctctattccggtatgacttgctgagtacagtgggtagtactcagtcttgctctacttttccccccaacctcagagctcgagtatgtgtccgatggcgggttctccgaggagtaggcttcgtccgtgccgtcgaggatgcctgtggagtggtgttcccgctgcagttcaagtcaaggattagctccagttatcttttgttttccgctgcatttctgtaagacctttataatgtttgtaagacgtggatctgtatgtcaacattgtcgtttgtgtaccctggctggtcctggacgggggttttaatacacattctgcttggaattctattcgggaatttctgggcgtgacagataagcccacgggggtcgctggggagtccatgccttgtttataagggggtgattatgatccaggaaggtgcgctgcagtggattgtgttatgcgaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtcgaacaatgtctttcgtgattagtctcacacctctcatcataataaaagatgcttaaactagtaataatttgattagctcctggtttggaatggtatattcctggtttggagatagaactgtgcagccggggtggttgttcagaatggttgggcctatacaacagggtatgttgtatagcgttggattaatattgcttaattaatacctaactgttttattaaattctgaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagtcgtctgcgccgtttatttattttccgctgcttagatctttattgattgagaggaactatctacctctgtaatgacattttattcgcttattaattagagtaataattgtactctattatcaatttgttattgtgtgcctcggctgattcctggacgagggtttacatacatgtaagcgtttagaattttggatagaaattccgggcgtgacaactcactggcagcacctctggccagttggccgccagcgaaaactattttttgtagtagtcacaacagttcagattggttcactagctcaggatagctcatctgtaataggcgggaagcattatctgtgtcggcgaggggtactgtcacgaaccaaaggttattaatgtgaaaagtcatatgtgtcgggtcagccaccatcacggacgaccgtcatccttatcgggcctaaataaaagacccaaactcatctatgacgggtcatagttaagacccgtcacggataagagttatccgtgatgtttcaagctcctacttccaagaactgacttttttgtccccaagagtgatgtctggcttgccgccgattcgccgggtcgctgccattgacttgtctacggctatgttccgagctttgagtgacaacatcaggtgttggcgtcagaacccgacatcgtcaaaagcctcgtgcgtcgtcttaccggtggtaagccctttttctcatttatactttgt

SEQ ID NO: 12182 - DNA, 2140 bp, Oryza sativa
cggttctcacatgggtaaggcatatgtctcctttggtctcatgatctctcaaaaagtggtagcgaatatctatttgtttggttcgtgactgttgaacgggattattggctattttgatggcactctcattgtcacataggagtgggatcttggtgaagttgtagccaaagtcttttagagtttgtttcatccaaaggagttgggcacaacaagaaccggcggcgacatattcggcttcggcggtggataatgcaatggaattttgcttcttggaggaccaagaaacaaggaactgcccaagaaattggcaagtcccagttgtgctttttctatcaaccttacacccggcataatccgaatcggaatagcccaaaagctcaaagtcacaacccttaggatatcacaagccaaggttaggagtatgaactaaatatcttagaattctcttgacggcaatcaaatggcactctttaggctccgcttgaaagcgagcacacatgcaaacactaagcatgatatcgggacgagatgcacataagtaaagcaaggatcctatcatggagcgatataccttttggtccacacatttaccattatcgtcgaggtctaggtggccattggtaggcatgggtgtcttgataggtttggcatcctccatcccaaacttcttgagtatgtctttcacgtacttggtttgagagatgaaggtgccctcttgtgcttgtttcacttgtagcccgaggaagaaggtcaactcgcccatcatagacatcttgaaacttttagtcatgatactactaaattcttcacaaaaagaggcattagtagaaccaaatattatgtcatcgataaaaatttggcaattgaataaatcattttcaagctttttagtgaagagagtagtgtccgccttcctaatttcaaaaccatttttcaaaaggaaatctcggagacattcataccaagctctaggggcttgtttgagcccgtaaagacgtcttgtggagctgtacacatggtttggcaactttggatcctcgaaccccggtggttgctccacatagaccaattctgagatgggtccattgagaaaggcactcttgacatccatttgatataacctgaaatcatggtgagcggcataggctaaaagcatttggattgactcaaggcgagcaacgggtgcgaaggtttcaccaaaatcgagaccctcgatttgggtgaacccttgcgcaactaaccgggctttgttccttacaaccactccatgttcatcttgcttgtttcggaagatccacttggtaccgatgacattttgcttgggtctctccaccaaagaccatacttggttgcgagtgaagttatttaactcctcttgcatagccatcacccaatccggatcaccaagcgcatcttccaccctggttggttccaaagaagagacaaatgagaagtgttgacaaaaacttgcgacacgagagtgagtagttaccccttttcttatgttaccaagtatgttgtcgacgggatgatctctttggacaatgtgatgtatccttggatggtgcactggggggacctgagcctgatcagtatgctctaaagtgcccggaacatcgatcccatccacttgcgccgttggcacgtcttcactaccgctggtccggaggttccggactgtagaacccggaacttctgggcctggagatgtccggaggttccggtcaataggacctggaacttccggctcagcagacacagcacttgtagggctattggatgtcgatgacggaggttgatccctatcttcttggtcatcctgcgtctcgactagtcgtatatctccaatagccttagtacctatagcttgacttggatccacatcacctacaacatgtacaacaacttgctctccttaggagccattagattcatcaaatgtaacatccctagtgacttcaacaataccggatgttttgttgaagatacgataggtatgtgcatttgattcatagccaagtaagaatccctcatccaccttaggtgagaacttagatgagcgaggcctcttactcggaataaagcatttgctccgaaagacacaaaaatatgaaacattaggtttcttaccgctcatgat

SEQ ID NO: 12183 - DNA, 1914 bp, Oryza sativa
catgcctacattattaaatactactctatatccccatggatgacatagagtaatcgaatattcagaccttaaacccacaccactgcacctctctggtaagctaacccacaattataacaacatagatataaagtagaacctatactcagagaatgtaaactaccgaaagtatatccgctatgttgtattgatctgatgatatggttgtgaatatgcctttggagggctcccttcccatcttctacaggttgggggcagggttagaacggtaggaatacgacatcagttttcttcatctactttacaattttaccaaaccaggactacaggtcgtttccttgatacacaagcaaacgtaatacccgaggcccctataatcagtcggatagcccatccatctacgtatatggtaccataatctctacactgacaatttaaaatacatagatccatcacaattaaggtaaaagaaaagcaaaaaaaaaaaaacacaagtgtaagaatatatggatctaaccatggtcaaatgtttactttagcaccacattgtcaaatcatggcgcaattaggctcaaaagattcgtctcgcaatttacacgcaatctgtgtaattagttttttttgtctatatttaatactccatgtatgcatgtgtctaaacatttgatgtgacagggtgaaaagtttttgcgtgggaactaaacaggtcttaactcatgaggcattggcgtaaaacaaatgagaaagtttatttatttgccaatgatatcatcgcttatcgtatgctcatgtcctcaggacaagacaacatattgcaattatcatggcttattggaaatacaaagagacacaaaacaagagaagttgatagcacactggcttggatatcaggatatccaacttatttatgactactccaggttcatagcctcgtatgggcttcgatgtgtgtgaaaccctttctggttgcatgttgcgtttgattaggacacaacggtgacagtctgagcttcatttgtgcagaagcgatcgcatgcatgctcgcaacgctccacggcagcattcactccttcattggcagcaactgaaatgaaaaggaaaatgatcgtacgcattggcctttttcgttgaaaactaatggtgattcagtttcatgtttttccagcttacaagtgtttatcttgctgcacactgaagaagtacatcccagcttgcagaagtcaagtacatctgatttctctgcaaaaccatgcatttctatttatattatagtaaaactactgtcgcgaccgaaaaaattaccttttcccgaacgctagtgtattaatccccatcccaggaaaagccaggtacaccatacaaacatgatataaaaggcacatatttattatatcgataatatttacattattacaaagacactttaggcctgacaatcaaaaataaacagcagcggactagcgggcctacgtccatttcacaggcgctcaactggggtataaaccaggactccacctaaaacttcttctccaaagcttctcttactgaaggggggagaaagatagagcaagaatgagtacaaccacagtactcagcaagccacaccggagatgcataattaatgcaagggagtacaaagggataataatataggggttgagttttgcaataacaacctttaaaagtcacttaattgcccaaagccattttataaagacgatcctagagctacacagtattattaaacaaggccgggaccctcaccaaccttccttaacccaaggcctacgatgattaaaccgaactggcaacccgaccctgagtaccagatatcccaagccaacccaagccaaccattccacattttagttgttgagcacattttaaagaatttgaaacactgacttgggtaca

SEQ ID NO: 12184 - DNA, 1042 bp, Oryza sativa
ccactggcatcatagctccgggacctggatgttaatgccatagtcaagctcccaaatgtcttgtattatccgtagtatgacttattctcccctattgcgtccaacgcctccacacgaactccactattctaacctgcgcttttcttgtccttgcctatgtgtaaaacataaatccgccgatgtcgtacaattgccatgagttcatgaggctacttgggccagttgccagccagtgcaagcgattcaccgaacggcaagtttttttccttcaaccattcaggaaatttgcatttatgttcctttgagatccaagtcgccgcccttctagggttccaggctcttatctcgttcatgtgtctgttggtatttcttaacgacattactagaaatataattcccagcaatggcgcagaaatactcctagtatattatggttacaaagttcatccgcaagcgcacgaatataccattgtagcatttcacccgagagtattccaagtgtatcgtatttatttaatccagtggcaagatcatggtatagagaacttgactaataatttatttgttacttgtaatagtcatagtctaagcaggggttaagataatctaagggtacagtgacacacaagcagactactcattctcatactaaattatctaagctaagtggaaagaaaagagaaagagaatctattcctatacttctactatacatagtatacatacattctagttatttgatatactagctaataccctctatctgatgccctcctggtactttgagaagccacccctgacgaccaagctccttacgacagcccgtcatgaccatacaaccggggctaaatacggaggagtacccttcccaggaaagtaacttaggactatatacacgcctggaggaatacccattctgagctgtcaccatcagcggcccacctctcatccgcagcatataaccataatgataccccgtaatttagacaccacgtctaaactgccagatactactctaatatcatcgtcatggcatagagta

SEQ ID NO: 12185 - DNA, 765 bp, Oryza sativa
acttgcctttgaatacaacggagtcatcccttctaaagacggtcacatcctcatcggtaaacaagcaattgtaacccaacttacacaattgagaaacggattataaattgtatcttaatgaattgacaagaagaacattacagagagattgattattggagatggcaattttacctagaccaattacctttcctttaccatcatctacaaacatgatattctcacgagttccgttcttctcatcaaaacttgtaaacatactcctctctccagtcatatgattggtgcaaccactgtccacaacctaacttgaaccaccggaggagtatgcctacaaaagaaatcaagcttgggatttaggaacccaaacttgtctaagtttgggtcccttgatgttagttaccaaagcctttgtcacccacacacaagtgcggtactcatcattgtaattcccattaaaataggcaaccactttgccctctgaatttttggaaattacatatgaatcatagtaaaaaccctctggccggaacctcctggcattgtgaccggaacttccggtcatatcgtgtgcacggccattggcccggaacttcctggtgggaaattttgagagacaaagactcccacccggaagtttctcccggtttgtccggatgttccgggtccctggcagctcacaagactagtcacctcacttgcttgtggtgcttaacgtaccttttctcacaaacatcaagcattctttcccatttaccatcacac

SEQ ID NO: 12186 - DNA, 360 bp, Oryza sativa
caaccaccagtgaaaatcgtctactctggcggctggctaacacaactgctaacacaaataatactttttcttgcggaaaataaagacacgggcgagggaaaaaaattatgggatgaaaaaaaggaaaattggaatccagattttgaaaagaaaaattgaaattccctggtgtgcccatcctctatcgccggcgacagggagggcggaggtctacgaggaggtggatcgccaccgccgctcgtcttcctcggcagtgagccatccaccggcgcccatcatacctgccacctcgcgagtccaccctcccctatcccgtggatccgccgtccgcaagcctcaccgtcgccggttccgccatcg

SEQ ID NO: 12187 - DNA, 276 bp, Oryza sativa
catttctatttatattatagtaaaactagcttcttgcaggcaagaatgattgagccagaaatattgtgacattaattaacagtacagaagaatagaaaaatggagttaatagttaagtccgttttacccgtatcagagtgaagggtgaggtgatcgtaaggtggctggcactcccatcaaagtgtttgcaggtagagagtttagcacaggcttcccttgagccacccgcgaaacggcatgagttatagacgtttcttaccgaggtggatgggcagc

SEQ ID NO: 12188 - DNA, 1316 bp, Oryza sativa
  unsure (1)..(1316): unsure at all n locations
gcggaccccacatgtcaacctaaaggaccgcggtagaccgggtacacagagacggtccacgggtcgacagaagcagatcccgtgtgtcaaccgaggcgagtggccgacaaacggactccactagacaccacacgggctgcacacgtggaaaccatacggctaccgagcggacacactaacacggtcaccacacgcacaagcgaacgactgccgacaccatacacgggtaccggggccgacaaccgcacaacgggcacgggcgacaccgaaaggatgaggacggtgcagcgagggatagggatccttaccaccacgcgacgaggcgtgggaatgacaacgacgaacgggcgcggcggaggcggccgggaacgacagagacgaacggcgaggggacgacttcggcggcgatccttggacgaaggcgagacgcggccggcacgaggcttgagacgcggagccgaggacgaagacgacgacgggggctgcagcgaccttgatgaaacaccgaggacggacgaggacggctcgacggagggacgaacgccacgatgaccgggaacgacgaaaggacgacgacgacgacgccggggccggcgaggaggcgacgagggcagctggcagcggctgcacggagacgaggacggcgtggaacacgccgctgcgatgacgatgacggtggcgacgcagcgagacgacgagccgggcgaccgacaggacgtcgacgacgagaacgaacggagacgacgatgatggaccgcggaggggtttggatggaggggaaacgatgccgaggacgaccttgccgctgcgatgccggaagggaaggcgacgacgtcgaccggtgcactagcgaggaacagtagccggccgggtgaggggatgtactggatgccggcgaggacttcgttccggcgagatttgggcaaggaggaggtgaggacaggggagtggacaacgtcacagtgccgagggagtggtggcgacgtcngccggcgcacgggagacgcggcagaggcggccggaggcggaacagtggcgttgccgccactgtcgccggtgggggcgcgtctccggcgatttccccacgaatcggaggcggccccggggaagaggatgcacctgcgaggcccagggagaagacggcgcggccggacggtgctcgggcgaggagggagaggcggctggaggccggccgccgccggagagagagaatgagaaggcggggagaggtggtgcggccaccggaagacgcgggaggaggctaaaatgatagaacgcaaagagtgggttccattttataggatgggggagggagc

SEQ ID NO: 12189 - DNA, 724 bp, Oryza sativa
ccgggagggggaggagaggccctggagaggagggaaagagagggaggagagggagactttgggctgggccgagagagagagggaggactttgggccagacttggcccaaagggaggagggggattatttttaggttttctttttaataaactttgataattgtttttggttgcttaataattatttccggtgctctgaaaattcaagtaaaatttgagggctccttttagaccaaggagaatttaacaaaaattctccgggccacatttgaatttttcttgtacgtattttagtgtttgccaatttcttttcgaattttaattaattctattattccttttagaaaatgatttttatttcaggatgaatttatcaggacgtgacaactacttgcacgcaagaattattgagccaaaaatattgcgactttaattaacagtacaaaagaacagtgaaatagagttaatagttaagtccattttacccgtgtcagagtgaagggtgaggtgatcgtaaggtggctggcatctcccaaaatcaattttgcagccagagagttagcacaagagtcatatgagccacccacgaaacggcatgaggtatagatgtttcttgccgtgctggatgggcagcagcccccatcatagttaagggtgaggtgatcgtaaggtggctggcagctcccatcaaagtgtttgcaggtagatagtttagcacaggcttc

SEQ ID NO: 12190 - DNA, 1173 bp, Oryza sativa
taaactcaccaacttcctaacactcaaaagcaaacaaacacatgcaattacatcccaccactgatgtaaatcacatgcgagccacacacaagcaaacttaaagcaaacaaactaacacaacgatctaagacaacgacttaacaagtcactctagttcttccaagcattggaggtcgattgaaggctcgttcggctcgtcttcatcatcttgggttgcgacccactcaatcttggaatggttgcgcttggattcttcttcttcatcacttatgatgatgaccgaggatccgcttgggatggggcaacttctttctccaccacacggacctttggcgccaattgatagcgagggacaaataaagctctcttccttgcggtaagacgaatcctggccttctgcggcggtgcttctccctttaacgcggctaattccttttccaaacgatccaccttgtcttctaacttgcaaatcttaccacgattccggtcttcacgatcttgagccgctaacacagtctccgcacgaccttcatccatagcccacagcatctcaaccaaatgccttgtggtagcatcattctcaattccttcagtctaagtagctgccacggtcacttccctggggttgacgaggatggtagcgatactcagtgtcggccaactgatcactatagcgatcacggagctctcctatggcaatccttgccacttcctgacatgcatggatgtagtttcttcctccagcttcgaacatcactgaggggatctcttcactattgctgttcaaggtgactttgactcggcacttctcttcatgacgatcatgaggaatctgggcataaaaaggggcagtcccaaatccaatggcaaaggacatcgtacgcaactcctggacaaaaccctcaacaccaaacaggtactcaagcttgtagcgcggcatctaaagacaagtgaaaggagggagttaagacctttatccattaatagcacaagtttttggattaatttgaataaagtttagaaattcaaagtaaaaggtaagtgaataaagtaaaccaaacttgcaagataatttgaaatagttgaaaacaaggttacaaattttgtactttttaacaacaggtttcaaaagaaagttataaaatcaacatgctaaatttattttattgcagc

SEQ ID NO: 12191 - DNA, 2205 bp, Oryza sativa
ttgggcactaccgcctgcagcgcatcgctcaacgcttgacgatgcgtttggccacgcaccatggtggtcgcttaccagtgttccgagcaaagtgtagttgtttgtatccattatgtcaaccagcctgtgtgcaatgttgattgcatctagagaccagtgatagtggtggagcacaggaaccattatctgtccattcagtgtttggaagtaaagaaacgaaacttacaatagcattgctgggtttaaaagatgctcgatgcaggggaaaaaagtagacatggcattagtctttatgcaaaaattaataactaaccaatgctggatgtagtcgcgcaagtttccggccaaagcatcagtggaaaatttgtatctttccattttgtttgataaaatcaatgttcaggagaaactgcaaaaaaaaaaaagtgtggccatgtgttggtgtgaaccaaaagagtcacatctcgcgaaaaaaaagaacagaaaaacaatcatgttgctgcaccgtacgaaaaaaaggaatacagtagaaattggcgttattcacgttactgatatggaagtcggaatgaaaatcctttttccataattatctagcctgtacttcatgtcatccttgaatagaatcgagctgaacacgtctatgaaaagctcctctgtcaggctcccgtcggagaacgattccagcacattgtttccatacgcaacagagctgtcgatctctagcagtttcacgctgcaagcataccagaaatattaacatgtaaacccgtaatctaagcaaggaaaaaaaaggtggtccgcgaaaaaatatgatgcaccatatgcacatcatcaaggtgatgatgaacaccaacctgtccatacgaccaccattggtcagtaagaagtgcctgagctggatgctaagcgacacgtccgatgacggcataccggggccaacaaccaccggcgaaacaaatattgccggctcttgtatgaaccgctttggcagagaccatggcgttgaatttacgtcgttggtgtcaggcatggtctcgggcaaaagctgccaaaaaaacacaataattgtgtaaggggaaaaaatgttaaccgaaagtagaggacgatcggacaaagtataattttaactgccatctacctgtgtatcgctgtatgaaccatcaaagcacagcacaatataagagttgactgctcctttgatatgtagcaaaaggacagatagttgtaaacttgggtaagaaaaggtttgcagttaaaagataactaccagctgtgtcattgtgataagtatagtacagagttttcctggtattagttaattttttcctttaatttttggtagattgtgctatagcagataaaagtttgtgatgatcctaacaaaaataatgaactaaagagtttagttcaaattttactcataatgatattttcttgatttctcatccatttccagtgaggttgtttatttgaaccactagcttagtggttccttgatcagtgaagttaataaatgactatcttactgcagtttgcaactggagaaaacacctcacatattgcctcagaattaaacttttggtgcgtactgtttgaccaagcagacaatccctaagtgctcatgctcaagttgatgacaaaaaaaaatgtgtccagaggaaacccaaactacgagaatatgatttgatgcaatgaagcacaagtgaactcgacgaatgggatgtttgagaatacaaccacggagaatgtaggagccccctcgagcctgcaaatctccttgattttctcgttcacttgtgtgtcgatcatgtccgtgtccggcggtagaacaaatgacggtgacggcgtgacggaaagaaattgcgaggctgcgaagtaatgaaatgtactacaaggatatcactttgctgatgtatgtataacgatataatgggtaactaattctccttacatcgcgtggtatcttcggcgtggggcagctcagttgtttcctccgtcgggtgagattgttggtcaccggcactagtagcatgttccatatgaatgccggttgaagcaactggatcaataccaatcgcacacacagcctcgacgcctagtgtgtcttcccggtgttctggcgccttggatcttgagcggcaatttcctcattgtgaggggtgcgctgtccgtgggggtggtgtgcgctgtgtcagaaccggt

SEQ ID NO: 12192 - DNA, 1095 bp, Oryza sativa
aatgtttctacttttcagcaatttggctactgaaacagaaacaaattatcaacaattccttctcagatatagttgtaaagatatttatgcatcatggttcaattgcaccttatgagtattgacatgaaaatggataagaaatatcttgcagagatgcttctactctgagtagcagcagacgtttacctgcatgataagcttccgcatccaaccagtagatgaagaaacacaaccaaattccactgcagaaatcttgcgtttgtagcaaaattccacacacggccttctacatattacttttggtgctcctcatatgcagcaggtgctttatatttcccttaaccagttgtcctggtaaaaagcaaaattaagacgccacaacatctagtcatatgtagataaatatatcattttagccaactaaaggtttggataaaatatcaagcttagcctacttaatcatggaagaagatttcagattcaggaaacagtgtttcttttacagtgagcaattgtgaatttagagagaacatgtaagcagagtctacttgccaagagcacctatcttatcataacagaagcgattatttcagaacatacaaccgtttacacgctagaacacctatcttatcatagtagaaatgttttgtgggcaaacagttctgttcttcagaataatgggatattgtgttgaatttcccttgaaacagttttgatgtgtgaaacagcagtacgctggaacactgagagcctaatgcggtactacttgcattcagacaagcagccctgcaacaagaatcttgtgtagcatgtagtaagaaagcacccttaaaccaatgcagcttgcagcgttaacctaataaagttgtgcaaatgaatgtcaaactaaaagattacaaagatagagaagcccttatataggcacaccgcacacatctacacttgaaatatattctgtaattaaatctaaattgatacgaaagacagagttgctcttgctaaaagattacattacattaaccttaatgtcttgtttaaatctgatgatgcagatttatagtgttcacatgaactggacaatacagcttgcatgcc

SEQ ID NO: 12193 - DNA, 379 bp, Oryza sativa
cccaggacattatgctgacaaatgtcccaagccccgtcgcgtgaagggtgtccctgctcagaataactctgctgtaccagcatcaaaggcccgtgtcaatcatgtcgctgctgcagaagctcagatgctcccgatgtgattttgggtacgttccctgttaactcattcctgcaacagtacttttcgattctggcgctacacattcattcttatctatgagttttgcgggaaataatgggatggaagtagaagatcttagacgtcctttgatggttagtaccccaagtgatcaagcactctctttgcaacgtagcccctcggtcagaatagaaattaagggagtaccatttctgccaatcttatcttggtagaatccaaa

SEQ ID NO: 12194 - DNA, 657 bp, Oryza sativa
acaaagcacttccctagttagatgtaggttaaacttcccgttcgagaaactctaacttttacctgccctcaatttatgcacgagtaatgaatgcccctgggtggaagcgagaggggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaaacatttgttgctatctaaattccatttaaagtcgtaccttatcgcccagcatcatcttattctctatttgaattccctccatctttcagatacggatgtagccttggatgtgcccgtgcccaatgaaaaggaagagcgcaacatgaaaacgtaagtcaaaaattaccggacacccacccagatcccaatagaatccgccaaatcctgcgggaaattgaatcccattcacaaactcctacatttaattaacaagaaaacttttgtatttatctacacctggattatctccacctttcatt

SEQ ID NO: 12195 - DNA, 4829 bp, Oryza sativa
gtgacactatagaatactcaagcttaaggaagctcatgacaacctcctttccactactcaacatggagttctcattgatgttggcatatcttgtgatttgcttgatgatagtgctatttgccatattgctcatgttgtatcatctagcatttctacctcttgtgatgatcttgtggatatgcctagctctagctctagcacttgtgtttctatttgtgatgcctcacttgttgttgagaacaatgagcttaaggagcaagtggttaagctcaacaagagtttggagatgtgcttcaagggtaagaacactcttgacaagattttgagtgagcaacggtgcatccttaacaaggagtgacttggattcatttcaaagaagggtaagaaagcttctcaccgtgctactcgttttgtcaagagtaatggtaagtattgctccaagtgtcgtgaggttgggcatttggtaagccttccaagacttgcatgtttgattctcattatatgcttaggaaggctcatgatggtagcattattgctagatatgtgggttcccctatactccgtggtaaaaagaatgacatttgggtgcccaaagctttggtctctaacctccaaggacccaaacaagtttgggtatctaaaagagcttgatcttcttttttaggtgaactaccgcaccggtgggagccattgtgtgcttgatagtggatgcactcaacacatgactggtgatagggctatgttcaccatatttgaagtaggagggaaagaacaagagaaagtgacatttggagacaatagcaaaggaaaggtaattgggttaggtaaaattgctatcactaatgatttgtcaattgataatgtctctcttgttaaatctctaaattttaatttgctttcggttgctcaaatttgtgatcttggcttgtcatgtgctttcttcccgcaagaagttattgtttctagccttcttgacaagtcttgtgtgttcaaaggttttagatatggaaatctttatttggttgatttcaattctagtgaagcaaatttgaaaacttgtttagttgcaaaaacttcaatgggttggctttggcataggaggctagcccatgtttgcgtgaatcaattgagcaaactttcaaaacgtgatctagttgtgggcttgaaagatgtgaagtttgagaaagataagctttgtagtgcttgtcaagctggcaagcaagttgcatgttctcatcctactaagagtatcatgtccacatctagaccattggagctcttgcatatggatttgtttggcccaacaacctataagagcattggtggtaatagtcattgtcttgtcattgttgatgattattctcgctatacttgggtgttctttttgcatgacaagtctattgttgccgagcttttcaaaaagtttgcaaaaagggcccaaaatgaatttaattgcactcttgtgaaaattagaagtgacaatggttccgagtttaagaataccaatatcgaggactattgtgatgatcttggcattaaacacgaactttccgctacctactaacctcaacaaaatggtgtagtggagaggaaaaatcgtacattgattgagatggcaatgactatgcttgatgaatatggtgtttctgattccttttgggcggaagccataaacaccgcttgccatgcaaccaattggctttatttgcatcgtctcatgaaaaagactttctatgagcgaattattgggaggaagccaaatgttgcctattttcgagtttttggttgcaagtgttatatttatcaaaagggtgttagactaaccaaatttgaaagtcgttgtgatgaagggtttcttctaggttatgcctcaaatagcaaggcataccgggtctacaacaagaacaaaggtattgtggaagaaaccgccgatgttcaatttgatgagactaatggctcccaagaggggcacaagaatctggatgatgtaggtgatgaaggcttgatgagagctatgaagaacatgtcaattggagatgtcaagcctactgaagtggaagacaagccatccacctccactcaagatgagccatctacttccgctacgccaagtcaagctcaagttgaagtggaggaggagaaggcacaagatccacctatgccaccaaggatacacaccgctctttccaaggatcacccaattgaccaagtgttgagtgacattagtaagggtgttcaaactcgatctcgtgtcgcttcaatttgtgaacattactcgtttgtttcttgtcttgagccaaaacatgtagatgaagctctttgtgatccggattggatgaatgctatgcatgaagagctcaacaactttgcaagaaataatgtgtggactttggttgaaagacttagagaccacaatgtcatagggacaaagtgggtctttaggaacaaacaagatgagaacgggttggtggtgagaaacaaggcaaggttggtggcacaaggtttcacacaagttgaaggtttggacttcggtgaaacttttgcccccgtggcaagacttgaggctattcgcatccttcttgcatttgcattatgctttgatataaaactatttcaaatggatgtgaaaagtgcttttctaaatggtgaaattgccgaacttgtctttgttgaacaacctcccggttttgaagatcctaaaaatcctaaccatgtttataaactctcaaaagctctttatggtttaaaacaagctcctagggcttggtatgaaagattgagagattttcttttgtcaaaggatttcaaaattggaaaagttgacaccacccttttcacaaaaatcattggtgatgatttctttgtgtgtcaaatttatgttgatgatttcattttcggttctactaataaggtattttgcaagggatttggtgatatgatgtctagggaatttgagatgtccatgattgaagaattgagcttcttccttggacttcaaatcaagcaactcaaggatgggacgttcgtgagccaaaccaagtacatcaaggatctactcaagaggtttggcttggaggatgcgaagcccatcaagacacctatggcaaccaacgggcatctcgaccttgatgagggaggtaaaccggtagatttaaagctttatcgttctatgattggtagcttgctttaccttactgcatctaggccggatatcatgtttagtgtttgcatgtgtgcacggtttcaagccgctcctaaggagtgtcacttagtggccgtgaaaaggattctaagatatttaaagcattcctctactattggcttgtggtacttaaaaggtgctaagtttaaacttgttggctattccgattcggattatgccggttgcaaagtggatagaaagagcacattcggtagttgccaaatgcttggtagatcccttgtgtcatggtcatccaagaaacaaaactccgtagccctctaccgccgaggcggaatatgtttcggcgggtagttgttatgcccaattgctttggatgaaacaaacattgttggactatggcatatccttcaccaaaaccccactcctatgtgacaatgatagtgccataaagatagccaataactcggtccaacattctagaaccaagcatattgacatacgccatcacttcctaagagaccatgttgccaagtgtgacatagtcattagccacataagaaccgaggatcaactagccgacatatttaccaaggctcttgatgaaacccgcttttgcaagttgaggaatgagttaaatatcatagacttctctaatgtggcttgagatggtgcaccatggttgcttctttttgcctttttgcatatttgctccttttgctcttatgctttggatttgttgccactaaattcttcattgcgaaaatggagcatgtcacattaagggggagttttgcactcttgcatgtgctctacttccctttatatgtgagcaaatcaactagtggtgctagtagtattttcaaaatgcccaagtcaacataagtcaaaacttttgtaaaatcaatgtaatttgaaaactatctcttggaaaatgtttcaaaaggtttcctatatgttttccaagcctcacattgcaaggaaaatgatttttaaatgaaaatgcccttttggccctcttttgaagaaactatattcttatttttggccaaaatgagattttcctccaaaatgagattgagagagaatttgagaaaagtttcaaaacaaagttggtaaagaggaggatttgaaatgtttttggtattcaaatcatattcaaaaaccaaatatttcaaaagttatttgaaaaacaatttagcccaaaaacccctatataccataaaaggtcacctcctagcacttaagtgagttttgttgcaaatcattataatttttaaatattatgggtggttagcaatatttatactcacacatttcaaaaattgctttaaaaaatcaaatttcttgttgaattttattgtgtggggttgccggcttgtgcaagggctgtgcacagccggcagggggcctggcggtctgaccggcgctatatgcgcggtctgactggccaggtgcggtggtctgaccggccacatagggccggtctgaccggctgaggtgggcctaggcagttttgcccctttttcttctccatcccgcacctaccctctcctatctcatccccattcatccccaactcgaaaaactctctctctctctctcccacctccccttaaaccctaactctttcctccaccaaatcccctcggtttgaccgtggatctct

SEQ ID NO: 12196 - DNA, 4116 bp, Oryza sativa
tgttgagtttttgatccatggcatggaaccctaggtgaagcacgaggtgttcttcgatttgcaccaatagagggtagtttcttggtgtgattcaactcctccaaccggtaaatcactcttcctcttgtgcattctctcaaatcgatctatttcaccctagggctatgggtagttgttccaatcttgatgaaataggtccaatcctttgatgttctagttccaatcttgtgcaatcttgatgtagcaaatatttttagagtcatttgtatgtgatggtaaaagggattttcttgtgcacttgtcagaggtggtctgatcgagctcggtcagcggtcgacggtctgaccgagctcggccgacggtctgaccgacatgtggacggcggtctgaccggccgttatccaccggtctgaccggccgctggacttcggtctgaccgcccctgacatgcagtgtgcagtttccttttcgcctaaacatagtgtcttctaaaagttattgctaatatcccatatcctttgctctttgacagcaaatgcctccccgcactcgtcatagtcgtcgtgagcccacgcccgatcccgtgagtgaggagtcaagcggagatgagtacgctcaaagtgatgaagaggttgaggccaatgttgagggggctagtgaggaggaaagtggagatgatgtcagtggaagtggagaggatgaggatgaaggaagtgatgatatgcacattgatccctccatccagtttgttgtgaacatgaggaatccatcgcagtataccattttgaggcaccatgatcagtttttgaggcctcgggacacccggaatccccgttttcacaccgctttccaaaagagtgtgtatgagcaagtttatgcagggaaagcttttgcagagcataagtggatttcttggagagacatcaatgagactccagagtttgagggcttgcaggatctcttcaagactgttggcattgacggattgtgactctcaaacaagactacaatgaagatttaatccgacagttctatgctacagtgtgggtggctggagactatagtgagatgaagtggatgtccgacacccttcagtgttctatctctaggaggcaattctggcggctcctcagtattcgcttggactttggagatgacttgcatgaggagcacactcacaatccgctctccatagactacgtctctcagttttacgaagacggagtgtggtacacacatgggaaggttgccggcttgaggaccatcccctgtgtggttaacaggattgtgagagttaccatcctccctcgccttggtaacaatgatgacattaggggggtggcttggcacgtcatcgatgccatcattcagggccatcaattcgacattgtgtctcttatgatgcaagagattgccatctctaaggctacattcactcagggaatctattatgccccttacatcatgaggttgattcaagacaagcttggggctgttgggcaaaatttaaagaagcacaagcagtacaagccccgccttcagcttggagctccccgtgctcctagggcggcaccctcctctcatcctggagctagctcaagctcagcacctcctcctcctcatgggtatgatccaaatgcttttttctatcctcagtatgcctactttggaatgcaaccaaacgaatactttaacccggtacttggggctattaataccctaagtgaaagcattcaacgcttgtccaccgggcatgaagctttgcatgagaatgttcgtggattgcgcacagatgttggagacttgaatgcttctgtggggagattgcacactagagtgggtacattggattctcgagtccaaatgttggagagctcccaagcatttgtgtatcatcgtcgtcgtgatgctcctcatccttccacttcggcgcgtcctcctcctctacaagagtgaagacctttttggtgcttgatgccaaaagggggagaaaagtgtgttttatgtcttgtgggttgggactagtggtagtgaggttagtcacctcatatttaataagttaaggaggtttgggctatattttgtatgggtatgggctattactctatattgtgtgttctttgtcgttttgttaaactctatgtcatttggacccctcgtggtcttgtaatagcctatgtttatttgtgagcccttttaggatgatttgtgacttatgtgttttggatggttaagtgatgtgaacttgtgcgatgatggatggtgtatgtgatattaatatatgtgaccatcttatgcctatggattgaagttcacattgatatattgctaatgtgttttgtgcttgttggaatgtgatattgaaatgtgcattggctccatatttattgtctatgattgatatgcacatgtttagggggagcttttgatttccattgcaatatatgtccatgtgttctatgtttgattatatatatatatatatatttgtggtgtttgacatcaattaccaaaaagggggagattgaagcatctaggcccccgttgttaattttagtaattaatgacaagcgctaattgtggactaaccattgctattgagataatattttaagattaggtccacgtcatgtgtgcgtatggatgactatcgatggattaaaattgacggcgcaaagcaaagagaaagaaaacggtaaaactagtgctgtaatttagaattgatcgaggtgtagggcgatcaaatttgctagtttatttgctagtttcgccgtactattaagaggggtaatgacctatcaaagagatgattaaattgccacattaagtcattgcattttcacttgtgctcactttttcatcacacacacaaaaactcacctttgctttcactgagctcggcctgaccaggggcggtcagaccggccacatagtggcggtctgaccggcgtgccctggccggtctgaccggcggcacatgctcggtcagaccggtcccctggacgccgggatggtgctactcagggtgaccgatacagagccgacggagccgtattcggtcagaccgagccgaggccggtctgaccgcccactcaacgccggtctgaccggccaggccgatggggccttctgacagcactacaacggcttgttttctagctattgcagagtagcacggtctgaccggccacatacctccggtcagaccggcagagcacaaagttgggggatttcgcccccaatggctagttttggtgggtgggaatataaatactcccccaccagcagcaaggggactctcttggcacccaattcaattgcatacaccccttgcacctctctcacacccccttgagctttgtgttcatccatctagtgtgttagaggtttgatctagccaagagtcaagtgtaattgcttccattgtagagccagtgtggcacttgattgatcatctccacgccgggtcattgcttgttactgttggaggttgccgcctcctagacggcttgtggaggagttgcccggtgacctctccgagaagattgtggaggaggcccggcgccggtttgtgagtggtttggagttcaccaccttcggagtgaaggaagaactaccctagtgatcgaggcttgggtagtcctctctgtgggcgggctcccgccttgcccatcccttgacgaagggggcgtgcggtggcttcgtggttgagcggtggagttgggctcgcctcaacggggagtaggaaaccggcgagtttccgaacctcggtgataaatctcttgtctccttgtctcatttgattgtcgcatttacatttgtgtaatttacatttctagagacaaacttgagatcatatcaccctaggattgctaaacattgacataggagtgtgatttactttcctagagatataattgagccactatcaccctatgtttgcaaaacataacttagttgcttagttagagttgaccctcaccaagcctagcaacttaggttagttttgattaggtgtcatttagtttttggcaaaattggttatatagcatcgaaagttcacgtttttggttttatagccccgaaagttaccggttcactttaatagcacccata

SEQ ID NO: 12197 - DNA, 63916 bp, Oryza sativa
tacccctcacaagtacaagtgtaatgcatgtcaaagaggggttgaaatgtcatatcatgtgtgtggctggatcattaacgatcaagacggacagaaaaattgacggaagtgctaaaaatgggaacagggtgaactttggatgctattaaagtgaaccggtaactttcggtgctataaaaccaaaaacgtgaactttcgatgctatataaccaattttttcttagtttttaaatcgcctattcaccctccctctagtcgacatctcgatcctacagtagcgcggggtgaccaacgtgcaagtcacggctggcggtgtgaagaccggcacaacgtgtggaggcggctggcaacggcagtaggctatcgcggcgcgtggaggcgagcccaatttagaggcgtggtcgacgacaaagctcgtagtggcatagccggcggtagcgggaggccattgtggtgcgtagagctgttggcggcattgacgcggagtacagccggcggggggcgttgatgcagcagtgtgcacgtgccgacagaggttggcaggtggtagagctttggagctttggctgtcgatcggtagggggcggacaacgggtgtaaacctagcttgggattggtcgggccggcaacgacggccactttgggcgtcgctttccctcctgagagtgttgttgagtcgtcctcttcctctggtggggctgccgggtcaaaaccctgtcttggttctccctaagatcttggcggatggcggcggtgctcatcgtcgccgttctcactggagtcgtcatattggaagcccccttgccaaatcttctctcaagcagttggtgcaggctcattcatcctcttgcggcggcacacaagcttttgcaagttggccacatcggcgggccttagtaggggagtggttccatcttctctcttaccctctacccctcaatcccaaaatcgtggatagaattgagttggtggctggttattagggcttatgtttcggcggtcttggttgtagattccttgttagtctagtggcgaccgctcacacttaacggcggctgtgtgtagacgttgtcagtgcgtggtggtggtggtggaattgtttttcattcctggctattgtttttcaggtcaatagtcttgtattttttttaatgaatcattgcgttgtctggtgctgatcgtaaaaaaaaactgggctttatattatttatatattctaggaactaggcaactagctacggttcaaatgccaaggttaaaccgttgttgatgtgaaaaacacacactggcctggaagatctgcttaacttcagtgcaggtccaaaatcttgcttctaggttcgtgagcgtgctagttgatttgatcctggaatcaacaagaaagaaagacaagaaaaccatggttaaatccataaacgacagccgatcggctagttgccgatgacatatcatttatcttcgagccgatgtcatattggaatcaatcggcagttgtgaataaataagatagaactaaatctactcgataggctatagatattaacgacatataattgttccttcgatgtatatttaaactaagtgattgggatagatcgatcgccatgtcgagacagtataaatcacttaagtcgaagtatacattaaagtactgattatatagacgtttatagcatagtcgatcaaatagatctagcatgtatcggctaatactctgataccactctatattaagatattaaaacaagcagaatatatcaaacaagaagtctaacattccgtagatacacgatataatctaaattaataatgaaacatgaccctataggtcactccctaacagtaagaaccagccgataacaacttatatagcgcaactaataaagattacaacgtatatatgataacttgacggattacataaacaagattagagtgtcataaagttggaagcactaatcccgagaacgcaagccgccatgacaagtttacctctagttgaagatcgaatcgatgcagctcaacccaaaagcaagaactcgtcgaaatagaatgaaagtaaaaaaggtggcgatgcgccgagagtgtattgaactgttgttgtttcttacattgggttcgggccatatttatacccgagatacaaaatatctcctcgccggatacgactcttatccctaacaaactctaagataccataagtctttgcggcagacttttgcccaaacatatctctaaggaaataatacaaaatatcctaattaatatatacaattgcctttccgcgagctttatctctattgtggcaatccttgtgaagcacgttgatcgactctagaaacagccttgaagccattaccgtcagaatcggctgcaccacctctatcggctgtatcggctgtcttctgtccgatccatctcagccgatgcagactccagccgatgccttcacagccgatgcatactctgttcttcgaatccatctcttttctgaatccgcttcgtttccaatgtcgaacttggttcatattttaccaaatttggtcgtgaacacatgccccccaagtccgctatatttgtaatgttgcggatttgctcaatttccctttccgagctgaactagggtttctaaaaccgattccgttttggccgttaccgtgctccccttttaaatagtaaccaccgctcttctcgtttcacggcgtcacttccgtttaaaccgctcttagccaaaactttccccaatcctccgcctcgagctctccggcgacaccttcaagatttccggcaatccaagggcgaccctccgcgacaccaatcctctccgtcggcaatgttgaactccgccagtccaccgagcgcatcatccgccgaatatgttgaggtaagtgcccatcggctaaactcccttcttattgcgcaagattggttcttttcccgctcaatcctcgatttttcttcttctgtagcatctcactcaccaagttgcgatccctagcataactgatgagttccagtttttccttggcccaatcggcaatctagaccccacaaagtttatcaatggagaaaccaaccgaattccttttagatttgccaatccagatctaagctcctggaaaaataccttcaaatcttggccatcggctgaaaagagttggcctgcctggtataagaggatgtcggctagcaaatcaactcactgggaagaaatcggcatatcccaagccttggccttaactgtagcagacatggcgagagatgaatctatgatagcagctgctacttacttctggtccacggccatgaacaccttcctcttctcccaaggagcgatgaccccaactctcttagatgtcatcatgatcactgacctagatgtcacctcatcggctaacctgcctagcttggatacccaactcacccatgagttcaaaaccaggagcataggtggttggttaggctatgttgtgaagaacatgggaaccgggccaatttctccaagggaacatgcagcctttccttatgatgtggcttgaaaaattcctgttctgcggtccaagctgtggtcctactgcaaactggcaacgtgtagctgagaatttggtagaaaagaagcatttccctcttggaaagtatctgctaggctacctatatcaaactctcaatgctgcaataaacaagatagtctctggaaaatcaattggcacagggggtccatggtggttacttcaaatctggttgaacctgcacaccaggatggttgccgatcgaccagcgctagccgatgcaaattttccaaggtttgagccgatcatcagagatgatggagaaaggagtactacacgccgatgtatgtccttcgaagaagcagcatcggtcagtaccgcatccaagttatcggctgagctcttcaaagaatggttcaacaacttttatgatgggttcgtgttgacagaaaacacgaggcctgggagatctgcttaactccagtgcaggtccaaaactcgccttcggatgtatgagcgtgccagttgatttgatcttgtaatcaacaagaaataaagacaaaagaaccgtagttaaacctataaatgatagccgatcggccaggtgccgatgacatatcatttatctttgagccgatgtcatttgtgcatcgatcggcaatcgtgaataaataaggaagaaaaactaaatctactcgatcggctgtagatgttaacgatatatactccttataccgatatatacttaaatcaagtgattgggatatatcggtcgccatgccgagacagtataaatcacatagaccgaaatatatattaataataggactatataagtttacagcataaccgatcagatagatctagcatgtatcggctaatactccgatactactctatatcaggacattaaaacaggtatagaatatcaagcaaaagcctaacacattcaaatacaccaatatcttggcataaagggcatatttaacatatcagtgaagcaaatagagataattatagttaaatcagatacgaccggctgaaactccgatgctattctaatcggcaactaggtggcaggctagagatcaatattctaagcacgacttaataggtcaaactcaattgatgcagcattaagtatgaaaagaagaacaatatctagataatcaagccgctagaagattcatagaatggtagatatcttatataatctggatcaacgtaaagatctaacctaatcggctgtcttctgcacacagatgttggccgatggtgtattagataacaatattgctgaagattatataagatatatgataacttgatgaattatacaataagattagagtgtcatgaagatgtaagcactaatcctaagagcacgatccgtcataacgaattttacctgttgttgaagatcgaaaccgatgcagctcaacccgaaagtaagaattcgtcgaaataaaagcaaaaggtggcgatgcgcctgaattgtattgaatgtgtcttctttcttttacatagggctcggggtctatttatacccgagaaatacaagatatgtccatattggacacgactcttatctctaacaaactctaaaatatcacaagtctttgcggcagacttttgcctaaacatatctctaaggaagttacataaaatatcctaattaatagatacaattgccttctcaggactctatccatgcgtggcaatcatcttgaagcacatcaactcgaacccaatgttgcacacgggtcgtattgtcggaaccggctatatcagcttatctagttcaactcaatctcagccgatcctagctgtagccgatcaggactccagccgattcctgctctgttccaaaactcgatctccgcctccaactcttcgttgatcaaatcccctttcctgatacacatggtaccaaatttgattgttaacacatgccccccaagtccgggtattcgataatgttccggatttgccgcaagccgactccgagaaggtttcgcactttaccgttttccgaccgttacctccttgctttaaatattaaccatcacccccgaaaaaacttcacaccgtgacttccgttttcaccgctcaaacaaactcaatcccccttcttctccggcgatttccccgacgcaaaggcgactcccaggctattcccctctcgacgagatccccacccgcggccatgtcttcttccgccagcccatcgggtgcatcatcggccgaatacgctgatggtaagttctcatcggctaaatccccttccttagcagcagatcgatcttctcttatctcatatcgctttccttatttcggttgctttgaatttatagcatctttctcaccaagtcgcaattcccagtctgacgtatgaaaatcactactttctcggcccaatcggcaatcctgatcccaccgagtttattgttggtgaaaccaatagaatcccctttagattaaccaacccagatctaggtcactggaagaatactttcaagtcttggccatctctggaaaaagttccaccagaaaagagctggaccacatggttcaaacgtgtatcagccagcaagagggctcactgggatgaaattggaatcggccaagcacttgaccttactatagcaaactcagccaaagatgaacccctgatggcagccacttcttacttctggtcaaaactactaatgcctttctgttcaatcaagggccgatgactccaatcctcatagatatcagtatgatcacaggtttggatgtcacctcatcggccaaccctatgagtttgaacacaaagaaccaatatgacttcaaaaccaaaagcatacgaggttggtcaggctatgtagcagcatacatgggccatggttcggtcacccctcgagaacatgtggcttttctattaatgtggctagaaaaatttcttttctgtggatcaagttgcggccccacaaccaactggcaatttctggctgaagctttagaaacaaagagacaattccccttgggcaaaattctcctcggctatctataccagatgtggctaagatagtagtcggttcagtagttggagcaggtggaccctggtggctgctacaaacctggttaaacctgatagtcatgaaggttgtcaatcggccatccgtatcagaagctgagttcccaagactagagccgattgtaggggatgatgaagaagagcgtactcatcggagatgcacatcatacggcaaatacgcttctacaccaactgatgccggagcaaaactatcggctgaactgctcaaggactggttttgtagcttctatgaaggctttcaaaaagatgctagagtctggttcctttatgaagactctgcacaacttgaacacccagtggacttcaaattcgaagacatcaatcatgaagtataccaatcatccagggaaatcttctcggctgcaatcagcccatgcatccttcctgttggcattcatcaaggaagaaacatccaaacttcttatgaattctatcatccaatgagctcagctagacaactcggaatgggccaactcccgatcagcttattctttgctgacaagatccaatgccgaggagggattttgtcaaccctgatgatggatcggctgcttagccttcaaggaccccctctgggcagtattgacaacatagaactggcaacattcaggagcaaaagcttcgacaggtggtggggtgaatggaaactgcatttattccaccaaccagcttcaatgtacatgacagacctctttcccgatattgtccctcaagtaagtcttcaactttgctcaattttagttaaataactgtttggccaattgatcttaactaatcatccttttgatttgcaaacaacagaatcttcctctcctcatcgcagcaacagtggcaaagacatccaatatgccccaagtttaattcctaacggaggtgggctatctcctccagttatcggttatgatgcccccaagacctcagctcttcttcaagggcttaccagagaaccagctgatgccggtaagaaaagaaaaaccagatcatcggctgtagacatcttagccccggctccaaacaagaagatcaaaaagaaagctaaaccagctgatgacctgcctgccctagatccatccattgaacaagctctggatgaagaggaaatcggagaagatgttgatcaagccgtagccgaggtaagtgatattgaaagaacaccatcggcttcacctaagcaggcccctccaactccttctgctctggttcacttctcaagggtaagtgcctctctttaatccctttcgcgattattttatcttatggccgatcattcccaagtcttataattgtagaaaaagaagactgcggtgaagaagaaatcggccgcaacaacatctaaaccagctccaccagtaagatagttttaactttcattagttaatttttagccgattctattaaacactcgctttcttttcagccttcacctcctccttctccttctgctcaacaatcgtcaagtgaccagaccccttcagctgcaggaagtcatcatgttgaaaaagaagaacaaccagccgctcctgctatcccagtaagtttcttctaacaaacattcagattggctacaattatttaacctctaatcgtttctaaattgtcaccacaggtcctagccgatcttttctcttttgacatcaaagactatctcgacgaaggagaagaagatgtcacaagcaaagcattggctcctttatctgatgatgtcaggaaaactctaagaagtatcttggatcggctagaagcatcatcgctagatagcttggtagtcgactgtggtccaatcagggctcggctgcatgaaatccaagctttaatcccagatgaattagctgatgtccttactccagctgtttaccttgagcagcaccaatacaagctagagaaagccaaattaagactggccgaacggtgagaacgtaaggacattgaggccactatccaagccaaccgtcaacttgtgcatgaagaaaaatccaagctcgatcaattatctgaaagtccaatcaaatctaacattgatcggcttgaagctcgcaagattgatctcttagcacaacttgaagaatgcaatgctgagctggatatggaacgcaagaagctagtcgatctcccccagtccattgaagagcagaaagctaggctcaaatcggctattaagcatgttgctgaactgaccaagtccttaaaagttattcctggaaccgatgcgcaagatgctcaagccatagaggaagtagagcagattaggcagcaagctatatcggctatccagcaatacttatcgtagtaatcttactgtaataggacattaggtagcaagctatatcggctatccagcaatacttatcgcagtaatcttactataataggacttagagcttctgcaatcggcttaacattctgatacttcatcccttaacatccttctgtgccgattaatatgactgtgagatttgctcaaaaaaaaattttgcactatatttactgcattgtaacagatatatgcccccctagttttacaatgtcaacagcagtgataaaactataaaacaactaagggtgatataacaatatcggccattgtcaatcggcaaacctcagccgattacattataaaacaactaagggcgatataacaatatcggccattgtcaatcggcaaacctcaaccgattatagcataaaacaactaagggcgatataacaatatcggctattgtcaatcggcaaacctcagccgattatagtataaaacaactaagggcgatataacaatatcggccatcacaaggcgatgtacgcacatcggcgacattagtagccgatcacgagttgatccatacactcgggtaatatttcttcaagtatttaccattaagagctcggccataaacttcaccatcaagcccttgcaacatatatgctcccttagaaacaaccttatgaatctggaacggtccttcccaattcggcgaccacttgccgaatttattatcacgagtaccaatcggcaaaatcaacttccacacaagttctctttccgaaaaaaccttaggcacaactttattattataatgtcgagcaacacgttccttatccttagtaaccttcgcaagggctcgcaattgggactgaaccaaatcctccctctcatcggccataagattgtaatactcatcggctgtcaaatcattttgcaactccgttcgtcgagagccgattctaacttcccatggcaacacagcctcatgtccataaacaagtttgtaaggagtaacttggatgatccatgacaagccatcctataagaccacaatgcttcggccaatcgcgtatgccattgccgaggataatcggaaatcttccgcttgatcaacttaatcaaactcttattagacgcctcggcttgcccattagcttgtgcataataaggtgaagaattcaacaacttgatacccatgctatcagcaaactaaacaaactcatcggacacgaatactgaaccttgatccgtagtaatagtttgaggaaggccaaatcgatagattatatgttcttgcacaaactgaatagcatcccccgaatcaactttcttcaaaggaatcgcttctacccatttggtaaaataatcggtcgccaccgatataaatttatgtcctcgacttgatgatgggtttatcatgtcgatcatatcaattccccaacctctaaacggccatggtttaattataggattcatagccgacgccggtgctcgctgaattgctccaaacttctgacaatcttgacaacccttataatatcggaaacaatcctccaacatcgtcggccaaaagtatcctgcacgtcgaagcaaccacttcatcttgtgagccgattgatgagtaccacaaatcccctcatgaacttcaccaattgcaactttagcttgatcgtcgctcaagcacttaagtaataccccatcaatcgtccgataatagagctcatcacccagcaacgtatacttcaatgccttatatcgcaattttctggaagccgattgagatggattgctcaaatacagcacatcatacctccagtcatcggctgacattgccgcaatttcaaccttaacatctttgaccatcggcttatactccgacgccccttgagccaaatcattagcttcaagattttgttctcgagatacatacttcaaagtaaccagccgaaattctttcattaattccaggcacttctcattataaaccaccaatgtatcactcttgcattcatattcgcctgtcaattggctgattactaacaaagaatctcccatgatttcaatggtatcggcttcaacttctttgagtaattgcaaccccttaagcactgcctcatattcagcttgattattagtctcatatgatttaatagtataagcaaactcaaaacatgcccccctaggggaaattataactaagccgatgccacaaccatgagtgcataccgatccgtcaaagaataaagtccatggtactatctcaaccgagccgactgaatcatcacgatgttccacaataaaatcggctatagcttgtcccttaatcgcctttggtgattcataccgaagatcaaactcagacaaagaaaatatccactttccaattcgtccctttaatattggagccgacagcatatatctgactacatcggctttgcatataacagtgcactcattagataatagataatgcctcaacctcgtacacgaaaaataaaggcacaagcataacttttccataggggaatatcgagtctcagcatataagagccgtcgactaagataaaacacaactcactccttcccttccaattcttgaatcagaactgagctgattgacttctcaccagctgataaatacaacctaaatggtactcctttgtaacatcccggcctagggcttaataggattaatagaatactcatattaacaagttgcaacttcttttccggaagccaatctccagagaactccagggttaagcgtgcttggcctggagcaatttgggatgggtgaccgaccgggaaattcttcccgggtgcacacgagtgaggacaaagtgtgcacataagacatgtgttggtctgtgagggcagtctatgacctatgaaagctatcggatgtaagtgggcccggcctggggaaaggcggaacgttacatcctttctgtgggggaatcaaaacagttcagagaactgagatattccttgatattatccaaaactttttgttgctctgccccccaagtgaattgttgatcggctttcaaccgcaataagggtgtaaaaggttccaaccttccagaaaaattagagataaacctcctaacaaaatttatcttgccgatcatttcttgtagctcggttttattttccgggggcttaattttttggattgcattaacgctcctttgggttacctcaatccctctttcatgaacgagaaatcccaagaactggccagccgatacaccaaaagcacattttgtcggattcatcttcaagccatacttcctggttctctcaaaaacttttcttagatcagctatgtgatcatcaacttctttggatttaacaaccacatcgtcaatataaacttcaaccaacgagccgatcaaatcgtgatatatatagttcatggccctttgatatgttgccccagcactctttaagccaaaagtcatgacaacccactcaaataagccgattgcaccaggacatctaaaagccgtcttatgtatatcttcctcagccataaagatctgattataacctgcgttcccatccatgaaactcaaaatcttattccctgatgcagcatcgacaaggtgatcggctactggcattggatattcgtccttcggtgtcgctttattcaaatcttgaaaatcaatacataccctgaccttgccattctttttaataaccggaactatgctagaaacccactctgcgtatcggcaaggatgaataaaaccagcatcatacaatcgcttaatctcagccttaacaggttcgagcatatcggctttacatctcctcggaagttgctgatgtggtctaacccttggttttataggtagccgatgttcgacgatcgatcggctgagtccaggcatttcataatactcccaagcgaggcaatctctaaactcttttaggagctctatcagcttggctctaaactctaaagacaaatgtttactaatgaatgtcggtcttggccgatcacctggacctatatctatctcttccaaatcatcggccgacataaaaccttgaccttgcttgtcatcgagatcatctattgtatccttagcgtagacatctgaaccctccacaacgccctcaaagtaatagcttgggttctccatcttcgattggttgtatatcagaatcggacacttttagaaaatctccatcccagacttttccagataaacaatcaaggccatccatctcccaaagggctaaatcagcattggcaacattaactgacctgtcggctagcacaaccttatcttgtcaccttgccactgaatcaagcactgatgcatagttgaaggtatgcaacaattagcatgaatccaatctcttccaagcaacaaactgtatgaccccttaccatcgatgacaaaaaacgtggtaggaatagttttactgccgactgtcagctccacatttaaaacacctttggtctccgatggattaccaccaaaatctttgagcaccatatttgtcttgataagatcctcgacattcctacccaacttcctaaaccctacccaacttcctaaacgtagcataaggcatcaaattcaccgcagccccaccgtcgaccatcattttagacatcggcttcccattaacgtagccgtttacatacaatggtttaagatgccgattctccgttccctcgggcttctcgaataccgcctactctggtgataggactaacttggccgattcctcctctacttcatcaacatcggcctgattgattccgaattcggctggcagcgtaaagaccatgttgattggtgctgtaacaacactctttccttttgccaacctcttcgcctcatcggctgcagcatcatcggctgtaggagcttgattcttaacacgtcacacctgccttggtcttggtttcctcagccgatgattaatgtcctcttcagaattatgccatttacaatatctcctcttgcctaattctttagccgatggaatcatatggccggtaggaagttgaatctgcttttctcggagtagcaaatcgaacatcttatcggctttggtgatatcgaagtcatacttttcctcctttccaggactcttcaaccattgacacggtataacctttttgctcctcacccattccgctgcagctatctcagaatcatcgtcttcatcgtccgatccatacatatacgggcaaacgtgattaaccttcctggagcttctcctgacgtcagccgacctatgctcacgcaaggttaccttttgtatcagatgcgacaaactatcgaagtctttggacaagaatttctccctgatcggaggaatcataccctggaaagctagatcggctaactgggcatcggtcaaactcaagctaaagcacttgttcctcatctctctgaacctctggatatactcgtgtaggggttcatcatacctctgcttgatcgccgttaagtcagacaacttcatctcgtggaccccactgtagaaatagctatggaattgcttctctaaatcggcccaactattgaccgacccatatggcaaagatgaaaaccaagtaaaagctgacccggataaggataatcggaacatcctaactctcaaggcgtccacagccgatgcttcaccacactgagcaaggtatcggctgatgtgctcataattaagttgacacaccctcttgccctgagaacttggagaaatcagggattttaaaccgattaggaaggggaaccctttcaaaccacttgggataagactgccgatacaaactcccagtctcttttggtctaagcccaaattgctccctcattacatcagcaatgacatcagcccatggtcgttgctgagctgctccttgtggttgctgctgcatgggctcgaactgaccaaactgaggagtgaactgttgctgggccgatcccgctggttgatattgggcttgcggggatggaagctgacaatgatagctcaagtttccccctggtagttatgtagattcggctgaatgttgcgcaccaagtgctcaggaaccatctgaggtaccacggtgccatccggttgtgcatgatgaaccaaatgctctgggataacttgattcacaaactgctgcgcaggttgccccccatgtactgcaaatctagccgatgcattggccggccccaggcgctaaatcggctgaacgacctgcagtcgtaccggagtctgctggatcagctgaggtcgttgccttggcggtgtttgctggattggttggagatgctgctgcgttgatggtgcttgctgaactggctgcacgacctgttactggatcggctgtaccactggctgaattggtggtgtctgctgagctggctgcgcgacctgttattggatcggctgtacaaccggctaaattgatgacatctgttggatcggctgctgctgcactagatcaacaattggtggtggtggaaaaaacatagcagcaacctgatcttgagtcggctgattcgaggtttgtccagcaagctgtggatgttccctcattagcaatcgagggttgatcggctgagctgacgccgtggccgatgtagcaggtaagggcgttgatgctggcgctgttggttgagtcgtggatgcgacagatggagccgcctgcacaactggctgagcatcggtgatcaaagttcgataattcagaaaaacgccttcttgcaagtacaccgggcctgtagcctgatgctcagctatcgagccatcggctatcgttttcatcatgttcgacagtgtattgactaagacctcggattgattgatcaaagcatgatgcaccgcgtaatcaacccgatcttgaaagttgttgaaaaaatcttgtgctagctcaatattctgattaagatttcctccttgcggcccttgagcagaatcacctggagctccgtgcacttcttgagggttatcgccttgatttcctatagaaccaccgatagcacccttgttgctcggctgatcgagccatctggggcttgtttcacttctccatccttagaagaaccggttccagggctatcagcaaccagttttaacttgtacttctgaaccagcattcccttgcgggtttgcatgaacgagctcagatactgatcccgtgcttgctgcatcattgcttcaaactcctgcttctagtcaggcgtgaatttcttgggatcgatcggcaggacattgtcatcaatgatgtcagttaatcccggcttcggtaatttgcctttaactgagcctgggcttgatggtagtggtgcttgtttctcggccatgaggaagaactgacgcctgacttctaatcaggtcccaccgggcgtgccaaaagcgtgttgacagaaaacacgaggcctaggagatctgcttaactccagtgtaggtccaaaactcgccttcggatgtatgagcgtgccagttgatttgatcctgtaatcaacaagaaataaagacaaaagaaccgtagttaaacctataaatgatagccgatcggccaggtgccgatgacatatcatttatctttgagccgatgtcatttgtgcatcgatcggcaatcgtgaataaataaggaagaaaaactaaatctactcgatcggctgtagatgttaacgatatatactccttataccgatatatacttaaatcaagtgattgggatatatcggtcgccatgccgagacagtataaatcacttagaccgaaatatatattaataataggactatataagtttacaacataaccgatcagatagatctagcatgtatcggctaatactccgatactacgctatatcaggacattaaaacagatatagaatatcaagcaaaagcctaacacattcaaatacaccaatatcttggcataaagggcagtgaagcaaatagagataattatagttaaatcagatacgaccggctgaaactccgatgctattctaatcggcaactaggtggcaggctagagatcaatattctaagcacgacttaataggtcaaactcaattgatgcagcattaagtatgaaaagaagaacaatatctagacaatcaagacactagaagattcatagaatggtagatatcttatataatctggatcaacgtaaagatctaacctaatcggctgtcttctgcacacagatgttggccgatggtgtattagataacaatattgctgaagattatataagatatatgataacttgatgaattatacaataagattagagtgtcatgaagatgtaagcactaatcctaagagcacgatccgtcataacgaattttacctgttgttgaaaatcgaaaccgatgcagctcaacccgaaagtaagaattcgtcgaaataaaagcaaaaggtggcgatgcgcctgaattgtattgaatgtgtcttctttcttttacatagggctcggggtctatttatacccgagaaatacaagatatgtccatattggacacgactcttatctctaacaaactctaaaatatcacaagtctttgcggcagacttttgcctaaacatatctctaaggaagttacataaaatatcctaattaatagatacaattaccttctcaggactctatccatgcgtggcaatcatcttgaagcacatcaactcgaacccaatgttgcacacgggtcgtattgtcggaaccggctatatcagcttatctagttcaactcaatctcagccgatcctagccgtagccgatcaggactccagccgattcctgctctgttccaaaactcgatctccgcctccaactcttccttgattaaatcccctttcctgatacacatgctaccaaatttggttgttaacagttccccaagaacactagaatctggtttgcatatgaaggacatagcactttcgagcttcctggtgatttttggtttgacgagatcaattccaaaaaatatgacaaatccaaagaggtattctcaacagccatcaacccttgcatcatccctgtcggcatccaccaaggcaagaacatccagatgacctacgagttttgtcatccgacaagcgccacaaggcaatttggcatgggtcaactgccaattagcttattcttcaccgacaagatccaaaacagaggggaaattacatcactactcatgatggatcggctactgaaccttccaggacctcctttgggcagcatcaataatataaagctaaggatgttgagaagtgcaactttcgaccgatggtggatagagtggaaaaaacatttattcgatcaatcggcttccatgtatctgacagatctctttcctaaagttgttccccaggtaaacatcctctaatttgtcaattcggttaactgcaatctgatgtatcaatattaactttgtgtaaattctctcttttgcagacaacagatttttctcctctacatcacagtaatagtggtgtggaaatccaatatgctctagggcttctgcccaatggtggtggattatcccctcctgtcatcggctataatgcccccaagacctctacattgctgcacggcatgcctcgtgtgccgattgctcctattgctgggaagaagagatccaaatcggctactgccccatcggctgcaaagaagaaacccaagaagcagaaagctactacctatgacctgccagccatagaccaagatgtagcaaattttttggaagattaagcaatggcagaagatatagacgaagcggctgaacaccttagcggtacaagggaacaaactccaccagccgatccacctggtcctcaaagaacgccatcacctccagtacattccacttactagtcgagggtatgcatctctttttcacttgttgttcttatatttaaagctgatttctaaccttgtactttgcagaagaagaaagtagccaccaagaaaccacaaggggcagctccaccggttaacttccttaatcttgtcaactttctttttccagtttttaaccgatgctaacttgtacttatgtttttagccccctcgacccccaactcatgtttctgaatcaagtgaaaacactccatcggctgtaggaagtcatcatataggagaagaagaagaagaagttatagcaccagctccagccatccctgtaagcttctatcttcaccttttcaaatcatattggctatcatatgactctaattaacaatatatagccgtattcttttccagatcttagccgacatgttttcctttgacatccggcagttcatggatgaagaagaagagaccacaagcacagctttggcacctctagccgatgatgtaaaaacaatcttgctagatatttcaaatcggctagaaggttcgttggagactctggtaaccagctgtgggtctattagagatagactccatgaaatagatgacaaaatcccagatgagctagccgatgccattactccaacggcataccttgagcaacatcggcttaagcttgaaaaagctcagaagaggattgctgatcgacgcgaaagaagagaccttgaagcaaccatccaagctaacagagcttccatcaataaagaaaaggctaagctggatgaactggaggctggtccgagtgcaactcaagcaaacattgatcggctgaataatcagaagatacagctcctagccgaactagagcaatgcaatgcacaacttgctcttgaacaagcaaagcttgccgatttgccaaaagccattgaagatcaaaaatccaagttaaagacttctatcaaacacttgactgagctgaccaaatctctgaagccgatctctagcaccgatgcaactgatgcccaaataatagatgaaatagatcaaattaggcaaagggcgatatcggccatccaaagatatgtatctggatgagctaagtcgtataaattcaactataaacttgcaaacttttgggctgtaatgaattccaagttaaacttttgcctttaaatttcgcttttgaaatccaattccaagttaaacttttgcctttaaatttcgctattgaaatccatgtttttctatatctttgcccccctaattttgcaatgttgaagacattgataaaattataacttggactaagggcgatatgttaaataccggccatcatacatcggcaaaacataaccgattataataaaaaaacaactaagggcgatatgacttatatcggccatcatacatcggcagaacacaaccgattatgataagaaaaaatagctaatggcgatataacatatatcggccatctgaaggcgatgttaaccacatcagctttgcatgtatcggtaaacctcagccgatcatgaattaatccacacacttggatagtatttcttcaagtacttgccattaagcgctcatccataaacttcaccatcaagtccttgcaacatataagctcctttggatacaaccttatggatttgaaatggtccttcccaattcggtgaccatttgccgaattaactgtcacgtgttccaatcggcagaatcaatttccaaactaattctccttctgaaaaggatttattcaccacttttttgttataatgacgagcaactcgttccttatccatagtaacttttgaaagggctctcaatctagactgaactaggtcttctatttcatcagccatgagattataatattcatcggctgttatctcatcttgtaaacctatccttcttgagccgatcttaatctcccctggtaaaactgcctcatgtccataaacaagcttataaggaggaacttgaatcgatacatggcaagccatccgataagaccataatgcttcagctaatcttgtatgccattgccgaggataatcagaaatctttctcttcatgaatttgatcaaactcttattatatgcctcggcttgcccattagcttgtgcataatacggagaggaattcaacaacttgatacccatgctatcggcaatctgaacaagttcatcggacacaaagattgatccttgatctgttgttatggtctgagggataccaaatcggtagatgatatgttccttgacaaattgtatagcatcccccgaatcaaccttcttcaaaggaatagcttctacccacttaagaaaataatcggtcgcaaccaatataaatttatgccccttacttgaaggaggattaatttgaccaatcatatccataccccatcctctgaatggccacggcttgatgataggattcatagccgacgctggtactctttgaattgctctaaacttctgacaatcctgacataccatgtaatatcggaagtaatcctctaacattgttggccaaaaataccccgcacgccgaagcaaccacttcatcttatgagccgattgatgagtaccacatataccttcatgcacctctcccatcacgactttagcttgattggcactcaaacatttaagcaacacgccatcaaccgttcgataatatagctcatcatccaacaaggtttacttcaaaaccttataacgcaatttccgagaagccgattgcgatggattttgtaaatattgatacacatcatacctccaatcatcggctgctattgaggcgacttctacctcaatatctttcaccatcggcttatatccagatgccccccgagccaaatcattagcttcaacgttttgctcccgagacacatgctttaaagttaccagccgaaatccatccatcaattctcggcacttctcgttgtagaccatcaacacatcattcttgcattcatattctcctgccaattgactgatcaccaacaaggaatcacccatgatttcaacagcatcggcttcaacctccctgagcaattgcaaccccttaagaactacttcatactcagcctgattgttagttgcgtaaggtttaatagtataagcaaactcaaaacttgcccccaaggggaaattataaccaagccgataccacaaccatgagtgcacaccgatctgtcaaaaaaaaaagtccaaagcacaatgtcgaacgagccaattgtatcaccatgatgctccacaataaaatcggctatagcctgccctttcactgccttaggtgactcatactgaagataaaattctgtcaaggcatatatccacttttcgattctcccttttaaaaccggagccgatagcatatatttgatcacatcgactttgtataccacagtgcattcattggataacaaataatgcctcaactttgtgcaagagaaatataaacacaaacataacttctccactggagaataccttgtctctgcatccaagagcctgcgactcaaatagaaaataactctttccttgccttcgagttcttggatcaaaaccgagtcgattgacttctcaccagctgacaaatacaatttgaaaggcactcccttctatggaggaatcaacactggaggagaactaagatattctttaatattatctcaagccttttgttgctctaccccccaagtgaattcttgatcggctttcaaccttagcaaagatgtaaaaggttccaatctcccagataggttagaaataaaccttctaataaaatttaccttgccgatcaacttctgcaattgtttcttgtcttctggaggtagaatctttttgattgcattaacactcctttgagttacttcaatccccctctcatgaacaagaaagcccaaaaactgccaagccgatacaccgaaatcacacttcgtgggattcatcttcaagccatatttccttgtcctctcgaaaaccttcctcaaatcggctacgtggtcatctacctcttttgatttaacaaccacatcatcaatgtaaacttcaaccaacaagccgatcaagtcatggaatatgtaattcatggctctctgatatgtagccccggcgctctttaagccgaaagtcatcacaacccactcatacaagctaattgcaccaggacacctgaaagcagtgttatgaatgtcttcttctaccataaaaatttgattgtaacctacattgccatccataaaactgataatcttattccctgaagcagcatcaaccaactgatcggcaatcggcattgggtactcatccttaggggtagctttgttcaaatcctgaaaatcgatgcacaccctaagcttgccgttcttcttgatgactgggactatgttggaaatccactcagcatatcggcaaggtctaataaaaccagcatcatataagcgagtaacctcagccttgatagcatcatacatatcggctttacatctccttggaggttgctggtatggtttatatcctggtttgataggaagccgatgttcaacaatcgatcggctgagtcctgtcatctcgtaatattcctaagaaaagcaatatctatactctttcaaaagctctatcaacttggttctaaactctgccaataaattcttgctgataaatgttagccttggcctatctcctgggcctatgtcaatctcctccaaatcatcagccgacatgaaaccctgtcctaacttgtcatcgagatcatccaccgtgtccttggtgtagaaatttgaaccctccacgacgccctcaaaataataatttagagtctccatcttcaattggttgtatatcacaatcggatacttttagaaaatctccatcccaaacttttcgagtcccactgggcgcgccaaaagcgtgttgatgtgaaaaacacacactggcctggaagatctgcttaacttcagtgcaggtccaaaatcttgcttttaggttcgtaagcgtgccagttgatttgatcctgcaatcaacaagaaagaaagacaagaaaaccgtggttaaatccataaacgacagctgatcggctagttgccgatgatatatcatttatcttcgagccgatgtcatattggaattgatcggcagttgtgaaaaaaataaaatagaactaaatctactcgatcggctgtagatattaacgacatataatcgttccttcgatgtatatttaaactaagtgattgggatagatcggtcaccatgccgagacagtataaatcacttaagtcgaagtatacattaaagtactgattatatagacgtttatagcatagccgatcaaatagatctagcatgtatcggctaaaactccgataccactctacattaagatattaaaacaagcagaatatatcaaacaagaagtctaacattccttaatgcaataagatcttaacataaagggtggatctggcatatcaatcaagcatataaaatataaagttgctaaatcaggtaagatcggctgaaaccctgatgctatctccctcgatgatcataaaacaagccagatatcataattatagatattacttaatagatcgaactcaaccgatgcagcattaagcataaagacaaatataagatctaggcaagatgatgaaaacttctaagagatggtagatacatgatataatctaacttaataacgaaacataaccctatgatataatctaacttaataacgaaacataaccctatcggtcactccctaacagtaagaaccagccaataacaagttatatagcacaactaataaagattacaacatatatatgataactcgacggattacataaacaagattagagtgtcataaagatggaagcactaatcccgagaacacaagccgccatgacaagtttacctctagtttaagaccgaatcgatgcagctcaacccgaaagcaagaactcgtcgaaatagaacaaaagtaaaaagggtggcgatgcgccgagagtgtattgaactgttgttgttttttacattgggttcgggtcatatttatacatgagatacaaaatatgtccttaccaaacacgactcttatctctaacaaactctaagataccataagtctttgcggcagacttttgcctaaacatatctctaaggaaatcatacaaaatatcctaattaatagatacaattgcctttccgcgagctttatctctattgttgcaatccttgtgaagcacgttgatcgactctagaaacaaccttgaagccattaccgtcagaatcggctgcaccacctctatcggctgtataggctgtcttctgtccgatccatctcagccgatgcatactctgttcttcgaatctatctctttgccgaatccgcttcgattccaatgtcaaacatggttcatatcttaccaaatgtggtcgttaacaaccattaaagctacatcctccattttcagttttcaattcagcatgatatttttttatgttattttcaaaatatcaccatattaattagtattcattcccctaagtttgttttttatatgtgcataagtgtaaatggatattgatgcatgctttcacgcacacaaccctttagaaccaacatacaatattttgatttgttctatagtaagtagtggaggtggtacatgcatcgagtgtattataagagtaaatatagtatggaagagttacttgtcattggatattatttatttctcaacatgaaaaactcctactttggaaaaagttagtaaatgttcagaaaatggaggaatgaggggaagggaagggcacggtggaaaccctaccacagaaacatgaaaaaggacatcactataggtgtcaaaaatgcaaaaatcgacatcccgtctgagccacacgcctgtgaggcgtcatccggtagaaccggcactttttagagagatagatgctggtttttaataggaaccggtacctatgatttttagagagatagatgctggtttttaataggaaccggtacctatgactcctaccagataaaggtgttggtttctattaaaaaccgatacctttatgtcccatcaaagtagttgtcagttgggctaggataaaaatgacggtttttcaaaagaaccgacactttcaggtgaggagaggagccgaaccaaccggctcgatcccgtttctcgcagtcgccgttcttattgttttctccgcctcctcattctctatcttgccactctcattctctatcccggcctctctccaaaccaccacctcacctcctcttcctcctcctccccttgcctctccgctcctccccctcgccgccaccgtcaccaacacagccgccaccgcacttgtaggagcaacgtgtcatctccggcggcggcaacaggggcgctaattctatgccgggggtgacggcggctatggcgtggggcgagcgtggagcctgattgacgacaacctggacgttgacgggggcttgtcctcgcctgaaccgacgacggggacgcgtccatgctaggggcaacaacggtgtgggtgagcaacccctcctctctgccccttcccaccggcgcttggggcggccaaatccgatgcctcccaacccagctccacgccctcttcggcccaacgcgacgtgcgaagcaacttctccacgatgatgagtgcaggttactccacgacgtgcggatggacttcattttttttctgatttgtttatcttgtacttttacctttgatgcatgcaaataatttgtgtcatggattttgattggagtgatggaattcttcaattgagccaaaatttctttgatttgtgatgcagatggatgtgggatggatggatggtgatatgtagatgtgggataggagctgctcgatgcatcggctagattcgagccgatgcattaagcctgattttttttcatattcatgtagtccaccttaaaggtggtctgtgaggtaccagttaggaaatccggcaactaagaagtttctttagtagtgaaataagacgccatgctgtggagcaaccggaggaaggtgcttgatacgtggaaaaccttcccattgttaggtcgggacacacattgtcgaaggaagcaacgccgggttgccaccggctgccagcgcagaggagcctcggagtcggataccatggaagagtaaaggactttgtgtggcctttttttttcagaaaagccctctatttgactgtatatgattttagactctttatttaataggaaaaagttcaaatatagtttagatggatgaaaactttaaaaccgaacatccaacccgtgaattttacaataccatctatgttactctttaaggtggttttgcatatctggtatcttaaacaaacggctttaaataagtattatagtatatttacgtatcattaatcctaggttgtcaatttatatatatatatatatatatatatatatatatattgcaatgtcatactattgttacgctggtatttttcttgtgagtgagagtgaacaagggtaaaaagatatatttaagtgaaaatttttcatatttgtccaatgagtatgtgatgtgatcaaatcttaggcaacttatatgcaaagaaaataaaaactactttgtaaaaccaccttaagggctgtacgaatggtattgtaaggtttaaagggttgaatgtccagttttaaactttaaggtgatagatggacttttgatcaaattttaggggattatttgaactttttcctattaaataaagttcatgagttcgttagaaaaaagggtaccagtgcaagtagttcagaaagctagagaggcctctctgcgttcagaacaacattgacagtaaggcaaagtaagagcatgcatatgttgctgaatactgcaggcaactaagattaaaccaccatagtattggtaacttgaaatgaaatgaaaaggagcttcagtgttgctgtttgtcatacacaaaaggttaacggattaattctcttttttttaaacacggtacaaaacacagacactcacaatacgcgcacactcatccctataagcacacactcactatacctatatgagtatctccagaagactggacagcactactacacaaacaatttttttataaggccccatgatttttgtaaatggaccataactagtcgcgtctggaaaaatcgagaggcattttcccatacggctccttaagtggcccgcatggaaaaatcgattttttcatgcaggcctcttaagaagtccgctgcatgtggatcacttaagagcccgtatggaaaaattgattacgggccatttaaggagccgtatgggaaaataaaatttgaaaaaaaaaataaaactagtttatcacactcatataaattccaaattggatgattctttttcctaaatgtttctaaaatcatgctctatcatattattgtgttcttactgcatgcagttattttggctatttttttcttgtgacttcattttatcaactaaaaatttgaatttcaaaacttcaaataatattttgaagaagtaaatgatttcagctgaaaaagtcatcaacaataaaattgtataacttaccaagatttataacttctattttggtcatttcttcatccgacaaagtgatagtaatattttcacaaaatttacatatctctcttatatgttataaaactaaataagagatatgtacattttgtgaacaatgttacaaaccactttatcggatgaagaaacgaccaaaataaaagttatagatcctgatgagttataccactttgttgttgatgattttttcagttgaaatcatttagtatttgaaaatattgtttgaagttgtcataatttgaaatttaaattcaaactgttgaaacaaagtcatatagaaaaatgaccaaaacaaaagttgtagatcttgtttcgttttacaactttgttgttgataattttttttcatttgaaatcatttactaccaaaaaattatttgaatttcttatattttaaaattcaaattttatatagttcaatcaaactcggatggtgaaattaccaaaagaaaaatggtagatctcaacgggttctacaactttgtttttgacaactttttcacatgagttcatttagtatgataaagttcattgagaatggcgaagtcatcatagacacatctctgtcgacaaaaacgttacttaccgctgagagaataattagccgtaaatatgagtatccgtgttaaatataagacttgaactcgggtgtgttggtactaccataagtaaactaaccgactaagggcatgtttagatcccaccccaaaattttacgccctgtcacattgaacgtttgaacacatgcattaagtattaaatatagactaaaaaataaaaataactaattatacagattgcgactaatttgcgagacgaatcttttaagcctaattgctccatgattagacaatatggtgctacagtaaacatttgctaatgatggattaattaggcttaataaatcgtctcgcggtttactgacggattctataattagttttttatttagtgcccgatcaatccatgcgacaccctatataatatccgatgtgacacgccaaaactttacaccccaagaactaaacaccccttaagctatactcacttcgtgaattaattctgtctgtatgaaaatagagtaaagattcaacacttccagaaggaaatatcctattatctagggacttgaggagtggcagacatgatggatcaaaccgactaccccatagatgtctccattggtcactatcacaagcaacagtgactttaaatagccagctaaaacatctagcagttgatattttcaaacagctaatatcaggttaaaagagaattatgtgggacttaaaaattccactaaaaatcaagatttttatgtggtttcttcacaagaaagtaattctaacgaaaggtaacctggctaaaagaaaataggggggagacaaacattgttctttctgctatgcacaacaaacaatccaacatcttttctttgagtgtcatgtcgctcagtttgtttggagacgtgtgttttttgtttttaatatccccccggcccaccccataacgccaaaaacatttttggtaattggcttagagaggtatctaggtccattaagaagatgattctaatttgagctagcgctgtatgttggtcaatttggcgttgtcacaatgataaagtttttaatggtaaacaattatctaaccctatacaggttatcttcatatcttcctactggctccacttctggtctacaatgctaccacaggaggagcaggatactatgcgcaatggtgctatactcttggaatcggtagccaagggtctcttatttcactatgggtggcgtagttccataagaattgctagctaaaatattttatgtgatttaacgctagttaataataaatgggagttggggatttgtcccatcaccttatttctcattttgatttacttttatcttacctttttattactattaaacttatggttgtgtgtcttataacagaagccgaagatggaatctatttccattatctaaaaagtttaaatagggttacaacagctaaattatttataagagtaaataggtaggtcctcttcaacctagccctcttcgaagatagtggcagctatacagctgtagcaggggaaataaaaccttgacaaaactataggccggattgaccaatatgacgccggattggtgtcgccagtcgccaccgatatggacacagatcgacgtgtataactggtcaaatcaagcactaagtacgtcctaattaagtatcaacaaaagctgcattaatcggccacagacctctagaaacccctagcttcgtgcgacaaactgtcgactcgaaccaccttcagccgagaaattccataccttccaccgacttttttgtgtgtggctagaagatgatgctttccaataccgattccaataccaagtacttttcttcacaatatatgaagcccataaaaccgaaatcgatccaaacaagtaacggattgagcacactagcacaaaaacgttagctcgtgaaatcttaacctatatgctcaaaccctgagctcacacttttaatgtttcgaataaaaagtttctcgattttaatgggatttttcctttccgattaataataagtttgtcaattaaaacaaaaggtttaatctgtgtattcgtgcacgatgattcacatgttagaaatgaatgttttcttttagattttttttagcttttaggttaaattagaaagtgttggtagcatcagataagcaaatctacatggaacacgggatatacaactattgaagggacattaatttcgttcttgccattgcactatctttattttttttttcctttgcgatggacacggaaacaaaatgcaccgtttgtattgctcttgtagctgccatttgttaggtcattgaaattgactcggtgacataacaaattaaaatcgtgattttagcactactatgaatatgcatctctggcggccaaatcaaaatttctcttgccgttggctgctatgactgctagtctgctacttcctccgttttgaaatgtttgacaccgttgattttttagcacatgtttaaccatttgtcttatttaaaaatttttgtgaaatatgtaaaattatatgcctacataaaaatatatttaacaatgaatcaaatgatagaaaaagaattaataattacttaaattttttaaataagacgaacggtcaaacatgtgttaaaaaatcaacggcgtcaaacatttcgaaacggatggagtactaattaatggccaaagagaatacagtatttttcattggcggtagtcaactacacatgtgggatagaattttcacaatcaggcgactattgccagcagcttgtgaaaatgatcttcgcagccggacagtgacgaaaagaggccacgcgatttgacctgtgatattttcacatgaggctaatatatattacatcaatgtacgtccgtttgtgatgatttcacgttaaatttgatttaaatttgttgacaattttaattattttcttggttcacgtactatgaattttgaatatatagaaatataccatcaatcttcaccggcatacttaataccactgaaagatatatattagagcggtataaaacaaaagagagcaatccggtatataactattcatttgatcataccagagaatatacaggagttatttttcatgaacaacacataaaaaaatcatgtctgatggccattccatattaattgtcctgtactctacaagatatttatcccgttagttgctgccactagcaaactctcgtcctatatgctgcaactttccttagttcttgatcagaattccaagaatctcttatcttatcgtatatacctacataattatgtaattgggaaaaaaacccgtaccatattggaaaataaccagtggttcacttctagctaggcttaatcacaaccatcaaggtatatcgtgtgtgctagccattttgtatcaattatacctttaattttcattcatcattccattatctcacctttaacacaataatgcttttttttgaagtgctattacgtggtatcaaagtagtatttctatataattagaaaataaaaacttaatatgcattgggcaaagaagaccagttggatcacgtccgtgtgtttattatttacaaccatcagtatgttctgggctaaccattatgtattaattatatagcttaacatgctttgattatttaatcacctcacctttgatttaatgctgcttgaatcaagtgttattggaatgatttataaaatctcactagcaacgtgaattctatagttacaacctaacatgtataaacaggatatatccctatccactagcaattattataacttaaaacttgttgtgtcatctataatttgttaactttttagctcaacgtggaagcaaattgaatcatcatttctatatcattatcataatatttcaatatatattgattgatcatttctataatatttatcacatatttatctatgtatttcacagcaaagagtagaatataatctactatacttgtataatttcccccaatagaaacccaatttaaaacatattatactgacttgattattataagataaattaaatatttttaagaaataaacgtaataaatggttgtgttcttttccatgagttcccaactcatctctttcgtttttcgcgtgcacgttttttaaactattaaacggtgcgtgttttgcaaaaagtttatataggaaagttgctttaaaaatcatattaatatattttttaagttttttatagctaatacttaattaatgatcacgtgttaatctattgctccgtttttgtgcgaaggggaggggttccaacccctccaaaagaacacaccagtgttctaaagaataaagaatacagtgaaagatttttctttttacaaaacatattttgagcttggagccacggactgaaaagaacttctagtcctagcactcccattaattgtgaaggataaaggccctgtttagtttccacacaaaagttttacaccctatcacatcgaacgtttgaacacatgcatgaagtattaaatataggctaaaaataactaattgcacagattgtaactaatttgcgagatgaatttctaaggctaattgctccatgatttgacaatgtggtgctacagtaaacagttgctaatgatgaattaattaggcttaataaacttgtcacggtttactgacggattctataattagtttttttttattagtatcggaatatcccatgcaacaccctatataatatttgatgtgacacgtcaaaacttcttaatgtaaacacccccaaagttatgagttctctgaaacaaatcaagttacctacgcttccacggaaacacacaaacatgtgagggcacaccgtgtactgtactcggtgttacaaggatttataagggtatgtatggtgcattcgtgctgctgaacaaaaacccatccaacgcgaactaacgcgtgcacgattaatcctagaaaaaagggaaaaataagcattaattccactatctcctacttaaaattttgttttattttacaatttagatcaaattttctgttatgccataatttgctatgatatattttttctcgtcgtgatacaagttttttttccacatagcatagactcggatgaaactagagctaccccgatcaaacggtagatggccactaggttttttatgtgttttatttatggatgagtgagagattgaatgacactgaatgaatattattgtcgaatgattggatctagctaaaccggttgagctacatgttgtattccagatcgccagacacgcatgcaattagaattaaaaaaactaattaaagatggatgaatgtgtcctgtacacggtgttataaggatttaattataagggtcaggcgtgcacatgcagcacccggtatcgtcctgttgaaccggaaactcatccaccgtggactgacgtgtgcacgattaatcccaaaagaaagggcaaaataatcattaattgcactatcttctacttaaaattatttttttatttctataatttatatcaaattttttgttatgctataattatatgttatgatatatttttctcgttgtgatacaagcttattttccctaagcatagactcagatgaagttagagctatggaagattgccgctggggtttttatttgttttattcgtggatgagtgagagattgaataaccactaaatgaatattctcgaatgagtggatctagctaaacccagttgagctgcaccagagcgccagaaagcaagacacgcatgcatgtaattagaattaaagaaaactaattaaagatggatggaccgaagtagatgaagttgggcaggagggcaatatcgatctctctcatcaatagtcccttataaaattagcatgcagctcgctataaaagggatggccaaacccaaatactgagcatccttgaagccagccagctcgctcgctctagactctacctttttcgctttttgctagagatctagccactttctttgatcgacatatatatccatcgagataaaaggagatagtgacaagtaattaacttagttttttccaataacgaaataaaatagtttctacgtcttttccacctctgccagcagaggcgcagccaagtaacttttaattatagttataaattaatacacagagaatgggtagccaagaatacattaagcagggcgggcagcagctggtggcggcgatcctgggcatcggcacggctgttccaccctacgttctgccccaatcctccttccccgactactactttgacatttccaactccaatcacctccttgacctcaaggccaagtttgcagatatctgtaagcgtacttgtttgtcgttaaatactactactgctacttaatttctcgttttaaatatatattacattattgacatgttgttatatcaccatttattttatttaaagatttaaaatcattctaaagctggttatactccgtaacaccagctaaataatgcttacacttttattcaagtaagataaacagttcactgatcatgcctagtgcctcaattatcatttttagcatgtgttagggacgcgcacgtatgtgtgtacgtgtattgtggtatgagtgtggtgtgtgtatgtgtgttaccctcttaagataaagtaaaatattatgtcaaaagttaagggcatcatatatttaaaaatagagatagtactgcttagttattacatatttactatcctctccgttctactgtatgatgtgttgaattttttcataatgtttaaccattcatcttagtaaaagaatatgaatatcatttgttgtaacttgttttatcattaaaaactataatcttaacttatgcttttatagagaaagtgtattcatccatcgaggggatatcccctagtttcatgcatgtcgtttaaatagttataaaaaattaaaataaattgacaaaatagattaatatgaaatatatcactccacaagcatacaagttaaaattcaacttatataaattatatcagaaataataaatatttttagtttaattttttttcgttgcatcttggaaaagtcaaatttagccttgcatgttcgtggagtgatatttttcatattaatttatgttgttaagtttacatatatatatatatatatatatatatatatatatatatatatatatatataactatttagatgatatgtaagcaattaggggatattctcttgagggatgaaaatccaaatccgcttttatatatatgtttgtaccaggggcgaagccaggattggggattaggggggagtggggtgaagataaaccatgagaccgaataactaatattaatagcaaaggaggtcaaatagtcaccgtcaataacaatcaatgcgtaaagtagtcctttaaaaaaacatgaattttagctctttaatgatatcattgaaagtttgaaactagtctttattgctaaattcttttaatgtaaactattgaataatctcacaaataagtaccatctattttactttgaaaaagatgagaattcacaaactaattttgtagatcatgtttcttgctaatatttttagacttgctaactaactaaactgataatactttcaagctatacaaaaacaaactagataaatatacttatcttagctaaccttaatataaagtaaaaatatgaggggtgtagtggtggtggtatttggatagggcctttggcaacccccttaattagctgcgctacttgtttgtactaaacttttaataaagtaaatgatcaaatattatgtgaaaaataaactgccatatagtttaagacaaggataatacgaggaactcttgcgccatacatacatacatacatacatacacacatacatacatacatatatatatatatatatatatacatacatatatatatatatatatatatgtatatatattttccaataaatgatgagctacaaaaggattcgttttttttcgtgtcacagctgattactcctttttttccattttaaagagtggcattcgatgtccaatatctcgatcgaagtatggaggtcagaataaatagaataatgatatctttcttcggagcagtttcttttcccgtcctcctcaaaaaagggcgtggaaacagatagaaactcttgaatggaaattgaaaagaaatgtagccccagttccttcggaaatggtaagatctttggtgttgatttggcattattcaacaagaaaaaaatcttatatatatatatgacactatataggacactcatatggggcaccatggtattaaatgcacaaaatcactcaaatttttcaaaattttcaaattgtgagtatatacctagttataataattcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttgaactagttagtaaagtggttaatgttaatacctaagtaattgaaaaagattcatactcatttaaattgggtatatactcaatttcaaaaatggtgcccgggcaccatggagcaccaaacaaatttactatatatatgtatatatatatgtatatatatgtatatatatatatgtatatatatgtatatatatatatatgtatatatatgtatatgtatgtatacgtatatgtatatacatacgtatatgtatatatacgtatatgtatatatatacatatacatgtatatatatacgtatatgtatgtatatatatacatatacgtatatatatacatatacatatatatacgtatatatatacgtatacatatatacgtatacgtatatatatatacgtatacgtatatatatatatatatatatatatatatatatatatatacacacacgcacacataatagaaggattttgcaggtgagaagacaatgatcgacaagcgtcacgtgcacatgtcggacgagttcctgaggagcaacccttccgtggcggcgtacaactccccctctatcaacgtccgccagaatctcaccgatgtcactgtgccccagctgggcgctgccgccgcccggctcgccatcgccgactggggccggccggcgtgcgagatcacccacctggtgatgtgcaccaccgtcagcggatgcatgcccggcgccgacttcgaggtggtgaagctgctcggtctcccgctcaccaccaagcgctgcatgatgtaccacatcggctgccatggcggcggcaccgcgctgcgcctcgccaaggacctcgccgagaacaatccaggcggccgtgtgctggtggtctgctccgaggtcgtctccatggtgttccgcgggccttgtgaatcgcacatgggcaacctggtagggcaggcgctgttcggggatgccgccggtgcggtggtggtcggcgcggatccggtggaggctaacagtgagcgcacgctgttcgagatggtgtcggcgtggcaggacatcatcccggagacggaggagatggtggtggcgaagctgcgggaggaggggctggtgtacaacctgcaccgcgacgtggcggcgcgcgtggcggccagcatggagtcgctggtgaagaaggcgatggtggagaaggactggaacgaggaggtgttctggctggtgcatcccggcgggagggacatcctggaccgggtggttctcacgctcggcctccgcgacgacaaggtggccgtgtgccgcgaggtgatgaggcagcacggcaacacgctgagctcctgcgtcatcatggccatggaggagatgcggcggaggtcggcggagcgggggctgagcacggccggcgagggcctcgagtgggggctgctcttcggcttcgggccaggcctcaccgtggagaccatcctcctacgcgcgccaccatgcaaccaagcccaagccgtctgatgtgattctctcatccatccatcctccttccgttcgtccgtccctccaatatttggaaaatatatttttctcctaaactatttatccgatcacaccgttatattcgttataattaaacttttacaacaaaatatcatatgattatattccaataaaataaaaatatttgtttcaaaccattaaaacacaatgtttcatgtttcatatgtaatagttatatctttcaatgtgtatcatcattgtgttcctcaaaattcacagaactacatgccactactctctcctctctcttcactctaatcttcaaaatgatttttctcttaaaaaacttattcaatctataatctgatcacaccgttatattcgatgattaaatcttacaataattaagatatcgcatgactatatttgatgaaagaatagcaaatgtttcaatccgctaacacttgtgtttcatacgtgatcaatgtgtatcttcaccgtgtttcataaaaaaatttaaatgtttcagttttttttaccgtatataacttaatgtttcatttgttggtcaactgcaacatttgacattccaatttattttagagggattgggcgatcgatacgtagcttcctccaagtatttgctccaatatgtgtataactcacagcacatgcctacgtgtgtacaatacatgccaaaagtatatatatatatatatatatatatatatatacactagcaaaaatgcccatgcgttgcaacgggtaaaaaaattctaataataatatacgtttttcacgcataatcatgtcaatgacaatatttctattttaatgagcggcttgttttttataaacagtgttttttttcgcgatttctcaaaccatttttcagaaatggcgcatttctttctaacagtttttactaccatgtttttttatgctttttttacttacgaagaaaaccatatttttctccctttttttgctttccttttctcgtgtgtttttttcttgttttctcacatgtttttttgcttgttttttttcgaaggttattttttgcttttttctaatacatgagaatatatgacgaaataaagccatgtagtagatggcaaaaaatcgatggatcctatccgactcaagcgtccatcaatttagcttttttctgacagttttttcagagcgattttttttaacagacggtgtttttttcttgcatggttttttaaaaccatttttttagaaatggcgtgttttttcgacagttttttccacgcatgttttttaaaaatattttaccgacaatggaaataatttttctcgcgcgtctttttatttttttattgacgatggaaaacctttttagcgtgttttttgagttttttttctaacttttgcctcacacgttattttaaccgtttttattttctcatgcattttctcttttttgaaatagttagattagagatagagaagagatatatactggttagaaatcagattttgtttcgccctttccattttttttctctcttgcaacttttattttatacgaaccagctttttattttttacgaaccattttttcgccattttcttagggaatcgaacgaacttttttagataggaatcagacttttttttccgtttttaaaagattcggatctagcgttttttttgtcaccactttttttttgccttttatatgaatcagattttttttccgtcggatctacagtttgtttttttgccactcaggggaaaaaacttttgttgttgttgtttttctttattttgttttttgtgcagcttttatttttatttttatgcacctttctgcctttgttctctttctctttttttattttttttaacaaaaactacctcaagtcctcgagtagcttgttgcaagattatagggactcaaatgtaaatataaaaattacggggactcaaatataaaagtaaaaatccaaaaataaaaatcatattaaaatggaatgctctcgacatgtagattccgtttttgcaaacagatcttcaatctggcacatcaatttttttcaccaatctgagtaagactttctttttggcttttctttttctttttatgcatctttctgcctttattctctttctcttttattattttttttaacaaaaacgacctcaaattgcttgttgcaagattatagggactcaaatgtaaatataaaaattacaaggactcaaatataaaagtacaaatccaaaaattaaaattatataaaaatagaatgctctcgacatgtcgattctgttttttcaaacagatttttaattcgacacatcaatttttttcatcaatctgagtcagacttttttttttttgtaacagcgaatctgataaaggagtcggactttttttttcactattacggatataggagtcggactttttaattttttttgttattttttttacggacgaaggaatcatcttttaagtagtacataatttttggttttttttgccccttttttttggatcggacttctttttttcgtccggtttttttatcggacaaacctggtttttttttcatccggttcaaacctggttttttttccatccggttcttttggtttttcacccctttttttttctggatcggacttctttttttcgtccggtttttttatggataactttggtttttttttcgcccctttttttctggatcggacttcttttttttgcactttttttcgcccggttttttatctgacaaacctggtttttttccgtccggttttttttcccaccccttttttggatcggacttcttttttcgtccggttttttctgcccggttttttttcacccggtttttttacagacgatggaagcacttcttatttattgtttatttattttttaagtagtagagatgtatactaatattgaacgtacatgcacgcatataataagagcatctcataaaaaacaaaatgcataagactacggaggaggggatcgagtatctgtcatgtgatgtgattgaaactatgtattttctttcagaatataaaaagctttagagtttgacacgattttaagaaaatagataaaattaaatagggagaggtcatgattggttgagaaggggaagtaggtgaaaaatatgaatggtggagaattaggattggttggggagggaatgttggtggataagttgttatatttggggataaatcttaaatattaaaagttgttatattttggggtggagggagtatttggttgaaacctatataagcaggatcgatcgatctctgcaaaatttgatataggaaaaaattaaacaaacccacttcatccagccaaaccctcttgccttgcattggaagctttttccttttttttaatctaaaccacttatgcgcaatactgttcaatttctagggtacattatattttgtattatagaagaaaaaggccattaatttcaagccgtttggatagcattggacgtgttggtcatacatgcatgtcaaacacatagaagagcccaaacagagagagagaggggggtggtttgatcgaatcatttactttatttctttctgccatttaatctttctaatttttttatttttaggagtattttatagacatacgtgatatatatatcaatgtatagttagtgtacttgcttcaatgtacatgatattaggcgtggagaaaaaaaatccgaagaccgagaaccgaaccgaagaggcggtttgtccggtcatcggttgattgttattttcctgtagttcggtgtttggctttttcttcagtgaaccgacgagaccgaagaatccgatgagtgttcagccaatccaaaatgctcgaggcccactaacaaacgtgcgcatcaagcccaacttttactgtggcccaaaaaatacatgacagctaacagatccaacaaattctattccctctctccaaatcaagcacaggccctcgggcagagctgggtaggccgtgtgtacttgcgggaagtcgaccgcagtgtacggcataggttttctcggtaaaaactgaacaccgaaaaaaaccaaaccgatattttttggtttattttgctcggttgatattttttctagaacttcctttggtttgcattttacaaaaactgaatgccgacacaaacaaaaattgactgagctttctgcacgccggactgggacatattatttggatctgcttacatggctgctttatcctcatcaagtttggatcatgctcctcttttcttggtgggctgtgaacagagggaactaaatacctcttttcgttttgaagcttactggcttaaattccctgagtttttggaagtagcctctgaatcttggaatagaccaattagaggatcaaatccctttgcaaagctcaacttgaaactaaaaagactagcaagagatctgaagagatggagcaaatctcggattggacatcagattgcagtatgcaatcgcaaatgaggttattttccaacttgacgtggcccaagaagagagagctcttacagacgaagagcttctgctgaaatctactctaaaatctagagttttaggccttgcaacactagtgaagataagaataagacaaagagccagactaacttggttaaaatgtggtgatgttaattcaaaattcttccatttgaaagcaaactcaagaaaaaggaaaaacttcattccagctctaaacactccctcgggtatagctgtaaccacagaacaaaaggaggctgaacttgagagatatttctcccagagattagggcagtatgtcccatgctccttaactcttaattggtcagaattaagtctcccttcccttgatctgtcggaactggaggaagatttcacagaagaagaattaaaagaagcaatatcaaaccttcccccaaaaaaacacctggccctgatggctatatagggcttttttcaagaaagcttgggtggtgattaaatcagatttgctacaggccattaaccatttcagctctctgaactcagatagattggaagacctaaatttagcaaacatttgtctaattccgaaaaagggtgaagcaacaagggtggaggacttcagactcataagcttaatgcacagcttcgccaagatattagcaaaaatgttggccaatagattggcgcctaagcttcatgaactcgtctcaccaaaccaaagcgcgttcattcggaaaagagcaatacatgacaacttcttgtatgtgcagaacatgatcaaaaacttcaacagaaagaaaaaaccgatgctttttataaaggttgatatttccaaagcctttgacatcgtaaactggccgtatttgctggaggttctgcaaaattttgggtttggacagagatggagaaattggatttcaaatattttaggaaattcaagctcgagaattatcctcaatggaatccctggtaaagcaatttggcacatgcgaggtctaagacaaggggatccactctcaccgatgcttttcatactcgcaatggaaccgctacatcagattttcaaagcagctgaagaagcttctcccttggcaaagatagacccaaagcgtagtagattccgatgttctctctacgcggatgatgtggctttattcatcactccatctgagaacgatctgatagcggttaaacgcattcttgagacttttgcacagatcagtgggctacatacaaacccgggcaaaactgagatttaccctattgcttgcaacaacttagacctcgacaatctcctttcctctttcatgggaaacctgaagactgtcccttgcaactatcttggccttcctctgcatacaaagaaactgagaaaaattgatttgcaacctctcttagacaaggttggagcaaggataccaggatggaagggacgctttttcacgtcagcagggagagaggtcttagtaaaatcaactctttcagcaacaccaatttatcattttactgtgctgccacagatgaaatgggtgtttaaaagaattgatcgttacaggagagcttttctttggaaaggtgacgacccggagaaggttagtgcaggcagcagccttgtcaactagcaacaagtttgcaaacctaaagacttgggcggtcttggcattctaaatttggaaaagtttgctagggccctgaggttacgttggctctagttcaattggaaggaggaccaaaagccatgggcaaatatggatcttccatgcgatgagatggataggtgccttttcaaagctggaacgaagataactgttggaaatggaatcaaaacatctttctggaatgataactggatggatggacaatcgccaaaggatatagcaccagcaatctatcgattagcaaaaagaaagtcaaacagtttaaagaaggaattagaggataatcactggcttgaaatgctccacccgatcacttctttagtggaaattgaagaattaatccaactaggaggtttgttacaacacattaatctagttgctggacaaactgatgacatttcctggagatggacagcgaatggacaatattcagcaaaaagtgcataccttgcacagttccaaggatccaatgctttaactgaatttacacctttgtggagcgcgtttgcggaaccaaaacatcgtttctttggatggcttatccttcatcaacgaactcttactgctgaaaatttgcttcgacgtcactggccatgtgattggatacgtagtttgtgcaatagtgcctttgaagatgcagcccaccttgcaaaagaatgccctttcacagtgaccgtgtggacgcagatttgtatttggatgaattttcagctgcctcaacatcatttgcaaggaaatctatcggactggtggagcagtttctgcactatttcgccaagacaaaacaggaacaaggttctgagagctctcatcacaacatggtggaacgtttggctagagcgaaacagaagaatttttcaacagatttcaaagaatgaactccaagtcgcctttctggtgaaggaaaatatcgacctaattgagcaatctaggatctgaccccgtcatgatcccctttttcaagatgtttctcaatacttcatgttgtagctgatgctccttccctccccacccctgtgttcacaggattcttgtttgtactttaactaaatttttattccttctaatatatccggcaaatctccagccatcttaagtttcaaaaaaagaatgccaggcaacccaaaaaaccgatccgattaaaccaagcaaacccacccctacgtgatactatcatatacccctgataatttcacaaaactatttgtgcagttgtgctccttagcgtgggagatgctgtgattagcggtagcggccggcaaggcccaaacaacattgtctcccttgagtagcctggcagcaatcgaatatagtataagtatatgctctctccgtttcacaatgtaaatcattctaacattttccacatttatattgatgttaatgaatttagacatatgaatgtgggaaatactagaataacttatattgtgagacagagaaagtagtatacatgaacccactacagaatcatgaacattaaatccaattgcgatcaacatcttgacaaattgttcaccacacaaaagtaaatcaacacaatgatttcacacagtaatagacccgatatatggagaaaagtacctaactttgttttcctgtcatcagatggaatggatcactactagaaaaaaagatttttccaggcggcccaaaaccattttcacaggaggggaagaggatcgccgctaccatctcgactgtgaaattaaaccattttcgcaagcgcgcccgtggcccgccagcgaaaatcatcccaggaaaataaaaaaaaccacggggcaccgccggccagggctcccctccacccgtcgtcgtcggcgccgtcgtcgtcgtcatcgtcaccgtcatcgtcgttgtcggcgcggcggcggagggggcgaggagatgaagcggctggtagaggcggcgaggagggaagccggcggcgcacggatctggagccgtcgtcgtcgctcgtcgtggccggcagcggagggatgcggcggcgcgcggacgttgtcgtgaagggagccagtggcgcggacgtgggagaggagggagccggcaacgcgcggatctggagccgtcgtcgtcgctcgtcatggccagcgacggagggatgcggcggcgcacggacgtcgtcgtggagggagccggctgcctggacgtgggagaggagggagccggcggcgcgcggatctggagtggagggagcagtcggcggcgtcacggtcgtcgtcgttgtcgaggagggaggccgccggtggcgaggagggaggcggcggcgcgcggacgtgggagaggagggagccgggcgatttttctaagtgtgggggagagagagagagagaggagggggagggaaatgagtggtggggaggagaggataaggatgagatgactagtttttttttggtaggtactatttttgcaggcggaccacataaggcgtcgcttaagtggtctgattttcgcaggcgccgcttaacagtgaatttcatgccggtttatatttttttaggctgtcatttggctccaagagtcatgtccgactgtaaaaaataagacccccacatcgggggaaaatgccttttctagtagtggatattaggaccaccaattgacttgcttgctgttatgagccatttcttttagtagtctctattgacaatactctactactattattatcaccaatagaagttatcttaattgttgatttatgagttctaattaatatcagtagaataaatgattctattactgtacttgtgaggtgacagtataaattgatatgatctattggattagaaaaaatgaacgacctagattgattctactacgagcacagaccagtataaagaaaacttttaattatgtgctattgcttcttgtaatgttggggaaaaagaccagctgggcttgatagtgatagttactcctaatttatcagcttctccaacttgctgtaatttgtaagcatgcatgcatcgacaatgatgaaatttggaaatatgataatactaatataatatgaattgccttcttgttttggacatgtgcttggttggtgactagggtaattggcttgaacgtaaagaccagactgaaaacttttgaaaagagttgaatttggttcaacctgccgattatatattctggaatttacatcctgattattgatacaattaggcagcagcacatggacatgatatatatacacatctactacttagaagaagcaggcaaaaacacaagatcggtggaggaactatgattgaaatattgaattaaccaaagtaaacgcaatagaagcttcattattgatggtccaggagagatgctctttccagtggccaagggggtaccttacttagctagatgtgttaaatcagcaaccaaacttgacttgcagcgtctttgccgtgtcttccccgtaagtgtcgtgcatatgccatcggcgttttcattgatagatacagctctgcatctactctcaacctcaatctttggacactgctgtatattacatggggtatatatatatcctctctgccttccttctcccagttgcagaccaaaggagccagagcagcacaaatattgagaaaataaggagaccggccactgaagagcatgccttctctctacatattccttgggcttcttctcttctccctgcaggctcctccatgtcctgctgcaactgatactctgaaggcaggacaagtgctctctgccggtgacaagctcgtctcgaggaatggcaagttcgcgctcggcttcttcaacccaagcgcaaacatcagtaagtcatctgacaacatctcctccagttggtacattggcatatggttcaacaagatcccagtttttactgtcgtgtgggtcgctaatagggagaggtcaatcgctgagcccgacttcaagctaacacagctcaaaatatcacaagatggcaatcttgccatcgtaaaccatgccaatgaatccataatatggtccactcgtattgtcaataggacagaggccagcatgaacacaagtgttcttctccacgacagtggaaatcttgtcatacaaagcacatctaatgcagtgctgtggcaaagctttgactacccaacagatgttgctcttcctaatgccaagattggctggaacaaggtaaccggtctgaaccgtgttggtgtttcgaagaagagcctcattgatatgggcactggctcttatagtgtacaactatacaccaatggcaccagaagggtgaccctcgagcaccgaaacccttcaatagagtactggtattggtcgccagatgaatcgggaatgaagataccagcactcaagcaactactgtacatgaatccacagaccagaggtttagtcaccccggcatatgttaacagcagtgaagaggagtactacagctacaattcatcagatgaatcatcttccacattcctcttgctagacattaatggccagatcaaattcaatgtttggtctcaagacaagcactcatggcaaagcctatatacccaacccgttgatccgtgcaggtcatatgatacttgtggaccattcaccatctgcaacggcaattcacaaccattttgtgactgtatggagaatttcactcgaaagtcacctcgggattgggaccttggtgatcgaacaggagggtgttctaggaatagtccattagattgcaccagaaacacaagttcaacagacatcttccacccattaattcatgttacattgccccgtaacccccaaaccatacaagaagctaccactcagagcgaatgtgcacaagcttgcctcagctcctgctcctgcactgcttattcctaccaaaatactagcacttgctctatctggcatgacgaattgtttagtgtaaaccaagatgatggcattgaaattcattctcaagatgttctttacctccgccttgccgccaaagatttgcagagtttgagaaacaacaaaaggaaaccaaatgttgcagttgttattgctgcaagcgtaattggttttgtgttattaatggtcgggatgtttttactgatttggaggaacagattcgagtggtgtggtgcgccattacatgacggtgaagacagcagtggaataaaggcatttagatacaatgatctagttcatgccactaaaaatttctcagaaaagcttggagcaggtggttttggctctgtgttcaagggaatgttaattgatctaactaccatagctgtgaaaagacttgatggtgatcgtcagggagagaaacaattccgtgctgaggtgagctcaattggattgatccaacatatcaacctagtgaaattgattggtttttgctgtgaaggccgtaagaggctacttgtgtacgaacacatgttaaatggttctctggatgcccatttgtttcagagcaatgctggtacactaaactggagcattaggtatcatatagccctaggagttgctcgaggattgggatacttgcatcagagttgccacgcatgcatcatacactgtgatattaagccacaaaatatacttcttgatgcatcatttactcctaaaattgctgactttgggatggcagcatttgtagggagagattttagcagaattctgacaacattcagaggaactgtagggtatcttgccccagagtggattagcggagttgctgttacaccaaaagttgatgtttatagctttggtatggtactactggaaattatatctggacgaaggaattcacctaatgaatacactagtgataattaccatgtttcgtatttccctgtgcaagccatcaacaagctacacgagggagatgtgcggaatttggtggatccacaattatgtgatgattttagtttggaagaggctgaaagggtttgcaaggttgcatgttggtgcatccaagatgatgagcatgatcgaccgacaatgagtgaagtggttcgggtccttgagggtatgcaagagcttgaaatgcccccaatgccaagattacttgcagctttaacaaaatgctctgatgtgggttcaatataatagttcataaatacttgtatttcactatatttcggaataatttatgatgctaacgtgtggcaggagaaattaatagaggaagtcaaacctgcaaatattgttgaattttatggtatggtgtatgttttccccccgttctgtttgtaatgattacctattatattctgatgagcagatacttttggaaaatatgccagtactagaaacatgtgtatattctccaccgtactggagaaaaagaaatatgtctatgtttatttgatggaagcactgaaatgtatcctcaaattgaaggaagttcatgtatgatatatgccattacttagtgcttgaattagagatatagcatttgtaaattgcctattgaaatatgccaccacgtagttatccaataaagtgccagactaatgtagtactacaatatttccgaacttcccttaggatgatgccatgtactattaacattttgtatgcacagtgtaattccgttcgcatcctgggtgatctcgatgcccagatatatatagtaagataagaggccaacaaggtcactcatgaggaatacctgcttcatttgagccttgaacatgtcgattttttttttttttgctgctgcagccggtgctgatgagattgtcaacgtacacgccgacgatcaaccgcgaagctcggcacacgtgtagatgctgtgttctgagtcgctcctcctgaaaccaagtgacaccatcgaggagtctaacttagcttggtataaaaggtccttactattttttttaagtaaattgcactagcggtccttagacttgtaagcaaattttatctagatccatgaacttgcaaagtgtgtatcgaagaccctaaacttggtttattgtatcatcccaatgaaagtctcatttgaccgtggtcttacttacgtggcatgacatgtagatgacggcatggcacatcatcatcatcacatgtagatgacggcatggcatcatcattattattattattattattattattattattattattattattattattattatttctttgtttctctcttcttcctctttcatttctctcttcttcgacctctttgacgcgggggagctcgaggtggctctagtggaggaagaagataaaagaataggaggaaaaagaaaaggggaaatgaaaaaaaacgccatgtcatcgtccatgtggcgtgccacgtagacaagaccacggtcaaacaatgctttggacggggttgatatattaaaccaagtttagagacctcgatgtacgctttacaagttcgtggatctaagtgaaaccttatgacaagtttaagggccactagtgcattttattctttttttccatgttgggctcaaattcacacactactacgaaactcctgataagaaacgccctaaacttggcacatagtatgagactttttcggtcctcccgacccttcaatgggtctaaaagtaaaaaaatgacacctataatattatataggtgccggtttattaaaaaaccaacactaataatataaatgacggttttcctaataaaccgacacttaggctgtgtttgaggaggagatagagaagattggaaagatacgcaaaacaaggtgaggtattagcgcatgattaattgagtattaactattttaaatttaaaaatagattaatattattttttaagcaacttttctagaaatttttttcaaaaaacgcaccgtttagtagtttggtaagcgtaggcgtggaagacaaaacaaacaatctcacaatcacccagggccgaacgcagccttatatgtgagatataagtgcgggtttttaaatcaaccggcatggacgcgagcgagcagagccaataggacgcaagcactctagaaaaatctacacgagactagtcttctctccgccctctctcttgtgcgcgcttttctctgctttcttcgcccctctcacattcttcgcctccctctccggctccagcacatggctgcttctctgtgtcgtcttcctctagcacggtggccttcggattcagtcgagaggatagcggaacaagcgggaggagtctccgtcgaggccaccgaatttaccccatgccacctcctccaacacaccggagaggagagggaggaggcggcgcaagccaaccgccaccatcacgagctcaggttgctgtagccagccatcacgcgcactgttgccttatgtgcaccgttgaggagaagggtaggtacacgtcatgcaggggacttctacaccaccactgcccattcactagatctggtgctcaacattttttttctgatatgtttggttttttcttgttcatgttgttctttcccttttgacgcatgcaaatgatctgtgtaattgattttaattggaggaatgatggaatttgttcgtttgtgtcaaaatttgtgatttggtttatatgatttgtgctattgaagaacaatttgggattcatgaagaataatttaggattattttgtcattttctttactgcaagcataggctcaagacgagctgactttttttttggaatcgtgcaactaatcggtaccggttctcaattcggcaccgatgagccttctgatcagtgccgcctctgtgatgccggttggaaaatacagcatatatgtaggtttccatgcggcacccattagattttgtgtagtagtgacatttgaatgggctttatcgccctaaattgatgccctttttgacccaatttggttggaaaatagtgtggccttggaaggtcacaattatgtcgttgcattaagcactgacgctcttgtcccggttatgatttgcacctttttctttttaataaaaaggattaaaatccgatctttacatccaacctgatgtagacagccaacgcaccatctttcttatgctggccatgatctatgttgctgtttttgcattgtcattcgtttgctcttatcccttggctgtcccatcgtccatttcaagttctgcatatgatctctccatatatatacatacagctgagctgatgatggttatcgttctgaacttctgatgttgctgttcaaatttcttgtatatcttctaaggcatgtacgcgatgggctgctagcctacatcctttgaaacgacaatacatatatgaagaaaaccgtatagtctctccaatcaaatttatttgatgttgaaaaggtactagtttactacctccccaagtgtatggtagtatgctgtttcagtttggcatctcagtgtttttttatatacgtatatcgcaaactccaccaaccatgcaaattcctcatggttgacttgagccagccaaacacatgttgtacttgtttaagcaacaggagataatggccaataaaagtggccacccccacccagtgctgtcttaatctgaatttgaccagcatgcatgctcagcgtcgttgccgtgtagatattccccatcagatcactcgctctcctcttattccttgtcccaactccaactgcagaggaagctaccagcaattctcgtctccatgcgtccccagagctatgcatttcttggccttgttcttctcctcttctccctgcttcctcttgctccatgctctgctgcaaatctaaataatgatactctcctggctggccaagcgctcgccgtcggtgacaagctcatctcgaacaacggcaagttcaccctcggcttcttccagccagacgcaggcaccagtaagtcatctgatactagcaccaattcccctggctggtaccttggcatatggttcaataagatcccagtttttactactgtatgggttgccaacagggagaggccaatcactatccctgagctcaatctaacacagctcaaattctcatcagatggcaatcttgtcatctttaaccatgccactgaatccataatctggtccactcgcgttattatcgatagtcataggacacaagaaaccagcagcacgaacacgagtgtcgttctattgaacaccggaaaccttgtgatagaaagcacaacaaatgtagtgttgtgggaaagctttgactccccaacagatgttgtgctccctggtgccaagtttggttggaacaagatcactggcctgaaccgtcaatgcatctcaaagaagagcttgatagatccaggtcttggctcatacagtgttgaactagacactaatggtaccaagggggtgatcctcatgctccgcaaccctcctaaagtgtattggtatggtctaacatcaccaactcttataccagagctcagatccctgctagcaatggatccacggacgagaggtttgatcatccctacatatgttgataacagccaagaggagtactacatgtacactttatccaacgaatcgccttcttcgttcctctcactggacatgtctggtcagatcatgctcaatgtatggtcagaagctaaccagtcttggcaaatcatatatgcccagcctgctgatccctgcaacccatttgctacatgtggaccttttaccatctgcaacggcaattcaaatccagtatgtgaatgtatggagagttttactcgaaagtcgtctcaggattgggaccttggtgatcggacaggaggatgctccagaaatactccattagattgcactattagcggtaacaggacaagttcagcagacatgttccaccctatagctcatgttaaattgccctatgactctgaaagcatacaagatgccaccactcagagcaaatgtgcacaagcctgtctcagttcctgctcatgcactgcttactcctatcagaacaacatatgctctgtctggcatggggatttgtttagtgtaaatcagaatgatggcattgaaaatcatttcgatgatgttctttacctccgccttgcagccaaagatttgcaaagtttgagcaaaaacaaaagaaaaccaattgttggagttgttacaaccataagcattattattcttgtgttactaataatgctcatggtgttggtaatggtttggaggaatagattcaagtggtgtggtgtgccattacacagaagccaaggtggtagtggaattatagccttcagatatagtgatttagaccatgctactaaaaatttctcagagaagttgggagaaggaggtttcggctccgtgtttaagggagtgttgagggacttgactgttgtagcagtgaaaaggcttgatggtgcccgtcaaggcgagaagcagttcagggctgaggtgagctcaatcggattgatccaacatatcaacctagtcaagttgattggtttctgctgccaaggtgacaagaggctacttgtttatgaacacatgttaaacggttctcttgatacccatctgtttcagagcaatgctactatactgacgtggagcacgaggtatcaaatagccataggagttgctagaggactttcctacttgcatcagagttgccacgaatgcatcatacactgtgatattaagccacaaaacatacttctcgacgaatcatttactcctaaaattgcagattttgggatggcagtatttgtaggaagggattttagcagagttctgactacatttagaggaacagttggatatcttgccccggagtggattagtggtgtcgcaattacaccaaaagttgatgtttacagctatggtatggtgttgctagagatcatatcaggaatgagaagtttacctaatgtacacagtagcaacagtcatcatgctgcttacttccctgtgcaagccatcagcaagcttcatgagggagatgtgcagagtttggtggatccacgtttgagtggcgacttcaatttagaagaggctgaaagggtttgcaaagttgcttgttggtgcattcaagataatgagttcgatcggccgacaatgggtgaagtggtcctggttcttgaaggtctacaggagtttgatatgccccctatgccaagactacttgcagctataacgagatcttctaatgtagctgagatgtaaaaacaattcaaaatcctctaattgctaaaatgtactgtataatgctactcttgtatttacatttttttttctttaatgacagacttttgtaagcaacggttgtcgatgcacagtgagaaatgtgttttttgttgacggtatagttgacataatgcttaaattgaaataggaagttggtatattggactgcttactgcttgctttagagataggtccttgctttctctgctagaaatgaacctccatgatagattaaaaaaaatagacacataaatgggatgaacaaagaaagctcaaaacaaagccactttcagcttattaactcttctcaataaaaaggtttcatcctatcggcccatttaggccttgtttgcctataggggaaattttccttaggttgatccacccaagagggcagattgggttgatcccctcctaccatccaacccccctccaattcccctcccctgagtattggtgttttgtctgttggttcatgagtacacaatacaacaagcaaaggaacccattgacactgtacaaactgcacatccaaaagaatggcactaagaagagccattttggatgttaatacatcacagcagtaagcataaaaacattaaaaaaaagcatataagatttgggggctaaaatgtgcacaagaaagctgaaatatggtaacaggaaaattactaatagtgaatggtaagaccatgactatttgttatatacttgtactgtttggtagtaggctagcagctcgaaacagtgtatatttacttcagttcatgccctatgataatatatgttacaagcagggagatatattatttgctgatcttttaagtccatgtggtggaatggcaatgaattgcaagttgcaaagcgctacagtatactctttattatcaaaacctattaacagaatgatatattcattattaatgaattcattcaagatattcatatagatatacaaaaaaaaatagtcgtctctctgtgtgtgaagcacaccatagaagtagatgagcaatctgatagagttagcatcatgcgtccttagactttatgaaagatagtgttttgccagaaggtgttgtaggttataacacattggaaaataaatggaattgaagaaaatattgatgttggtacttggtagtatgatccaaatgaaacagtgataacaaagaaaatattgcataggatttcatcgttaacacttttaatggtcttttcttaaggtgattaactttgcacaaaagtgtgttggagaaagaacagaacaagcagtggcattgctcagataaaaaaaatttcaggaaaccaattgatggtctagttgaactgtaaagtagagcttgtcataataattatcccatggatcaccattctaccaacattgataagatggagcttaacaagagaaatccaggactgaagatacaaaatgaacgatttactcaagtgcatttcgttattaggtggagtatatacttaactcactgcggtgatttcagtgaatttagtgcatgcgatccggatctcccgcagctcgcgtgtatacatacagatccagatcctgcactaccgcaccacacaacacaacccccaagcaatataatcaccataataacactgaagaatctaggggggggggggaaagaaagtaaggggcaaatgagagaggagtgaatgatgaatgcggcggaaaagcagaactcacggggacgggataggagattcgcatccggggaggaaaaattggaagaggaggcaggcagacgcaggcatggtttactgcggtactggctctacaggaagagaggcggcgacgatggcggagggaggaaggtggacgcgtggtgttgccactgctacgactaaaaaacaacaaggcaagtcaatcttgatcttagagcatcacaacaatatccttaaatgaaacccaattttaaaattaaaatttattttataaaagaattgctccaacagttccatagagatgtatccaaaaattagaatctcattctcctccttactcgctctccacaagtcaggagacactctcactttcaatttccttcgctctctacaagtcggtcaggagacactctcacttccaatttccttatagcaaaaggagatggcgacaagtggagagatcgcgcgcgtgggaggggatggacaaagcgattttctttattatatgttggtagttcagtgtgggttcactttttattattggaagttaatttaagatatttgttagaaataaaaatctatttacaccttaaaatcaaattaggaatttcaaaaacagaattttaaagataaaagatttttgggtatcgtgctctttacccccatcaacttttacaatcgatctatctttaatcctatcttactataaagttatcctccactaactccttaagcttaacatgcaaagatgccacatcatcatccattaacaagatgccacatcatcatccactaacaatcatcacatttaaacatcatgcaaacatgctatatctttatagttttttatagtttttataatttaagagcttttcaaatacaaacatattaaattaaattatcatccagtataattcacataatgtttcaatgtaaatccttattatgtttatgatatcctatatacttatatagttcatcttcacttagtgcttaaatgattaatctatggtctaaattatctttctcctttttttcccttaattaagtcatatcacatcaattgtttttagcctttagattattaatctacggtccaaactatctccctacttttcttcttccataaagtcataccaccttactttttatttttgaatcaccattctacattttatttaaatttaaattatcataaaccgcattaatttacttaatctgatgttatctagctatcttacatgttatttttttattgttatcatactaaattcccgcagcaatgcgcggggtttcacctagtatatatatatgcctctcaacaacttagagcatcaccaacaaactaggtaaattccatccccaaaaatttaaatttgagaatcataaacggattttgatatgtgaaaaagtgatccttccaagggattgagtaggacttattaaaaccaaaacgtaggcccatactatacactactaacggaaatcactttatattcctcctcccgcatgatcacaataacaaaaattaagttggagaattttttttccttacgtgagatagctatgggactctatctttacttaaagctttaaatccaccagcttataaatcatataaaccaaaaaactaacttaataaccaaaaaacaataaaactaaactaatagaagacttttgttatcaaacaaggccatagtccatgaaactattgatgctaacattacgttgttgcgaatggtacgagggttcagataaaacgctaccactggatagcatattgcaacagtgatatccatagatatcatgttatagaacgagtaaatgcatatagtagtatttctcatttttaaatttgaaaatatatgttaggtagaccttttgacatatgttgttagcagtcgtgaaaaaagagctagctgggtgaccaaaggcgatgaagagacatgtaaaattaatcgtgaaaccaaattcctcaatttttggccaaagattgttttatcgtatagtacaaacactattggagaagtgatctttacccaaatggcaaaaatcacattagtcccggttcaaataaaccaaaagaatatgtttagtccaggttcaaaagccagacgaatctttttttatctttaatcccgttaccaaccaggactaaagatcatttttaatccagcttcaaacagttatcaggctgtgtctggccccaactatccttagtcctgattgataacactaaccagtactaaaatcaacactttaatccttgttgttcataccaaccgggactaaacaataaaaaaaacggaagaaccgagccgcacgggggagagagctgcgtccttatcttctctttctctccctcgcgcgtccttatattcttctctttcttcttctcctcctccccctccccttgtcctcccctcatcctcttctcctcgtcccgtcgggagcaggagcagcatgcctggcccggttcttggcagtgggtgtggctcgagaggtcgtcggcttcggcgcggcagctagggcgcggcggcgggtcgcggaggcgcaagagcgggagggcgatcgcctccgtcggtagcggcggcggtggtggtgggctagacgatgctggcgtcatcgtctcgccaggtggagctcggcatcggcttttgccttggcgtggcagctggggcgcggaggcgcaagagcgggagggcgcttttttccgccgccggtggtggcggtggtggtgggctggacagcgctggcatcgagctgcattcgatctatgaatgaataatggatgattttgttgtgatgccgttgcatgtagacctgtggtttgtagactttttttagatgttttttgaatttgtagatgatttcgttgttgagtatgttcattcgattttgtggatgattttgttgttgagtatgtttttgtgaatttgtggatgtcaatttgatgtggggatttagggatgttgggagcaactggcatggctcaaaatcaatacacaagtagtaaaaaataatgaaaataaaaagaaaaaacatttgccacatggcgctacaatctttagtctcgattggtgttaaaggggttgtaaatcgggactaataacgatggattccctagtagtggaagcatgagatgcaaaaggatcacgcttgtgaagctagcaattctcataaaattctagtcaaatttcctataattttcctcgttacgacaacaaaaatgatgatggagaagctgttttgcaggccagcaaccggttgatgccccatcattttcctctcccttttgtttctttcaacatatacatattgctgccttcttattttcttccattttcttatttagtatactcagtatatattagctttactagcctgattagactaagacatactaccttcgtccaaaatatcaaattttaattatatatctgagcatgtgctaaaaaaagtatattatgggacaaaaaaaatagtttttgccccaaaaaatgcccctttttaacaggtctttgctttttatcaggtcttactagataatttattaattaatatattcagtcaagaccacgtcaatataacgatggtatatcagatagggaaaaggggagaaattctagtccatttgcgactagtagcatatcgctagctacggcacctgcatggttcgttttcagtgaaacaaccaaagtgttattgttaaaaaaaaagtgttgaagtggaaaaaaagagcgagatatcgatgcatgtcatgtgtgtgctgtagctaagtaggagtcgtggctacacaaattaagtagtacgtcacaggaaaaagatcattttttttccggtgggctgcatgcttcagaaaaccacaatcgatcagaggaaaaattaggtgtgtccaactgtccaaaataagttaaggaccgtgaaagcaacaccctgcccaactctcttcctgctttatatgatctttttcttccatttcctctctatgcataacttcattatatattgacaacattttagttcgttttacgcaacgttcttttcctattgatttttatcctcatttctggccatacatacaggatacaggttagtacttagacatcacggtctttttaaatgtatggttggtcgcttctaatattttgttgtgatattattagaaacaccgataacactgaaatattaggaattgccaatgcgatatactgataaaatactcctatcttctattaatatattagtcaaaaaactaatcaacatcattaatataataactgaagaagggagtcacgttttttattaggtaatagtttgtttttaccccggaactggatgagaatccattttccttagtaaaaacagtctatttttcagcatgaatatttcttttcgttgtagacaccgccctatttaattagagctaattaacacaatcgatatttccaccaactttgattgacaatgttcttgaaaatgtcatgttgaaagtgcttttgttaaaccatcattgtagttccctgtccttgtctccatctttctttttaaaaaaatatcttacataagagaaaacatatatgcgagcgaacaaatcatgtgttccagctgaacgactttgctatatattacgtatgtttttttcatttgacattggttagtttaaaagaggatggaggtcgtattacacaacatatttttaacaggcgcagtgctccgacaacggggaagtgcagaccctcttttgaagatttgattagaggcaggttgtgactgagagtgatcggtgctaagaagtgtgaaaaaaaatatacaaagaacgaaacacagggagtatacaggtttaggccacccggaggtgtaacaccctactcttataattttttttctactatcaacaccgaatgatacaacacgaacaacaacagtagggtgttacaaccccgattggcctagacgtgtatactccatgtgttttgttatttgtatatgat

SEQ ID NO: 12198 - DNA, 18874 bp, Oryza sativa
cgaatcttcaaggaagaagggatctacgcttccctgttgtcggagtaccgcgtccctgacagcttagagcttgccctatgattcatggcctggtttcatctcaagtgatctcccgaatggatagggttgcagggttaaggttaggggagaataaggtcaggatgagaaagtgagatgtgtttgtcggcttagagggatagctaggacgatggttgtgtcgcctcagcagtgggagatgatgaggatggtgggcatgtgttgaagctagagcaacacgagatggtggaggccaacggtgtgggagcattggagccgagtacaaaggaggagaattgtggaaatgaggttgcgaggagaagagagccatgttgccaggtgaaacttgccaaagatggaagagggcgacgatgtgggtgtatcagagcttaaaagattgaggatggtgatgcggaggttgcaagaaggagaagatgtcgaaaaggggagcaacgtggtttggtggggcatgcgagcaaggcaactgttggtatttcttaacgacattactagaaatacaattcccagcaatggcgcagaaatactcctggtatattatggttacagagttcatccgcaagcgcacggatataccattgtagcatttcacccgagagtattccaatggtatcgtatttatttaatctcgtggaaagattatagtagagagaacctgactaataatttatatgttacttgtaataatcatattctaagcaggggttaagataaatcaagggtagagtgacacacaagcaggaagcatactcattctcatattgaaatatctaagctaagtggaaagaaaagagaaagagaatatattcctatacttctagtatacatagtatacatatacatcctagttatctgacatactagccaataccctctatccaatgccctcctggtacttcgagaagccacccctaactgccgagttccttacgacagccagtcatgaccatacaaccgggactaaatacgtaggaataccctccctaggaaattaacttaggactatatacatgcgcggaggaatacccatattaatctatcaccatcagcggcccacctctcatccgcagcatataacccaaaataatgatattccgtaatctagacaccacacctaaactaccagatactactctaatatcatcgtcatgacatagagtatttgcataagcaaacattatacccgtaccaaagcatctcccaaataagctagcagtataatcagtataacatgaacataatgtaaagttggcattcatatactcggaaagtatttcaataccataaatgacatttataaagaagagtattctaataaaagtacaaagcttacaaaagagaagagaagagctactagagctatacccaaactcttccgaaggcttccggactccgatttctactctattcctattcaactagcttaagaacaccaaactaattaaacttgagagaatatgaaagaactttgcttgaggtgtgtgagtgaagtgagaagaggagctccttttatatgcaggtaatgacggttgtgatggttggaatggtcggtaataccctccaaccgtcattagggatcaatcccagccgtccatcaaaaccctgcatccatcggtgccacgggaggttcggccgaaccatgggctaggcccacctggtccaaactcggcaggtggcctcctctgttgctcctttatacagacttgtgaattttggtctaattcatcgtgtcaattctgagttcttggcccattcatgcataagtctgattctcgacatcgtccgattgatttatcgtctgatttgatgtcgattctcctccacttaatgatcattctctgcaaaagtttagtgaaccaaaaactagtggaatattattattctaacatggatatgcattgcaagcatagctagttcttctctattttggtaatattgacggtcgaaactaatcgctaacgaccatcaacagcaaggtagaaaacgtgggaagaatcgtgtgattggggaggagtgtaaacccaacttttggatcttagctttaacagagccaggttcaccagccaaagatggcgatgctggtggtttctcgtacatgaggaaaaattgttgtgattctgacttctaatcgatcccactgggcgtgccaaaagcgtgttgatgtgaaaacacgaggcctgggagatctgcttaactccagtgcaggtccaaaactcgcctcgggtatgctagcgtgccagttgatttgatcctgcaatcaacaagaaacaaagacaaagaaaccgtggttaaatccataaacgatagccgatcggctaggtgccgatgacgtatcatttgtctttgagccgatgtcatatatgcatcaatcgacagtcataaatagataagaaagaactaaatctactcgatcggctatagatattaacgatatataatctttatgtcgatatatacttaagtcaagtgattgggatagatcggtcgccatgccgagacaatataaatcacttagatcgaagtatatactaagaataaaattatatatattcatagcatagccgatcagatagatctagcatgtatcggctaatattccgataccactctatattaagatatcaaagcaaataggatataccaaacaaagagcctaatatacttagatacggcaagatcttaacataaaggacggatttaacatgtcaataaagcatataaaacaaatatagttaaatcaagtaagatcggctgaaatcccgatactaccctaatcggcaaccaagaagcaggctagagattgagattctaatcatgactcataagatcaaactcaagtgatgcagctataagtatgaaaagaaggacaatatctagacaatcaagccattggaagtctcatagagtggtggatatcatatataatctaagccaacgtcgatatttaacctaatcggctgccctctattgatagatgttagccgattgtaagttagatagcgatattgccagagattatataagatatatgataactcgatgaattacatagacaagattagagtatcataaagatggaagcactaatcccgagaacgcaagctgtcataacaagttttacctattgttgaatatcgaaaccgatgcagctcaacccgaaagtaagaactcgtcgaaataaaacgaaagcaaaaagggtggcgatgcgccgaaattgtattgaacgtgtgttaattcgattacatagggctcggggtctatttatacccaagaattacacaacatgtccatatcggacacgactcttatctctaacaaactctaagataccataagtctttgcggaaaacttttgctcaaacatatctctacaaaaactacataaaatatcataattaatagatacaattgctttctcaggactctattcatgcatagcaatcatcttgaagcatatcaactcaacgcgatgacgtacaccaagtcatattgtcggaatcggctgtatcgtctaacccagtctgactcagacttagccgatcccgatcgtagccgatttagactctagccgattcttactatgtttccgcaactatcttcgtcttggattccgcttcgatctaatcttcgtctccgatactgatattaccaaatttggtcgttaacaaaagtctattaaagaggaggaaatattaatttttgttaaggaggtaatattggcattggagtattgatctagtctagtctaggttacaaggacaaataagaaaatgtaagcaagattaataataaattaattaagagaagaaattagaatagtagagaggatacaggaagagagggaagagtgggtgattggtggagggaaggagacgggcggacgaacggagaccttatgctcgatctctgcctgcttctcccttctcgcgctctctctgcagcttgccgagagagagagagagagagagagagagagagaggtttgacccccaacaaccctcctcctccatatcatctcccgtcccgtcccgttggttgctactactacttactcacttcctcctccttctagtaaagggaggagcaggtacacgggggttgagatctgaggagggaggagaggaggttcgtgatgatggagagccaggcgctgcaggaccccgtcgccgagccccatggagctgagcctgccgccgccggagctcctcccgccgtggtcagcctcagccttgttgcttcaccgtttccatttcacctacctccacctgccttatctggatcttatcttgctcaaacttgctcctatacttacatagtagtagatccagatctcatctcatgcctcaattcaattctttgtttctgggatctcatctcaatgcttgcttgctgcgttgaccatcagatctcaatgtcatcttgctgctgcaggttcccggcaaggagttcacccgcacctgcaagggcctcgtcgtcgtcctcgtcggcggatatgtgctgctccagctcctcccctcctccctcgactacctcgccatcatccccgccaagtatctttctttctttctttctttctttctcctttcgcatgcatatgcaccacacccaccacatccatgctgcacgtgctcccttcccttctctctcgatgcatatcacaccgacacacctattctaccaactacgcgattgcaattacaagcaacactgacatcaatttttaatgatacatactgcactttcaacaaccacgcaacattgctgctgctcccaactcccaagcaccattttttattcactctgttatgctcgatttaattctctagttaaatgccccctttgctttcaccttgcaggactattccatttgtatggactgtcttcacagctggctacatcgaacaagttcttccaggggtcagctcattttctcctcactcacattctttttttttatatagtggatttcaattacacaccataccggctcagaggttacaaatactttctgaggtctcaatttgttatcctagttacaagctgaggttgaatctttcaaagtatttaaactgatgcaatgctttgtaaacaaatactttgatgaaaagtatttcacagagacatactttcaaaacaatgaaaagcgatgcaatgccataaattttgtacctttttgctgtttagtgtttactcttgattattattatttttccttaggctatcggcagttcccttggtcttctcttctgtgggaaggatatcgaaccagtgtggggccgcaaagaattcttgaagtttatcatcttggtcaactccatctgcggtgtccttgcattctgctttgctgttgcactctactatgtcactggaaaggagagcttcctgtaagtttctaaccatcaatcaattaacttttacatagctattatactactacagattatatttctactatgtcattgaaataatattcattcttgcttcctgcgtattaccttttcatatgaatattcagttagtttcttcaaaagcaatgaatatttagttcatgcaaacttctacacattagctcgctggataacaatatcataccattacttctatacgtgataataaatatttttatttcggcatattgtggttactgttggttatgtttgcataatgtaattcatgtcaacaccttacataatgctttcttggttagtaacattactgactgaaaattgtgcattgtactcactagctgatcttgattgttgtgcagtgttacaccactttctggtttccatggtgcccttgctggctttcttgttggcctgaaacaacttttaccaaaccttgagctccccatgtgctttttctggaaaataaaggctaaggtatgctgatgaactactataaaatacaatttctgagcatgtagtgtgctaataaatacttcttccacaacaagttacatagcttctctcctttttcccttgctattgcagtggatgccattcttcgtgctatgcttctcaactatcatggccttcattgtacctgattccattaacttccttccaactctgctatcggggatgtatgtcagctggatttacctgagatacttccagaggaacccactgacagggcttaagggtgattcaagtgatgacttctccttccccagcttgttcccggatgccatgcggtaatttttttaatcgcgatactgcattagtgcattggcaaagatcgtcacaattaatcccacatctgatatgccattcttgtgatccttgcaggccagtcacagaccctgttgctaacctctttgatcggatgctgtgtgcaaggtctagaccttctgaactggccctcccagtctcagatcctgcaaaggcatcgagaagaaggtaactctgtcgtgtcttggcatgcctgtaggcgtacctatcaactagtacactggtagttctgattagaatgtggcacataagtatgaaattaattgtttgaaaatctgcaaaccttggcttttgataaatcttttatcaatttaattagagctcagcgaatctatttttattgttccagggagcgtggcgaaagggttcttgaggaaaggttggctgcagaccatgcagcagacacggaagccccagctctgggccattccacagcagaagattaatatagctcgtccactgtcaacacaccatactgcgataggagccacggccacctgcctatgtgctttgtaacaccgaaaatttgtgttctggagaatgcaattcagtttacaatggaccaatgatatgatattttactctcttttcttattatttattggttaaattctgttgtagttgattacagtgaaaaaagaaagaaaaggatgacatccccatccagatgtaatgtagaaagaattgagactttgtgaggattgctgttgagaatattttccaagtgaactgtgactttgagtcaataatagggttcatatcagcaagggacgcccatatcggctatcaatttgtttgtagaagcagaattattgggttttgaactattggtgctaactaaaggatagatgcttgtactgcaggtgtcatctatgctccttcaaaagacttggcactgcaaatgggcaaaggtgtcatctatgctccttcaaaagacttggtagcggtgagaagtatatccataaaaccataggttagaaagcattcacgaatgtcaaacatagagataggagttccaagtatttcaacatatcagtgctctcttcgttctaaaataaactaacttctatatatgaatttgaacataaaatttctatctatgaatttgaacataggctctattcagattcatgtataaaagtttgattttttttaaacggaaggtgtacatgactaatgctctattatcaagaaaaatgtgggttaaaataggaagaaaccaaaatcttatccgtatcctatgcaacatacaatttgtgtgtatatgcttctctggtattcaaatagcttccagaaagacatgcgagtgagttggtttgtactcctttttttaacttatgtaatattatcacagagcatcaggtaaaattgtgtcatagcatgtaatcaagggtttgtgccaataagacttagggctcatttcgaacgcatgaatgcaaaaccacatgaataagaaaaacataagaaactaattaataggtaatgtaagtgtaaaataaaggatcgaaaaattgagaaaaaaaatgagatgtagtgcttggaacatgtgatagagtaaaacacatgatttttgctaactatgcataacgtatattttcttgttcgtaaatttgtgtttaaactatgtttatttggaggtgtatacattgatttgtgttggatatctcaaaagaaaaaaaaacaagtcctagtgaatgtcaaaattcctatggatttccaatgaaatcaatggtataggaagatttcctctaatatcatattcccgttccttcattacaagtgaggacttcaaatcctctaattttccctagaaccgttcaattcaaaggagtccttgaagatgcaaaatatgtcgatgtgcaaaataaaacttcgtagatgaaatctctgacaaaaggtaggtgctattgcctataggtaggggtgaaaacagtatggaaactttccggattccggacctattttcgaaaatgaaatttgtcggtcggaattttttggaaacgaaaatgaatttggaaatattttctcagaaacggaatcaaaaatgatatagtcagtttccgtcggaactcggaatcggtcggaaactttccgaaaaatttctcggaatttccggaaattttgtaactaaaataccctggattttttaagcactgaatagtgaataccatggtgtttagctgttattttttaaaaatatttgttatgcaaatctgaagttacataagaatatttgtttcctgcattgggatttatcaacaacattactctcttaaatatagataatttattccatagattgtgttttgtgatgtaccgttgagacttaacaattggacttatatatgttttatgatgaattgttgaccattgagaattgagaattggatttatccgtttgaggggtttttatattccaataaattttcgttaccgtattcgcgccggttcatcttcgctccgtttgcggtttcgataatattcgattctgtttttgtatgtggggtttccgatttcgaaaataatatgaaaacggaaatgataaagatgctttccgtaccagtttcaccctacctatgggtcaagtaacagagccataatataggtataataagcccgagccagcaggctataggttattccacgctagcaaaattctatgtgaataagggagaagagaagaaaaagaagaaagtgggtgctagatgtgtcgtgggatgatagtaaagaaacaaggttctatcgctcacttgcagctgttaggagtgatacataatgtatttggtaggcttctaacatttctccacggacaagtgtgcatatatgtttgtttttttcctatctaacacgctaaagcatcggcaacacaaatagctacggttagtttagatcatggtaatttggttattcatgcatgaattgagtgattgattatctccaactagtaatcgtgcacgtgcaatgcacgtttcccacaatatatacataagtgtactcaaagtttaatgcattgattttccaatgatatgtatatcacacagcgcatacaaagtacgaaaagcataaaaaattgtctcaaaatagtactctagtaaataacatttacatgttcaacagtaagtgtatatcttctatcgtgtgaccagtagaagtttatatgatatgcaaaccatagaggtttatatctcagttactttcaagacattaattgtctcgtaatagtactctagtaaattgttatcggaacagtactcggcgtagttgccttaagtgaaaagaaggagatgtcgagtgtgaacatgttggaaacaccttaaaaattgaaacgacaactatgtatttgtggtatggacttacagggtatcccgtgaacatgtccaaattatattagttgagcactggaagggatttcacactgcacatgtccatcatcctagcagttgcagcccctccaaacgaaagaaaataattcaataaggaaaataagaacttgatgtctcatggagctacagccatttatctcaccaataaagttcagatccatttttttcttaaaaatctttttacagaacaattaagctaatgaagcaacgaattcatggtttgaaactgatatagctgagtgcatacaacttacgactcacaacattaatgcatcaagaaaatagtcagtagggcgcacgtgaaatccatgtagccaataaaatgagtaaaaaagaaaatagtcaaatctcatgcactgtttcacatttgttttcagatttattattacttattcagaagggtttatacaaagcaaaattatgttgggcacaattcttttgcatccttagtctgcaaaaataatgaagaatctgagctcctcttattatcaattggtgtatctgagctcctcttatcatcaattggtgtgcccaatattttggaagccaatttgatgaactgaatagaagcttcttaaacatgcccccacacacttatcttgtcgatagaacagaagaccaaatttctggagcatcctaatcactaaagagaattttggatggtcaaaaactgataatgcatcatctatctcgatcaaaccgagtcaacatatgactaattacttgaagaagctcaatcaagcaagtaaactaaataatgaatcaagaaacattggaaaaacatatatatacaaatgtaccatgttattatcactggtcatccactcattgaacgtgagaaactaagttgcatgggaccggcggcgctggtctagcggtgcaagggcagccccgggtagggctccggcggaagggggaaccaccacggcgtctgtaggggcacgatgcggtggcgtgcggcgtggagtcgcgaggaggcacggcagcgagtgaggtggtccgacgatggatgcatgaccagggtttgatctatcggaaagagaaaaaatttcgggggtcagcggatttttttcggaaatttcgtacgaaattttcaagcaaaattggggaaaattgacctacacctcaatggaacacagggcttggactgccgttgtcgtcgatgcaatgcgccggcgagtgcatccgccgctgttcaagccaacgggcggtagagccgctgctgtctttgtgagaggaagagcgaggaggcgacggggattggtgtggcgttgtcatcgcgcgctcgggggcggattcatctctctctcttgatggctggatctgacacggacatatattaaacttgttgttgttgatgggacgagcaaggcccacataagggttaattgggccgaagaaaggcgtcgggtgttaagggcagccgagctgattcgtatcgggttttagggttttcttcctcttctcttgcatcctcccatctcctctccggcggcggcggcgtcttgtgcgcgtgagaaagagaggagaagaagatggcgacgatcgtgaacacgacggaggaggagccgatgctggccgtggtgcgcttcaccgccgagctggcctgggcggacgccggcgccgacgtcgccgagccggaggtcacccgtctctgcgtcgaggcgcagcagcacatcctcgccgcccgctggctcgacatggcctccctcatgctcgcctccgccgacctcctcctccaatccacgcgcctccccgacaaggacaaaggttcttcccttccctctctctctcccctattgaatttgagaggctcatgttgctgctgctcatcctttccaattctagatctcgagtgcatcctcgctatcatctgcaacctcgtcaccaaggcccgatcccaagacgaggccctgcagatcgccgaactcatctgcgccaagctcacccaccagccccaagacaaaccggccctgcgcctcaaagtgtaagcctcacactctctctttttttttaaaaaaataaataaataatatatatatacattattttctagtattggatttgtcacaatgctttgcttccattgtatgcgccccacacaaggcagtctcttcagcttgtacaatctgctcgggagcccctatgccaaggccttcgtctacaagaaggcactcgacctcgccgccgctgggaaggctgccgactgcattatccctacttttaagaacatcgacagcttcatcagcgattggggcattggcaaggtggagcagagggacctgttcctcgctgccgctaggatcctcaaggaccagaaagggtgcgccttgcattgctttcttccattactttcctgacattgcagcattttgtattgaggtgatctcatgccctttcttgattgacaacagcatgaacaaggagtacttcaactttctgaataagtaccttgccaccttcgatggatcggccgatgacgctgatgcaatcggtgatgcaaaggaagaagctgttgcagcaatcattgagtttgtcaagtcatctgatctctatcaggtaattctttacttgagagttcacatctctgttgccaagtctaggatttgtttaggcgtaacgacacaatttgctccctgttggatggacattattaaaatgaacaaaggattaagatgagccccactgtgtccatatcagaacttcaatgtattatggcgattctcacatcagatcaacagatgtcgaattgggtcatatagtgttgaattcggctgttaaactgccaatacgacttttttcattttgtgaacaaggacaagttattcgctaacatttgaaacctagtatgtacttgtgctctcatctcttagtatgtctactaccctgaaactgatttaggaagttatcatatattcatgtttataaacttgttctttacttgccattttaccaactattgccagtaatccagttgcaaccaacaatgggttattgggtatggacatgtctcttgtatgttacagtccctggtctttatcaatttcaatcttgacaagctatatgtatagtttaagggcacacttcaatgcagtggatcatgcaattatgtgtcattgcagtgtgatctactcaatatgccagcagttgcacagctggaaaaagacgaaaagtatcagctggtttatgagctcttgaagatattccttactcagaggcttgattcctatttagagtttcagtcagctaattctgccttgctgaaaggttatggtatgtacaactgctgaattgaaaacattaaatgtctttacttggagcaaatatggaaaatgtgatgcttcgtttacaggatttctaatgataaacaattggcaggactggttcatgaggattgcataacaaaaatgagactgatgtccctgcttgacctcagcagccgttgtgctggggagatcccttaccatgcaatcatagatgcacttaaggtgaattagctgttcaatcctgccattgtgttactgttcacctgtcgaagaatttatattgaccatgtaaaacatttattagatcaatgatgatgaagtggagtattggattgtgaaagctatttcatgcaagatattggattgcaaagttgaccagcttaaccaggttatcattgtcaggtattcgcatctgtaggaccttttgacttacctttattttggttttgctttaacatttgtggtccatattaaggtgctatatatgtatatattctttggttaatgagtgatctggtatgtaattttcagtcggcatactgagaggatatttgggatgccacagtggcagagtttacgttcaaagcttggagtttggagggtaagccacttgacgatatctcacctttaatttgtcattttgattagctcaactgcatagtttagttaaaaaaaatctcttcttttttggttctgtatgttggttgcatatcactgggctgaagtctttaagcatttagcatggatttgattcagttgtctatgaaaattctgctgcagggaaacattgctagtgctattaacacaatacaagcaaacaaggtgactgatgatggatcacaggggatccaaggcttgatgatccgttgatggagaggggttcctgaattgaaattatagtttcaactttgagtagatgagcaatccttttgtatgagattacttgtaatgtgaattactttgatcccatgaccttgtggctggatctggattgctatggcatgctaagcaatctcattgtttttgtagtcatagcggtgcttaaaagtcggttgttacacaagtaccaatcagtcgattactaaagagttccaacagaatggcagatctattgtggcaattttccttcataacggattgatgagttaatgtattattgtttagaacatctggtgcgatttttcataacaattatgacagtcatagaacgtcttgttcaagaatactgaatcaagttatcataaatgaaagcctgtcaacaatatatagaccttagagtagatatctaactgtttagaatgttggaatttccattttctttgatatcttttgcttatttgtacgctgtgatggttattttggtagccttcagatctcagtgccctctgttctgtatatcacgtagtataggaacccattttgtttgtatcatcctatctgaagaaaatctcagcccatgaagatgaaaggtgcatccatattgatgttatttttttaattataccattatttagtaaaattaacaaatacatgatggcatttactttgttatcagatattgatcatgtgtaaaaaatttggcaacatcacatttagtctaccgggcctcatcttttcacttatgcttatcagtcaaaatttaaattttcaacctgacttattccacgaataaacgagacaatgctgtcagcttgccaaaattttggtaatgccaaattttggaaaggtccatttaggcagtaatctgcacaggccagaagaaagaatgctattaaattaaatatcctgaaacatgtattgccgtttggcttttgaacccaaaaaaatgaatacaaattgctacaacatgaacatatacacggcaaagagaaggtttttggattggatttggatagaggccgtccaagcaattatgaatcctacaaaattatgaagcaacagctgaagaagtcttccctttccgagagatgctctccaaagtataaatgtctctgcacacttgccaaggcctaatttctacagtatatgcctgaaacaatataagtaacatatattattagccttcaaattggcagggcagacgtcgtaagttcattgctattgttatatgatgcaaacttgcaataggcagtagtgatgaatataaaacaaattcaccaatttatagaaatcagctgctcttcatttacaatcattcagcaagaattaaattcacaaccatgtttctaactattcaacatagaaaagccaacacaaattgtagaaaggttccaaaatggtagtaactcattcctgaattcctttacccttttccccaaaagaaaagaaaactgagtcaaatacacaaatgaaaagcatgtgcggtataaaaataaaggctcctgactatgaaaagaaaaggtatagcaaccgaacgctaactataccaaccatactccaatccaatcaaccaaggagtcactaaggatggatcaaaattcaaaacgagtcacaatcagaagcgcaatgattaatatggtgagccctatgatagcacaattaatctgatattttagcataaatgccacgggaacacaacagataagacagagggaaccaaataatggggcttttaaaaaaaaaaagggaaccaaataaccgttttgatgtatagcacttgcgtcaatttgaagaattcataaatgagaaaaaaaaactagaatagacaagatgtagagagcaaaatcagagtccacaaagaactcaaaaaaattaatagaagaacaaacctgtcaaaggagttagcactttggtgaacatagctggtgatactattttagagggataattacatccagatctgtagcaacccgccatcctttaggatagacaacactttcagatccgaatggcacatgccagttcattatttgagagcagtcagcaggtatgccttccatctggctttcatcctccactagctgctctacaaacgcgcttccctgcaaagtaacaaccatctcatctcagctgttacactacatgcagaaaggcatcgcaaacaaaatccaagaaggggggggggggggtacaagaaaaggtcacagtattgcatttggtgataaccatgtgtttgaaagctacagagaagtatttttcagcattattcgtacacttcttttgcccttctctgaatatctgtggttcgtgtagtagttggcaagagacaacatgatgatcaattaactagtaattagcatgttgatagcatcagcagcttcttcatcagataaacttggctctacacagcaatgagaacctgcaggcacctacctacctatcttggtggactgaaaaaaatggagaaacaacttacttggagactttctttcaccatttctggatgcctgatcgaattccatgccaaatgggacctgagcttgggatcccagagcatggtgctgttgaatgcgaaaccggacatggcaagatgaaatctgcgcagcttgttcccgtcgtgggttgtgtgccatcccacaacctggccctgtttacatacagggccttggagaaccacctcgtttgtgtgttgagagatttctggaacaggccatgtggcaaacctcctgatgatggtacacagaagcacaaattaagctagtagttagtactactaacttgattataattcggtatcgaattttgagcagtaacacatatttgaatgcatcccgacactagtaagtactagtccacacaggtggtgtccttgggggaaagagccttcttcagtcatactatgtactagtagcaatagataaaagtatggatgttgaacccgattcatggcgctgtgtagtgtatatgagcaaaacttgcaaattattaatacgaatgggcatgaaaatagaaattgggtatgaaatcagggacaatataagattgcagggggtacctgatttggcggaggtggtggaagaggtggagggagtagacgccctcctcgtcggcgaagtagaggacgccgtcgaggcggtggttgtcgacgatgtcgagggcggcgttgatctggtgggggcggaagtcaggggcggaggcattgatgttgtggcagcatccgacatagcggtgcaagacagcggtgcggcggagggcggcggcggcttccggggtggggttgccggcctggacgacgatccagaggaggggtgagtcgtggaggaggcggagggtgtgggccatcctggtgaggtagtaggcctgggaggggcgggcgcgcgtgggggtgacgacgatgagcagcttgtggttgctgtggggggtggatggcgggtgcgggtgttggaggatggggaatggatcgcggtggcggtggtgggaattaggattggggatggggcccaggggtcgggggagatgggagaggaagtggaggaggccgaggaaggagccgaggaggaagaaggcggcgaagcgagggagcgggcggcggaaggaggtgtgcccagcagcagcaagcagatggtggtggtgatgagccgctgatctgggagaagacgaagacgaggagtggcggagcggcgaggatggcggggaggaagaggcgaaggggccgaggtgtccgtggcggagaaggtgctgctgctttgccggtgagtgcggccgccggatcgacgccattagccttccttggcttattatatacgagtagtagtagtatgttgatcggagctccagtccagtccagatctatatatcctcgctcgatctccactccagtagaatcgatcgatgcgcgcgggcggtggcagcctcaatctcaatctctctcaagggaggggatggaagaaaaaaaaaaggaggatgagtttggctgtgtgtctgtgctgggaaattgccgaattggaatgagatcgaatacaagaggatcggaagaatccaatcacggcgcgaatggcggggagatgatgctgttgaagttagccagcccaggcccagctgatggatggatgaagcgaagaacagcgcaaggaaaggaaggctacctgcccctcctcgtgcctgctgtggacacccaaaataattaacgttaactactcctgctcctgctgccgttagtttaaaactcacttttaacgacgcttctcttcgactacgacgcgtactagacttgtactcctctcctactcctaattgggtcaaacgctgacccacggttttgggtgggtcaagcctttcagacccaattcagtactggagtagtactgtacgccaaaaccaacaactctgcttccctccctccctcctctaggggggatttataattatgacactgcaaatattaatctttactataatgatattgaacccacattttatagacacggatgggcccatttgtcatccacacggagtgtcaaaacagcgaagccaccatgtttgcagtcctaatattgcaattttctcctcctctcttccaccgccatcaccacgcggcggaacccaacccaacgcattattattattcccttcccatcccccacccacacacactaggggcccctttgaatcaaaggatttatgtagtattttcataggattcaaatcctataggaaattttcctatttgtccatttgattcaaaggattgaagctttccaaattccatgaaattcctatggaatagcacattgtatgtggattttggaggaaatatagcaagagctccaacctcttgaaaaatttcctttgagtctatctctctcatccgattcctgtgtttttcctgcgttccaatcaaacgaccattcctgtggtttttctgtgttttgcaatcctctgtattaaacttcaattcctatcaaaatcgtatgtttttgctattcctccatttttttaattccgtgatttaaaggggccctaatttcctcctgaatcaatgcttctaacatactcccct

SEQ ID NO: 12199 - DNA, 11062 bp, Oryza sativa
  unsure (1)..(11062): unsure at all n locations
actattaagaattaatgtgtcgcacaagtcctcaatagctcctcctatccctaataatcctctctccccttcctaaaaaaatccctaatagtctctcctccctacaaatatttttttgcttccatccaaacagctcctcaggatctcactctcggcccgagctccatctgaaggacggcaacccaagctctactcctatgaacttgggcactgtaagatggtcgctagccgctcctcaagggggtcgagcaccacaaaacgctaccacatctcattatcgagctctaccccaaggtcctccaccaccacctctccttgttgagctcgccagtgtgagtaagccgagggcgtgggaagaaagggagggatgaagtacgttgaatccaccttttatcagggaattgcaaacaactccaataatactaaaagtggtattgggtagctccaaaccactttggtggtgggatattgggggactatatattggagatgctcggaaaatattattcattctcgtattttctatacttgttactttaccctaaaataaattttaatcagttgcattgaaattacattatcttttccataaatgcgttaccaaatagagaatgtgttttaatcgatctagaaatttgcaagttcaaatataactgtgaattcatgttaactaattttagtttaattttttattatacaatttgtaccagttgaatttaatcttgcatgtttgtgaagtgatatgtcttacattaatctatcttgttattttttttaatatttttataactatttaggtgacatataggaaacgagggaatgtctcctcaaggacgaaaatccatctcctaccaaattagctgggatccctagctagggatgaaaatggagcagatagtatccgtccacttcgaaaaaaaaacggatacgaataccgttcagagcgaacaattctcggatagtccggataaagatacaaatatggatatttgatgaaaggtactattaggatatccgctgaagccatgacacgtacctcatttctatataactctagatcttcaagctaactctttaaatattaatagtagcccatctcacaacaccagtctatactagtaatattatttaaacatttaattttttaattatattatattttgtattataatattagttagacgtgtatttatatgaacactcttgtacatgttaaacttgattagaagcttatgaccaaatttattatataaaaagggctaattatatacctccaccattttctaatatatgataccacgtcttattcaaaaaaaattatacaaatataaaaaaattaaatcattcttgaaaaacatttgacgataaatcaagtcacaataaaataaaaataattacatattttttaataagataaatggttaaactaacatatcttaaaaggtaacggcgtcatcctatcttactataaagttatccactaacttcagaagctcaacatgcaagtgtgccatatcgtcacccactagcaattattatctagagtattttaaatatcatacaaacataacatatcatttgtaattttattgtatttgtagaactcaatatgcaagcaaagttaaatcattattttcatattatttaaacatatacatctgccatttctataatatataacatgtattcatccacatatatatcctacaataaagtgggaggtatcaactaatatattaaaaaaatgatggagtgtgttggtatttgtttatattaaaagttggggtggttttcgtgttccagaaaatatttatgtccgtatttgtgtccagtataattcgtatttgttttcatatccaaatcattcgtatatgttttcatacccaaagaaaaagagaatgtgggacgaccattatccgtatgtatccattccattttcatccctatcttttgcagtttctagatttactgcaactttggtaacagtcactaaagtgaccgttggacaaaaaaggaagacgtagatcctccaaacttactgttcatcagatgctgtagcggtcctagaactggacagagccgctgtagtctctaccgttgattcattgaattgatcctgtggtgacttgcagtctatacagtgatcgcacgcaattctttggttagtccgagtatgcgtcgtggacaggacaattctttggttctcccagcctggccatgccatgacatcacggcaactcgccatggcataattaaacagcacggcaactcgccaagcaaccaaattacagtatagttgcatcccggccgcgtacgtgtatacctttcctctcccctgcccctgctgcttgctgcactctagtactcttagtactaaactaatttcattttccaaatttagaaaaatatataggagactgacgaaaagagaaaataaatggtcttcggattataagtaggcctcgttttcaattcttaatttcttgtcgagttttttttctaaaaaaaatagtaacatagaagaacgatcagtacacaattacacatgcatatagtacaaagttacaagtagtaattgagattttcaatacaggaggcgatgcaagttgcaactccactctctgttgtgtttgaattgactactggtagtggtactcttatacggaagcaaaacctgaaccgaactgcagtggcatcgcatcgcgcaacgcacagcacagcacagcacatgaataaagattaccagtgatgttctccagtactcgatccgttctataaaagattacaagtgatgtgacacatcctagtgttataaatttgaacggatataaatttgttgtactaaaatatgtcacatacagttttagattttttttcagagagaatacacaatatattattcagtactactagtactacctccttgcaaacttgttggttagttcaatattgagctaaccaatattgagttaacaaatgtcaaaaaaaatataaagggagtatatgcctagctagctagtagcagtataagttactcccctcatttctataaggcataactattttttttcatgttacataatataaggcatgcatgcatgcatataattaattagaacctcttctctattaaattattacttttttaaatcctcaactctcaagatctctaattctattggatacatgcattatatttattagggtgattcaaactagaagatgataataattatttcttggtatttaggttaagggtggttgtgtattatattttggaacgaagggagtactatcctcccaagccattaattgttagaggtccttaatttggaacaaagggttataaaagaattcaatcctataagaatttttcatatggtccgttggagcttggatcaaattaaggaatagctatagaaaaatcatacgaaattcctttggattggtccaaagggattttagagtaattttaacgtaaggtcaaaccaattgggaaatatcctttatatcttccttttgtattcatatatttttcttgcgctcgatttgaatagtcatttttacgttttttatgtgtgctttaaatccataggatttgagataagtggacacttaagatctacatatttcatgattccgaattataaaaatcctacgttccaaatgagcctttatatttcttttgcaaggataatccaattgatatacaataatccagctgaaatgcgtcacttgtgcaagaacaggatgaatgagaaagaaaacattgatgtataaaacatataagcacattgaaaattaaagttgcgcgtagtatagtacgtaaatttaaaatcggttgtggctcataataatatagcccgtcaaacaagcaggtcggccctttggaatttcgtacttcatgcgtttggccgtgttcggttgttttggcgaaaaaaaaatgacacatacggagacacatttaaatattaaacgtagactaataacaaaacaaattacagatttcacctgtaaactgcgagacaaatctattaagcctaattaatccgccgttaacaaatgtttactgtagtaccacattgtcaaatcataacgtaattaggctcaaaagattcgtctcgcaatttacatgcaaactgtgcaattggttttttcggttcatatttagtgcttcatatatgtgtccaaatatttaatgtgataaaaaaagtcagaagtttgaaacatttaatgtgataaaaaaagtcagaagtttgaagaaaaataaaggcaaccaaattgtccttaattaatgcaaggatgatcaacgacgacgttacgtcgtagcttttcatgaatttgtttgcttggactgcaaacgaaaaaatgttcaacactttttcggtttgagttgacagcagttgacaaggatgtataatttggtgcatagcttcctggtcctattacaaccgaattttgccaactttttcatcatctctttttttctttcacattaattcatacaaaaagtcagtgaaaatttggtaccacatgtataatgcttattatattatatgcggcgctgtcacacaacgtacaacgtacgcagacaggctacgacgggtactacgtaaaaaagacaagaacacgcgatcgatgacacacactggttcctgcatactatgcacacagtacagtatggtggaaggctatgagcccacttgctaattggctgaatagaatggcttaccaaagcccaacccggcccacacgttccaactagtcggattgctacttttttggactttttgagcttttcttttttcctttttttttgtttgggcaaagcttcaatggacgccatgaaagctcgagactcaagggatgtaacgcaggggcgcagatctgtactccctccgttcaaaaaaaatcctaatacaaaatgtgatttaaaatgtgttatatcttgtactaggttatatttttatgaaatggacaaagtgaatccattgtaattgcatcaaaagtactgcaaacagttcccactggtagtgtagagaggtactgaattcattcttatatcgataattgatgataaaagagtattataacttaggtgtaaccattctcacctttcgtactagccttaactcccaagaactacacaggtcagggtgttaatataatcctaagatataaacaaaatatataatttttctgatagggggccactagtactttttatcttgggcttcttctggaaatctctgctaatattactactcaaggctcaaagttgagtagagcggtgggaccaacgatctgttcaagggcaacatcataatgctaattgcggaaaattacagatctagattacagcccagcccagtcgcatgcaaccaagaggtggcgaagcctgaaaacactagtgatgccacgttactcaaagctacaggaatgaagcaacgtgttgcatacgggctagtagatccataactttgccaccaaatgagaacgacggtggctctaacgtgatatggcttgggccacctggttcaagatcgagcatgtggcgagaaaagcaaagacccagctatcccgagcccctttgaccagggtgcttggggcatagtgtcagggttatggataccacatacctaatagtagttgactaaatctcggcagggctcaccacgtaccatgtcctatacggaaacaatctgcggatataggaggagtaccggataaggaaagacagccagagttctacatagaaacgataaggactactcggattgtatccatataggtttccctagttctacttggacaagaggacacttataggtataaatacaagaccccctagaagaagaggggacacgaccacctcaatcaacacctaacacaatcgacatagaagccacaacacagaagcctacatacgccaagacacgccgccggatatcgacttcagggataagcacggctagtaccctacggtgtctccggattctgtcaggagagacgaaagcgctatctctgatctcgccgagcagggattcgaggaggaaggctatcctgttgtcgactacgagtcagatcgtcagaccgccatgtcgacaatagttagataggctaccccaaatattgtactggtgtgattatcatgaataagagcaataccggcttcggccaacaggatgtagggttattacctgacaattcaggggcccgaacctgtataaaaatccctgtctccatctcttttacctcagtctcgcgtatatcctaataccaacgatccccataccatgcaaataccagaattgcgacatcaaacgtcgacagtggcgcgccaggtagggggattttggtgcttcaggatttagacgagatgggtttaagagatggattctccaacaacaagctactcgacgacttcggctgtggggagatccaacaggctgtggggagatccaacatgtccaagtacatctttcgactagatcggaaccatcatcgtcatcgacaacttggtctatcgagatcaaccaagcctcaagcctcgtggcgtaccaaaagatgttagaccgtatgatgttgaacaagtacgcaacaaggtaattagtagattggttttttaaattgatctactaatttcgtagatacatccgacatgtatctaccaaggtacgcaatattttatctgcaatttatcgtacctatttagatcatacagcattgtcagatccatgatttattatgtttacctagagcatgttctttatacaatatttattgcgcgagtgtccccgatgttaaatcgactacggtctaacgctgggggctcgctctattttcttctgtataaatcatgcttgtttacggtttacataatgcctgatatttacatctgctcgttatatcctgataatgctagaagatccatgcagttttttaagtacatactcgatattatctgctatatgtcttgccttctagaaactatttttcaggaacaattgagcactcgagtaggttgtggtcaagtacaccgcattgtcgagaacgatctcgacaaatgcagagtcgtcgcgcccaacctaccaacgaagaccgatgacctatctcatagccccggccatggctggactactcaagaaaaggttgttaacggataattcctcgcgaacatcatcggcttgatcacccgacatgattgcgaacggacatccggatatgctacaagttgggtgtgtgagtcatgctggccacatgagacgcacatgtaataaaccaactctagcacctctattggtgtttgagagataattctacacgttcactggttctcgaaccagtgcgtagcaatctcttgcaccgccaccaccattggtgtccgagagataattctacacgttcgctggtcctggaaccagtatgtagtaatctctcgcaccgcaacctccattggtgtttgagagataattctactcgttcgctagtcctcgaaccagtatgtactaatctcccgcaccgccacctccattggtgtttgagagataattctacacgttcattggttctcgaaccagtacgtagcaatctctcgcaccgcagcttccattggtgttcgagagatgattctactcgctcgctggtcctcgaaccagtacgtagcaatctcttgcaccgcagcctctattggtgttcgagagatgattctactcgttcgctggtcctcgaaccagtacgtagtaatctctcgcaccgcaacctctattggtattcgagagataattctactcgttcgctggttctcgaaccagtatgtagcaatctctcacaccgcaacttccattggtattcgaagagataattctactcgctcgctggttcttgaaccagtacgtagcaatctctcacaccaacaaacctccattggtgtttgactactacctggtcctcgaccagaggtgtagcgattctcccattacctctacttcaacaaagttgatatcaggtgcacaataatgccaagtgttttacccagagatcccttacccagatgacacatagcgttgaaacctatcctaatgttcctttacgctgtcttgacaaggcctccgaggaacctaagggaacttcggctggggacgcccagagccgataaggccttgtcggatccttcagagacgaaagaccatgtaagatctggtcgtgtaagagttcttgccgtgcgtattaaccaagccatgtaatcggaaatggattttccaacttcacggctgggggctaggatcagtgcttgttcaaccgaggcaggtcaaaggtccaagagccttatcttccgaaaacgattctctgatgacaaggctgggggctagggagagtgtataactcaacaaactgactgatcgaagtcggtaaaagagtagatgctcatatacaaaacattggtctgcaagtttaattcatttttggttttccatacatattataacatgttaccctttgagcgttcgctcgggggctatttctatctaatattcttttctgagtattgatttcaggaaaattctattcgacattatcgaacactccatgtctctatggttctacaccaagatcgactaaggcgagtacgacaaatattgacaaggctccttcgcagactctacgcctactcgattactcgagaacggttggtggatctcgacaaggaatacggaatgaagagatggtgtacccaccgagataaaatttcttgacttcaatctaaattctcgattacagcaagacgggagacttagtcgtatgctctgttctttcttggttgacatcggagatcagacaaaccctataggtgcccgcacgaggctgataagggaagtctaaacgttatctctgaactcaccgagaacggtcacatgagctcgataatagttactccaaggtctgcgcgtggttgagaatatgaattcgttcatttgcattgaagtcgggggctactgtcagggttatggataccacatacctaatagtagttgactactctcacactctctaatgtttgtgttcatccatttagtgtgattgagggttgattagctaggagtcacgtgcattgcttcattgtagagctagtgtggcacttgatcatctccgagccaggtcatcacttgttactcttggaggttgctgtctcctagacaatttgtggaggtgttgccggtgacctctccaaggagattatggagaaggcccggcgccggttgtgagtggtttagagttcaccacctttggagtgaaggaagaactacccctagtgatcaaggcttgggtagtccacttcgtggccggctcccacctttcccaccccttgatgaagggggcttgcggtggcttcgtggttttgagagttgaactagggcttgccttaacggggattaggaaaccggcgagtttccgaacctcgggtgaaaaattccttgtcttgtctcatttacttattgcattttcatttgtgcaatttactttcatatagacatatttgagcccatatcaccttaggattgcaaaacatcacttagttgcaatttactttcatagagacatatttgagtccatagcaccctaggattgcaaaacataacttattagttgcttaattaagtttatccctcaccaagcctagcaacttaggtaagttttgattaggtgtgttttaattttaatcgcctattcagcccccccccccaagtcgacttctcgatcttacataatgctagcacacaggagtagggtattatgcttccgagcggcctgaacctgtatatttgcttgttttctttgtttgagtgctcacacaatctgaaattgatccctactcacccctggccgaatctcgaaagggggtcttctcttccctgttgtaggagtaccgatctccgacagtgttaactcaaagaaaaaaaaaccatttacgcccttgctcatttgatcatacttctcaatggtttttgtttcaatataatcaatatcgacaagtgtttgatagtgataatctcataactattacatgagtaaaaagttctaattccaacaaaaattttcaccttcatcactcgtcgcacgcacgcctgctggtggatcccgctaccttcaaccgttctgccgcccgtcgcccgtagttctctcgtttggatcgaagaagagaagcaccagccgtcctcctcgttcggagcgagaaggagcggcatcatcgccaatcgtcctccttgttcaaattgaggagaagcaatgtcattgccatcgtcgtctccttgcccttactgtatgccggataatgccgtcgctgccgatgcatatagcttgtggatgggaggttgtgccgctgcagccaacatcctcgccgacccgccgctactagttccagagcttgcacgcctcgactctatcgaatccaccgcccgggcctcctcatcaccggatccgccctgccactcctccttctcatcgcctgcgcaacaagcctccatttgatccacctcaccactgctgctccttgtcactgagccaccaccattgctccttctccttgtcgcacgcaccaagccttcatctgatctgcctcgctgctgctccttctttcctcgagccgccgccacctcttctcttagtcgttgagccgtcaccagatccactgtcacgcccagaaattcacgaaccagaatttctaaactgaatgtgcattaaatccctatccaggaccagccagggtacacaaacgacaattgttgacatacagatccacgtcttacaaaaatagaaaagattacaaatgcagcggaaaaagataaaacgagctaaacttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12200 - DNA, 745 bp, Oryza sativa
cagtagttcatcacatgtatcggctaatactccgatactacgctatatcaggacattaaaacagatatagaatatgaagcaaaagcctaacacattcaaatacaccaatatcttggcataaagggcagtgaagcaaatagagataattatagttaaatcagatacgaccggctgaaactccgatgctattctaatcggcgtatatatatatatatatatatatatatatatatatatatacacacacgcacacataatagaaggattttgcaggtgagaagacaatgatcgacaagcgtcacgtgcacatgtcggacgagttcctgaggagcaacccttccgtggcggcgtacaactccccctctatcaacgtccgccagaatctcaccgatgtcactgtgccccagctgggcgctgccgccgcccggctcgccatcgccgactggggccggccggcgtgcgagatcacccacctggtgatgtgcaccaccgtcagcggatgcatgcccggcgccgacttcgaggtggtgaagctgctcggtctcccgctcaccaccaagcgctgcatgatgtaccacatcggctgccatggcggcggcaccgcgctgcgcctcgccaaggacctcgccgagaacaatccaggcggccgtgtgctggtggtctgctccgagggcgtctccatggtgttccgcgggccttgtgaatcgcacatgggcaacctggtagggcaggcgctgttcgggga

SEQ ID NO: 12201 - DNA, 418 bp, Oryza sativa
aaaaggtatgtacagcttacagcactccaaattccccctggagacttgaacagaaagctaggtgattaaagtgatcgccggcgaggtcatggcccccacgccggcgactaaagaacgatggtgagggctccatttccggtgacctccacacgacaggacgcacctcgccgtggcgcattggtggttaggcaccgcgcgccgttgaaccgggcgtttttcttttttaattgcgagatctttctgaagcggtcaagctaggcaactgcaagtggtgtgatagcttacaggtggggccgcttcgtcagtgggggtgacggatcggagcagcttggcgttggcagctagccgcgctggttgcacttcacacggcggagtcgtcgtcgtcgccgccgttgacgtcgggtttggcggcggtggc

SEQ ID NO: 12202 - DNA, 752 bp, Oryza sativa
ttagtagcctaagtttccgtacatgcagtttgtaggtggctcggtctctcaaggttcagaattgcaaatagaggtggcagaatttctatggcaagatgttgaggtaagtagtaaccatcaaaggacatagtttccttctacattttcctttatatggcaaactaactttatttgtttaagttttagctcgatggaagcctaatcgttttagctgacaatattatgggttcaaccaacaagaataatactggagaacaaataatgcactatggtgccaggtaaaatcctttccttgcactcttatctgtaaactcttgtcctgtacagacgaaactcaaaactccatggttgttgaaaggtgtgggagatgcaaactgcaaagtgttaaaattgtgaataaagggatcaactggattctgccaataatgtctactggaagcatgatgtcgagagatcagaatctgtgaagatcattcttcatgaaaatgccgaatttgaggcaaaagatgttgtccttaaggtgcaattatttataaacactttgaattccattatctaaaaaataaacactttgaatagtgtccccgctttttcttttttcttactattgaatatccttgttctaccagggtaaccatatctttgaagttcccactggtcatagaatgcgcattgttcaagatggaccaggtttgttaaatacatgtcctattttcctcttatctttggtgccattttgcgaaaaggctacc

SEQ ID NO: 12203 - DNA, 15265 bp, Oryza sativa
attcccccaaaaatgtctccttttgtttccatcactgttatatgttatgagcaacattcaagttacaaacttccattgtttcaacctttgaggtatgcttgaatcaacttatttagtaaaacgtcattctttacagcaccttttgtaaacatgttacaacttgtgccttgggcttttacaggacctatttattttgaaacagcatgtcaatgatctggagcattggtgatcaaagttgagcttggctgctgcagtgggtatggaaactaaaagtcaggagaaagcaaattgagggatttgaggtactgtgcatgcttgttgataaagttggaatattcaacactgcctggatagttaagattgacagtaacagtttattgcattgtgttggtgacttggtggtaaattacctggatatgaatagcacaacagttacagatagtcagaatttgaactattatccccttttgactgctttagaataatgatgctgacgtgaatttgacaaagaaatgttgtgtcaaacctgtatgcgttgcatgaactggagttgtcggatgcaaatggctattagctaatatttttaatttacatatacctagaatgactaaaccgtactatactgctatggtttaattggatgatgtgcaatgcctacagaataaaacaagtatccacttgatggattagttcgctctctaccacacaaaaggagttaggattggagatccatttgcatttattatgtacatctagcaaaataatactatgcacatccagcaaaataatactatgcatttgtctaaacctgttacctacatgttctatctgagctttttattcatgtatgaccacacgctcggtttgaacaaggctggaaaaagtgtttactctatgctaccctaagaattaaggaaacatcattttcattagaattgagttcctatttaaacttttggttgtttttctccagaatggggtggggaagggaggagggatgcataattaatactagcgtattaaacaaacacctgtgtccagataccaaggtactagtcatcactgatgtagtcagctagattcactctgccttgccagatccaggaggcaagcttcttgtccctcgagcatttcatttcattcatgtgtagatgactaagggctgacctaatttgattcctttattgtggatcagcagaagtttatatcaacttggcgtggctgatgcgttcattattcagcggtgctgcaggatggtggacatgtctcccagcacttcagctctctctctcggtaagtgttctggtgcacctggtctctctcatatacccctcttggggatgtgcagtttttatacactactagtacagtaaatcattatcctgaaactggggttgccctggtctttgccacaacatgtattcatatgcttcaaattgctgcaagcattgtgtaatgcaagttgtggctacaaaattgggtgattgactaaacaaagaagtagcaaaccataaatgctgggatctaatgtcgagtcgacggccccggttttggttcatcagaatcacccttacacgacgtgcaattatatactggtacaacaaaatggtggatctatagtttggactgaacattagtcatcttgtccagtattgtattataccttggcaacttactctagattccaaaagaaaaaaacattttcacgttgagaattacattatatatttgtgaattgtgagaatattctagagaagatgagatataccctattggggccgtatgatgggagacgaatagacgattggggtggagttggggcaagactttttttttgagaaccagttggggcaagacttgagagggtgggtatatcttgtccatgttttttgcacatcttttcccacttttcaccttgtttctagggatgtcatatgtatatacgagaaaattgcatcttgcaccaggtctatccgcatattttggatgacaatgtaattagtatttgaaaacaaaaattcgtaaagcaaactcttcggtcagtgtaccaacgtacgtacagtgtataccgttgtcagttaaaaacttcaagataagtgctcgggggtaagccaagaataatccaaaaaacacttcaaacggttttgacttaaaaaaaggttctggtctacaacagctttcttggtcagaaagcgtgccaactggccaccatctatagtacatcgtctcaaatctagaaattgttttctagcatgaaactagttgaatttgccgcaaaaattgtttgaaataaaattgtatctcttctgcaactatatttctatttctaaattatatttatgttatgtatagacgagctgatgtcaaatgtagtcttcgccaacaaatggtttgtcaccgtattttttttgtcacagagtaaggctgtctttagttccttaaaaaagttggaagtttgaaaaaaaaaagttgaaagtttatgtgtgtaggaaagttttaagggtagttggggataaactaaacacggcagtagtcgggtggctaagcggtgcctacctcgcctagcacctctttttagaaacacacacatattatgtagtcaacagtactctcctgtttcaaaaaatgtatgtctagattattttataggatttgagtttttttagacaaagggagtacttcctccgtacctgtaaaggaagtcgttttgtacagcgacacgatctccaaaacacaactttgacttcttgtttctataaaaatatttattgaaaagttatatatgtatacttttatgaaagtatttttcaagataaatctattcatataatttttacattttcaaacttaacaactttagagttattcatgatttatattcctaaggtttggcttaaacattatcctaaacgactttctttacgagtacgaaggaagtatatatcattataatttgcacctacttgttataaacgtaaatattgtgatttgccactcgaatgacggttctagttgcatttttgcaattttctagtggtagttttgcaataacgattcaaagtagtggtaaatttacaattgcccctaatttttagaccttgattggcttctttcaggctgctcaagtgattggattttctctaacagccctttcccatatggagctgattttttgggatagtttggaatatcccattattcaaacatgcccttagtatctcctgttcgtgcaggtagtacatcgtatctgctccgtgagttggtttcgtgcgcatcaattacactgtactccttctatagtacaagaggagattcttttttcagaacaagctcaaattctaatacaagtaggatgatacccaaggtccgatacaaggagggtggcgatactgctgaatctacatgtctattctccacaaagaagccaatcaaggtttggacttaggaatctcctcaactaccatcattaaaaagacaaagtgggcataaagaacacgaaaaactcaagtcatgtatcaggcctatttattttcttttccttcaggacaaaccaagacatgccacatctatgaagagaagaaaagttttaagtaaaaactaaggaagaaaaggcgcatcacgccacacacaaccatatcccgtgggccatcttgcgagaaatggctgcctccggcgttgactcggaggctttggctaccctgctcccctcgccatttcattggccgtttcgtggccatccatcacgaactcgatcgattcccctcttcgagcccgtaccaattattagctagtttaactcgtacgatgaatcacgccgaaacacaatataaatggtggagtcggctcgctgtcaaacgcgcgggagctcgcgccacttgtaatttttcgcgtctcctctcgtccggcacagcacaggagcgcggacttgaagacctcaagtagcgattcgtccgtgcggcgcggcgcaagaagggaagggaaggggactaggggagggcgagatggcggcggcgggggcgtactcggcgagcctaccggcggtgccggactggctgaacaagggggacaacgcgtggcagctgacggcgtcgacgctggtggggatccagtcgatgcccgggctggtggtgctgtacggcagcatcgtgaagaagaagtgggcggtgaactcggcgttcatggcgctctacgcctacgcgtcgtcgctgctggtgtgggtgctggtcggcttccgcatggcgttcggcgaccagctgctgccgttctggggcaaggccggcgtggcgctgacccagagctacctcgtcggccgcgccacgctgccggccaccgcgcacggcgccatcccgcgcaccgagcccttctacccggaggccacgctggtgctcttccagttcgagttcgccgccatcacgctcgtcctcctcgccggctccgtcctcggccgcatgaacatcaaggcctggatggccttcaccccgctctggctcctcctctcctacaccgtcggcgccttcagcctctggggcggcggcttcctctaccgctggggcgtcatcgactactccggcggctacgtcatccacctctcctccggcatcgccggcttcaccgccgcctactgggtacgttcgtctctcgttttttttcctttctttctttctttcctctcctcagttggatcacatgtcattgtcggaatcatgacgtcacccaccccggtttttttgatccggcgacttcactgttccggcgtctcgggtttgtccaacgcgtgttaggtactggtactaccctgtaccatttgtttgacccatcaatctggattcctcatgagaatgcatcacactccatgacaaaattctcaatagaatttagtcgtagtacgtacaatgtctagaccagaaattacttcatgttcaaagtcaccatgggggaaaattagtagaaaataatggaaatcaatgcatcagctggttgtagatttttttttctaccctttgggaagtcacatgatacgtagcatcacattgccgctgataggctgatagctgcacccaataaaagggttaaaacaccttttaccacatggaatgtgtgaacattggaccgcgtccatttgcttcggctggtgggcggcggtgatggctgccgctgcctgccgtgcccggaagacttcgttggcgcgcgctccattttttttccttccttttgttcttgcggttgctgttgtgtttggggtcgcaatcgtgtgtgccactttgcagcagcaagcagatacacgcgagcttattaagaaatggtgtggttccacaccaacaccaggaaattcagtctagcgtcgtggccggaaatttattatctcgatcgttgtcgtcgatagtaactgcacgctaaaatatctggtgatattgcttctcgtgttatccaacttgtgtggctaatggtttgggtcaagaatagagaaaacggcaagttaaaaatgggcttattttctgagtttcttttgtgatcggactatctgaattttgcaaggactgtactagctaggcacgtttggaatgaaaatctttttccgtaataatccgaaaataaactttttctacaaagtcgaatagaatcatcttgcgcgttgaattttgcaaggactgtactagttagtagctttttcatgcacggatggttttttacattaaaaattttgacaccttgagttacctaccaaattttataatttaaaaatgtatgactcctaatatattttcaaagatgctaaaaccaccctttaaccaatcgtccattaagacttctaatgcgtgtggctggcaggtggggccaaggctgaagagcgaccgtgagcggttctcaccgaacaacatcctgctgatgatcgcgggcggcgggctgctgtggatggggtgggccgggttcaacggcggcgcgccgtacgccgccaacatcgcggcgtcggtcgccgtgctcaacaccaacgtctgcgccgccaccagcctcctcatgtggacctgcctcgacgtcatcttcttccgcaagccgtccgtcatcggcgccgtgcagggcatgatgaccggcctcgtctgcatcacccccggcgcaggtaccatcacgaaaaatctccactccttataatttctgaatttatcatgtcccatttagaacacggagattttatatatttgaaatgataaaatattaatagtggtaatgttcgttatttcacatcatccctaatcccctattactgatatttgagccttacaatcaacgagtctatcaacgagtcttcttccattttattattggctctttctaaatttcgaaataacctaattgattgtgaatatgttattaattgacttagtaagctataaaagggagaatagctaatatggtccttaatctttcatattgtacaaacaagccctttaattttgtcatatgtgttatatagtccttggtctcaccaaaatcgtcacatagatatgccatgtcacattcctatgcaaaatctatatgatttgtccaatttaccttacatatatcataggaaaataaaaaacaaaaggtaaaatataagagcaaaaatatacctcaaaagggtgaaaaaaaggataactattttttcctatagttatgtctaattcacccttatatttatttttctacgatatacacgtaagggtaaattggacaattcatcatagattttgcataaatgatgacatggcatatccatataatgattttggtggatccaagaactattctagaccttatgacaaagtttaaggatttctttagaccatttaaaaggttagggactaaactgatcctacagaaaaactttagggactaaagtagctattctcccgctataaaaactcttctttcttttttgcaacgcacggttcctggctagtcttggaatgattctacatttatatccgaggcaaataaaaagaagtttcgtatgtttttaggtccggtttgcaattgttgtcctatgctgcgttgtgcttgtgcttatttttccaaatgtcagcagtaatttgttggttttattcacaattgtgtaagcagggctggtgcagacctgggcggccgtggtaatgggcatcttcgccggcagcgtgccgtggttcaccatgatgatcctgcacaagaagtcagcgctgctgatgaaggtggacgacacgctcgccgtgttccacacccacgccgtggcggggctcctcggcggcatcctcacgggcctcctggccaccccggagctcttctccctcgagtccacggtgccgggactccgcggcgcgttctacggcggcggtatcaagcagatcggcaagcagctcggcggcgccgcgttcgtgatcgcgtggaacctcgtggtcaccacggccatcctcctcggcatcggcctgttcatcccgctgcggatgcccgacgagcagctcatgatcggcgacgacgcggcgcacggcgaggaggcctacgcgctgtggggcgacggcgagaagttcgacgcgacgcggcacgacctgtcgaggggcggcggaggcggcgacagggacggccccgccggcgagcgcctctccgccctaggcgccaggggcgtcaccatccagctctaggcgcgccacgccacgccacgccgcgccgcgccgcggcctggcctctaattacacgcgcgtttgtactgtttttggacgtgttattgtttaggagtagtgaagtgaaccaacgattgactgcaaggtgaagggtgagaacgcgagagaccagaccactatagtctatagtacatatggatgctgtaatgatgttgatccgagttcgtttttccaacacgataaaggccgacatgcctattaaattttccaatctatcaggtcgtgcttgctacgtgcaaccgctctctgatcaactagtacgcgacgtgatccaatgttgcaataacgtagtagatgcatgctgtattcaataacaccaccacccaagtgacttgttttttattggataaaagttcaacaagtttgtgatatggtacaagctctgcaaagaacagtctcacaggggtgtcaaaatgcagagagctcgcgtcctagaagacggccatgagctcggcttctcccagcacatgcccctcgatggcgtccatcagcttgtccttggtcacctgcaagcaatcaagaatcaaccaccgttaaactaatccttaaaacagcacatgtaatcgcaacaagatatggttcgatcggatcaaaacttgccttgttgccgaggtgcacctcgtcgtcgagggcgtagagcttgaactggatgcggtggccgcgggagggagggatggggccgcgccagccgggctgcttccagtcgttgacgccctcctggatgccgccgtactcgcgggcggcggcgccctccttgccggagaagccctcggggaggcccttgacggagggcgggatgttggcgacgacccagtgcgtccacggcacgatggggccgtccgggtccggggcgtcgacgtcgtgcaccaccagcgccagcgaccgcgtcccgtcgggcaccccgtaccactccaccggcggcgagatgtccttcttcgcgccctgcccctccagcgtgtagtgccgcggcagccgcccctcgtgcgccgcgatcgggtgcgacaccagcctcaggctctcctgcgccatcgcggcacaaacaaactctgttcttgcttgacgaacgcttcgtgtgttcgcttcgcgctcgtggcgtctcttggttgatgcgagaatggatgacgatgacgacgagtgccgcggcgtgcgcggcgcgggggtttaataaacggaggaggagcgattcgagcagcgtggcgcggcggacgtacgcgtggcgagggtggtggagggggtacgtggaggtcggcgccggagtcgtgtcgcgttttccagagacgggggaaaaaggcgcgttggggtcggccgcgtgacgaagtttcgagaggcttacaggtttatcctttaaggcccgtttggttggagggatttttacctgtttagaaggatgaggttattacctgttttgtttggttgggagacatgaaaattttgatgggatggagatggggaattgaggaaggaactctttccttttcaataccttggtaggggtggtaatttggagggaattcctcatttactttacctaaacaaatctcagctaaccgttttcattaatgacctaatctctaactaaactctatgtcaatttccaccacctctgccaaacaagatattgggaataaaaatcaaattcccatcttaatctcaccatcaatttcctcatgtaagctcccaatccccttcacttaagttgccaaacaaaccgtaagcacttgttaatcggcgcagtgtttttctcttctctgtccgtctaggtgtctcccgctcccccgcgcgcgttttagcgcggaggaaagagagagagagtttggatttctcgtaggaactgggcctgaattattatccatacaaggcctgagcccgttccgattatattatagatgggtttaggccgtgacaaaattccttcagctggaaaaaggccgtgaggaaggcctgtcactgtaaggaagtccgttcggattgccttaaggagtaagtccacttggagcccctcaaatatccggtgcaatatagctccctcgaagatatcggtatcacgtacggatgagggatacgaattagatttgacctatatttaagggagttaaaatggacttattccttttccttatgccgattatatacgggcccaatcatcaatacttctaaagctagatggggacccagccagctgattggtccacttgtcccataagtttttcgacacgtgtcgcttctagactctcaaatcgatcgcttcagtaggcaccggctgggccgtggatccgcgcatacttgtgagctaggccacgccggcctaaccagctcctgggctgaaaaaaaatataaacaaacaagagagctgcccctgctcctaaaaaaaagtgagagaaaataaaatatgaaaaacatatccaaggaggatgtaatgataaattacatcagtttactgctaattaatactaccatgaactagcctatactgtgagcttgggtatttcttaatcctctaaaaacgttacattcaatagtaacttaagaaactgcacatgttttaaagtagcgagcgtgccgattctggatatacaggaacaatatggttctctgcccatttcaaaataatttatgttgaattactatgaaaattttgtattacaaattgatcattcaatgaaaaaagtggtagctgaaagtcatttccccagaaaataataatgaatctaattcaattcaatttttctaagctgaattgagtttttcaatttttctaagccacacactacagtactgactatccacgatttaacccgtgataaatactaagttgttttttcctttgacgaccaatatctaccaacttctattctaataccattttcattgatttattcaatatttaactatctagctagcacaagttcataaacgcaacaactattttagtcaccagcttttacgaatccagaagaacgaaactataataaatcaattctactatgaaacaagcaggttataaaatagtaggcgtgcctatcggcacgctaattttctagtttagtttaaattcacaacttggatatcaggtcattaatggatttgggtcgtgattttagtcttaatttcagcctacaaatacggatgggtgaaaatttcggacactaactgaaccaagttgggctcggcctggttaagactacgcactaaaggaggtcttttttctcgtcgcgtcctttacgtggaaatccaggccagttggccattccttgactcgtaccgaactaccgatgagaatttttttactctatgagaaactgaacaaaaagctactaaattggcttattttttacgtataccaatgagaattttgagtaccatttgcatttttttaaatgaattgaatgaagaagaactaaaagaagaaaagttttctcaacacgaggagagatcccttcaaaattgcattattgtaaagggattttaagtatttatctagggctaagctctgggcctctagctaggttgcattccggctaattggcgcctctacttctctgcactacactgtaacactatctgcacgccacaggatcaaacggtgattctatcatgagctaattagtagattaactgtactcccttataacttaagacgagaaatgatacattctaacactatgaatctgaacatacacatatatttgtagtattataatatatcacatctctctctgtttttttttgagtagatcgctgcttgcatccatccatgcatatatcattcgatggtcacttcagctttgacaacagtgccactctatattcagaacaccgctaaacgatgcagtcatgcaacagggcagggcctcgctgctttcggcggttcggcccccgccgcaatacatttccttgagctgataacagcgacggatcaatgaaccgtacatgcgagccatcatccacctgaccggaccaccagtcctccaccacaaacctcctcccttcctcgaggctcgatcgatgaaccgcacgcgatccgtcgtcagatcgatgcaacaccatcgtgcaacagtggtcacaggaaactgatcagctcgctttagcatcagactcgcactcgcccagccacaattagcccaagtaggctacctctttttcgcgagatgttatagtacatttaccgtgcatgcatctgctcatcgtttctgctggacagctgaatgtgggcacagggcaccgcacgtcgatcttgcgtctactctccatcatcagctgcgagaaaatcgatcgatccaaagcaagctagataggagtagcaattatatgatccatcgtccatccaatcgcatgacagcgtactccgttttctaacttgcactgcgtgaaaaaagttgtcacttcactgatatgatcatgctttggctaagtagccaacaactactggcaagtacgagaacagcgagtagaatgtagccatgacggaaaccgtacgatggggatgagtgggatcaggggactcatagtgcgatgctggtgaagaagatatggcgcttttgcagtttttgtccggttggatcgcctactttttccgcccacagcttagctagttcgcactttgccatatgcaacctgggcagggcaacgccatatgcgccttttacccgagcaccgtgcctaatctaagcttaagctcagcccaatcgtaatgtgcactaggtgcaacaaggcaacaacaactgcactgcactagacgtaagcccaagaaaggaagaaagctaggaattggtgatagaacgcacggaaagtagcctggacagccttcgtctccttcctccaggatatttttcagaaatgatgatagataatggaagtgatcagacacatggctttctggctttaattcagtcattgccccttttttggagctgctagctaagctagctagctatctgtttctctgctttaatttgtgtgtagcggtcattgttaggcatgcaataatctattagcaaaaggagcatgatagtagattagattgggaattaaagggtggtgtgtgtgatatatatgtatgcagctagtgatatgtgtgatcgaccactcaaagcccggccggggtccatggtgtgcagcgagcttttcgatcgggccacagccttatctcgatcaatcgagctcaaagcgatctgtgatttgtgaccgctaccgttgctgcctttgatctcgcgcgccgcgcgcgcgcggtcgagccgagagatcagggtggatttcacgtaacgtcgcacgccatgtgtcttgttggcttcctgtctcggtggctagaggcgtagtgcacatcagaacagaggcgccaaactgaacagttactactattggtattttctccttttctttatctttcgagatagagaaaaaaacaagtgctggtattctttttagcggtctagatattttgttttcatgttttctgtttgatttacattattcagtttactatcgtagattttctacttgaatataggaacaattcaattaggtatttttaaaaaaaaaataaaaacaagtggtctgaacaaacaaaagaagaaagtttttttttgagaaaacatattttttttgaagagcagaataaataatccattttaatgattcggtaaataatatgaaaagattacttaggttattgctgcatgagcattgcttcaagttatttcaagtgttaactactgaaaattgcttgaaacaagacggtatgaaggcgaaaaaggccgcactacttttgtcttgctcgattttattatcatccggttcaacttccggttgtaaataaaatggtcatgttaactcatgtgtctacttgtaccagcagctgttaggcgcatagcatgaagacatgtacactccaatcatacaaacctgcgtggaaagtcgtctaccggatgcaataatatatggagcagtacacaccaacttatgtacacaaacaatttgaatatttacatgacttttgtggctcaaaaccaacgccctccattgcgacttgcgagtcaataatattcccacaagccagcaaacgtgccagcgacatcgctcggtcaacagctagcgaccaaatctttccaagtcgacgcgaaaacgagcgcgcggagccagtcggccgagcccgaaaacgaccggatcgctccgaagcttagccagccggccgagccggatgcatccgttcgagcggctgtcttcgttgctgcccctttcccggaaaacggagcggttcactagtacttaaaaaaaacatatcgtttactccctctgggttgataatacttatcgttttggataagggcacggtctctaaaaaataattttgaccattattttttattataacatgtataaaagtgttaacaaatatatgattttattaaagtactttttaagactaatctatacatgttattatcatgtttgaaagataaatattttaaaaataattcataatcaaagattctaaaatttgacttcactcttgtctaaaacgacaagtattattagcccggagaaaatagtagtttgaaaagcgtgagcgcgaaaaacgagagcggggagttggtaaccaggggaaatgaactaggatggactcctccgttttcatattgtaggtctttttaacttgtttttttaaacatttttagttcgagtaagattatgaaaaaaattagtaacatcagttttattaaaaatatattttcataatatgtctatttatactagaaatattgatatatttttccataattttagaaaaaaaattaaaaatgtttaactaggaaaaaaatgacttataatacaaaacagaggggtatttgagaagacggggaaatgagaaaatttaaaagatgtgagaaatgaggtgtgccattggtgtatgattaattaaatattaactattttaaatttaaaacaaaaattaatataattttaaaaacaacttttctgtatgtttctttttcttttcttttttttttgaaaaaacgaaccttttagcgtttaggtgttcgactgcgcgcgcggcagccacgcctttaccaaccttaaaagggacggccctgccgccttgaatttgttaaaacccacacgacacccatcgcgtttcgcactccggtacaccacggtgctcgcgctcgcgtcgctcgccacaccacacgccaccaccgcgcgggcacgcgcgccacttgcgcgcagacgcgccgaagcttcttcgtctcgatcgcgccgcgcgcgatcgagcgcgacgtacggctagctgccgccaccaccaccaccacacgccggccggaggactggtcaatctcccatgtgcctccaccgcatatagcgtggagagctagctagctctactactgtggctgtggcctgtgggagcagggagcaatggccgcgcaggagagcgccgcggggacgacgaaccaggtgatgcggtggcggtacggggacgtcgacgacagcaacttcgcggtgcacggccgcgccgtgtacctgctggtcgggctgctcgtcgccgtcgtggtgttcgtcgccctctgcctctacctccg

SEQ ID NO: 12204 - DNA, 17845 bp, Oryza sativa
tcaactaaatgactacgaaaaattttcaaaaaaatcggcaagatagatcaatatgtaatatatcactccacaaatatgcaagttaaaattcaacttctacaagttgtaacaaaaataacaaatttaactgtaaatatacatatagtaatttgagttttgtttgttatttttgttacaatctgtagaagttgaattttaacttgtatgtttgtggattgatacattacatattgatctatcttatccatattttttcaattccttttataattatttagatgacatgcaataaatgggtggacattcactcaagcggttaaaatagtttctcgattgcaacagggaattcgctgcggttcagtaaagtatttgtggctggattgttggagttatcgcgaacagtggcaccacaggctgaagctgcctgcccactacgtaatattattttaagcgagacttgattagttttcacgcatgcactcctgatgtcgtccaccaccggcatttcgatccaaccggggcaacattcgctctgatccaacattcgctctgatcctgaagaagagcatgctcgcagtagcagcaacttgcaagctagtagctagcaacaaagtcgaccagtgatatgttgatggaattgtgggtgtataatactcacgaatgttacgcatatataaatagactataaatataattttagtaagactagagatataccgttggttttcgtctttgagattagcgtgtgttagagggtgcagttgtgaaggtgtgagtgtgatattttttgcgtttgtttaccgtgtaatgaaaagaaagaagtcgaccggagatattctcctgccgaaaagtgatcgatcgacataagaaaattcaacaggtgctgtatcctttcttttctgttccatagtgcagcggttcaattttaaattcagtttaaaggggagagattaatttgaaagggagacacgacaggattggggttatcgctaatgaaatcatcatcatggcccggtggtctaccaggtgcaacaaggttagccactggcccggtgcttttgatcatttttgatgaaccagtgcagcacaagtagctgatgctgacggccggcgcctgtcctttccgcgagcaagaggtggctttattactctttccgttactaaatatttaacaccattaactttttagcacatgtttgatcgtaagtcttatttaaatttttttataaaatatgtaaaactatatgtatacataaaagtatatttggcaatgaatcaaatgatagaaaaaaattaataattatttaatttttttatataagatgaacggtcaaacatatttaaaaaagtcaatggcgtcaaataaaatatatttaaaaaaatcaacgccgtcaaatatttagatacggggagaacttcgtaagcggggttgttgattgcaaacttgggactactggagacatgggcccggaggatcgattgggcgcgactccctcggcaattcgccatgttcctgtatggtcttctgccggcgccattgtagcgtaatctattggatgagcggcggcgaagctgagctgccgtcttaattttgcttgagttatatatatatatatatatgaaacgaaatcgtgctgttccggtagccggcgctgctgattttatgagtttgttagtaaattaggtacatgaatttgtgagacaattaactagcgcagcaaccaaaaaggaaatacgtacaatttggtattcggagagaactcgagagctcaatggaaccatgtcagactatgatccaaaaatgcacttctcttttgctttttagccctagcggacaactttagatgcaattattgcagcaacgtgcagataaattcgacgattgtacgaagtgagcataactcaactgattaaattcattatgatggaaccaactaacccggattaattgaagttctagactttaacggctaaatatttttcagtggtaggcgacgtacctgtcgtgagcgaaacgtctgtgatgacattgttaatctcaagatatgtctaacaagtcttccagagatgctcataggagtagagtgtgcgtgtgtgttcgtaggggtgagtgtgcgtgtgtgttcgtaggggtgagtgtgcgcgcgttactagcgtctttttttcacgaattgtatattatataataagttgtacctgtccttctactgatattgtcgaggggtgaccctctctagcgggaggctgtgaggcccccctttgagagttcggtcgggggcagcgggtgagattcgaggatttggtgagcaaaactgtgtgtgatcttgatctcggaagctcctccaagacgatgagacaaaagaggtttatacaggttcgggccgctatgaagcgtaataccctactcctgtgtgtatgattcttctgtgcttagaaagtccctgaatccctggtatgcaagctagggttagacaagctttggctcagggatcctcagtccaatcccccttcctcgctaggtatggtcctccttttatacttctaaggggatatcacatgtgctgcgagtgctacctagggagaagggaaaatattctctatattaattacatgtcttgtgccttagcccagaagctatctgcacgtcggttgctgcgcggggcccatcaaatcatgcagggcgcccttgtcatttgccatttaatggatgaggacttccgggttctcgttcacaccagaaaacgggaacccgggtcagttcagagtggttggaccagctctgaccggggtaagaggctgtgaaacccctcatcattatgatgggacgggacggagcacgccgctcgccgcctgacacactgacagggcgggggtacacagtcgccgtcccatcggtcattcaaccggtcacagaccggtcagatgcgcagcacgccacattaaatacggcatggcgcggttgcatagaccgctttaaatgcagttaggtgggcgttaggcgcgcccacctaaccctgtacacgtgggctgatacgtggagggggtcggggcagctcgaccccaagcaagggcggcctcctccctctagcttggagggggcagccgccgtgccaccccgggctcgacccccctcggggggaaccacgtgggtttgggggcggcccaaccccaagctgggagggggcagccgccgcaacaccccgggctcgacccccctcggggagagccacgtgagtttgagggcggcctgctccctctagctgggagggggtagccgccgcgccaccccgggctcgaccccccctcggggggagccacgtgggtttgggggcagcccgaccccaagctgggagggggcagccgccgcaacacccgggctcgacccccctcggggagagccacgtgggtttgagggcggcctcctccctctagctgggagggggtagccaccgctccaccccgggcttgatcccccctcacggggagctacgtgggttgggggctgcccgaccccaagctgggagggggcagccgccgcaacaccccgggctcgacccccctcggggagagccatgtgggtttgagggcggcctcctccctctagctgggagggggtagccaccgctccaccccgggcttgatccccctcgcagggagccacgtgggtttgagggcggccccctctctctagacgtgatacccccgggcccatatcaccgatagtagcccccggcattagccctgaccaaaaccttcccccagtggccagggttgacgccactctcctagtctaacgatgtgggcccggtctcttctccattctttgctggcactagggcccatgcgcctttttcgccccaacttgagggcgactcgccagcccgtaccttgggttgtgaatttattttctgtatatattcagcaaacgttgttagattctctcgggcccgcggcgcaccttgcttgcccctgccttttgttaacctctgttcatgttctacttcatctattcaaacgattattttcgtgtgagtgtgaggactgaactttccatagccagcaatcctcacccgcgatcaagccaagctgggtgccatagccagccggcggggccaaagccagttgctacgggagagccagcacagggggctccgggcgtcaacggcgtccagagctcgacgcaggtctaggatagagctaggaatcgtagcccccacacttttagcaaagaatcattttaatgggtgaagtgaatacaaactttttgttaccaaggggggcaaatgagcgtgtgacacgtgggaatcatgggaccgcgaggaagagatgggtgagagataaatataagccatgataattttgctgataagcatgaataaagaagatatatacttaaaggaagtattacaaatgctatgctcaaaaagagtccccggccaacgctgagctttcccagagaggtctgctttggtccgggtattgtaacacctcctttgttacctttgtttatccttgtttacacgttgcgacctttcaaacctttggctcgaagagggctccccaccctgggctccgaaccctttagggaagctgttgacagaaacacgtggcttgggagatccgcttaactccagtgtaggtccaaaactcgccttcggatgtgttagcgtgccagttgatttaatcctgtaatcaacaagaaatagaagcgaagaaatcgtagttaaatttataaatgatagccgatcagctagatgccgatgacatatcatttatctttgagccgatgtcatctgtgtatcgatcggcagttataaataagtaaagaagaactaaatctacttgatcggctgtagatattaacaatatatactccttatatcgatatatacttaaatcaagtgattaggatagatcggtcatcatgccaagacagtataaatcacttagatcaaaatatatgtcaataacaagattatatatgcttatagcatagctgatcagatagatatagcatgtatcggctaatactccgatactactctatatcaagatgttaaagcaagtataatatattgagcaaaagcctaatatacttaaatacggcaagatcttaacgcaaagggcagatttaacatgtcaatcaagcgtataggataaaaagtagttaaatcagatacgatcggctgaaaccccgatgctattctaatcggcaactagaaggcatgctagggattgatattctaagcacgacttaatagatcaaacttaactgatgcagcattaagtatgaaaagaagaacgatatctagacaatcaagccgctagaagtctcatagaatggtagatgtctcatataatctagaccaatatcaatatttaacctaatcggctaccctctattgacagatattaaccgacgtcaggttagatgatgatattgctagagattatgtaagacatatgataactcgacgaattacataaacaagattagagtgtcataaagatggaagcactaatcccgagaacgcaagccaccataacaagtttacctcttgttgaagatcaaaaccgatgcagctcaacccgaaagcaacaactcgtcgaaataaaacgaaagtaaaaagggtggcgatgcgccgagattgtattgaacgtgtgtgttttattacatagggctcggggtctatttatacccgaggattacaagatatgcccataccggacacaaccattatctctaacaaactctaagataccacaagtctttgcggcagacttttgcccacacttatctataaggaattcacataaaatatcctagttaatagatacaattgccttcccaggactctatccatgcgtggcaatcatcttgaagtacattaacttgaacccgatgtcgcgcacaagccgtattgtcggaatcgtctatatcgacttatttagctcgactcagactcagccgatcttgtcgtagctgatccggactttagccgattcctgccctgttttcaaactcgatctccgcttctgactttgcttcgatctaatcttctctccgatgctgatgttaccaaatttggttgttaacacatgccccacaagtccggcatatttgataatgttctggatttgccataagccgactccgagcaagtctcacactccgccacttttaaccgttattccagcgctttaaatactacctgttacccccgagaaatctcacgccgtgacttcctttttcaccgctcaagcgaaaccttttctctctcttcttggcgattcccccggcgcaaaggcaattcctaggcgacttccttcccagcgagatctccgcccgcaccaatgtcgtcttccgccagcccacttcgtgcaccatcggccgaatacgctgaggtaatttctcattggctaaatccccttctttagcagcaaatcgatcttcttcaatctgatatcactctctccctctgaattgctttggatttgcagcacctttccaacctagttgtcattcccagcctggcgcatgaaaatcactactttcttggcccaatcggcaatccagaccccaccgagtttattattggtgaaaccaataggatccccttcagattaaccaacccagatctaggtcactggaagaataccttcaaatcctggccatccctagagaaagttccaccagaaaagagctggaccacatggttcaaacgtgtatcagccagcaagagggttcactgggatgaaattggaatcggccaagcacttgaccttactatagcgaattcggccaaagatgaacccctgatggcaactgcttcttacttttggtcaaacactaccaatgcctttctgttcaatcaagggctgatgactctaactctcatagatatcattatgatcacaggtctggatgttacctcatctggcagcatacatgggccagggctcggtcacccctcgagaacatgtggctttcctattaatgtggctagaaaaatttcttttttgtggatcaagttgtggccccacaaccaactggcaatttctggctgaagctctagaaacaaagagacaattccccttgggcaaaattctcctcggctatctataccagatgctgagcaatgcatcagctaagatagcagtcggctcagtagttggagcaggtggacattggtggctactgcaaacctggttaaacctgatagtcatgaaggttgtcaattggccatccgtatcagaaactgaattcccaagactagagccgattgtagatgatgatggagaagagcgtactcatcggagatgcacatcctatggagaatacgcttctacaccaactgatgccggagcaaaactatcggctgaactgctcaaggattggttttgtagcttctatgaatgctttcagaaagatgctagaatctggttcctttatgaagactctgcacaacttgagcacccagtggacttcagattcgaagacatcaaccatgaagtataccaatcatccagggaaatcttctcggctgcaatcagcccatgtgtcctccctgttggcattcatcaaggaagaaacatccaagcttcttataaattctatcatccaatgagctcaactagataactcggaatgggccaactcccaatcggcttgttctttgccgacaagatccaatgccgaggaggaatttcatgaaccctgatgatggatcggctgcttagccttcaaggaccccctctgggcagtattggcaacatagaactggcaacattcagaagcaaaagcttcgataggtggtggggtgaatggaaactgcatttacttcactaaccagctttgatgtatatgacagacctctttccagatgttgtccctcaagtaagcctccaacttcgctcaattttagttaaataattgtttggccgattaatcttaaccaatcatccttttggtttgcagacaacagaatcttcccctcctcaccaaagcaacagcggcaaagacatccagtatgccccaggtttgattcctaacggaggtgggctatctcctccagttatcggctatgatgcccccaagacctcagctcttcttcaagggctcgttagagaaccagccgatgccggcaaaaagaggaaaaccagatcgtcggctgtaagcatcatagccccaattaaggagaagaagacaaagaaaaccaagccagctgatgatctgcctaccctggatccatccatcgaacaagctctggatgaagaggccattggagacgaggttgatcaggccgcagccgaggtaagtgacactgaaagaacaccatcggcttcgcctaaacaaacctctccaactccttctgctccagttcatttctcaagggtaagtgtttctcgttaatctctttcgtgattattttgtcttatagccgatcattcccaagtcttataattgcagaaaaagaagactgcagtgaagaagaaatcggctgcaacaacatctaaaccagcttcaccagtaagatagttttaactttcattagttaattttttagccgattctatcttacacttgcttcctttcagccttcacctcctccttctcctcctgttcaacaatcatcaagtgatcagacctcttcagctacgggaagttatcacatcgaggaagaagaacaaccagctgctcctactatcccagtacatttcttttatcataacaagcattcagatcggctacacttgtttaacctctaactgcttctaaattgtccctacatgtcacgcccggatttttgtttcaggatttataaattatttaataaattattaatagaatttatattaaatgttcattaatttacaagtgaagttaaatgtgggaaataaaatttcctaaatataaagcatggatggatttaaattttattaaattctccatggttaattatactctctggaattttctcggatttttcggagctcaattcctaattttaatcatacaaagagcatttcagtaattacccacatattaaattaatcattaaatggtctaattataattttgttaagtactttgagtgtccaagtatgttcaagatttttcttggaattatttgagcattggaagtatttttaacaattcaaagatcatttcattgattaatttaattgggaaagtaataaaatccttctcctcagcttgggccattttcagcccattccttcctttccttcctctctcttccgccggcccaacctgagccgcctcctctcctctcagctcagccggaaaagtctactttacctccctagcactgttcatcttctacctctagcagccgaactgagaccgagtgggctcggtttttcccctccaaatccgaccttttctcttgtgttttcctaaaattagttgaggggaaatattcctcttatcctcatctatctttacccccaaaaatcggagtaaatcgttgagtattttatccgaatcgaactcgtttttgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgctgccgccacgtgctccaccccgccgtcgtcgccggccgagctccatccgcgtcgcgccgccgcctccgtcgtcgccgccggtcgccgtcaccgccgtaaggtgcgccgaggtgtgggctagcccggccgccccttccccgtcgtcgccggccaccggagcccctccgccgccggtcaaccgagccgccgccgtcgcccctctcgtcgccggccgtcgtcggtcgtcgttcggcacttcggtgagcaccatcgggttcgtctcgtcgttctctacgtgtaggtgtcctccaaatccgcagccggtcgccctagctccggcgaggtcgccatccgagccggccgcctttgatgatgtcatcatgacatcatcggtttttctttttcccgtttttctaatagattaaatcttcggaaattcataactaaatcatcgtaactcggttttgagtggttcaagttgctaaattcatctaaaatcatgatctacatgtttgtttactttatatgtattgtttatttggtttttattagtctttttcttcgttttgcgtgttagcttgtcgtttccgtcgttgcgaaggttcgtgagtgcgtcaggagtgttcagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttaggctttatatattggttcagctagatattagttatgattgcttagccatgcttagaaacattagcacactattgggataacttatgactcactattatttaaggatggcttaatgatagttcacgatggttaatcgtgattggttaattaattacttgccaactaaaacttgataatggtgggttgtgagcacatggttttgagagtcgtgctcatgacaattaaggaccggttcgcgagctactgttgtgagacatttaccgtgccaaccacaagccagcgtgggcaacggctttatcttttgtatagcgtgattcattatagtgcgccagactgagaagtagcgagaagtccacgggggtcgctggggagtccatgccttgtttataagggggtgattatgatccaggaaaggtgcgctgtaatgggttatgttgtgcaaggggtattgtcacaactcctttccgaggtaccgtggtggtattgaggcacatggcgacatgatgtggggttgtgtcttgtgggtacagtggtacacctctggccagagtaaaactattcgaatagccgtgcccgcggttatgggcgggttgagcaatgtttttcgtgattagtctcacacctctcacaataattatggatgttataactggtaataatttgcttagctcctggtttggagttagatctgtacagccgggtatggttgttcaggatggttaggcctgtgcagcatgggtgtgctgttcagtgttgattaaaattgatgattaattactctactattttaattatcttaaatgttttgctaaatgctgctttttgcaaatgggcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagccggagcttcgctagaccgtaattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacactgcaggtcttagctgatcttttctctttcgatatcagagactatcttgatgaaggagaagaagatactacaagcaaagcattggctcctttatctgatgatgtgaagaaaactctaggaagtattttggatcggctagaggcatcatcactagatagtttggtagttgactgtggctcaatcagggctcggctgcatgagattcaagccttaattccagatgaattagccgatatccttactccagctgtttaccttgagcaacaccaattcaaactggagaaagccaagttaagactagccgaacggcgagaacgtaaggacattgaagccactatccaagccaaccgacaacttgtgcatgaagagaagtccaagcttgatcaattatctgaaggcccaatcaaatctaacattgatcggcttgaggctcccaaaattgaactcttagcacaacttgaagaatgtaatgctgagctagatatggaacacaagaaactggccgatctcccaaaatctattgaagaacaaaaaacaagactcaaatcggctattaagcatgttgctgaactgaccaagtccctgaaagttatccctggaaccgatgctcacgatgcccaagccatagaagaagtagagcagattaggcagaaagctatatcggttatacagcgatacttatcactgtaatcttagtgcaataggacttagaattcttgtaatcggctaaaacattctgactcttccaaatcatcggccgacataaaaccttagaatttcctttgaaatttgcacagaaaattttatgaatctgaaatgaatctgaaaattttatgaatctgatatatatatgcccccctagttttataatggcgagagcattgataaaattatgcaccaactaagggcgatataacaatatcggccattgtacatcggcaaaccacaaccgatgacattataaaaacaactaagggcgatataacaatatcagctatctcaaggcgatgtaaacacatcggctgtcgtgtatcggcaatagtagccaatcatgcgtgaacccacacacttgggtaatatttcttcaagtatttaccattaagcgctcgcccatagacttccccgtcaagcccttgcaacatatatgctcccttagaaacaaccttatgaattaggaacggtccttcccaattcggcgaccatttgccgaatttactatcacgagtaccaatcggcaaaatcagcttccatacaagttctccctccaaaaatctttagacacaactttcttattacaatgccgagcaacacgttccttatctttagtaaccttcgcaagggctcgcaatcgtgactgaaccaaatcttccctctcatcagccataagattgtaatactcatcacgatgttctacaataaaatcggctatagcctgtcccttaatcgctttcggtgattcataccgaagatcaaactcagtcaaggaaaatatccacttcccaactcgtccctttaatattggagccgacagcatatacttgactacatcggctttgcatataacagtgcacttgttagataacagataatgcctcaacctcgtacacgaaaaatacaggcacaagcataacttctccacaggagaataccgagtctcagcatccaagagccgtcgactgagataaaacacaactcgctccttcccttccaattcttgaatcagaaccgagccgattgacttctcaccagccgataaatataacctaaacggtatccctttctgtggaggaatcaaaacaggaggagagctgagatactccttgatattatccaaagccttttgctgctctgccccccaagtgaattgctgattggcttttaatttcaataagggtgtaaaaggttccaacctcctggacaaatttgaaataaaccttctaacaaaatttatcttgccgatcatctcttgtagctctgtcttattttctgggggctgaattttcttgatcgcattaacgctcctttgagtcacctcaatccccctctcatgaacaagaaatcccaaacgatcatctcttgtagctctgtcgaagggatgcaacaattggcatgaatctaatcccttccaagcaataagctgtacgaaccctttccaccgatgacaaaaaaaggtggtaggaatagtcttgctgccgactgtcaactccacatttagaacacctttggtctccgatggattaccaccaaagtctttgagcaccatatttgtcttgatgagatcctcggcgttcctacccagcttcctgaacgtagcataaggcatcaaattcaccgcggccccaccatcgaccatcatcttagacatcggcttcccattgacgtagccgtttatatataatggtttaagatgccgattttctgtcccctcaggtttctcgaatactgcttgttctggcaacaggaccaacttagccgactcctcttccacttcgtcaacatcggcctggtcaatcccgaattcagctggcaatgtaaagaccatgttaatcggtgccgctataacactctttccttttcccaacctcttcacctcatcagctgcagcatcatcggctacgggaacctaattcttgacacgccactcctgtcatggctttggtttcctcagccgatggttgatttccttctcaacctcctgaaaacgctccctgctcctcaatctctggaccctcctcttctgattcttcgtgaaaatatcagaaggacaccattgattcttcctgatcgcttcttcctcttggccacaatcctgattcatcggacccaatctctgatgaacagggagtcttgcctgtttcagccgattatccctattatatgatcggctcgagccctcgatgatatcactgcatccagggcaattttcaatagatggcaacctcatcctttcgttccagcagaatctgaagaattcacaaccccgatgaggatcaaaaccatcgtcgtattcttcgtaatgcctttcctgctgcttatcatatttcctctgatacttgttgataatcttagccgaatttactcgaaaaccctttgcatgggctctattggctgcttgaccagctgtatgcaccatattcacgggaaaaggattcccatcgaccttcatcggcttcttggaatcatcaaacctaatctttcccccttcaatggcaacctggatttgctgtctaaagaccttacaatcattagtagaatgggaaccagaattgtgccatttgcaatatcttctcttgcctaattcctcagccgatgggatcgtatgaccagcaggaagctgaatctgcttttctcggagtagcaaatcaaaaatcttgtcagctttggtgatatcaaagtcatacttctcctctttcccatgacttttcccccattggcatggtataactttcttactcctcacccattcggctgcagctatctcagaatcatcttcttcgtcatccgaccaatacatatatggacaaacgtgattaactttcttagagcttttcctgacttccgccgacctatgctcgtgcaaggttaccttctgtattagatgcgataagctatcgaagtcttcggatgagaatttctccctgattggaggaatcataccctggaaggccaaatcggctaactgagcatcagttaaactcaagctaaagtacttgttcctcatctctctgaacctctgaatatactcgtgcacggtttcatcatgccgctgcttgatcactgtcaagtcggacaacttcatctcatggaccccactgtagaaatagctgtggaattgcttctccaaattggcccaactattgatcgacccatatggcaaagaggaaaaccaagtaaaagctgatccggacagaaataaccggaacaacctaactctcaaggcgtctacagccgatgcttcaccgcactgagcaagaaatcggctgatgtgctcataagtcgacacgccctcttgtcccgaaaacttggagaaatctggaactttaaaccgattgggaagaggaactctttcaaaccactcagggtaaggctgccgatacaaacttctagtttcttttggtttaagcccaaattgctccctcattacatcggcaatcacatcggcccacggtcgttgctgagctgctccttgtggttgttgctgcatgggctcgaattgaccaaactgagatgcaaactggggctgagccaatccccctggccgatattgggcttgcggggaaggaggctgatattgatagctcaagtttcccccttggtagttatgaagattcggctgggtattgcgtaccaagtgctcaggaaccatctgaggcaccatcgtgccatccggttgtgcatggtgaaccaaatgctctgagacgacttggtttacaaattgctgtgcaggttgcccaccaggtgctgtgaacccagccgatgcatttgctgaccccgggtgctgaatcggctggacgatctactgtcgtaccggagtctgttggatcggctgaagccgctgccttgatggcgtttgctgaatcggttgcagaggctgctgtcttgatggtgtttgctgagctggttgtacgacctgttgttggatcggctgtacaactggctggattggtggtgtctgctgaatcggctactgctgcactggatcaacaataagtggaggtggcaaaaacatggcagcaacttgatcttgggtcggctgattcgtgatctgcccagtagactgtggatgttccctcattaacaaccgagggttcatcggctggcctgacgccatagctgatgtagcaagtaggggagttgacgctggcgccgttgactgaattgtgggtgcaatagagggaatcacttggacagatggttgaacatcagtgatcaaagatcgataattcgggaagacacctccttgcaaataaactgggcctgtagcctgatgctcggctatcgaaccatcggctattttcttcatcatgtttgacaatgtatttactaaaaccccggactgattgatcagagcatgatgcacagcgtaatcaacccgatcttggaagttgttgaaaaagtcctgtgatagctcattattctgattaagatttcctccttgcggcccttgagcaccattaccttgagccccatacgctccatcaccttgtactccatggactccttgagggttgtcgccttgatttcccagagaatcaccagtatcacctttgttgcttggctgagccgagcctcctggagcttgtttcacctctccatctttagaagaaccggttccaggactatcagcaaccacttttatcttatacttctgaacaaacgttcccttgcgagtctgcatgaatgaattcaggaactggtcacgtgcttgctgcatcgttgcttcaaactcctgcttttgctcaggcgtgaatttctctggatcgatcggcatgacgttgtcatcaatgatgtcggtcaatcccggcttcggcgccttgcctttaacgaaacctgggcttgatggtggcggtggctgtttctcggccatcaggagggactgacgtctgacttctaatcaggtcccaccaggcgtgccaaaagcgtgttgacagaaaacacatggcctgggagatccgcttaactccagtgcaggtccaaaactcgccttcggatgtgttagcgtgccagttgatttgatcctgtaatcaacaagaaatagaagcaaagaaatcgtagttaaatttataaatgataggcgatcggctagatgccgatgacatatcatttatctttgagccgatgtcatctatgtatcgatcggcagttataaataagtaaagaagaactaaatctacttgatcggctgtagatattaacaatatatactccttatatcgatatatacttaaatcaagtgattgggatagatcagtcatcatgccaagacagtataaatcacttagatcaaaatatatgtcaataacaagattatatatgattatagcatagccgatcagatagatctagcatgtatcggctaatacttcgatactactctatatcaagatgttaaagcaagtataatatattgagcaaaagcctaatatacttaaatgcggc

SEQ ID NO: 12205 - DNA, 1954 bp, Oryza sativa
gacgtcaggttagatgatgatattgctagagattatgtaagacatatgataactcgacgaattacataaacaagattagagtgtcataaagatggaagcactaatcccgagaacgcaagccaccataacaagtttacctcttgttgaagatcgaaaccgatgcaactcaacccgaaagcaagaactcgtcgaaataaaacgaaagtaaaaagggtggcgatgcgccaagattgtattgaacgtgtgtgttttattacatagggctcggggtctatttatacccgaggattgcaagatatgcccataccggacacaaccattatctctaacaaactctaagataccataagtctttgcggcagtcttttgcccacacttatctataaggaattcacataaaatatcctagttaatagatacaattgccttcccaggactctatccatgggtggcaatcatcttgaagtacattaacttgaacccgatgtcgcgcacaacgcgtattgtcggaatcggctatatcgacttatttagctcgactcagactcagccgatcttgtcgtagccgatctggactttagccgattcctgccctgttttcaaactcgatctccgcttccgactttgcttcgatctaatcttctctccgatgctgatgttaccaaatttggttgttaacagaagcctgcgaccacttagcaaacgaggtcaagctcccatgagcctgcgccccaacgctacacattttgttcgctctttcctttcggtggcctccttccaatctctcttccttcttcatggacgattacttccgcacgagtgtgagagccgaaaaattctagagccagcaatccctgtccacagttgagccgggttgggcaccgtagccagccggcgggtccaaagccagccgctatggaagagccagcacagggggtcccgggcttcgacggcacctggagctcaacttaaggctaggataaggctagaagacttagcccccacacttagcaaagaatcgttcatatagatgggagagaggttgggctcttaccacccaggggccaaacaaatgcgcaacacgcgagcgtcgcagggtcatgagaatagaatgggggaaattaaatataagattttaagctaatgaattggaaaattgaaaaaaacttgaagcttgaaaggacgatcagttgagccaggccaggcaccgtagccagccgtcgggaccaaagccagccgctacagaagagccagcacagggggtcccaggcttcgacggcacccgaagctcaaaactgcaagagtcctcctaggagtgaaccgaggcggcagcaggttcatgggataaccccgcgcttggcccctgagggccatggggaagacgtttgccatgacccggtcgccaccccccgccgcctctatgatcgtcgtgcagatctggagggactcggaggggtcggcgccatcgtcgtacttctcggtgaggcagggctagatctttgggggccctcagacattccgaaaactcgccacaaagacctggtagccaagcttacctagtggggacgtggggggccttgccccctgcctggggtggcgcgacactcctgaggatgctgcgccttccctcgtagcggcgacgcgacaatcaccacgccggcgatcgaaagaacctcaaaaatcacgaacgcgcctcctacctggcgcgccagctgtcgagaggtgaccctctctagcaggcggctgtgaggcccccctttgagagttcggccgggggcagcgggtgagattcgaggatttggtgagcgaaactgtgtgtgatcttgatctcggaggctcctccaagacgatgagacaaaagaggtttatacaggttcgggccgctatgaagcgtaataccctactcctgtgtgtatgattcttctgggcttagaaagtccctgaatccctgata

SEQ ID NO: 12206 - DNA, 11041 bp, Oryza sativa
acggctccaccccgggcttgatcccccctcatggggagccacgtgggttgggaggctgcccgaccccaagctgggatggggcagccgccgcaataccccgggctcgaccccccccggggagagccacgtgggtttgagggcggcctcctccctctagctgggaggggatagccaccgctccaccccgggcttgatcccccctcgcggggagccacgtgggtttgagggcggcctcctccctctagacgtgatacccccgggcccatatcaccgacagatataattttggatacaaataagaacattttattgctaaccatacatctgtcgatatttttttcttttaaaaatttattaaatgtaaatacatgtagttaccaaagtgtagttacgttataacttgtatataactacaatataatttgtttacataatgataaaatgtgacctttaattcagcagaagctacaatatcttattacatagttctctattgagaactaagtataatggtgtctaagaagggaatatgtcctatatacacaagcttcccgtgcccattaactagcaaatgtcatgaaaaaaactacaaaaaaatagacatttactcataatagtattacacatatatacaaagtctcatattcaaattcaatatattttatctgtaacaaaaaaaagttaaaaatctgacattttaaaggtaaaactctgtcagaattttttcttttttgttacggctaaatataatacatttgaatgtaagatctcacacgtaggtgtaatactattggaagtatgtgtccaattttctctagaattttctgtgatatttgctaattggtgtgcacgagagcttgtgcgcataggatatattcccatctaataaaggatggagggatgacacttttcatgtggttttgagtctttagttttgcttcggtattcatgcgtatggatggggggattctatcctatgtcctcggctcgcggaagtagtgtattaccgcggcgtttctgaaagttactccctccgttcaaaatataaacaattataggattatcagaaattatacataatataaaatataagtgtttttctaggcattgattctagcaaatgtaaatatatacattttccgtcaatgaaaagcttgggaaggaaacgtaagcaattcaaaattcaaaagttggccactgaacagaactagaagagaatatttttcatctaccttatttttcttaaaaacttagaaaagcttatattttgtaatagaggagaaaatatgatttatattgtatagttaaatgcaagttactctgtacaatgtaattacattataattatatttatttgacaaatgtttagatagtcgatctgtttgggtcacaagtgtaggaactaatggtctgaatgcgggcctctttcaatcggaaaagagaataattacactatactatgtgtttttagtttctttgagtttaattggccctatgctgatttattcgtgtaaaggtacatcttataggttgggctgaaacaattcttcctagtcaacttagcccgagcttgaaaccttgaattctagtagtagaccaaaggccgatcttctaagagaccgacgcaactggtctgcatcatttagcccattatggcctgctacctcgcatttctaacaaaggaataagttcaccggaggtccctcaacttaacaacgagatttttttaagatcccttaaccataaaaccagaaatatgtaccctaacctcacacaatccgtgcactcaaagctctatagcagtatatatgggtggtttcgctgacgtggcatcctagtcagcaaaaaaaaaatttaaaaaaagtggggcccacatgtcagttgcacatctcttttttttcttctcttttcttctccttctcttctcttctcttctcttctccagtgaggaaggccgacggtgggcagagcggtgatgagcgagcgcgaatgtggccagcgggcctaggaggctacgggcggagcggcagctctgcggctgcggcggtcactacaagataattgagctatcgccaccaatttattacaacgaaaaataattcatggcaatatattgtactatcgcaatgatattttttttcgtggcaaataactacattttgttgcaacgatttacaattgttgttttattcaatatttttgttgcaataggaaatgagctatcgccaaaaaaaacattactattgcaaaaaaaacatgttctatcaccacacatttaatttttattgcaatttgcatagtacatggtacttttcactattttctattaccatgatcaacaaattcattgcaataaaaaaattatcatctcataatttaacttattcttttcatatgaacacgaattaggacaaaatttatatgaaatttataactctcgatgagatctacaacttaaatttttcatttgaaatcttttaaatactcaaattcatgattcaaatctcagttaggcagtctcaaatggaattatatgcatttttaaataaaattgatacgtaggtgagttggtcatggagagcgcgcgtgagggagagatcttgggttcgaatcccggccatgacaagatatcaaaagaaaatagttaggttgataaattaatactgaaacatttaatttggtacgtagaactaatgccacacatggagtggtggcaatagttatttattgcaacgatgttaagtgttacaatatatattttttgccacatccattttatggcaatatcaaattttattacaactaaataaaaatcgttgcaataacttattaccacgctatttattaccacggctagcaacgatttaaagattgtggcaacgattttagcattggtgctacgctatttctattgccataattttagtattgatgttacgatttttttcgtgacgataaattatttttctagtagtgggtggcggcgaccggctgagcgcgctgagtgacggcgtgatcggccacatcttgtcgttcctcccggcgaatgaggcggcgcgcgcggcggtgttctcgccgcggtggcaccacacgttcaccgccgtccacaccgtctacctcgtggagcccgacgcccccgttgtcgaccacgacgagcttgccaagtacagcccagggtggggccctccgtccgaccccaacccgccaccgccgctgttcaccagcgccatcagcgccggcctcctcgcccgccaccgccgcctcgccgccgtctccttacgcgcgctccgcatctccatggtcggactccgacgacgacaagaagtatcccatggccgtttacaggcggcagttcgagccacagaagtacagcgtgctgagggggctattcacctgcgcggtgctgcgctcactgtcgctcgggtccgtccggctcactctgcccgcggccatcgccctcgcggtcctcgagacgctgctcctggccgacgtcaccgaccacgagaggaacatgcagcgcctcatctccggctgcccgcgcctcgccgacctgacgctcgaggcctgctatgagatggccccgctctccgtggcagggctggctctccggtgctgccatggcctagacaccgtcgtcctcgacgacatgtcgtcgccgtcggagctactacaagccttcgagctacaagccacggctctccggtaactcatacaaaccatgcggtccatgcaaccgacgctctggccgagggtgaagccggtgatgccctcgtcgtcctcgttgcggtagcccgagcggtagcttcggtcgttggctgtctagttggtccaccacgtttgttggtgacgagcgcggtggagcagccggtgcggaagtagcagttgaggaggtgcttgctctggtccttgccgttgtaccagccgacgatgacgatttcgacgctgacgacaacggcgtaggagagagaaaattgaagaaaaaaaatgtgcagctgtcatgtgggccccacttacttttttctctgactaggatgccacgtcagcgaaaccacccatatatactgccatagaaccttgagtatacggtttgtataagtttaggcgtatgcatttatggttttgtgattaagggacctcaaaaaatatcactgttaagttaagggactttcggtgaacttattcctctaaccaatgcagaaaccacggcccacaaccgccactgtcaactggtcatcctgcaattccccctggccccatatgttgttgcaatccatttactatatactccctccattcctaaatatttaacaccgttgatttttttaaacatgtttgaccgttcgtcttattcaaaaaatttaagtaattattaattcttttcctatcatttgattcattgttaaatatacttttatgtatacatatagttttatatatttcacaaaattttttgaataagacgaatggtcaaatatgtttaaaaaagtcaatggtgtcaaatatttagtgacggagggagtaccaaaaacagtagatttttttaataatgaaaagaaatatatctcccatcctatgtaactagaacacaattgataaattctaaagtacaattgataaattctgactgaaataaaggatatgaggttatggggtaaaccttcatatccttctaaatgataacaagctaaactgatggaaagaattcacaaattttctataatgaaattccatagggaactacgcaacccaaaatggaataaatgatctttggctatcaactacaagattagagcaatattgtgaatagtatcatgcttctcttgtgataccattatagatcaagattgggaagatgcttcttctcggacgtccggacccaaggagaaaaatgagacgggctgcctctgacatacatatgcagctacccaagcctatattaatatctccaatatgacacgcatgcacctttaacgatatttaaaacgatttttttcataaattacttattcaatctacaatccgatcataccattatattcgttataattaaatctttacaacaagatatcgcatgattatattctgaaaaaagataatcatatgtttcaatccattatcactttttgtttcatacgtgatagggatatgtttcaatatgtgtctttagcgtgtttcacaaaattcgcaaaacaaccgatcactattctccctctccacctcatacatgcacatgcatgcatgtatgcattttagcgagtttcaaaacgatttttcttctaaactaattacccaatctacgatccgataacactgttgtattcgtcgtagttaatctttacaagatatcgcatgattatatttggatgaaagaaaaacatatggttcaatccattaacactagttgtttcacatgtgatagcgatatttccaacgtgtatctttatcatgtttcataaaatttttaaatgttttagctactgatttttttttcaccatgtataacttgatgtttcacgcgttgatcaactgaaacatttgactgactgaatttttttgggcatcgggcgtccgatgggaagtttcgcaatgcccgtgatcgagcgtctgatgcacaatgtttcaatcagaatttgactatgttgcacattttaaattttatgttgccatggatcttttaaaaatgttgcacatggcattattttgatgttccaataaatattttttttgatgtttcactagcttatttacgaatgttgcacgtggtattattggatgtttcagtaagtattttctaatgtttcactaattcatttataaatgttgcacatgttgtttgggatgttttgatgaatattttctaatgtttcaatacttataagttgttgtttcacgtacaatataaagatgtttcaattagtaatataattatatttataaattttatcataaatataatcaaatgagatattattgtaaagatttaattgtaacgaacataatggtgaaattggatggtaaaacggataagtaatttagaaggaaaaatagtttaaattttattggtagagaagaaggagagagaaattgcatgtaaatatgcaggagggtagcttataggcttgcagattccctgtgatagttttgtttgcacggactgcattcgattttctgctaaatatcggacgtctgatctgtagcagcctcttcaagattggagctggtaagacatgaaaaaaatctgtattggaaatactaaatctgactaacagaaaacactcgctccaacacaaagtcatttctaatcatttttttatggaaacaactatagatgcaacttgtatttgaagtgtttatctagatggtttttttcatattaatctacacttttattagatataaattgactaaactttgaacaaattttagtcacctgaatctaaggtatcatcttcaacctctgaatagagagggaagctaggcagaaaagaggcggtgggtagtagctcatcacgacaacaactatgcaaatcacattcttctaactagcattggtggctctttgtctttttcggcattgtgatgacaactatcaatttctggaaccgaagttagaacggaggtgagtaggggccaatgaggatggaaatagatggaaggctgagatagtagtggaccaatggcagatggacaagcgcttgattagttatgtactaactattatatacttaaaacaaaatattgtttgattttttaaatggaaaatctatacataaagcttttatacgaaacacacattgtttagtacctcaaaaatgtgccaaaaaaacctaaccgagggaaccgttaagctaaacagttaaatcaaatgagacattcgattattgagtggattatcaatttaattataggaataagttaataattttaaaaaataaatttaacaaataacttaaaataagtgatataaagtctaaaaaataaagttcaagaattttagaaaatgtatttttcaaagtgtaaagcaaatgagttgaagaaacaagagggcctttggcccagccggcatgcttgagtttggacctttgcctacttgttctttggacttgctgctcgtttgcttctaaccatgactacactatgggcctatttgtggaagttttagattctgataagcagctgtttggtagccagcttctgagaatctggaaaagctctgaaacccagcttttccagcttctgacttcttagttcatttttcagaatctgtaactacagattctcagaaactgtggactatttggggcagcttctagtagaagcagtttttgggaaaagttgcagctgggacaagctcccccaaacagggcctacatatacatttagcctgcatcaaacggatcatagtgcgccaatttgtggtttttgctacaaaacaactaaaaaaacgtgatagggctgttgagcaccataaaaaaaggataattagctataggatgcaaacattattttattattccctctctaaatggagagaaacatttaaggaaaagaattttgcagccgttgtgcacgccgtcggcatcaccaccaaattctagggctttgaagagggaatcggagaagagagagtggcttgggtttcgttcaaattaaacaagacccagtcaggatacaagcatatgaccccacaagggtaaaattttcttttccatgtggttctcgctatatttggattaaaaataatataataatggcgaccagttttttcagtgtctaacagtcgtatcatgtttttcatgggtgtcatataacaaattttaccaattaaatttcatcatttatggatgcacccattcttaggtctagcttccgctggtaaaaacaatattttaatagcaaaatttctaagtatatttaacagaactttccatctcttttaggttggagtccaaccaaacgattttagataaaaaaaaaaagtgagcgaagcaagctgaactaatctaaacaataaattagaggagtggagtggggtttgtaattctatagctatacagctttatttcagactacactttaaaagttagatttattaattgaagccctgaaactcaaaattgtgacgttgcgagcaagtttgagatacttgagcgtattgctctattttaaaggttatccttcatgcaatcatgctacccctcttatcggcagaaagcgaccggaaaacgatggacaaagggcttttctttgacggcacttgaccataaaaatacataatactttcaaaggaataccttgtgtgtgtagcttactccaggacaacctaattaatctaggagccggacgaatattaatggtcggcatgacgatattatcgagctgcaaaatagaaacaacagtaatttgtcacattgttggaaaaagcatcaactgaagttctgattggctagatcagtaagatatgaatattaaagtgcacagtcggtattcaaacttgtccgtcggtgctatgtactctgaaaatatataagaatttattaaagtgtgttattctgatttatgttgctatgacccctataggatcatttgtagcttaatgtggcatgccacatgaacaatgagatggcatcatcaccaactctataatgactaccttgaaaacaaaatttctttcctccacttccttttcttcttccatctcttttttcttccttttatcttttaagtggtgatgctacatcaacatctatgtaatatgccacgtagaatccaaaaaggtttgtagatttgtgataatttaggatcattataccatattttgatagtatgagaacttagatgacatatatgaacaagttcaataactaccatacattttactttgaataatacttatacatttgagttgtcacggtataacataaataccatgatatattattgtaaaggacttccctcatctacaaatataagtattccaaatgttcaaaatttatctatctctattattataaaaaattgaagatgtttttaccggtattttggtacgtcatccatgtataagtcggttattaagttcgtttgcttttggaaatacatattcgtatttgagtcggtttttaagatcgttcacttttggtaatacagaaggaatcatataagaaatatgtttaaaaaaactcacatgctaacttgagacgatcggactcctaactgcatctcatggttttctatctctactattataaaaattgaagatgtttttactggtattttggtacgtcatccgtgtataagtcggttattaagtttgttttcttttggaaatacatattcgtatttgagtcggtttttaagatcgttcacttttggtaatacagaaggaatcatataagaaatatgtttaaaaaaactcgcatgctaacttgagacgatcggactcctaactgcagctcatgattttctaaaaatatatatatccaaaagaactcccacagtaaattttatcttaactatacaataaaagaataataagattaaaatagacttgactcgttgcaacgtacgggctttttttctagtaatcataaacattcaaaaatactacgtgtcacgtcaaatttctttctgtattactccaaccgtacttccagagtatcttattttgtgatagctagggcgtctactatgagtgtgtttgaaggaagatgaaagaagacgattgataaaataggcaaattgaggtaagacaccagcgtatgattaattgagtattaattattttaaacttaaaaagtagattagtataatttttaaaagcaacttttctatagattttttttcatgaaacacggtgtttagctaaacagttcggaaagcatgtgcttggaaaacgacgagttttcttccatcgaactctccttaaaataacttaaatacttatatttagggataaagagagtaaaaggtaactagaaattcaaaatgtaaatgttaaagtaaggtcctagctatcatagctctgaatcgatgattcttggagaattatatgtctagactagattcacaaatccatatatctgaatctacgattatgttaatattatttgggaaaattatactatttctattttaaataaaaatataaattttaaatcactataattttgaacactacaatttaacatatgaacttttaatccgtgtgttttttttaaaaaaagaaacagtgcatctaggatccgaagctacgtcaaagtaaacataagattactacaagtaagagaaaactatacattcgaatgtaaacgtctccgtgctacaagcctgcaacttcaggcagaagaagctgggtaaggcctgatttggtttgagttttaaattaggcttaccaatatttagtaatttcaatagtgtttagtgtctatttagtttaaagcctaattttagcaaaataggtcatttcaatagtgaatttaagctattttggcttcaatgcaaatatctttgccttaccaaaattagtcatgccaaaacttgtcaaaatttggcaaatttggcattgataaaatttggtaagacctatttaggccacaaaccaaaccaaccctaagttttctccactgtgggcgacgccgatgagaagataaccgatacggtagtggcaggctggcctggtttagttcaccaacactggtggagaaaccatctttggtcggtcgaccaaattccacaatagtcccggttgcaataaaaaccgggactaaagatctttagtcccggttaaaaatctttagtcccggttaaaaaaattttgatctttagtcccggttggtaacaccaaccgggactaaagatcattttttagtcccggttcaaataagttggtgggtacagttaagctccaattatctactaaagatttatttttagtcccggttgtttataccaaccgggaccaaaataaactgccgatatctcctcggtatcccctcccctttttttctctccttcgttaaaaaccaccaagacttagtctcgg

SEQ ID NO: 12207 - DNA, 5653 bp, Oryza sativa
gggactaaagatctcctctctttagtcccggttgataacaccaaccgggactaaagatctttagtcccgggtatttgaaccgggactaaagatagcgatctttagttccgaattggtagtaccgatttgaaaatcgggactaaaaagcacttctccaccagtgcaatttttttcccaaaaacattatatcgaatctttggacatatgcatgaagtattaaatatagatttagaaaaacttaattgcatagttagggaagaaatcgcgagacgaatcttgagtctaattagtctatgattagccataagtgctacagtaacccacatgtgctaatgatggattaattaggcttaaaagattcgtttcacggtttctagacgagttatgaaattagttttttcatttatgtctaaaaacccgttttgatctccgatcaaacattcgatgcgacatcaaaaattttgttttcgcaaactaaatagtcccgcgaaggattacggccggagtgatctcatggctactagtaattgactacccgtctacccgcccgctctctgcacaaatcaccgcacgtttttgctgcggcgccacctggtacgttttcaatccgtggccccccgttgccattcagcgcgcgacacgcccccatctccgtgcgaaaaggcggaccggccccacgccaccgcttgcaaaactggccggcagtggcacacccaagttttgactcctcgacgtacgtcggcgcaacatctgttggactccaaccaccttttttgcgccgcgagatggcgagagaggcgcagcctcgaacgaagattctaacgaagattctcgcggaggcggggattctgtgttctcgatacggagtccacggaattcggttcccttttgctgcttggtttggtccctgattcctttcgccggcaggatgtccaatgcgcgcgggttgcttcctgcagatcccattgccacccgcacgcactgttcaccactcatacacatgtgatttggacgcatacccatggaacgaccaatatgtggttaactaatgctagaaccaaatctaacagtagcataattcaaatcacgtacgattgctcgctgttttgaaaggtatttggggtgttttaaactttgtaattgacgaatctgtgggtcgcaactaggcttgcggagtgctttttattttcctcataaaggcaggcatgcgcacctgatagccaacagcgagaggaatactgtatgagatcgtttggctcctttcccttttgctactacttgcatatcaaattattaagcactactccattcatctaccagagttacccatattacttttgtcatcaagactaaggagaaattaaatcatcttagatagtacaaaatcaaggagtgaatgtaaacatacaaccgataagtatttagatgactcattaggttctcatcaaatatttaatttatttcttcatttaagtcttaaatgcataaaaactacaaataaaaacaacttgtttggaaaaatttaaatgtgaaatatgtctaatttttatggatagagcgagtacgaatcttgcatcaaagcctcaagaatatcccgttatactagtaagagcgaatcaaccaaccaaccaaacccttggacagttggactgtttgtttaacattgtgcggggagcgagcgacgacagcgacgtccttctcactttctcacactgcaccgtacgtcaatttaaatttagtactgccgcgactaatcactgaggtaaacccggggacgcaaataatcaatctgcgttacggcgtatgtaataccgaatgggaaactgaagccttgtttggatccaaaaaattttgataaaaacgtaacatcaaatgtgtttgacacatgcaagaggcactaaatgtgaaaaaaaaatccaattacacagtttacatgtaaattgtgagacgaatcttttgagcctaattacgccatgatttaacaatgtgatgctacaataaacatttactaataacgaattaattaggcttaataaaatcgtctcgtaatttataagtggaatctgtaatttattttgttattagtctatatttaatacttcaaatacgtgtccgtatacttaaaaactttacaataaaaaagtaaacacaccctcagaattcagggtagtacgacgcactggtgcactccgcagtcaagcatgcgaataacgttgcaaaggtatagcaaaaagcacttatgtgcaagcaagcgcgagtaaaacatggtgcctcaaagacggtggaaaaacggtcggcaagcacgtacgagagccgagagcggtcacgggtggacggcagtacagcacggtgcacatcgctgttacacggagagaacccaaggcggcagagcaacggccgcctggataaacaggctaggcaggctagccacgggccgcgcgcgcagtattacgcagtaacgcagtaaacccaggagcttcatcggcacacgttactgcgtaatactacagtaatacagtatgatgagaaactgacaattcactaattcagggtagtactacgcactagtgccctacgccgtcaagcatgcgattaaccgttgcaaaggtcgtggacggcagtacgtacgcaacgcggtgcacatcgctgctaaacggagagcgcccgaggcggtggagcaacgggcgggccgcgccggcagagatctgacctaagggggagcgcggacgagcagagcttagagcaagtataatagttagttataagcttactataaatttagaaggaggaaagaggtagtgaaaaaaaaagaatgttggctctcatacaagagctagcttatcacaagctccaatataaatgcattaaatgtgtaagtgagagataaagagaaaaagaaaattgtagctaaccttacagctaatttattatatatattggctttaagatggtctaatagtaggaagtgagctctattattatccttgctcgagcaagtttaatagtgcagcccgttgccggctctaatttcacacacatcatctgcatgtgatataagagccaataaatacaataagcgttggcccatctgctataaaacaaatttactttattatatgtagggcccactatttcagccttttactctcagcaagcctgtgttacccacgtgcatgtaggtttggagtttatgccaagcctgcgataaaactagcgcccgttttacactctctctacttttccatcttccacgtatgatatagccagcgtatgggtaactattgtacctgctcttacctagctaggcgttacagcgtagccggcgacggcgcccgcgtccaggtgcactgcgcgcagttgcacatgcgcgggcgggtgggcgcgcggcggtgcccggtgcacgaggtggcgaaaaccaggggagccgagacgagccagggggcggggatccaaccgcgcaacaagtccgggcccggcttgtcggctggactgaatgaccgatcacactgtgtgggaaaacataggcttaattcactatcagcaattcagcagatggattattgaattactagcacgataatgaattggagcgtatacgcgtcgtgtagcggtgtagggtgttcgagttgattgttaaattaaaaaaaaaacggcgcctttttcccagttgatcaagaacgcctattctctactcggatacaaaatgaaatctttacgtagagtagcataatactcctccaaaaaggtatatgcatacgtatataccagactaagagtcatgaggtctagttagaacttagaggcgtgttgatcaaatgtggcactaataaaatgctaaattaacttcacatcgacaacaagggtttaatttcgcattgcttatttagattgagagtagtatgtccacatcgcatatcttcttagtacgatttgttaatgaaaagatggacgatgattcgatgaatgcattctagactggaggttccagttccagaccggttgacggtatacaccaatgcatgacgcacaaggtttggccagccaaaccacggcgaatggagcacgcgaaacaagtcagccgattcccagtttgccacccatctcaccagactacaattctgcaagcagcaacggcgccaaagacggttttttctccttcctctatataagccccacaatgcccaccaccagcttgtcacaactcacagccaaaacctcgtacattttcagctagccacaagcaacacaagtccaagacaagtcaagcgttcgcaccaagtcaaaccgcgcctcactgccaccttcgtttgcgcaccatggagcttgccctggttggcaacccttcgaatggcgtggcgaagccgtcgtgcaactccgtcggctcgctgcccgtcgtcagctccaacgccgtcatcaacccgccggtgaccagcgcggcgggcgccacgctcggcaggcacctcgcgaggcgcctcgtgcagatcggcgccaccgacgtgttcgccgtccccggggacttcaacctcaccctgctcgactacctcatcgccgagcccgggctcaagctcatcggctgctgcaatgagctcaacgccgggtacgcggccgacggctacgcccgcgcccgcggcgtcggcgcctgcgccgtcacgttcaccgtcggtggcctcagcgtgctcaacgctatcgccggcgcctacagcgagaacctccccgtgatctgcatcgtcggcgggcccaactccaacgactacggcaccaaccgcatcctgcaccacaccatcggcctcccggacttctcacaggagctccgctgcttccagaccatcacctgctaccaggtccgcgcaatgagccctgcctctcgtctttcttttgcactggatgtctggatgaatttcgtcgaacacctgagctgaacagagtgcgttgcacgcatgcaggccgtcattaacaacctcgacgacgcgcacgagcagatcgacaccgccatcgcgacggcgctaagggagagcaagcccgtctacatcagcgtgggctgcaacctggcaggcctctcccacccaacgttcagtcgcgagccagtgccactattcatctcgccaaggtagtgaactaaacatacatgatacatgcacgcatctcgggttaaaatcttcttttctccatagtttctcaattttgacatatgtcctatcaggctgagcaacaaggcgaacttggagtacgccgtcgaagccgcggcggacttcctgaacaaggcggtgaagccggtgatggtcggtgggccaaagatccgggtggccaaggcgaagaaggcgttcgccggcatcgcggagtcgagcgggtacccgttcgcggtgatgccgtccgcaaagggcctcgtgccggagcaccacccgcggttcatcggcacgtactggggcgccgtgagcaccaccttctgcgccgagatcgtcgagtccgccgacgcctacctcttcgccggcccaatcttcaacgactacagctccgtcggctactccctgctgctgaagcgggagaaggccgtcatcgtgcagcctgaccgcgtggtggtcggcaacggcccggcgttcggctgcatcctcatgacggagttcctcgacgcgctcgccaagcgcctcgaccgcaa

SEQ ID NO: 12208 - DNA, 2780 bp, Oryza sativa
ttctagtttctgcaattggcccccttttctatgaacaatttatcaaacctatctaacaagctcaaagaaacagcacaaaacagcagaatagcttgttctctaaagaaacagcagaatggcatttattcactcgtgagcattaaatactgtgctagtacttgtttttgttttaaggtccaaatgactgcctttttaaagtaaaaacagtcaggagctaaatgtaagcatttgctgccaatatatctgctaaaaattatatctgcacaaacaggaatatgggggcatcaaggggcccaggtaaaaagaactctgcctttctcgattgtgccttgacagttgcagttataggcaagtagctaagctattcgtataggtaagaaagccacagcacgtttaccattttggaataggcaggtagttaatatgttcgtttagagaagaaagcctcagagtcatgttttcatatttgctgttacacaattacagtaactcagtaacataccttctgccttgtgatatcccaaaatggacctaaagcaggatgaagaaatataagaaaaggtggtccagaacgcaagtattcacagttgtctttgacctgaaaataggaaagaataaatttaaataagccattagaaaggtagcccacgcacaatataagtggtcagtgctcactaagtttgtcttttgaccagacaactgaaaaaatcataggaagttggaatccaattggcatctaatatttttcatatacagattttatgttccagcagaacatgtcaccaggaacttttactccctagcacatactccctccatcccaaaatataagcatttttagcatagtgacaagtcaaacatttttaactttgaccattaataacaaaaaaataaaaaagatcaatcatataaaattaatgttattagatatatcattaaacaaactatcataatataaactctttttatttaaaacatcttacttctatagatattgttagtcaaagtaacatcttggagaccgtgtcagtgtcctaaaatgcttatattttcggacgaagggagtaagtgactaagttgcaatgttgccattaattgactaaacatcaatatggccccacctcaagatgaggcaatggtccaggaatccaggtatttgaaactacatagtatttttttttaatcttttcattattctatctaacagcagaagtaaatcagataaccatatctatcaaacaaatttgagtctgttgatttgttctcatgtgaatgtaatattgtttcggtttaatgaaatcaatacgaaatagaaagttgatacttccaaatatagatattcatgttaccttactggatgacattttaatgaaccaagttttaaagtttcaaaatatcaactaaaatactattgctaggtagaactacaaccagcgttaaccaaccataacaccataggttctgtgttactgaagtaggctagcattacatggaatgtcgattcatgtcacatgtaaaaaaataaaattaagaaaaaaaaacaaaagtaaatctaccttgggaacctttacattgcagctagaaaggagatcataagcattacgcataatgtcaaggagtgaaccctctggagtctgtaaagcaagcaaagtgtatacttgtgacatgcaagtttgagaaactttcagttgctcaagttattatggcaagttttagaagaaatagcgaattgcacaaccaagtgcatgccagaaagatctagaatcaatgtcatcatgctatgcacacttttgagtcccaaaataaattaatgaatcaacagttttatgttcaaaacgggctcaattacagggtagaaaagaaatattattataacaataataaaaggcatgatatagagttctagacaggcaaacattcatgcaagcaccagcatataactttgaacgcttggcactttggcagtacatattgctaagtgctgatccaccaaatgaaattctcagtaactgtcatgacaataatcagatttcacaatcaatataaacaagcaattttgtcatttctgattcacttatttggatctgcagtgtggtcaaccagacatcaggcaaattgtgaaaatataccaacttggggatttttggtggtggtggggtgtgtgtggtggtggtggggaggttacagaagtatactaccaggcttcgcccagtagttgattttataaattaagaaaacatgagaatccaataattggattgagaagcatggtatactaacctggtgcaatgacttatcttctgatttcagcttccttttagctgacgaagtgacttttttcctttcgttgtacacaatgaatgtgtctagctcacctgtgacatgagattgctaaacatcaagtatcccaacaaacaaaggggaaagggtagtttgatggatacacgatgaatatcacatatgaaaacaatgacatactttctattcctttactgcacctgtagttatatgtgttcataaaattatcgctatgttttgcatcgtgcattctaacctgcctccagcagcactgtaagagaggaaaagttaatcattaaagaagagagatactataatactatcgtagtaaattgaataaactaaacaagacttggtaatatctttaatgtgcctccaatgcccaccttacacaagaaatggagtaatcaatactacgcaaaatgagagaaatatattctacatcattgaacccatcgctcagaagcatatctacactgaaa

SEQ ID NO: 12209 - DNA, 43858 bp, Oryza sativa
ataccatttttttctctaactaacaaaaaaggatagcttttgaggcgtgattcaactatagaaagcataatgccccaattcattccaaaccaaaagaggagttaagtggtcaatctgcaccaaacaattaggataaaatggtgactcaatcttcagttgatagaaacattcagttttatctttggtccgatttgactttcttgcatatgtagaattcttatatgaagtcactaaattatttcaggtttcatgcccttgctacaaaaaaccaccaagctatactcagggagtttatgccaacatgaatagagtaaaacaactgctttcattataagcaatcgcgcaaatatgttatgaagcgcccatgcttgccactgtatcatttcttgacgtggatttttctttctttatgtggataccacagaaatcagcatgattttgatatatgtttggaaattaattatactttaagatagaaacataagcctaagtgcactagtaagaaccatgacccaaactgtacaagtacaaataaaatgcaacggtgcttatagatggaccagaagtctaaagtgaatttattggaaagcaagtacctacactcaaagcccagatgatccaagtatgacacagcttttttcaaatttagcaccattccgggtaaacagctagcatttttgcgcgaaccaacttcctctgctgcttgcagatcaacatatagtatatttgtatttgctggatagttagcctgcaaactaaattaagaaaagtatagatgataaaatgtcaatacctataaaaggaaaacagccttattcatatgcatcaaacataaagggtgaagcagataaagtatatgttgccatacagcatcaatattttaatattcaggtaggtttgcatacttgcattgcatttactatttccaaaagtcaaagtaacacaaactattggtattgttctggaatcttgattttttttccccttgatacttttaccaacagaaagtatcactctcgaagactgcttcataaacctttctgttacagttttgatactaagaacctaagtttataactcgcatttattaagatattaaaattagccatcaaatttcttcctaatcatatgaacattccagtatgattaacaatttaatatataggaaaattaaaacaggaggaagggtaaagcatcacgagcagaaaaataagtacgcggttggataaaattgaaagaaatatttacctgccatttgttactgttggttctgggatgccatatttttcaaactcagtgtattcaatgcaagtgataccatatgcccattgtccatcctggttttctttttcgattagtacatttaccccttcagtagcactggtcttcgttcacaagacgcaaaacctaatttctggagtatgatatgtcagaatatggaaagagaacacaatagttgaattcaaaggtgcaaagttaacatggcagccaggatttgcatcagtagctaatatggaacactcaaaaggtaaaatgaaaaagagtttcatattacccctgggaaaacttttaccttatcgtgacgcaggcctattcctgccaatgccatcagtgttaaatcagttgcagccacaacattgctgaaaattacaagacatgcacagttacttcctttccaaataatatgttttgacaatgattaacaaacatttgattcttaggataacctgacttgacgtacagttgcgccttttctgccattttggtaaagccattggaatatacctctatcacatgcaagtttccaaatagcaccatgaccaccaggcttaccaacaggaaaaagtgctccgctggttaaccatttaccatccttagcatttactacaggtaccaaaggctataaaagtcatgatgagatttagttagcactgtaccatagttttggacagaatgagtaccgattttacagactagaaagacacacaccaataaataaataaataaataaataaatactagaaatcttgattatatacctgttcaaataagcggaaattctcacggcctctgccaaaccattcaagtctttcacatattgcagttatatgctcatggttatccttcacagagcttgtcatgatcgcgacaggagttatacattgtttcccaaaaatcttgaaatgcaaaaattccctagcctgccaaatatggtgccattcacacaattatattactggtcatagttctttgaacctttttaaatttctcatgacagagtgctacaaaggaaaagttatgcaagtaatacatatgtaaccatagacactttacacccttttcaatccttgtgaaagaacattacataaatgtggtttgctagaatatttttcatatagaagttagtgtcacctaatgaggtgtactgcataaatagaatgcggaaggagcaaaccaggtggtttctacttcctccatttcatattataagactttctagcattgcccacattcacatatatgttaatgaatcgagacatatacgtgtgcctagatttattaacatctatatgaatatgggcaatgctagaaagtcttataacctgaaagctaagccagtcaatcccctattgttttcaactttcaagtgataccctcagtaaaaatattacaaataaacaaaagttccatatacttagcagaagtacctgcagatcacgtatgaggccttctaatagagatctcccacaataaggaagcaatgcagcagggagggattcaccagtatccgagtccactaaaccaagacgatcaccagcaccaccaatcggataaatctctcctagttctggcaaaccctagaaacggtcaaatttcagttcatctaaagagaatgtaatgtctttgacaaaatgtcccgcactaaaaaaatcagaccacaaatcgcacggactatgctattgatctctttggtcaattttaggtaatgtagactaggaagtaacctcaatcccccacagagcagcttgagatgcatattccgtatcttccaatagattaagtccacttggaacatggaagtcaatagacttgtgtttgctaggccggtgcttgtggtccttcgaggctgaaagcaactccaatgccataatctgatagctggaaccaataaaggaataccgatagtgtttcagatatcagggtgaaagcaaaacattgtttaaattttagtgatgttttaaagagcactgcactagagtacaaacaagctatggcaataaggttaccaactcccagattttggccaggagcacaggattgcttggcaactttagttaatccctcgttttactaagtctacaactaaagcaaagcagcaaacaagcaattctcagtttctcacccgatgatgcctccaatgcagtcatagaacacgtcgatgtcgccgaggaatttgagcagacgccggagaagctccgattccccgctctccgccacaccctccaccactccctccgagctccacttgccgaccaaagcagccaagctagacagcgcctgccgcagggcgctccgaccatcgctcccgccgttatggtggtgatggtgctcgtggccgcgaccgtcccagtcgagctccgcgccgagcacgtgttcctggccggcggcgactaggcatttgagcaggaacacctcccgcggctcgagcgcgcccagaaccccaccattcgacccctccccgaagaactcgaccacccgggtctcggcgtcgagcgcgcggagcttgtcggcgagggagcgagccccgcggaggcgcgcgcgcagggcggagaggcgcgcgagctccgccgcgagcgccaggtccccgccgccgcgcggctgctcgcgggaggtggccggcccgggcccaacccctcgctcgagtggcgcggtggagacgctctgcgagcgggaggccgaggacggggacggggatggggaggagagcgcggagaggacacgtccacggcggcggcggcggcggcagccgggggagcggagcggcgggaggcggggcgagcagaggtcgaggcggaggtggggtggaggcagcgtgcgagaggccatgcgaggagtggagagcacaggaggtggtggtggtggagagcgagcgggcgggaggaggggggggagaggtgagacttgagaacgagggagagaatggataagaggaggacggcgagaccgcgagagcgaaagcgaagggggcatatgctctcgggcggaatctcgggtacccctgcgtgcgcgcgggcgtcgcggaagacgcgcgcccggcgcgccggttgtcacttgtcaggtgatctttttgctgttttctggtggggccgtgggctgcttcttgaaacttcgttgctcgtagcccatttagggcctgtttggtaagaccaaaaatatgggtccattactgtgtatggatcagaaaaaaatggaaaattttgaggaaaaagtacaccgaaggtccctcaacttctcatcgagttaaaaaatatcctcaaaccgcaaaaccagatatccggcgtcccttaactaatcaaagctggtcacaatagatccttatgtggttttgacccttggttttggcctacgtggcggctgagtcagcgtgggccccacgtgtcaaggttatccacgtcagcctcctatccttctttccccttttctctcccgtcatcatctctctctctcacacacacttctctacaagctggccagggcgaggcaggagagaaggagcgcggtgccacgacggtggcggtcacagtggggaagcacgtagagatgacacaaacgtgtgcgggacgaagaggatgggcacgatgcggcgggcgtggacgctgggaggctggtgagctcctcccaagtacaaatccgatgtcggctttggcttggcggtggcggcaaggcgggaggaatgcagcgaggagggcgacgccatgagggcgcttgaggaccaatgctacgatggtggggaggcacggggaagactggtctcggcttcggcttggtggcggcggtgaggcgggaggcagggacaggcgcgacggcggtagctctccaggaccaagcgtcgtcgttgccaggagctaaagggcgtcgccgtcgctggaagctagaggggcgagcggctcattagggctcgacttggacgacaatggcgatgtcgagcaggcggtgtggcggcgtcggcaggcaagcgcggctacggagaggcgacggcgggtgagcagcggttccggacgcgggcggagcggcggcggtagcgggcgagaccgctcttggtgtgccgacgctcctcttgctagcgcatgccgaggcggcctccgaccaggcgtggcgccgcgactaccccaacccgtcatcgtcccccagcgcaggtgaacctcgtagagcccctcctgtcgctcacgtcatcttgccaagagcggtcttgatatctcgccggtcgccacgttgccccttttccgatgtcagacgtcgctggcaccatgctcccctctgtcctcttcgctcttcccctgtgctactgttgccgccgccctccccttctcccacgtagccgccggcgccgtgtcgctgtgtttccccgccgcaggccaccgttgcggcccgccgccatcttctctcccgcctcgcctaccggtctctgcacccaccgctttgcctcgcccagaaagagagaagaggagaaagagggagggtgatgatgtggatcaccctaacatgtggggcccatgtgggttccacgctgactcagccccacgtaggccaaagccggggtcaaaaccaccgaaagacgtattgtgaccagttttgactatttaagggacgccggatatctggttttgcggtttgaggatgttttttaactcgatgacaagttttttttttttttgagaaggtaactcgatgacaagttgagggaccttcggtgtactttttccaaattttgttctttgatcaatgtaagccagaaattgggcctccgaaacgagggctcaggccttctggtttgagtatttgacttgggctaagcaaggtggcccaaagagatatttttggggaggagaggcccaaagaaatttggatggaacgccatcgttacggtcccaggctcccagcaccagactcaaaaggtagtgtttaacatcaatacggtaaattgttaaagataagaatgccaaaaaaaatcattagtgttaacaaagtttagatgttggaagcattattacatctgcaatgtttcctgttgatagagtttaggtgtatcctcaaccgtgtacacagggcacacggaaagcaattcaatcaggccagagctgcagataaacccagcacttaattatcagctcctcaattcaaattccaaccgtatcacaaaaggaaaacatttgagttaaaacgactgatgaaacacacgtgcatgcaccggtcactttgatcgagcatgtcttaacgaacagcacgagagctttggctgttggagataaggcgggaacgaaaaagctcgatgtcttaacgaaacgattacaccttcgtttgaaaaatttaaatctcctgcacgcgtaaatctctcatcgccccgccactatataaggcgaccaggtacccgaccccatgaacacacaccaaaccacctcgagatcgcttcactctcgtagcaatggcgccgtcgctagccaccgtcgttgcgatcttcctcgccgccatcctcctctcgtcgccaccaccctgcgccgccgcttcgtccgcgccagcgccggctgcggccgggcatggcgtcccggcggtgttcgcgttcggcgactcgacgctggacccgggcaacaacaaccgcctcgccacgctggtgcgcgccgaccacgcgccctacggccgcgacttccccggcggcgcggccacgggccggttcaccgacggcaagctcatcaccgactacatcgtctcgtcgctcggcatcaaggacctcctcccggcgtaccactccagcggcctcgccgtcgccgacgcctccaccggcgtcagcttcgcgtcgggcggctccggcctcgacgacctgaccgcgaacaacgccctggtgtccacgttcggctcgcagctcaacgacttccaggagctcctcggacacattggctcgcccaagtccgacgagatcgccggcaagtccctgtacgtgatctccgccggcaccaacgacgtcaccatgtactacctcctgccgttccgcgccacgaacttccccaccgtcgaccagtacggcgactacctcatcggccttctccagtccaacctcaacgtcagatcaatctacacatcacaactctctctctttgatctgatcttctttcaatcttacataggtcactttagatcttagattcacggtagagttgaaatttgtgtgttaaattatagtggtttagaattttaaatttcatctaaaatagaaacaaaatgatttatccaaatattatcaacgtaatcgtagatctaatattatagacttgtagagctaaaattatccatctctaaaaaaaaaaaatcttgaatccgcagctatgccaaagaggatgacatactcatcttcatgatcaaaagttaaaactcacaatgcctttgtgtgttattattgaccgtgcagagcctgtacaagatgggggctcggaagatgatggtggccgggttgccgccgttgggctgcctcccggtgcagaagagcctccgcggggcgggttccggaggctgcgtcacggagcagaacgaggcggcggagcggtacaacgccgcgctccagaaggcactctccaagctggaggccgactcacccggcgccaagatcgcctacgtcgacatctacacccctctcaaggacatggccgagaaccccaagaaatacggtgagcaatgctcctcatctgatctccttccgtccaaaaaaaaactaaccttaaataacgatgggacataacctaacctagtacaacgaatcgagttttttttttggagaataagggagtactcatgcacaagatcacgttgcatccggtgaacttttgatttatttgatcatggtgtgtgtgtgtgtgatattgcaggtttcacccaggcgagcctcggctgctgcgggacggggatgatggagatgggggcgctctgcaccagcgcgctgccgcagtgccagtcgccgtcgcagtacatgttcttcgactccgtgcacccgacgcaggccacctacaaggctctcgccgatgagatcgtcaagtcgcacgtgccgcagctcatgcagtaattagatggtccgtagcatagtttagtgtccagtgtgttaaactaattattaagaataatagatatgcatggttcagtagctatagagtttttgcatagagtaaagtccatcaccggtccctaaacttgtaccgctgtgtcatcccggtccctaaactcgcaaatctcggtccctaaacttgcagatcactcgtttaggtcctccaacttgttcagttgtgtcaccccggtctctaaacttggatttgaatatcatctgggtcaaataggacggtctaaagactttatatttaaaaataattcataactttttcatgtgaactctaatgaagacaaactttatatcaaacttgtagcccttgacgcgatacacaacttggaagtgaattttttttaattttaagtcattttttgtcccaaaatgtaatttcaaaattaaaatttcaaaatctataaacatgcaacaatattttgggaccctaaacagttttaattcaaaaacttttaaactacaaagttgtaggtcacgtcaagggcaacaattttaatataaagtttgtcttcattagagttcacatgaaaaagttatgaattattttttgatataaagtttttagaccgtactgtttagggaccggggtgacacaactgaacaagttggaggacctaaatgagtaatctgcaagtttagagaccgggatgacacagtcgaacaagtttgaggacctgaacggtcgatttgcgagtttagggaccggaatgacacaacagtacaatttagggaccggtgatggactttactcttttgcatacatatgttattagttggtccatccgtatagggttaggggcaaccacaatgtatgaaaaaggtaaccttaagtcaatgattgcacttgtaaagtgagccatatacattgtgaaaagtagcattagtttagggtgcaccttatgcttaaggtctaccacaagcaaaaagaaaatattttctctttcattcacttcatgaacaagagatgaaacaattatttttccattctatgtgggcccatcttatggctaaattctaaccataatattgttagtatggctttaacaatggcttattaaggttacactacaccacaaacattgatgatgcccgtagagtgggcagatattcagtgcaggatgtgtacacagggttaattttaattcagtttggtttattcaaaggaattgtgagccatctcatagtcgcagtcacagacaacagattgatttgccatttacattgtctactagtatatctagattagaaatcaagcgcatggatattttcttcacatttggccctgcatatactgaattactgatatgttcaaacagtcaaacagtacaatcacagactcctaaatcttactgaacaggaagaataaggaggccctaattgatctgtcacgatctaaagaacatgcagagacctatccatagaaagtgtgttactgaactgtgacggttatgactcgctgatagaatcgccattctactacgaataacaggtctgcaggcaaaccccaaaataactgacgaaactcccataattttcccaaaaaataaaatagtttatcatcaagcccctaaaagcaaacttctccttgtctccaaattttcccccaaaaaagtgagtttggcaactaccactataagcttcctaatccatcaaaattcctgtcttaatattaataacctgaaaaagcaaacaggaaacattatggacacatgaatagtcatatgaaaatttgtttggaaaatgacaattattctgtgttaatttggaaaaaactaaaaaaaaagtgagttatcatctgcaattctggataaatatatttttttaagacaagaaagaaggtcaggcacgcttaagcccagtattatgacactcacaatttcacaattttcagtttttaagcagtcaatcatacttgctatagaaaacaaggactattgggacaaataacgtacttaccctaataaacatcatctttacttgcctctgtctgaacggaccagaatgtcagccagcgtctcatttttcatattgttcttgcctgaaaggttgatctttgaatgtaagcacaaaacttgagcaatggccaacagttgcaatcaacacaaatgagttataacatgtcgatttgtgtgcagttctgcactacatacagtcatatagtaataattgagctagtcaatgatactgacagaggcttatgagtatttgtctcagcatatcaatatgttgccattaacacaagaaaatataaatattttaacataactgataacttatatctgagaaactcaaataaacacataaagaggcctagagtatgaatcatcttaacatgtgccttttaagcttgactttacataaacatgtaagcataatttagaagaaggttcaaatttaaatttcacaaacagcagataaaaaaaatttacaccggaactttatactccttccagtcatgtttacatgacgtttaggacaacagaatatacttcataatagcacaactaagctgtcctaaatgtctagtatacttaactggagggagcagttgttacttggtagcaaattcctaaatgtgcctactgttatattgtagcgcagttctccttttttaagggaagaacacagtctgactcactgactgtaatcagtagtgtagcccagagccaagatggatccggtgaaatttcatacacattttgtaaagaacagagagtgatattatgaagacacaaaagtatcaacaggttcatgagaactgagaaacataatgtagactacaataggattattctaataaacccacttatgacagcaagaaaaacactttaattccacaagctaagctagtagtttttttttagataatgagctaagctagtagtaacatgttaaacatcttcaaaaaactttctttatagggcaattttatggtacttgaggagataccatgaagtaccattttttctattgtaaatttggtacctcatgatacctaggtactatgaggtaccaaaatttacactaaaattttggtacctcatggtacctcctaaagtaccgtagaattactcttctttataactaaggctttggtcgatatcgaaaatgttcagacgcttcaagaaacgtgtacataaacaaattccagggccgccaaacaaaatgcacaatgcagcaaaattgactaaaaaacgtacacgcattcattgagttacctgcattagggatcgggaaagaatcgagccacggtgggagcacacatggaagcaagacacctgacgagctcactgtcgggaaaacgtcgctgcatagctcagagcactgaatcaccttcttcaagcgcatgtccacgctaacactaaccctctcaatcgcgaggtacaggacatccgcgttaaacggatcaatggcaccgatgtacggtatccccttaggagatccccctttggccccgagcgtagacagcgccacctggtgatccagcgtccagtggccactctcgtcgtccagcgtgaacgacatgacaacgaacggctcctgatcggagacctcgacgtagcgcagcttgccgttgctgacccccattcgccggtgcttgacgattcgttccatccctctcgagcacggtttctcagagaggatgctacctggcggcaacttgatggaacgggctcaggccggtggctgaacgggtcgacagcgacggcgccccagctcacgtccacccaccacagccggccaccgaatgccaccacctcgtggttcattcccattgcccgcccgggcggcagcggagacggcatgaccagcttgctccattcccttgtctccgaggagtacctgcgcagcaggaatcgccggccctcgtcgtcgccgtcgacgttgctgagctgcgctgcggcgtacctcttcggcggcccgtcctcgccgccgccgtcgcgttgggtgaggatgccggtgtggtggacgtccacggtgttctccgtgccgtcgaagtccggcagccggaagagctcgccggtgagcgggttgcagacgaagctcgcgaagtgctcgtaggtggtctcgacggtggtcctggcgagctctgggatgatgacgtcaagcggaagctccgggacggggtgagccgggccacggaagcaggccttgaaggtgtagacgaggaggaggccgtcgccgctcgcggcgaggacgccgcggccgcggagggcgacgcggctctcgtcggcgctgatcgggcggtcgttgagcgctatggccttcgccgggatggtgacgcgggaggcgcgcgggggcggcgcgagggcgagcgacacgccggctccggtggacccgtccgctgtcgagatccggtggatcagcgcccacggaggacgcgaggcggcggtggtgagggcgcggcggagacggccggaggcgacggcggagaggccacggtggcagagcattttggagtagagagacagagagagaaaggaggccgagagggttctgcacttgtgcttttcgaggacaagaggagagatgtgagggactgtgggtgtttgtggactcggtgcacggagttttctgcgtagtggtgatgtcatggcctcacggcagtcacgggcagagaaggcgtgctccatctcagattctcagtcagtagttcagtacagtatgtagatgattcactaggaaatgggaatggtggagaagaaatcggtcggaaacgttttttttacttaaggaaatggttgaaaacaggagagaatttttcatatttatgaatttgacatttagtgttaacttcaatgcgacgttgacagaaattagaaaaactaaaatttaatacagtaataatcgataaagatattattattattattattattattattattattaaaatttactctctctgtctcattttaagtgcaattataaatttctatgttcaacttaatcgtcttatttaaaaatgtttagtcaaattatttatgttttatcatctaataacaataaaaatattgattatgaaaaaattaaataaaatggacgattaaagttaaacatggaaatggagggagtacatgttttgcacccaaaaacataagaaaataaacgtccaccacaaaaccaatattttctatttgtttctattttctactccaaagttcaattatcgatcgaatcaagtcatttcactgtattaataaaacagtgtcacgcactgcaaggagaagttgcaaatcgttcccgttagtatttctcaaaaccagggccacaaagttaatcaataccacagtataaagcccaacaaactcgcatttctaacagcattctctcgaagattgtttcagtttggattgttcaaacaagtcatctcatagattgatttgtcatacatacactgcctactagtaacaaattagtgtaatacattggaacgtaagagcatagatatttcgtcttccatattcgaccaatgcatatactgttctgttgatgaaacaatacaatcacagttaacttgcagaacaggacgaataagggctccctaattagatttgtcacaaggtacaaaacatgcataggcctatccatagaaaggacgttactgacttgcagttaaacatatatgctgtcctgtgacggttatcacacgctgattgaattgccattctaatacaaataacaggtctgcagaaaaagctcccaaaaactgaagaaacagtcagaattttcccccaaaagagagttcatatcttcccaaaaactgaagaaactcctgtctccaaatcttcccaaaaagagagttcgacaactaccaaaatcagtttcctaatccatcaaaacgcctgtctcttaatcttaaaaacctgaaaaagggggaaattatggacacttgaataatcatacaaggatttaaaaccctgaaaaaaggggaaactatggacacatgaataatcatacgaggataatttgtttggataatgacaattattctgtattacttcggaaaaactaaaatatcatttgcaattatggccaataatatttttaggataattgaaaaaaaatagaataaagaaagacataggcacccttaagcccctccttagtatcatgaagagtaatacttttgataatactcttcatgcacttaaccatgatgctatgtctttccttgccctactttgtttcatgatactcttcatgaaaaacccttgaaagttttcatggtattgttcctgcacttaaccatgcttgctagttgagaaaataacaatgcaccttattgagatacatctaataatgaaataaactaggactgctggggaagtaaagtactaaacctggaaaactttgtatctacttggctctgtctgaacgaaccagaatttcagccaacgcctcatttttcacattgttcttgcctgaaaggttatccattgaatttaagcgcaaagaaataagcaatagccaaaagttgcaatatcaagacaaatgagttataacaagtcgatttgtgtaagatcgtttggtttgaagtaatatattcatccaggtgggcatttcacctccctgtgatctgtctaaaaaaacaagccaatttgcctgctctgcacacgataatttagtcaatgaaactggcaggctttttagaagtcatctctatgttactattaacagaacacaaatataattgttttaacataaatgacaatcttatacctgagaaaatcaaagggcaatgaacttgtaagtgatattttgccaacattaacattgctaactataataaatacttgaggccaatcaaacaccccaacctttttaagcttgactttacatagagatggaagaaaattttggacaagtaaatttaaaaatcacaaatagcaggtaaggtaacagattttacattgaaaccctcaagttggtagcaaattaccattcacaaacaacagataactaattttagacaggaacattttagttggtacttggtagcaaattcccaaatgaagctagcgaagaactggattatgcggaggtgtaggcatactggcataggtggctcgatccagtcggatcaacagaacttgtatgtgtattcatctatatccagttaaattgtagtaagaattcattagtggtatcgctagtggtatctaacaaataactctaataggattggattaaattgtagtgagaacttgtatgtgagaattcgttagtggtatggtatctaacaaataactccaataagcttaagtcatggaacgttaatgagctacaatctctaataaattcccatgggagactcggaggcagtgaccaaggcccaatatgccttccttgagaaacacacgccttagcaaacaggaagaatctctatgatatccattttaacaaaattaaaacaattaacatgtggatgtactaactcgggtaaacaagaacgagaagcgaactgcagagtacataatcacattatgaaagaaacattcaaacatgcaagtacaagtgattacctgaagaaggaatctggcatgatccaagccacggcgggagcaagcagggtgtcagccagttgagttggtctaacagagtggccccagtcaccaaccccgtctccatgtccacgccgataaccacctggttgcctggaccggccatgaggtacacgacgttgcctttaagcggatcgatgcaacagatgaacggcgcctccgcgaagatgtggcttccgtccgggcagagctgtctcccgtcagccaagggctccccgctggacaccagcgtccagcggttgcccgcttcgtcgagaacgaaggagtttagctcgaacggctcggccccggccgacgcgggcacctcgacgtagcgcagcctcccgtcgctgaccccgactcgccgatacctgctcagcctcagcttccgtcgcgtcgcgaagcccgacgcctcggcgggcagcacgctgccggtcggcagcgcgacgatgcggaagtccggctcgtcggcgaacgggtcgaatgagacggcgccccagcccaggtcgatccaccacatccgcccgccgaacgccaccggtgggtggtcgatgatagtggaacgcccgaacggcagcgaggagaagaagctcggcatcgcctcccacctccccgtctccgagaggaaacggtgcatgacgtggccgttgacgccgacctcgatcaccgcgtaccgatcaggcggcccgtgcccgtccccgcgatcggcctgggtgaggagccccgccgcgccgccgggcgaggcctcgcttctcgcgccgccgatgtccgggaggcggaacagctggccggtgagcgggttgcagacgacgcgggcgacgtcgttctcgtacaccccgcggaggaggaagccgtcgctggtcgctctgtcgatgaagccggcgaaggggggggacttgctttgcgtgagcgccggggccgtggcggccgcggggagagaggacgcccaaggggaagaagagttgggaggcgcacgggggctcggcgatgcgggaggtcgcgtgtagctccggcgggtcctgccgcgcgatgtctatcatggcccacgcagggcgcgagggagaggcgaccgtcgagtgggagcgccggaggcggccggagacctcaccggagagaccaaggaggcggcggagctgcatggtggcggcggtggggagtgaagagtgggggagaggggagctcggaggatcagaaattgggagaggatccgttgcttttgctatttcgacagagccggtgcatgtggactcggtgcgcgcagtgatgatccgttggttttgcctggaccgtgggagtgggactgttctactggggttgaacatggacccacttgttctacaggtggtgtatgcggagggtgaggatgcttaacattcactagtactcctacgtcctacgtggtctcacttttctattatctcgcgtatcagtgtttataataatgataatgttattatggtagagcatacgaaccgcatacggaaagtaccacggatctattctaccaaacatgacggaaaaaaattggatatgacaaatcctaatactacaaatttagagatatctctgtttagattagagtattatgtcttacaaccaattacttcctccgtcccaaaataagtgcagccatagttttccgcgcctaactttgaccgttcgtcttatttaaaaaaaattaaaaacatatgttacgagtaaagtactatttatgttttattatcttataacaacaaaaatgctaattataaattttttttaaataaaacgaatgatcaaatttgagagctgaaacttatgactgtacttattttaagatggaggtagtataattttttttaaaacgagcaagtatgtagtagtacaacggaagtaaaacagcgaggggaaagcatctttgtcttttagcggaaaggcgaagaggtgccgtgtttgaaggtttgaatgcccagtcatgtctaatggcggtgttgcgtgtttcccattggttgttcacaaggtctgactccaccggttttcccgccaaaactgtcttatgatgggctggttgggtctagtacaagcaagggtccatgggctggcacgaactcacttcacaggctcggacaacttgtcggaattacagaagaccataaagcgggtgtttagatgggactagggggtgtttagatggggctaaaactttttagcctatgtcacatcggatgtttggacgctaatttagagtattaaacctagactagtaaaaaacctaatttcataaatgaaagctaatccgcgagacgaattttttaagcctaattaatccataattatcaaaagttaactgtagcatcacattgtcaaaatcatggcgtaattagactcaaaagattcgtctcgcgaattagtccaaggttatggactggattttgtaattagtgtatgtttaatactctaaattagtgtccaaacatccgatgtgacagggacttggaataagtctctagaaaccaaacaggccctaaaactttttaatccatgtcacatcggatgtttggacgctaatttagagtattaaatatagactaataaaaaaactaatttcataaataagagctaatctgcgagacgaattttttaaacctaattaatccataattatgaaaagtttactttaccatcacattgtcaaattatggcgtaattagactcaaaagattcgtctcacgaattagtccaaggttatggaatgggttttataattagtgtatgtttaatactccaaattagtgtccaaacgttcgatgtgacagggacttattgtaagtacctgtttcccaaacaggcccaaaattcgctcaaaagaaaatacagaaggccataaaaaaaatttcaccaagtctatcaaataaaaattctggcaaatttgaaacaactgggatgtacaattccattttaaattcaagttctttgcgaggagtcataaaggatctaggataaaagaaaaaaaatattaaggccaagcatttgcacaagagatgcgaagccatccataatatgcttacaaagtaacagaactgatgccatgcaagctgtttgtactttatagtagccattacatgctgattgaaccgaatcattctgatggaacgaccaacaagtcggagcactgaaatggcgaaactcccacaacctcaccaaaataagacttaactgattttatcagcaaagacaaacaaaccaaacttcttcattccccagattttcacaaaaaaaaagagttcagcaattaccaccattaacatcttaattgatcatagcacttgcatttagattatgaaccctggaaagtaaacggaaaacattagggcatgtacaaaggtagagtcggatatgagctctacgttatttagagattagcatcctacaacagttagagacaatatggtctctaatcattaatgtatcaaaatattttttcttacttttatttcctttctttcaccaccatgcaacaaaatttgctctagtaaatgctaagagtcgactctgagccgttgtcatacataacaaccatactcctttctctttcctccatgtcatcaaatttacttgcatggcaatagagagagaccactaataaacaccgtatgcatgttatcgtgtgaacacaagtaaacatcgtcttttagagtttagtcagaataaaaaggaaacaaaatcaacaatttttgtacagatacaaggccttttttatgtgttcctttagaaagtatgaaataaaaaaaatgaattgtcaattattgttccctggaacatatgcattctctatatggataaattaaaagaaattagagcagatagtgatatatacatgttagcaagcagaatttctgacttcataagttggccacaatattgtaggacaaaaagaacatgattcatcctgatggtaatgccagctggccaggcaacctgtggcatttaagcttaagcagctattctcagcagcactaacatttgggaataaggatgtatgagcaaatcaagtactccacaacaatttgagtataagctctagaaatggtaacaccattataaggaggtagacaaatgtacctagtatcattcataaactccaacgaattcagaaaaaaaaagattaggaacatcgatagcatcgaagtattggtcaaccatgatagactcatccacacgatagcattggactgacgatgtaataactaacagattatgagcaagttgtttctcaaaagtaacctattgcattagctgcaagcctgcaactaatacccgtaaaaaaaaagcctgcaactaatatgagagatccggaaggagcaatgaaatatgacaaatagtggataaaacaagggtacacaaacacatgagttagaagagaaaataccaatagatgaattagccagtgtgcttcatttttaacagcatctatctacacgaaccagcatgtctgccaaagacttcctttcaacattggtcttcttgctcaaaagggtttctgcaatcatgtatacaagaatttgaacagtagtaacacagccatgatagtgacaagaaacaatatgcgtatatatccaataattgcaaaagacatggtaatgaacattgcatcaaaacacctgggcattaactatatgaacaaaataacaagtgttacacaacagacattcctctccaagaccacaatatgcgagattcttctgggaaataccaagttctggtgctgatatatgtcgatgattatcactggtatagtcaatttactagaagtgcaagccctatcagagaggattgactctgcttaacctagcggtggcaccactttgagggcagctatgcaggatcacttcaatggaacattttcaatagtactgcattagactagtagagaaagatagaaattaaggtaaactagatgcaaaatttggagttcacaaacaaaatctgaatagaattcaccagtcaatttagtaacctgaaaagcaaacagttagcatcaaacatcctttttattgcattagtccgaattacataaagatggaagcaattgtagaacactataaattagaaactcagtggataacagtaataagatttaagccagggaccctaatgagatataatctgtatcaaattgcaataggatgcttagaggaactacactgaccaacacctgtataagcccaaacgtgttacatgaaaattcaggcgcgttagcagcgaacaggaaaatcgttatggcatccatttttaataaaattcagacatttttagttagatgggaagtgcagaacagataaccacatgagaagaaaaaatgcttagttgatcaaacacctgtagaagaagggatccgggttgattcaagccacggcgggagcacgcagggtgtcggccaggcaggctcatccagcacagaaagcccaaaccccatccccctctccatatccactcccaaaacgagcccgctcccgaccatgatgtacacgacgtcggcgttaaccggatcgatgcaagcgatgcctggcatccccgggaagggcgccccttgcgcccgcagcgctgtgctctgctccatcgtccagctgctgccatcgtcgtcgagcacgtaggacctgaccacgaactgctccactccggacacctcgacgtagcgcagcgtcccctcgctgaccccgacgcgccggtgcgtgctcagcaccttcttccgtcgtcgcctctcgaagctcatctcgttggatgaaggcagcactctgcccctcggcagctcgacgaatcggaaatcgggctcgtcggcgaacgggtcgacggagacggcgccccaggcgaggtcgatccaccacagccggccgccgaaagccaccaccggctggtccacgacgatcgggcgcgcggccggcagcggggacaggaatcccggcatcgcgtcccacctccccgtctccgagaggaatcggtgcatgacgaagtcgtcgcagctgacctcggccaccgcgtacctgtcgggcggcccgtcgccgccgtcggcttgggtgagcaagccggcgtagcccatcagaccgggcgaaacctcgctgcttgcaccgtcgatgtccgggaggcggagcagctggccggtgagagggttgcagacgacgcgagcgacgctcctctggcccggaggccgagacgaagcggggaggttgggagccgtcgcgtgggcgcaggcgcaggcgccatgcgcaacaatggcgcggaggaggagcaggccgtcctcgctggtcgcttcctcggcggcggcacaaagggggccctggctaccgcggggacggatggcgtcgtaggggacgaggagttgggaggcacgcgggggctctgcgaggcggaaggtcgcgcgtagctccggcgcctcctcttgcggctcgctgaccaccatggcccacgcaggacgcgagggagaggcgaacgtcgagtgggagcggcggcggaggcggccggagacctcaccggagagagcaaggagtcgccggagctgcatcgtggcggcggtggggacttgggagaggagagggagaggacggaggattagaaattgagaggatgcttttgcaatttgtcagagccggtgcatgtggactcggtgcgcgcagcgatgatccgttggttgcgtggagaaaatgaccgtgcgattcttctacgaggaaatcttggggcccatttgtcagtgattaatctatgggtgcagtgcaggaagaccaatgtcaatatgtcatggattcttctagctttcgcaataaagcgtgtgtttagttcacgtcaaaattaaaagtttagttaaaattgaaacgatgtgacaaaaaagttgaaagtttgtgtgtgtaaaaaagttttgatgtgatgaaaaagttaaaagtttgacgaaaaagtttgaaactaaactcagccaaaaccaacttctgttataatgtggggttctatttttcgccatcagcaagcaatctgtcaagattgaagatgagaacacacagtagtactcataactaaggagcacatgcatgatgcaagctaccataattttacagagaagagaaccataatgtgttgcacgtaaacattctacagattttcttgactgccattcagacttcaattgtcaatcgaaccaagtctatcactgaataaagtaaacatggttcatagcacatacagcaaggagaagttgcaaaacgtttgccataatttgtcaaatgagggacacaaagttccatcagtaaagcccaacaaactcaaatttctcgcatcaaaaccctcaaaattcaacaggtagcaccagcaaagtccagatgcacagcaaaacccaaacttctcccagcatccccaaaatgagagttcaggtacttgaagaaactgctaccatcaaagggaatctctggatctctaccagtaaatttcaaggaacctgcaatcaatgagtaaacatcagtctccctatctcacaaacagagaatagcacagaacaagtgaaatgaacaatcgccagttttggtggttaaccaaaagtaacactgaaaccagaacatccatttggttttgtacctaagctatcagtcaagcgtgaagcattgcatgacttaagtcttgactacaggctacagcacaaattacagcctgataatatagtactagtaactagtaaagtagcatgcaagatgcaacatactttagtagttcagtctactcttgaatcttgatcgactagttacaaatatttcagcatagtaaaagacacatcaacatgaagattctgagaaacttttaggtttgagatagttcatgtctgcttgttctgataggagtgattgtcctttaccgaagcagcaattctcagcagcagcaacattcggcaataaagatgtatgagcagaacaagtactccgtgacaattcgagtataagctttagaaatggtaacaccatcataaggaggcagacagatgtaactagtatcattcataaacaccaaagaattcaaacaaaaaatacaagattagtaacatcaatagcatccaagtattagtcaaccacgagagacttatccacatggtagaattggactgaacagactatgagcgagttgtttcttaaaagtaacctattgaatgactgcaactaatatatgagagatccggaaggactgatgaaatatgacaagtagtggatataacaagggtacacaagcacatgagttaggaagagaaaaataccaaaagatgaattagcaagtacgcttcatttttaacagcctctatctacacgaaccagcatgtctcccaaactcttactttcagcattggtcttcttgctcgaaagggttcctgcaatcatgtattcaagaatttaatcaagagacaataatagcatagccatgatagtgacaagaacaatgtatgtatccaataattgaaaaaaacgggcaatgaacattgcatcaaaacacttgggcattaactacatgaacaaataataactgttactacctaagttttcaggttataagactttctagcattgcccatattcatatatatgttaatgaatcaagacatatacgtgcgcctagttgcattaacatctatatgaatgaggacaatgctagaaagtcttataacctgaaaccgaggaagtgctacataacaggcattcctctccaatgacagcaacatgtgagattcttctgggaaatactaagttctggtgctgatatttgtcgatgattatcactgctatagtcaatttactagaagtgtaagtcctatcagggaggatttactcagcttaacatagcagtggcaccactttgagggcagctacgcggcaccatttcaaagtaacatttcaatagtactgcattagactagtagagacatagaaattaaggaaaacttgatgcagaatatggagttcagaaacataatccgaattaagttagaaaactgcaaagcaaatattagacatcaaacatcatttttattgcattgcaactccgaattacaaaacgatggaagcaaatgtagaacattgtaaatctgaattcacaaaatatacctataataacatttaagcctatggatgaaaatgagctataacctgtagcaacttacaacaggaggcttagaagaactaaccaacccctgccaaagcccaaatgcattactcgaacattcacgcgagttagcagcaaacagcaaaaatagttacgacgcccatttttagcaaaaatcaggcagtgataaacatggatgcactaacatagtaacaagagccactgaaaaaaaaacacacacacacatacagagagaaggaaaaatgcttagtagatcaaacacctgtagaagggatccggcttgtttcaagccatggcgggagcacgcagggtgtcagcccgatgggatgctccagcagacagctcccgatcatcacccccttctccaagtccaccccgacaacgtgcctaccatcctcgccgatcatgaggtacaccacactagctttcagcggatcgagagcaccgatccgcggtgtctcctgcaatggctccgaccagagccggccgagcgccactctgtgctccagagtccagccgctgccgccttcgtcgtcgagcgtgaagcagctgagcacgaacggcgacgcctcggacacctcgacgtagcgcagcctcccctcgctgaccccgacgcgccggtacctgctcagcggcgcctcctgcagccgccgcctctcgaagcttatcgcgtcggcggcgggcagcacgctgccgctcggcagctcgacgaagcggaagtccggctcggccgcgaacgggtcgacggagacggcgccccaggccaggtcgatccaccacatccggcctccgaagctcaccaccggatggtccgcggtgatcgctggacgcgccgcggggatcgcggacgagaagcccggcgtcgcgtcccacctccccgtctccgagaggaatcggtgcatgatggaatcctcgcctctgatctccgccaccgcgtatcgatcaggcggcccgtcgccgcggtcggcttgggtgaggaagccgggcttgacaaagcgccaagtaccgcccgtgtcgccggtgtcagggtcctcctccgggagggggagcagctcgccgccggtgagagggttgcagacgacgcggacgactttggtgtcggacttgaggccagggagcggcggccaggtgtcatccttgggcctggggatgaagacggggtttccgccatgggcaggaacttggactagctcgagcgcggtgcggacgaggaagaggccgccgctgttcgccgcgcagatggtgccgcgggagatgacctcccccttgctgccgtcgtcgacggggacagcgagggacacgatgaagcggatggggacgacgagctgggagacgcgcggtggcgaggcgaggcagaaggtcgcggtcgtgattggctccggcggttcttgctccgtgtggaccaaccccatgtcggccatcatggcccacgcgggtcgcgaggcggccgtcgagtgggagcggcggaggcggccagagacctcgccggagagaccaaggaggtgccggagctgcatcatggccgccacggcgtcttgtcgtctagtggtgctgtggtgatggggaaaaattgcgagagagagagaaagagagagaaagggaggatgagaaattgagaggagacacggttcatgtggactcggtgcacgcagcgatggtcatctgttggttgcgtggtggacttgttgtacgggggtgcagtgagaacagcttttctgggtcccacttgtcagttatagtagtccatgggtggagttggttcacgaggtccgggctttcgaaaaaattcctctatttggaacgatcgtacgagtagagcgaaaagcgaagcgattgttttgaacgggaggggaaaccggtggaaagcgaagcgattgttttgaacgtttgaagttttttgagcgaacctgaacgtttgaagttgaactgactatcgcctgtgcctgcgctgccgacgagccgatcgtacgtcacaaagtttcccgccaaaaatattcttgggctccgcttggtcatatgggcctacagcccacaagttgccgtgggttcacggcccagctgaatagcttaaggcgtccacatcaaagatatcgggttggtttggtttgtggcctaaataggccttaccaaattttatcaatgccaaattttggcaagttttgatatggctaattttggtaaggtaaagttatgtttggattgaagtcaaaatagcctaagttcactattgaaataacctattttcttaggcatgtcaaaatttggcttcaaaccaaataaacactaagcactattgaaattgtcaaatattggtaagcctaatttaggcctcaaaccaaaccagcccatcatctctctctctctctctctctctcactcactgcccctaagctgattagacaagacgattacaaatcgggcgtctgatttttaaagaaaatcggacattgtttcaccataacaaatatttgaccactataatatttgtgaaacatagttgaaataccattgaaacatttcattttcatggatgaaacatcaaacttcaacccgttgaaacatcccaaatatgcaagaaatatgaaacaccatcaaagtatccattgcaatacttcgattcaacacgaagaaaaatccaaatatattggctggaacataaaaaaattgcgaaaatgtatcaatccagatctagtttattcctcctctccggtggtcgtcgactgttccaaatccacgccgggatggtgcaattcctttctactccaccaaggcgggtaactgctgctgcccaagccttcatcacccatagtcactgatgaacaggagtaacgccacttccagatccacgtaggggccattgcctttctgcaacttccacccgtgtcgatgttcacaatatcttgttaggagctacacaggaaggacgccccctccctccacccccaccggccaccaccgacccctgtcggccccatcccctctgcatggccataaactcagtcatcgactaggggatgaacctcctcttcatcgcttctccgctggccttttgcagggccgccgatgctagggggatggctccctacatccatcttcatcggtgctgcctctcctccaccgctgttcgccgccacgccggccctctatctccgtcgttaaggacgtgcgtgggagagagatgagagagggagggggcggggggtcatgggatatgtggaatgagcggttgggaggagcccaatattttcttatccatcggaggctcgataggtagcgttttcattaacttttattttatttttataaagcccattctattaaaaaaatgataagcattttcaaactgaggaattttgcacacaaattgacgcaggaacttgaaaaaggttcatcataaggccaccgattttgacacagctaatgaatttctcaagcaatttcctgacctgggtccttgtgagaccattgaaaggaacaacatgtacacagaagcacataagcaatctccaattactacttcagatctgagtcgagtataacacgtgcataaggatatccatttgctgatggtaattctgttgtttattccaagcaaataggcaattggcagctggcaatatactcccttctactccctccatgcatttttaagtgcagccatggttttccgcgtccaacttttattgtctgtcttatttaatttttttttaaaaaaattaaaaacataagtcacgaataaaatactatttatgttttatcatctcataacaacaaaaatactaattataaaatttttttaaataagacgaacgatcaaatttgggcgtgaaaacttatggttgcacttaaaatgggacggagggagtagtacttttttttgtttgccatcagaaagcaatcacgcatcaatctatcagatggcctgacaaaaaattacattgataatgagaccatataacagaggacaaagcttagataagtcataattaaggtctaaggagcacatgcatgagaaattttgcagcaaagagaagcaaaatgagttgaacgtagacattgtttctagactgccatttgtcgatcgaatcaagtcattatactgaataaaacagggttcacaacttcatgcacacagcacagcaaagagaggttgaaacatattccccatagttttcaaaatgagcgccacaatcagtgataaagcccaacaagctcaaatttctcatagcgttccccaaaaatgacgtgtagtcaccattcgcttcctaattctctcgaacatctgtcaatgtgagtaacctgcaatgcaaatagtaaacatcaaacttcgtaataacggatgatgaccaagaataaacagttaaacactagggtcatctgaacattcatttgaataaatgggtaatacagttaacattaagagtaatttgctgtagtttctttcaagtaaatgccggaatgaatttcattgtctaataaagaagtagtagaaagaacatcgttcagtttaatcaagatcactttctgacatatatagtccactatacactgtgaatcggtgattacatgaaagaagacaattgttgaattcacagcacagtacaacagttgtgtcaagtggtcaccttgtatccggcttgatgcaagccacggagggagcacgaaaggcgtaaacacggtgggctcgtcgagcagaaaactcgcaatcaccatgcgcctttccatgtcgacgccgatgacgtgcttgccgtcgtcgccgccaaccacgaggtacacgacgctggcgttgagcggatcgatggcgccgatctgcaagggccccgccggcgagagcgggccgagcgccacgcggtgcgccagcgtccagcggccgccgccgtcgtcgtcgagcacgaaggagctgagcacgaacggcttggcaccggacacctcgacgtaccgcagcctcccttcgctgaccccgatgcgccgccaccttctcagccccaccttcccccgccgcatctcgatgctcgccgcgtcggcgggcagcacgctgccgctaggcaggaggacgtagcggacgtccggctggtcggggaacgggtcgacggagacggcgccccaggccaggtcgatccaccacatcctgccgccgaaggacaccaccggctggtcgatgagaatctggcgcgtgaacgacagcgaggacaagctcatcgtcgcctcccacctccccttctccgagagaaaccggtgcatgacgcaatccgcgcctctgatttcggctaccgcgaacctgtcgggtggcccgtccgcgcggtcggcttgggtgaggaagccgtggagaagattgtgccaactcttgctctcgccgacggtgtccgggtcctccgggaggcggagcagctcggcggtgagagggttgcagacgacgcgggagacctccgtgtgggacttgaggccggggagcggaggccaggtggtgtcgtccttggagatggggatggggaacttgacatggtcgggcacctgggcgagatcgaacacggtgcggaggaggaggaggccgccgctgctcgccgtgcagatgttgatgcggcaggcgacgttgccttcggtgcccggtgtagcggggcacaggaggcagtggagggggacggtgaggcgggagacgcgcgggggctcggcgaggcggagcgtcgggcgccgctccggcggcactcgctcgtccaaccgcaccgcgtcgtccatcatggcccacgcgggggcggggcgcgaggcggccgtggagagggagcggcggaggcggccggagacctcaccggagaggccaaggaggcgccggagctgcatcgcggcggcgcggcgtgtaggtggtggtggtggtggtgtggctgagagagaggagaggaggagaaactgagaggaagcttttgcaattgtcacgcccggttcgtgtggactcggtgcacgcagtgatgttccgttggtttcctggagaaatcgggttgttctacgcctgcggggtgtagggaaaactgtcgggtccagttgtcagtgagtatttgggcccatttgtcagtgtcagtggcctactaccactactacattgctggcccgcctccgtgcgaagtagtattccctccgtcgaaaaaagcaaacccagaattagatgtgatatcaattttttgttcaaatttactgaacaaaaacggatgagtatttggaacgtagcagtgcagcagcgaaaaaggagatggctttgaacgtttgagctgcccccccgaccgtgcctgctgccctgatctgctattccacgtcactagtttcccgtaaaagtgttttgggcctgacgcctgagctgcttgggccgtagaagcatcagtgaccatgggcccacggtccacggcccagctgagaaaaccactagcctacatgaacacctcaaattaaagggaaaatcatctctcactcaaaaaaatgaggggctggtttgatttgaggcctaaattaggcttaccaatatttggcaatttcaatagtgtttagtgtctatttggtttgaagccaaattttggcatgcctaagaaaataggccatttcaatagtgaacttaggctattttggcttcaatctaaacacaactttaccttaccaaaattagtcatgccaaaacttgccaaaatttggcattgacaaaatttggtaaggcctatttaggccacaaaccaaaccaacccgaggctatcgaagtgctactccggcatttccctcttctgactcctcagccctgattatgcagtaagccctcatatcactttcgaactgaagaaatttcacatcaaacatcccacaattgaatttgcccccaaaaaattggctttgtcaaaatttggcaaggaaaacaaacaagagtctacaaatctaccagctcatactgttggaaacaacaatctcatttggaatacaacaacttcgcaaggaacaattcaattccataaaaaagagctggggaaaagtctcaaggtcaagtgtttgcacataaacatcacgctttccatagccataataataagatctctcacaaattcactagttacataactgaatttctgtacgcatgcattgacttgtgcataggagcactgcagacaagcatagcaagcaagttgtttttgtgataaccattagtacatgctgatggaatccaatcgttctactggaatgaccaacaagtctgcagcaaagccccaaaatgacaactcccagaatttcatcagtaaagaccaaccaacaaaacttctccaaaccccaccaaaaagagttcggcaattaccaccatcagcatcctaattcatcagaacacttgcatgtgttaggttaacaaaacctgaaaagtaaatgcgcaacattaaaaacctgaataaccataggaacaaaaatgagtgttttgggaaaatggcaagtttagcaaggttagtttgaacacaaacaaacatagagatgtattttattagagcttagtctggatgaaaagtgaacagaatctatgactactgtaacaagtacaaaacattttttctgcattcctttgggattgaaatggaaaaggagttatcgattattgtcctctggatgatatgcattgattaagaaggaaacaagagcaatactctctctgtcccataaaaaatcaacctagtactcaatacgacacatcctagtactatgaatctggacatacctcagtccagattcattgtactagaatgtatcacatccagtactaggttcattttttgtgggatggagggagtacttgctaagaagtaacaaccatcatttccggcttcatcagtttgtgacagtataaagtattgtaaggcaaaaagccaaaaatacataatgaatatattttatagtaaggctgggaaccataagctcttatgaataataacttaataagataggcccagtattaagtttgcactcaatcatgcttgttcagaaaacaatactgagcctgaatgacatacaagtagaagcaaatcaaaccagaatcaccagtaaatttataatacagttagtagtagctggttacctgataaattaactacttcttgtcactgcctgaacgaaccagaatgtcacccaacgtcttatttttcgcattgtccttgcctgaatgatttttcgttgaatttaatcacaagaacttgagcaacaaccatacattacaattctaagtaacacaatcttactacaatagctaaggaattaaattgacatgtattcgaacaatacaacacaacatacatatgttgatgttaatgagagaaaatagcagtatttggacatagataactcagaatagtatgttggtcagaaaagcaacaaaaacataacagtccctttaccaataagcttgtttgctaataattgattaatgattacattgttaacaactgatgtatgttcgagtagcaggtcaaataaacaggtcttaaggcacaattaaatggaaacaacatccctaatgctaacctttaaacactgtattgcacaaaaaggagacaaaaaaaaaagcagattacacagtgtacatttgagattcaacacgcagtataaatccagtgatgttctacacaagaacactaaattgcaaatgagctacattttgtactagcaaattcccagagaggctgctattagcttgtggctcactagtgtggtttagctgagagttactgaccaattcctttcaatgcccagatgcattccatgaacatcattacacacaagtgacttaaatttaaccaaccaaacaagtgactgaacttataaaacaagacaagtgaaatagtgctaataaagtgataattgcatcttgaaaagagacatgctaattaagcgatgaaatgataacctgaaggtgggatctggcatgacccaagccacgaagggagaacgcaaggcatgagctcggagggatcttccactagactactcccaatcaccacccctctctccatgtcgacgccgatgacgtgatcgccgaccgtgggataggcgacatgggcgttcagcgggtcgaggaaaccaacgcacggcttggtgccccggaatggcagccacgggtagcctccgtcgccccagatctggctgagctccacgcgatgctccagcgtccacttccagccgctgccctcgacggtgtcaccgtcgagcgcgaaggagctgagcacgaacggctcgtcccaggacagctcggtgtaacgcagccgcccctcactgacccccattctccggtagtcgcccagcctcagcttgtgtcgccactcggggtttgtcgcctcgggattgagcagcacgctgccgatcggcagctcgaggaagcggaagtctgggtcatggctgaacgggtcgacgtggacggcgccccaggtcatgtcgagccaccacagccggccgccggcggcgaccaccgggtggtcgactataaccttgcgcggcctcgtgagcccgcacccgaacaggtagtccggcagcgcgtcccatctccccgtctccgagaggaagcgatgaatggggaggtccttgccgatgaactcgaccacggcgaatcgatcaggcggcccgcccccgctgtccgattgggtgaggaagccggcgtacgcctgccgagccagaccgccgtcggggagacggagaacctcgccgctgagagggttgcacacgacgcgggcgacgaccttgtcgaagtcgtacctgatgccggactgcacaaaccaagaaggatcgccgcggttgtcgaacatgttcgtcgcggcttggccggtcagcttggctacctcgtcgacgacgcggagcaggaggaggccgtcgctgttcgcggtgtacctcgggccgtaccgccggatctctccctccaggccggctgcaggcccgctggggcggcgccagagggcgccgtaggggacgacgagctcggaggcgagcgggggctcggcgaggcggaacgtcgcgcgcgtctccagcggcacgttcggcttggggagcggcgtcacggtgttcaccatcgcccactgagggcgcgaggggcccgtggagagggagcggcggaggcggccggagacctcaccggagaggccaaggaggcggcgccggagctgcatcgcggcggcgcggcgcggcgcggcgtctcgtctcgccttgtcgaggggatgagaaaattgagaaaacgggaggaggcttttgcaattactactcctcagagaggcgcagaggcgcagagcctggtgcatgtggactcggcgcacgcggcgaggatacgtttggttgcgtggagaaatggccgtggggttggtcttcctgggagcggtgagagggagctctactcgggcccatttgtcagtcacaatggtctatgggtgttggttcacggagaggcttttcgccgttgctccatttggaacggccgtacgatacgagtacagtctactacggcctgtcggcgaaatgaaaaattttgggtcatatcacgtttgaccggatgtcggaagtggttttcgaacatgaatgaaaaaaataatttcataactcgcatgaaaaccgcgagacgaatcttttaaacctaattaatccgtcatcagcaaatgtgagttactatagcacttatggttaatcatggactaattaagctcaaaagattcgtctcgcaatttatatgcaaactgtgcaattagtttgtctttttatctatatttgatgctctatacatgtgtccaaagattcgatgtgatgtttttggaaaaaaaatttggggactaaacaggcccaaagtttgcttgcttttttggtgcgaaaagcgaagggatttttttttgaacgtttgaattgcctcgattggctgtggcgactgtggcaggtctgcacatgacccgatccacgtcacctgtttcccgccaaaaatattttaggtcttagtagctgattgggcctgcgggtcatatcatatcatagcccacaagtggccacggcccatgggctcacggctcagctggaggcatctactacatcgaaggcatcgacaagacgacaagcgaccggagataatagataatctctcttttgaacggaagaattttacccaaaaaattaacagagaaaattaaatcttgaaagattcatcataaggccagggatttctagagaagtactgaatagctcaagcaagttatggacttgggtccttgtgagtcttcaaaggaacaacctgtacagagaagcaatctccaattcctacttcatattgtacggggtagaacataacatgcacataaggatatgaatttgctgaactgatctttgaaagtctatcctacgccattggtacctcatctgttttataatacaatactttctaacattgcccatatttatatagatattaataaatctatatatatatatatattcattaacatttatattgatgtaggcaatgttagaaagtcttataatatgaaacggagggagtagtttggaatgtaatgttggggggttctattttttaccgtcagatagctagcaagcaaagcaccagtgtcagaattcaaaagaccccgaaaaaacatattccattgatgaatgatgaacacataacatcgaagaaaacttagatataaggagcatatgcatgatgcaaaaatgtaatcgttgtatgtgttgttctagactgcggttcaaagctcaactggcgatggaatcaagtcatttcactgaaataataataaacatggctcgtgcatagctaagagaagttgcaaaatgtttcccagaatttgtcaaaatgaggggccacaaagttcatcaggaaagccccaaaacccaaacttttcacagcattcccacaaggtgtgtcagaaaccatcaccattcgcctcctaattctccagaaaaacctcgtctgtcaattttgagaaaccctgcaaatcaaataataaacatgagactcccttgtctctactatctttgtaataattctgacaaagaagtaaacactaggggcatatgaacacacatgaagaagagctacatttatctgtttttaattcagtgaaaataaacaagtaaatagaaacgccactacataatgagatgccgtctagctttatagtttaaacactgaaataatgagctgcgtctcaacagcattgcgacataatttaatttgagggtttttagggtccatgggagtatgttctagtgttaatcatgactcatgggtttgtatactgaacctctccatagtcaatactcccaaggagtcaagggcactccaagaactcattcaatttatataacacagaattctaacatgatcaatagttaaggagcaacaacaacaacaacagcattcagtctaggcaagatcagttggtaataatatgtgccatatacttacagccccatgttttccaataagtcataatgaactagagggcagcaatagtccctattggcagtcagcacacttacagttgagcattatacatttatacttgtgtctgccaagtctcttattgcaaattaattcaaaatacacaactattctacatcttccgcaaaagaaaaatgacattgcaaatacatgtaaataaacaaaccatcctgaacttggaaagcaatcagataccgccactaattgataaaacagtgaaagttagttaacagaaagtaccatgagatcaaaagctgataaaattcacttcttcagttctatgtctacatgaaccgacatgtctgagtatgacggagtattgcttttcatcttggccttcttgctccaatggatccctttattcacaaagataagaaactaaacaatcagtatatgcttctctacaatgtatccaagatataaaacagcaaacgaaataagacactgaacaggggcatcacatagatatacgtttacacccaatttttagataatggaaatggattacatctccggcgtttacactaaattagatgaatggaatgcataataataaacatactatattcaaattagccgagagagagagagagagagagagagagagagagagagagagagagagagagagagagagagagaaatcagcatcctttggctttacatctactcctaaatgcttcctgtttcaaccttggctacaaaagtatccaagttccactctttctccccaaattcaccatttcgccacaactattcccgatttgccccaaaattctagtacaattggtaaaataaggattttaaagacatgttaaaacgaaatatactaactccaactaacatttacatagtgcacttcagcaattggataactcaaacaagcatcatagaagaagcgtgactacaaataaaagtatgaatcttgtttcaaaagtaaacaaataccttcaggaatctggcttgattcaagccacggtgggagtacacaaggcaggaggggaaagtcagcacaacccaaacgagaactgtcaatcgccctctccttaatcatgtctatgctgagcatctgatcaccaactatgaggtgcacgatgttggcgttcagtggatcaatggccccaatccttggcatgccacccaagggaaccgacgcgtggtgctcatccttccagatcgggccgaaggccacctcgtgctccagcgtccaggagtcgccgccctcgtcgtcgtcggcgagcgagaacgacctgatcaagaactgcttccccaaagacacctcgacatagcggagcttgccctcgctgacccccatgcgcctgtacttgccaagctcccttagcatcaccacgtcgtcaaggtcaggcagcacgctctccttgggcagctcgacgaaccggagctccggccggtcgctgaaggggtcgatggtgacggcgccccagctcgcatcgacccaccatagccggtcgccgaaggccaccacctcctggtcgatgtcgaccgtcctcctggctggcaatggggacggcatgcccaccagcttgtcccactccccggaatccgagagaaatcgccgcacgagccacccctggccgtcttcctcgcggttgccgtcgagctccgccaccgcgtaccgagcaggcggcccctgaccggcatcggactgggtgaggagcccgaagtggaggtacctcgaggtcttcttcgtgccgttgaggtcggggaggcggtacatctcgccgctgagcgggttgcagatgaaccgcgtcacctccgggtcgcggtcgacgccgtcgagggcccactcgcgcatcggctcgccgccgcggctgccgacggtggggaggtggttgcgggagtcgtagaagcggacggggacgaggccgtcgccgctcgtggcgcggacgtccgtggagaccgtgccgaacatctcggactcggcgtcgtggcggaggcgggggtcgacgaagctggcggcgaaggtgaggtaggagacgcacggcgggtagtcggcgtggagcgacgcgcccggctgcgacgacgccccggaccggtccatcttcgacagctggagcagcgcccacgggggccgcgccggcgacgcggcgcgcgtggagaggtagcgggcgaggccgccggagacggcgccggtgaggcggcggaggcggagcatcgcgcgcggaggcgtggaggtggaggtcgcggtgatttggtgtagtagtagtagtagtagtagcctgtagtgtactactggtagcagagaaggggagaagagggttttgtgtttgtgggagaaaccgagagaaggggatgcggaatgaacatgaactcgctctacggaccaaggaaaagcagcgtggtcaaaagaagaagggaagactcttcagactttactatcaagctgtactcggatatttttttttctttaattacaagctgcatttaattactttggatattttaactacaaagctgcatttaatggtatttcagtaggaattaatttttagaaatccaaataatttagaaattttctcaaactgaacgcgcccctaatgctttctcaggtgacaaaatcgaagggcctaataaaacctttatagttaagataactgttgggcctgtagcccatctacagtaatttatctatgagactccgactacaaaccttcccgagttgtagaattttttttttaaaaaggagaaaagcaaagttggagaaaaaaaatttcctttaaaaaaaaaagaaaagccggtctccttcatcttcccgtccgtaaaccctaactgacttatactcatcaatcgtcctcctcgattgctcctcccctgattccgatccactccgaggcctcatggcggcgaccgattctcgtcgccttgcagacctagatgtcgacgagctggaccgcctcctcccgttgatcaaggtcacccccttcgccgcgcaccgcacttctgcccccagaggatgtggttgtccttgtgcggcgccgaggcggatggaggagtctcagggtaaatagtttttttccccatatttctcttgtgttggttttaggactatctgcatgatttatctgatcatgcagcctcgtcggagaggactccaaatcccccccacaatcgctcagtcgcctttggacaattccaagaaagactccgagaaagctttacgcagtaagtacatgattttatcatacaagaaaagaaaagcaagcaaataataaagccaataattgtgggaagttaatttactcacttatgggggtggcatgtattacccgacccatcattaataaaatggttataaggtagagtatatctaccttccagcataaaaaaaaacttatgggggtgccattgtacaaagaatgagatatggggtagaagaattacgattgtttgtctgtttttttttctgtaaacaaatgtagtctgcttcctagattgctttgctggactcgtcatcttgccggcagagcaagaacaacttgtggtgctcaaagccatccttgattccttctccgaggccactgggctaaaaattaattttcacaagagcaccttcctccctatcaatgtcctgcatgatgaggcggttcggctggctgggactctcggttgcccgatagcttccttcccccaaccttatttaggcctccctctctctgttaccaagctatgcctcgcggacttccaaccgctcatcgctaggattgacgaacgtcttgccggttggcgcggtcaccttctgtcttctgatggacggctcactctcatcaattcggtgctctccgccctcccttcctatatgatgggagccatccttctccctaagggtgtgttgccgccattgacaaatgccgaagagctttcttctggacaggggatgaacactgccatggtgacaactgcaaaattgcgtgggacattgtttgttctccgaaggaaaaaaggtggtgctgggataaaaaatcttgaagtccagaacaatgacgaggattctgcgtcgtggattgactgttttcaaactgaacgggtctatagtgctttctcaggtgacaaaatcgaagggcctaatgaaacctttatagttaactgttgggcctgtagcccatctacagtaatttatctcagactacaaacctttccaagttggagatttttttttaaaaaaaggagaaaagcaaaagttgaagaaaaaaaatttccttaaaaaaaaaaagaatagccggtctccttcgtcttcccgaccgtaaacatcgagattctagagagacgaggcgcgggaccagtgaaaccctaaccgagctactcatctctcgtcctcctcgattgctcctccacccgattccgatccactccgaggcctcatggcggcgaccgattctcgtcgcctcgcagacctagatgacgacgagctagaccgcctcctcccgttgatcaaggtcacccacttcgccgcgcaccgcacttccgcccccggaggatgtggctgtccttgtgcggcgacgaggcggatggaagagggtcagggtaagttggtttttcccccttgtttctcttcgtatttgtttttccctccttcccgtgttactgggtaaccccctatctcacacaatatttatctgatcatgcagcctcatcggagaggactccaaatccccccacagtcgctcagtcgtcgttggacaattccaagaaagattcagagaaagctttacggagtaagcacatgattgattttattgtacaagaaaagaagagcaagcaaataatgaagtcttatttggggaagtttattcacttatgaagtcttatttggggaagtttattcacttatgggggtgccattgtacaaagaatgagatatggggtagaagaattagggtagcttctctgaggtagaagaattacggtagtttctctgattttttttaactgtaaaacaatgtagtctgcttcctaaattgctttgctggacccatgtcgcaagttcgcaacttgtgatattatttgagctacgggcattgtgtacagttagattttatttgccaatggtctgagcttacttctactttcagaacgcagtataaagatggcaatgaagattatcaattactctgaagactgtatgagaaagattgtagagttgaatgccactctccctctggatcagcatttcttccctgcctgcatctggccacgggaccttgaggacttgcgtttttccaagattgggttttacgttgactatcgcttgaatgacacttctccaagtaaatgcttctacagtttattattaaaacaagttgcttttcttagcttcttcattattgaaggttccagtatcagtggatttgaaataactctagatttttcatgtactgtctgtcccatgcaccccaagggatctcaaatagtttagcaaacaatcatggagtagtgtcagtgttatatgtttatatcagttctaactcatttgatctaggattataaggatcaacgttttatatatttaagggtgttattataatatctatatgtgattatgtcataaacattggagtctgaagtaaaatgtactcttgcctgacacgagtacaagctgcttctaatatcgatttcaaatcttttacagtcaaccatagcaggactctgcaacttatgtcctttcttagatctgcaatagttcaggggcactgtcgtattatctttgttgttttttgatttcttgttttcccagagtcgtaacgtttcattttgatctattgcttatgccactcacagccacttgggggtgtaagcgctttgcacatgaagacaagtatgttgcatcaactatgctgcggatcaatggactagtgtttactggagatttcccacatggccggtccatgcatgtttatggttttgtggctgtgagggatgataaagagccattgaggaactatatcttcaatgtcagcagggagaaggcttgtcaattgaacctggttagtacatctatactcaaagactttttctacagttgattgtattttgattggtatataatgagcgtccatagctagcgcttatttttttagtgtctataactttggaggatttattgattagtagcatattgcccatgcattgcaacaggattttaattaaagaaaattatcattaacccattattaccatcattttctgcacatattacctcttaattgctgtgtatatttgatactgccatatgacctctttggccctacactatccatttcctttctcgcaaaaagtagagagttggttttggggggggggggggggggg

SEQ ID NO: 12210 - DNA, 7360 bp, Oryza sativa
tgggtggggttgatatgtggggcctctagcccaactgtctttttttcctccgaaaaaaggaaggtggctgaaccaccaccactattcccttttaaaggagtatagaatctcctaaatgcacaacattcccttccctcccattttccttcttaaatggccatatgccttttcctttcccatccatattgtagagcatgctttgtagaaaacacccacctgaaagtaggaggaataagtggtaggtccggcttaagacttctgtagcagaacaagcacttctacatattagtaaatatgtctaaagaatggcgccatgaatgtgctaggaatatatatgtgtgtgctaggaaaacgaagagaaagcacttctctttgttttttggcccaataaatcttatattcagtccaatactccagttgtacgctaaactctttggattgcactgtgttcagtaatatcatgatttggttcaattttgaagtgaaaagaacacacctgactgggttgtacagagggaactatatatatgactgaaaactttaaaaaacacggttgaatatgctatgagagtcctatatttaacatggaaaatgatgttattgcttcagactatttgcagcatttagcttgccgtagctaaatatagcattcctctaagcctcaatcagtcatttttgtcatttgacttagcatagaatgtagttctttgttcactgatatctatataatcatatcacaaaaactgcactaaattatatgtgtaggatgaatctcattgtaccaatctcatgtagtcaatcctttattttgatatattgatggtaaaagctgggaaaaattgagcatgaagtgctagctacttataatattggaagggagtgtctctagttcaaatgtgcaaattatacttgcatagaatcacatgaggtaggtctagcccattatttcttgttaagatcttggtaacatcttgacattggtagcggcttaccatgtttattttggaattcctaataatctgattcaaaccagtgatatgtgtggagtaacataaccatattttgaccttatccttttctctttggtcaaaatgcaggattcgccttcattggagattagtccccccatgcgtggcatctccgtatgggacagtgctttaatcgagtttcacttgaaggttaagggcagtgacagtgatagtagttcagatgatgacatactcattaacgcctgtatggagttcgactatgagaccattgagcatgacaaaaagttgatatcaagaattgatggcccgttcggtccacttgatatgcgttatatcttcttaaagaatgggattgaggccactatcgatattgatctgggcagcacatctgaagcttatgatattttgcttgtagcattttcaggcgaggattccatgacgctttacaaggaccgtgttggacagcataccaagtttacagccgttgtaattgttcctttagacgagttgttacatatcaaagcatttggcacgtatggttcgtctcattttgatggcaatattgctgtgcctgtattaaagcatggaagctgtaagaaaccgttttggtttcagttggcagagaagaagtcggggcataagaatctgcctagagcttgcctggaggtcacgttttctacgatgggttactataacacgggagagatgtagaacaaatgactgcaagaactgctattttgctctagagcatttcgttttcctgggctgtgaaatgtttaagagttgtgatttgatactgaaatccgtaagttgtattttaactgaaatcgataatgatgttttatcgatcgtcagtttctttcgctgtgatatggatgcttgtatgttttccaaagtttgagtcacccgttgaagtagggactgaccacagacgggcagtcaaatcttgtttgtcatgaattcacaactgagctgatctagcacttgctgccatggattttttatagtatgtaggttgatgatatcttcatagtacgtaggcaaattaattgcgtcgattaatcaatacaagcgtttttatgcaatcagaatacctactgtaattttttttaaaaaatacaaaatccatacagtgcttagaaatacatgttctcataacatgcgattaatactaaactatcatagcatcaccaaaagatatctacaccaactagtgaagagcaagaaggatagaaaagaggattctaattttaggaaggtaattaaagaatagaaaagaggattctggtttttataggaaggtaattagggaaactgttcgaggcaactttcaaaagaaaaagcctaaaattttgggattaggatccattcggtgatgctcttatatattttctttaaaaaaaatatcttcagtgagatttaaaggcatgaaaaatatcttaccctcaaacagatggcctaattaactttctaaaacaagaaaagtaggctacgacaaaaactatcaacagaattaatcctttcccctacacgctcaattccttatcccggtgcagcgcttcccgtgtacagggaagcttcgagtggcggatcgtgagcctcctaatttacaaggacatttacaatagtctctatatctctctattatcatgcaagtaaatttgataacatagatgaaagataaatgaggaaagaaaaatatggttgttatgcatggcaacggctcagagtcgactcttagcatttattagagcaaattttgttgcatggtggtgaaagaaaggaaagaatagtaaaaaaaaaatattttaatacattaatgattagagcttatattgtctctaactattgtaggatctctaaataacgtagagctcatacctgacacctttatacatgccctaagactgaaattaactctccaattcttaggtactctctccgtcttattttaagtgcagtcatggattttcgtgcctaacgtttgaccattcatcttatttgaaaaacttataaaattaaaaataagtcacacataaagtactatttatgttttatcatctaataacaataaaaatatgagtcatattttttaaaattaaaacggacggttaaacattagacattaaaaccataactgcatctaaaatgagacggataggtggttaagggatctgttggagtgatgcttttacctctaaaagtctctgattttgggcttgggaggagtttaggggaagtctccaatatgcttagcatgaaactgtgacaaatcccaataatatataaaccaatgtctctttataagttcataaatcatgggtctattgtctaaaataaggccagtaataatttactagaagaagccggtcaaatttggctggctcaaccttcatctttaattttcgttcaaaaaaaaaaaaccgtcatctttaaccggccggcaataaacacttcccgagtaggactgtagagtagtgctaattaaccatcaccatctcatcaaggaaatctttcaatgcaaccaatagcaaatttctatgtgagccactcatttaataaattaaaggtgcaattatgcgaattgagtatatgatctagtcaggagaaaaatcattagaaaggtaatacgcagttttgaatatcattatttgatattttgttgaagtcgggaagatcaatgatcctcgacacactacttgttcctctgttgctttgagtcatttcctgttactgttaaatggataataggttctattaccaaacagtattgttggaatttgcaaggcagtcatcaaaggaactggttaagctgcaacaaaacaaaggatttattcgccaatggaactgattaatatgcataaaagaaattgttaaccgtcattactgaattgcatatatacactttcaaatgctattttctttttctttttgatattggactttcagtagatattattattactctagagaaaacagttcggaattagacaaaagaaagggaacaatttttttgtcgggtcggccgaagaggtggctgaccaatttcattaagaattggaagaaaattaaagtgcacaagtgtgttacatcgataggaggatgtcgatcaggtccaatgcaagacgcctcagtcccgtgaacagaaaaagcctaaagactggacagaaactgtatactcaattaattacccgggcgaaaaattcatgcctctgtccagatgataatttcctctttgatgtcattcaccaagtgctctatcgtcctgagacattggtcgaaaattctcccgtttctttccttccaaatcagccagcataccagtatgaagaggcagtcaaaggacgctctgtagctcatccggcaacgtgctctgttctgcagccaccagtccgccagagcatatccttcatctcctggaactgcgaagaaaggtaacaattcggaattctttacttttgagtcttaaggtcataatattaccactatggcatagcttcttccttaaacacgaaaccacaatgggtaagtgagtgccatctggtaagtctaatatacctgcatttggttgtcattcttgatgtaaacatagaaaatcaacaattgacatacgtgaaaaaactacaaactattaatagaaactagattgtaagagaatatatgggatttaagttttggaaggaaattagcccactggcattataaagatcaaatgatagaaaataacatctcaactagatgaaagtatgagaccaggtagtagtaacatcctagagagagaaatctatctacacctaactagttacctcaggaaaattcccacataaaacttcagaattagtaaatattaaatataaatttcatttgtatataaataggtttcgaaaaagaaggttactaaacatctgtttacatataatttcaatttaataactagtatagttaggcagatatacttaatatcaatagcccatgcaaatgcgtggtttaacaactagtgcacctttgttaggttctgttatttaccagttcagtttagttgcagtggcatgttgctaaaatgcaatcttactgatacaacttacgtagttacctcagagttgtgggcagaccaataattgagacttcctgagttcaaaactccaatgtttgaggtacaacttctcccttcggcctaaatcaagagaaactcacagattcagtgttactttctggttgtttatgaagagaaaataagtaatgcacttgactaaccccgtgccaacgccacacattcctttcatacagaaatcttgtgctggacaagtcttccaaaagtgctttagcaaatctgaacaacagaataccagcatgctgtgatgcctacatgggaacagacaaccgtgaaaacaaatatggaatgtgtaacccttcgctaaaaaaagaaactaaatgctgtgataggtgcaccccaaagatcataggtaccaccatttatccatctgtcacgcgaccatcaataatatagtaccatgatcatttgtatacacatcaggggcatttcaaaaaaaaatacaaacaccattttaaatttcaaattgttgagcagcaatgcaacaaagttacactagaacatgatgttgatatctggtcagcacataaagtgataagggaaacatgaagtatgggtcaatttatcaaataaatgtacctaaaactcacaaattcatggttgcatacatgctgcacagatttttttggaacacatcaatggccaattgctggttcatgtgaaaccaatttcccaaaaattccatatatagaattgaggacagtatgaaggaatgcagtgttaatgtatacaccatatatatatttctgttttggttcagttggcccacttagcccatttggcccatgtatatgtatataaccttcactaccatctagggtttactgctgaatatatttttcgtgatttcccccaaatgttgaacatggtatcagagcttgcctgggattcgccggagctgcgtcctggacgtcgcatcagcgatctgctctgctgctaataatctcttctcctccgccggcaagtttcccctgtcctcaatcttctttgctgctgcctaccgaatctgctaggaagcaataggtttcccttgtctctacacccacggctgctgctggttactgctgctacatggttggactgcctcttactacggggaagttaaagcgggtccatttgcagccggtaatggacaaaatcagagcaaggatggggggctaaaaaaacaagctagtttatcaaagcgggcggaaggttcttgtgcaattagttctcagtgccattccaacctacttgctgaccattcttaaaccaccaaaaggattcctaaatgatgttgacaaagcgcgacgaaaatttctttgggccagagaccaagaaagcttgggcggaaaatgtaaagtgaattggcagcaagtatgttctccgactatacatggtggattgggcataccttgtttggagaagttctcacaatcgctgaggctacgttggctctggtatgagtggacaagcccggaaaaaccatggataggaaccccgccgccctgtgatgacaccgatcgtgctttgtttgctgctgccaccaaagtatcggtcggagatggacgaaaggcaaaattttgggaatccaactagataggagatcagccgctgaaatacctagccccaaacctcttcaagcactccaaaaggaaaaacaggtcggttcttgaggcaataaccaatgatgcttggatcgaagacatccgcggaggggtgacaatacagctgcttcaggaatatatatgcgtatgggaagtgctccacaacgcaggagaggtgatccatgaaggggctgaggacacaatcctctggaggtggtcggccagtggcttgtatacggcaaaatcagcatatgtcatgcagttcatgggcaaaacgttttcggattctactgagcttgtatgggaaacttgggcaccggggaaacacaaattcttcgcgtggttgctggcgcaaaatagaatatggacggcagatcatttgcaatgcaggggctggccaaataactatttctgccaactctgtttcagaaatctcgaaacggtacaacacctcttcatggagtgccccttcacgcagcaggtatggcgggacattggtcgcaaattcagaccgcaacgtttcctacatgtgaccacagacaacactctcctcaattggtggcgcgagcaaacagatgaggcagaaaagttgcaacagaaagggcttcgttccccatttttgaccaccctttggaagatttggatggaaaggaacgatcgcatcttcagaggga

SEQ ID NO: 12211 - DNA, 1390 bp, Oryza sativa
tacagaggctgctagtactgaagtattattggggatttgtcacttctgtccattatgatttcttcagtagggattcttcctttacccccagtgagctctatttctccacctacttggctgaaacaatgccattcctgtttgaactggggtcatattcaaagaaattgcaatcagtatcgttgtcatctccagtcaaataaaccacatattcatgataaggatgctaagtctgaatttgccacattcttgaaccagcttgcacacacccctttgaaaacagatccatcctcatgtattgctgatgttagtatggatattacgggctgttcactttcagcaaatgttacagactcttgttggatattggactcaggggcatcctttcacatgacaccggacatttcacagctccagtcatgctctttgacaaaagcatcaagtgttcagacagctgatggcaccattctaccggtttctcttcaaggcactctccaaactaaagaatacacaattccagatgtcttttatgtgcccaatctatctatgaaacttatatctgttggtcagcttaccgatatgaagtgccatgtggtttttgatgaggctgcttgttatgtactggatcgtgctacaggcaatcttgttggagctggtcatcgactcaatggtcctaggggactttatgtgcttgatcatttgcatcttcccacttctacttcctctggttttcctggaaactctgcttctgccacctctataacttccaattcctctgtttattcctctttgtcagcctcttttcctcagtggcatcatagacttggtcatttatgtggttctcgcttgtctactcttgttcaacagggtgtcctaggaaatgtctctattgagactgatttcgtgtgcaagggttgcaagctcggtaaacaagtacaacttccttatcgttctagcatgtctcggtctacctctccttttgcattagttcattcagatgtatggggtcctgccccatttcattctaaaggaggtcaccgatattatgtcatttttgtcgatgatttctctcgatacacttggatctatttcatgaaacatcgcagtgagctctatcaagtttacaaatcctttgcttccatggttcatacacagttttctacatctataaaaaattttcgttccgactccgggggagagtacttgtctaatgccttccgccagcttttaagtgaccatggaactcttccacaactttcatgtcccggtgctcatgcacaaaatggcgtcgctgaacgaaaacaccgccatatcatagagactgctcgtactcttctaattgcgtctcatgttccaccacatttttgggctgaggctgtatccacctctgttt

SEQ ID NO: 12212 - DNA, 1345 bp, Oryza sativa
tattgttcctcctgttactccctcttccccagtgactagtactcctcatgatacatcatctatgcctgcccatttctgtctcaccgtatcctttgcatgacactcgtcgtcctcaaatcactgtaggtgatcagtcgccctctcgtttgactaaatccagcgagctatcaattgatgattctaatgagctacctgttgatgatatgcctataccatcatcaccatcttctcctgcagcacgatatggtcttcgagatcgcagtaaaattatgccacatcctcgttacagttgtgcaatagctgatggtgttcaggagcctcgcacatatcaagaggctgttacaattaatgaatggaaattggctatgaatgaggaactttctgccttagagcacacgggtacatgggatgttgttcctcttccccatcatgctgttccaattacttgcaagtgggtgtttaaggtgaaaactcgctctaatggatctattgaacggtataaggcccgcttggttgctcgtggttttcagcaggaatatggtcgagattatgatgagacttttgccccagttgctcacataactactgtccgtacccttatagctgtagctgcaactcgtcaatgggagatctcacagatggacgtgaagaatgcatttcttcatggtgatttgcaagaggaagtctacatgcagcctccaccaggtttgacatgtccatctggtcatgtgttgcgcctacgccgtgctttatatggtcttaagcaatctccacgagcttggtttgagcgctttagctcagttgttctaaaagctggatttgttgctagtgagcatgattctgccctatttatccacacttcttctcgaggtcgtacaattctcttgctctatgttgatgatatgatcataacgggtgatgacgcttctcatgttgccttcgtgaagcaacgtctaagtgagcaattcatgatgactgatcttggaccactaaagtattttctgggcattgaggttgcttcaacaccgaatggttttcatttgtctcagcatcgatatactctcgacttactatctcgctctggtctaagtgatgataaaactgctgccactcctatggagcttcatctcaagattcgtcctactgatgggaatccactttcagatccttctcgataccgacatattgttggaagtcttgtatatcttgctgttactcgaccggatatctcacatgctgttcatgttctcagtcaatttactagtgcccctacatctgtccattatgctcacctattacgagtgctccgctatctacgtgggacaccatctcgtgggatattttt

SEQ ID NO: 12213 - DNA, 8952 bp, Oryza sativa
ctcctccaatctttcctttcctttagtgataattgatatgatgatatgtttccaatcttaattttctttccaaattaaggctgatgctccatcttcgctacttatatgattcatcgtaaaatacgccttcgaacttggtttacgcatttctagccgatctctgaagaacatatgctctcatttttaactttcaagtttcaattctatacttgaatcatgtgtatatcccgtgcatgttttatataaaagtaagcagtgcaaaaatctttttccagaaccagaatgaacatggtgacgcgcaccacggttcaggctggagcatatgtataacatgccttttctttacctttagaggctgtatttttctcctactatatttaatgaaaaaacacaatctcgtgctggctctattaaaaaaataattcctgtaagaaaaaggccatgtttctttgtcgcttttaatgcgtgtcaccatgttcattctccttttttcgaacatgcaaaaactttgcaagttgatatatactagtagaacaaaagacttctacaacctctacctgctgacatggtcatgggggagcgagagaaaaaatacactgtgcttcaatgttcattctggttaagaaagaatgtttttcatatgctcattcatttacagtatggcgagtgtccccgagccgtccgccgctcgctcgtgctcggagcagagcaactcatagtaaaggacagcaacagagtaggtcaatataatatgatgagaataggtgagggagagaggtagaggagataagattgatgaattgagaaaatttgaagtatgtaaagggaaaagagagaggaggtgagaatttgtgaagagggggtattttcgcatgaacaacacttaaggtctcagcatgtgaaaatgccccccttagaggcccagatgtgagccgtacgtgaaaatggaggtcaatttttataagctcgatcagttacggtttgcttgtaacctataagggttctcgtacagaaaaatcatttatatagaactggtagcaaatcagtaacatataggagtgccaaaatatacaaattaattaacatgtttgacatcaattgcaaaaggaaatataatagagcacaaataacaaagagagattccacatgagatggaaattaaaccgaacaagacatggccgggaaagcaatgtcgtccaaaccacagggcacacgtagacgtaagcatccgagtacaccgcattaattacttggtgttcgcgccaatgcgcgcaatgcaagcgagctccgctatgccggcgccgccggctggtcgatttcgccgtcgtggtccgggcgggcgatgccggtgtgcgtggcgagcacccagagcagcgtcacgagttcgctgccctgcgccagcgccgcctcgtgccccctggcgtgctcctccgcgcgcgacggcgacacgtacacgacgagctcaacccacacgtcggccagcatctcccacaccgcgccgtcgccggcttcgtcgtcctccaccagctgcttccccagcacggcgcccctctcgagcaccgtcatgtcggcggcggcggaggcgtccacccggagcgcacggatcgtctcgtgccggctccgctccgacgagaggtagtatccccgtgcgccgccgagcgccgccttgatgcccttcttcaggtccttgtagatgcgctccgtgccttcccggtcgtccggcagcagctccggccggaaggcgacgaggtaggcgcagtatctggacagcctcgccgccgtcctccggctccggctggcacttgtcggaagctgctgctgctgcttcgtctccaggaggctggtggcgatgtgccaggtgaggatcacctccgcgacggctccgctctggcacgcccacgagagccgcgagaaccgccggtgcctaccgcccatcgacgtcagcacggcgccgccgttgctgagaggatcgccgccgcggaagcgttctaggatggcgagcttcgcatgcctgggcagcgtggcggtgggcaacctcggcgacaggcagcatgtgctcaggacggtgaactgcttgatggtgatgaggctagggtagtggctgaggtttcggcggagccagaggatgcagcggacggagccacggaaggtggggctctcgcggcggcggggcttggcggagaaggtgcagagcagagagacgatgaaccagttggagaggaggaagacgacgaactcccacacctcctcgtagacgacgacgatgaagaggaggtagcagatggagacgtcgacgatggagaagaacaccagcggagacctgacgacgtttttccagaggcatttcgtcagcgagagtatgccggatgagacggcatagttgtcgttggttaggctcttgaaggcgtacaagacgttgccattgccgcagaggacgatggtcatgacgcagaggccgaacacgacgacggggaagcagaggtagttgacgacgaagaagtaggggctcgcgagcaccacggggaggacggagtggtagtactcggccaggaagttcacctcgtcgttgagcacctggaacagcgccacctccgccgggacgtcgccggtggcctgagcatccttgcacatgccgtccaagatgaggtcccggcactcgtcggtctccttcatggtcgccggcggcaggttctcgaaccggcggcgcagaagcttgaagagagcgaaggagaggcagagcctcttgagccttgggtgttgtttggtctgccagattttcccgacggtgacgacggcggcggcgaggccgaggtcgagctcgtagccgtgtggtccggccttgagcaccatgttctcttcccccatcacggcgaagttgcaccgctccatcctgctgccgtcggcggcgacatgctcatccacctcgagcagctttggcagctgcgccatgtaggaggagatgaggcgggcgttcttgccatgggcgaaggagcgcttcccgatctcggtgatggcgacgcgctgcaccagcttggccgcgcagagcacccagaggacgccgaacagcgccttcttgccggcggcctggaggttgaagaagacgaggttgcccagccaggcgacgctggtggcgtgactgatgaggctggagtagacgtgcatgccggtggtgatgaggatggcctccaccttcttgcggaggagctcgacgaggagcatccatgtgaggatgacacgcgccagcagcgagaggtcatcggagtgggcgtctctggtggtggtagtggagtcgccgactccgagcggcgcttgcttggcctcggagaagaggtaggacatgacggggaggaagaggttgagcgcgctggagaggaagatgcggacggtggggttgagcacggcgctgacgtcggagacgccgctgaagaggttgaggttgaagaagacggcggcgaggatgaacatgacgacggaggtggacaccacggaggactcgttgctcttgtcggcgtaggaagccgtcatgttgtggacgaatgaaatcatggtttccgaacacgactgcagcaaatctgaggtcacggacgtcatcgctcgatcgatcttgccacctgcctacctatgagtaaattggtcgctagctagctatatatttgcgccaatggacccatgatctcaagcttacgagaggaagacgagaatatactttgtaatgagggacaataataaacacgttctatattaaaaaaaagtataaacgcggataattgtgtcccatatgcatgtcacgctacaaatatatgtaagaggctacttcctccgtttcacaatgtaagtcattctattattttctacatttatattgatgttaatgaatgtaagaaatgttagaatgacttacattgtgaaactgagggagtaatatatatatttcttacttttatttgtccgatctgtatatatcgatcaattttgactttacatgtgtatgaaacagcggaacaaaacaatcaatcttgcatatttcctgaaaatttacgattattagcaccaacataacaagcgagctgagggcatataccttacggtcttattactaaaatccaattcataaagtccaatgtatacttctctattaattgggcatttcccaatgaactcccttgttaaccagaaagagttggccgtcaatcagatagatcatacggttgtaaccatatactccttccgtttctaaatatttgacgccgttgacttttttaaatatgtttgactgttcgtcttattcaaaaaatttaagtaattattaattctttttctatcatttgatttattgttaaatatacttttatgtatacatatagttttacatatttcacagaagtttttgaataagacgaacgttcaaacatatttaaaaaaagtcaacggcgtcaaatatttagaagtcaacacaaacatttgtaagccacattaaaaactcatgtaagtccatctacttacgagttttgggcttatgacaccttcaaattaattcatatatattaattatgaatttataaatcaataatcataaaaagtatgtaacttaaactctacaactcagtcattattaattctgatttttatagaactaggaagatagcccataaaaatgtgtgggcatgcattggaaaactttcttcttcatggacatttttgagataactctttctaagctatttgttatctttatagtatataatatgtacttcatccctataagcaattttttataatctacgtcatcatctaaaatgaaagtagatttaatttgtttagaaattatgtcccatggattaagtttaaatcaaaagtaatgtgtttttccctttttacttgaatgtgtagatgttctcttttcttaaaaatatctcaaaaaactattatttctactatatatgttttatttatacgatcaagctagccctgctttaattggttcatattgacgcaatttgttacatagagacgaaggagatatacatgtcctatactccgcttccctgtaaaatgtggtatctatagtactttttaaaggtgaagtcgagtcaacataagtattaaaatttaaattgaatcggtaaaattgaactttaaatcatcaatttgttggtctagagtaagctaattatttctaacctcaatccctcaaagtagtcaagctgatgcgggttgcggtacagtgggaggcaggagatagaggagactaggaggaggacgtcatcaaggtctagtgagcggggcagtgtggtcgtcatcacggccaaaatatttggttgggtaaaatgaggaatcaattgttctaataggccaacagataagggggaggaggcggcccaaaaaggatgatttctctgcttgatgagttgtttgatgccttttctttaattttttaaatacacatataaaatacatagtatatatatctattttttgataaaattattgggtattcatttgaatacccttgaattgttgtaggcccacccctgtgattaagaaagttgggaagaagaaatatgaaagagcccgagagtccgagacggcatgggccggagtgcacacatacgtattggagggggaggtggaagggacatttttccctttagcttacaaatagttctaaatctaaaggttaaaaataataggaccacttgtttaagtgaaaacttgcggtcagatattttatctttttctaacattttaaacttttttaatttattggagcgtcatgtgacatcttagtagcgttctgacttccgaaggacgtttaatcgatcttttggtatctatatatagttagaacccacaatatacatatacctacaagtaagtactgtttcaaaacatcttaaaacttatcgaagcatacatgacgcatcatctgtaatttattactccctccgttttatattataagttgttttaacttttttttatcaaatttctttaggtttgactaaatttacagaaaaaattagcaacattgataaaaccaaattagctttattgactgtaacattgaatatattttcataatatgtttgttttgtgttataaacattgttatatctctttataaatttggtcaaacttaaaaagatttgactagaaaaaagtcaaaacaacttataatatgaaacggatggagtatattatagaactctaatatgttatacagctcgacataaaaatatgtgtcaaataatcatatacatacatacaccattacacaatatttcaatatacatacatacatacatacatacatacatacatacatacatacatacatacatacatacataatttgtatgatatttaatacatatttattcatgcattctgcagtaaaagtgtgggacatcaactagtataatgcataatatattagatatataccagctgactgacaaagatcgtatcatatattttgttctttttgctttgtagaagtgtgtttgcaaagcactaaaaccacaaaattgatgccatgcatgtgtgccctgcatcaattctcttaagaatcgtgcgcatgcttgtgttatacatattgattattcttccataattgacgagcggtgtgctagctttatttcctgatgtcctatactcctgttgctttcaatcattttctttggtgaaagaaagcaaatgacgcgaagaataaatccgtttggattgatcgaaacttgtctgtgcatattatctctgagctgtgttgcctgctagcagcgctagcgcacgcaaatatactatgttacttggtaattacacgaagacatcattgacttttgttacaacctttgatcattcgttttattaaaaaatttttgtaaatcttaaaaatataaataatacttaaatttcatttagtgatacatcaaacaaaaaaaagacatttacttaaatttttgaataagttgaatggccaaacatgacgtaaaaagtcaacgttatatattaaaggacggagggagtattaaagattacttgaaaaatatgtttgtgcgtcatattaggggacatgagtgataaaagagagtgtgtgatcagtaaaagccgagcaagtcagtagcgtgaaaagtgaaattaatggtcagtaaaagcttagagaggcaatacccagactcgacgtgtgaatcgaacgacatacaaagagaaagctaatgataacaaaacaaaagacacgcagatgaccaagatgcgtgtatatgtgccgattgaaaaaaaaaatgatttctttaagtagataactcctcttgttttaatgtacgatacttttactttttatatatggttgattatttatcttatttaaaaattatgtaattatcatttttgttataaatttacttataatgatgccatatattgaaaaccgggaatagtatattaaaaactacggagagtatatgtgtgtgtatatatatggatatggaagagatggatatttatcccagctatcgataaatattaccatatatgaaatatttatattgctatatttttgtatcatgttcatctcactctgcatatattgccatagtccatttttttttctaatttattagttttttcttttcctataataattttttaattttcccctttgatgtcctggccatccaacccttccatgccagaggccacaacactataaaaacattttctttcatgacagttgtgttttatttttattggtgaactaaaaaaccccgcttataaaaaaaatataagggctcaaaaacctattttttcaagcggcgttcttaaaaccttgcatgtaatgttgaaattcctaccaaaccaaaaggccctaaaagttattaattatatgtatttatttttatgaaacttttataatttatttttttcacaatttatgattttcatctaaggaaataataaacatagaaatcaattattttttgtcatcaataaattaaaaaaggaaaaaaaggtgagcggtcgctctgaccaagtgaccaacatgagctatcggtgaggcgcagagatctctcgttttatcgctctctttcttcttttgtctcctagctcagctctcccctcgttctcgatctagttttcctctccacctcaacctcgacttctcgtccctctctcgattcgacgggaggggtggcggcggcaaggggagtcgtgggcagagttccttccacagttggcggcagtgtagctcgggtagcgggcggcggatccagcggcggcttgggtcgcggacgatggatccggcgtcggctcggggcgttggggatggatacgatagcggcggtgacctaggacgcaaatccgacaggcgcgggcgacaagtccgatggcacgggcgctcttcggtaaggcttcgacggcatatcctcatccacgacaccagcgaggatagctcatacatgaagccactccgtctgcctggcttcgtcgacaccctgaagcccaagagcctctccgttgagggccgccgcatctaggaggccttggccccatcagagccctcttgctgccttctcgctagaggcctactgagccccctccgcctcctcatgaaccggccaccacctacgacctgccacatcggtggggagatgcgtcgagcttcgaccgttcaccgaagccatgcactgctgcttggagctcttgaccgcaagtcaaagttgccctccatgaaattaggtcagatctcaccaattgctttgtcttattcaattacttgttgtagcagtctcgtggaatccttgttgtatttatggggttaatttcattcggttttgactctgaatcaaatatgcatccaacatcctttcgtgttgattttatttttctttttttgtatcaagtgggcatggacgagatacccaaacaacgacaacggaccacaaaaaaaaggttttt

SEQ ID NO: 12214 - DNA, 6210 bp, Oryza sativa
acacacacacaagtttattatcatctagctatgtagatataccagcaaattatgaaaatctctttttgattaggcctcatttgggagtcccatactcccgtacgtgtacatgtcgactagggtttaattaagtactccgcacagtcaccgcgcggcttaactaacatttggatgaatccctttcaaagaagccctttttagtgtattcttgttaccggcctcatgcagctcaccacgaatctagacgcataggtagtacggagtgataaatactagtaatacgtgctccctccatcccttaatatttaacgccgttgacatttttacatcatatttgaccattcgtcttattcaaaaaatttaagtaaatgttttttttttgtggtttgatttatcactaaatgaaatttaagcactatttatatttttaagatttatataatttttggttaacggcgtcaaatattaaaggacggagggagtatatacataccgcaatctttgagtaggaagctatagggtgaagtcattttgtcgcgctacttacttattgtgaagtccatatgtagtaataattaataatacatatatacacgtacgtacatcatatctcacacttctgagaaaaccctcttttgtccggtttataaccctttagtcccggttatagcaaccctgctgggaaaaccctcttttgtcccggtttataatcccctttagtcccgtttaaagcaatcgggaaaaaaaggcgggacttaagatgccccggtttataaccccttttagtccaggttatagcaaccgggacaaagaaagtgggactaaagatggcgatctttagtcccgattacctgtgatctttaatcccggttatataaccaggactaaagatgtataataagaaccaggacaaagtaagcgggactaaagatgacgatctttagttccggttatataaccggaccctgctgggaaaaccctcttttgtatcggtttataaccctctttagtcctggttatagcaaccgggaaaaaaaagcgggactaaaaatgtcccagtttataacccctttagtcccggttatagcaaccgggatagagaaaacgggactaaagatagcaatctttaatcccggttatataactaggacttaagtgaaccgggacaaagaaagcggtactaaagatggcgccatctttagtaccgggactatgtataataagttgcaaaaatatgtcaggtgtgggattcaaactcaaggcctttcacttcagccctcacgcacgcaaccatcccaccaactacactcatctgacatagataggggtgctttctttttaactagcactgaaggcatctttagtcccggttggtgactaaaaatcaatttttaatctcggttcgtaataccaattgggactaaaaatgttttgaaagattttgtgcatctttagtaatggttactattcaaaccaggacaaatgtggttttatccaaccgatcaaagatcatttctccacaaaccaggacaaatgtggttttatccaaccgatcaaagatcatttctccactagtgtcactactctcgtgtatgtttccaaatgtcaccaacaccggtaatgtacgaactaaaactgagcaaaatccccaaaataacatgcgccacaaacaaacaccgtaccctataacctgtgtgagttccaatatacttgaaatatagcattcccactataaacacatttgaaatatagtgtaggagtgcgtgcgcttgaacactgtttacgtgcacacacacacccaggcacactttaatactctctgcattgtgtggcgacattgacttttcatataacgtttaatcattcgttttatttaaaagagtataatttattttgttatgacttgttttatcataaaagaaactacatataattttaacttgtatattattatgctaaatttttagataagataaatggttaaatgttattaaaaaatcaacaacatcatacattttaagatggaggtaatatatattagtgctatgtctgtctatgcaacaagatctaaagaggggtttagttttttctatcttttttttttcgtgggattacctgttttttggtgcgttaggattttgaggtagctagtgtgggctttttatatgggaaaatgcgatggttgggaaggagaacgaagagttggtttttaaaaatattagagatatgtataactaattaaatctcgtatacgctatccctccatcccaaagtatatatttcttttgtcaataatattgagaagtaattaacttatccatcatgtgatgaaaccaagaaacatgtgtgtgtctatatatatatagtcaatgagtattaatatgattttttggattctgattgtaggatcgaatcataagaactaagccaaccagaggggagggtgaatggttggtatacacaaaaacccaaaacttttagtggaaataaaagttacctcaaattcgacggattgcggtctgaccgaagtagtcgtaacggtttgactgcccaaagatcgttggtctgaccgaggtagtaatacaggtcgaaccgccgagatcaaaccctgcctcctgaagccgtcgccggtctgaccgcaggtatgccgccgatcggaccaccgcgataccgccggtctgaccaccggtgtcccgtcagttggaccgctgcacccgagaaaacacgaatcgaagaactctcaaagtagatgacaactttattatttctctctgtgtttacaaagtgcaacaacaacactcctcacgaaattctcgactaaactcgaaaccctaactaaaactatcaactcaatgctctcaaaagtgataccgggaagcctcacgctccctctctatttatacatgaggtaggcatcctaaagccgcgaaccaaactcatactagaagtcctaaatcacttaggaaaccttctcgtataagaaacaaactttacaaactccaatcataccaaatttgaactccttccaaattcgactccacatcccatacgcacacaatacctccatcgtatgccatatggaatctttaccaaccacgtgcattgaactctagcaaaagtatcccgcatgatatctgaccgtcacggacatcgccttatccccaagtcgactcccgatccatcactgcaaatactctcctgaggcatcaaatcacctacacatgaatcaaacaaagaaaccatattccgaaaccaaactatctccaacttgactcattgttagcaaacaacagtattacatacatatagtatccatctagaagccataaacatgaaacaatcacggatatccaaataaacaacccgaaaccgaaaccgacacagcgtcggccggtcagaccgccgcgcgatacacgccggtctgaccggcaaccactgcccggtctgaccggacccaaatcatagcattacctgcatatcacctgtaaatccaatcatctccaaaaccacttcgccaataatctccaaatatcaaaaccgttaatcacagatgctaattgttcatcacagaataataatcaaaacacgctttgattttacactgatcaataatttagtttagtacatagagagactacaaatatatccatctcatttagaaaaatcagaaaataaaatataccttacatttgttttgatggaggattttacatgcataattaattaatagacagagagagcagcagataaataattaaagagacactagtagaattgcaggcagcagagcagcaggtaatagcaatcgctagactgtttccggcccagctgcgacgcaatcggctgtattattatgattgaatgatacggtagggcgtttgaacaagtcgaggccgaggtagcaggagacggcgatgtggtaggacctggtgcaggccttcccgatgaggaatcggacggtggccgtcacctgcgcggtgatcgggatgtcgttgcctctcatcatgttttggacccagtagtcgccgctgacgaacacccgcaccgggatggccgtcgtgttccgcggcggctgcacgaacggcgtccgcaccgacgaggcgtcgtcttcgttgagcagcgtgggctcgccgtcgaacggcgtgtaatgcagcttcacgtcgaacccgcggtactccacggcggcgcgccacccggggttggcggcggcgactgtgaggttcagctccacacctccatccagaggcaggatcatgcgcgaggccttggtgacggagaagtcgatctccccggggctcagcagcgcggagatgccgatcacaatgacggtcgccgcgagggttccaacgacagcgacgaggatgtactgcttcgtgctccaatatgatttgtgtgtgtttggtgatgatgaagccacctgcagcttcttcgtcgtcgtcgtcgccgccgccgccattgctgccatgcctgcttaattatctagctacctacgtgtacctccttactagttagctagctagctagtgatgcgtgtgtgatcgacttgtttaattaattgaagaaagctactctctccatcatatcgaagcatttccaaatggtttaagtagagattaaggtttataaagaatatactttcgtgccgatgaggacggatgcaagggtagcttgagatagaagacagcataagaaattcaaatgagagataattgataggagtacttctatatagtacttcatctgtttcacgatataaatcattctatcattgtctatattcatctagatatataacatctatatgaatgtgtgtaatgatagaatgacttgtagtgtgaaacggaggaagtatatatgaatggagctgaatttttgactggaggcttcctctcgtttgtgcatgttataaaaaacattgttattatttaagaaaattggtgaaaataaattaatatgtaatacgttatttcacgaacatgcaatctcgaaattgtttctagctagttgtataaattgaatttgaacacaaatacttatggaataatatatgacattttaatctatctcgtttgtttttcatattgaaccagatagctcgtgtgcgaattcgaataaagtatttgtttttctctagaaaaagaattcgaataaagtagaaataattaattcttggctatcttgcatgcgccaattcgaataaagtgagtataaataattgatgactagctacgtacgatcgagctgcatgactgcgatatgcatggtcgaattcgaataaagtagcttgtatttctacgctagctaggtgggtgagcgggaattggaataattaacttttagttaagctgttttttttgttaattaagctactacgttactagctttaactaatttgtatacgatcctcgcgtcgtgagctagctagctgtagctaggtagacaccacaccacagcatgcgcaacgagaaaaaggaggcggcggaggaggaggaggaggaggagaagaaattccggtggctggacgtggtgcgatacgcggcggccggggttgtggcgttgctcgccgtgggggtgctggtcggggccatcgtggtggtgctccggccggacgcgctggtcatgaaggtcatccacggctccatgttggtaaacctgccgccgccgagcttgacgttcacgttccagctggaggtcgacaacccaagcgggcgcgacaccatgagcttcaccgacatgtccgtcgccgtcttggccgtctccgtcttcggcggcggcgtgatcagcatggctaacctcttctacttgcccaacatcacggacttgcagccggggaagatgatgcaggtggtgacgacgcagtggacgaccaacccggaggcggaggtcggcgactacttcgtgaggaggctatcccgtggggaaaccatggccgtcaccctgcgagtccagggcatcctcatcaccaggttggacaccctcaacggcgacgggccggtccacaccagcaaggccaacgtcacctacacttgcttcaacgttaaactcggcgtcgacaagtccttgaactccaccgacgacgtttcttgcaatagcaagcaatggcggatctagaaaaaaatagtagtgggggctgaataaactacatcagcataaatcgaaccttcagtccccacatcctatagatctatggaaaaaaaatttagtgggggc

SEQ ID NO: 12215 - DNA, 17469 bp, Oryza sativa
aaataattaatgagctactctctaagaattcaattttgagtttgaatctggctatatatccaggatttgatttttttttttttgacgaagggagtactagctagcactgtgttgtcacactcgtcactacttacagatccggccaacattgatgtcccatctatgaaaaggttacaggtcaccgaggccatcatctcttatgggtgcaaatatagtccatttagaatgtggatatgaaatatgacatgccgtaaatgtgatgtcatccataatgagttatggttgtgacacgttaaagactattttgtaatgtttgttttgatttcgatgatgagtgaagtttcaagttttgttacaaggtataaggtgcggttttattttgttgacaaatgtatgcacttgcacctatataaatatggaattgcatattttagtagggaaggtctatatacaattcgactgaaataaaaacctccatcgttcttatagttgttagtaggctggtgtgagagtgttgttggtggagttgttgtggtagtcatgatttcgcttagttgttctaattaattatgtactataaggtttggtcttgtttcttcttaaaatgggacacatttcttcctttatataaaacgtcagcaaatgtctaaccgttcaaaaaaaatgatagaaacaaaaaccactaaatcattttgaatgttgtgtcgtcggatgcgctttaagatttgtgcatatggtaaaaccttctccttttcttcaccctcccccttctttaggttgagaggagaaaagataaaattttaaaaatatatgttctttttaatttgaaggtagagaggagaaaacctgttttttcaattttattttttccccatgtgattgacattggatcccactgatatgtagacgccaacgcggcataccacatcagttcacatagcgtattagagctcatttggacaagttcgaggatccgaaaatacattttgagagttcagcgagtggattgaaaccgtttagacaagtttagagacccaaaaatacattttgaaagccaccattgcatgccacatcagtacgtggagcggattagagcccatttaatttggatatattttaatttggattgatcaatttgttcgaccacaatatatatatatatatatatatatatatatgatactcatatggggcaccatggtattaaatacataaattcactcaaatttttcaaaatttttaaattgtgagtatatacctagttataagaattcgattcatatctatacctatcaacaaagcaactcaaatttagctttatttcacaatccataattgcatacctaactaattatatgttttatatgtttggatgctatatacctagaatcaaaatctaacaaaaacaagttcaaatttagttcaaacttgctttgaactagttagtaaagtagttaatgttaatacccaaacatttataaaagtttcatacccatttaaattgagtatatactcaattttaatcatggtgcccgggcaccatggagcagcaaacaaatttaatatatatatatatatatatatatatatatatatatataacacattacgcttttgtacttgcttcaaacaaaaagtttaaacttggtatcgatcggtaaaagttggtcaagcgctatatcctgtttgcaagctgctgcctagctgcttcgctgcctctggcttgctggcctgctactgctgcatgcatgcggctgattgatctgctagttagctgccactgctggccaagcacacgcatgggccaacggcccaaagccagtttgctgctgcttactgagcccaaagcaaatcaaaggcagccactagctagcttttttttttacttcctccatccaaaaataagttaatcaagtacggaatgtagcatttatccttagtgctccgcatagattaacttattttaacaaaaggagtaattattttgggcgtcgctgttcgggcacttcactctagaaggaaaaaaaatagcatcatcccctccaaaaccccaactgcagttgaggtgatgataagtattctcgctagatccttcacaccacgtatactcttaacaccattcacaatgcgtctatatggcatacgtcccaaaccagcctcgtagaagattccccacatatgcaagttccatgcacacacaaagtgttggtgctaattatcttgctaagtgcgaaccatgactgggttggcgagccactctggatggagaacttctctgatgaagccagctttgagaagtctgtcaagctcttctcttatagcttgtttccgatcaggtgttaatctccgcagtttttgcttaactggcttggcgtcgggtcgcaccatgagtttgtactcaatcatctccctggggacccccggcatgtcggacggttgccaagcaaacacgtctgcattgtcgcggaggaaggtgatgagctcgatttcctatttgctggtcagtgtcgccccgatcttgacagtcttgtcggggttagtgctggtcagcgggacgattttgatcgccccgtcgggtcttgacgtcttgttgggcttgctcactttcgtaggtggcacagctgtggtgggtaggttgggagtttgctcgaccatgtcaaggctccgcttgtcgcattgtgctgctagctttgcatttctttgaatagtgattttcccttttggtcctagcatcttgagcaattgatacgcgtagtgggatgccgccatgaacttcgtgagcgcagtccttcctaagatggcgttgtacgccgtgtcgaactcggcgacatcgaaggtgacctgctatgtttggaagttatcggcctgtccgaaagtgacaggtagcgtgattttgcccagtggcttggacgatgattctggagtgatcccgtggaaaggttgacctgatagtgtgtcacgcccagaaatttagcccaaatttccatactattttgtgtattaaatccctatccaggaccagccagggtacacaaaacgacaagtaatatacagttccaaacgtaaataaagcgtaaaatacttacagaagaggctcttagtcctcgcaccgaaaagaaacgacagcagcggaaaaaggtgatcctaacggggcttcagctccactccacaggcaaaactcaactggggtctgagccttggtcttctaacttcatcttcagctcagaagcactacacttctgaaaagggggaaataatagcaaggctgagtacaaccaccgtactcagcaagccacaccaatgatgcagacgtgcaaggggatacaaggacggtttgtggctatttgcataaaggcggttgtaaaacattttattgagcaaaacagtaaaactgttgagtaattaaagtaatattaaatctccactgattaacgctacactacgttacacaggcccaaccaacccacctgaactacagtgcattgggtcgatttattaggatgggactaatcacggtgaatcaggtcgaccgcccataaccgtgggcatggctattcgaatagttttactctgatcagaggtgtacaactgtacccacaagacacagccccacgacacgtttccgtgcgccgacatgccaccacgacataccggaaagaggccgtgacaagacctttcgcataaccccatctaaccaagcacaccacacctcaggtttcacctccactcctcgcaaggcagcgagcagtcccctctcgtgcctaggtgaatccggaagctgcataggccgtcgcagggcctatccaaactccatcacgcccacccttgcctggatgcgtcagctagaggaaagctacactacaagctcagccgttgcccacgctggcttgtggtaagtacgataagttcttccagggcatcccgcgaaccggtccttaattgccatgggtgcgactagcaaaaccatgcacccacagcccaccattcagtcgcattttagttggataattacggccatgaagcatggccagatgtctcgagcacgcagcccattctgatactaaaaaggtctaatactgcaattatcccatcaactgagctagtggtaattaagcatggctaagcatatagttctagctaggtcacataagtaacatgagctagtcgatttattacccaaggttgacaaagaacagatatcaagtaaacatggcacaagtgagcagataggtaatatccagatcccatgtaattagcaaaacatgcatatttatttgcaaacggtaaaacatttataaattgggataaacatgctcaaggggaatgtgtgacttgccttgcttcttcaaaacaatcttccgaactcttttcctcgtgaccgcggacttccgaaacgacggattctacacgctggcacgcaaaacgaggaaaaacactaataaaaaccaagaaaacagtacataaaaagtaaacaaacttgtagagcttaattttagatgaattttgcaagttgaacggcccaatttggagttcgaatgaattagatatgaattttagaagttttgagccattttaatggatttatacaattattaccgatttatgacgcaattaataattattttctcaaaggaaaaggcattcgctgacgtcagcaaggggcgccggcgccgacaggcgggccgaacgcgtcagcgggtcaaggaggcaggcacacggtggacacggcccaccgtggccgaggcggcaccgtggaccgagaccacgggtggtccacgggcagcacccaaaagttggcaacggagggagggggctggctcgccggccgacccgaccaggcggcggcggctcccggccggacactcgccgctgatggcggcacgtcgtggcgccggacacgggaggcagaggggaaaaggaaaggaggagggaggcctcaccgtgcgccgggtggcgaggggcgacgagtgcggcggcgagctcctcgggacgacggcgggacggcgctcccgctgcggctccacgggcgggaagcggcggacggagactgggatgacctggggagggcggtggaaggattaggggaaaaggaggaggcgcgaggcggcggaaaaaaaaaggccggaggccggcgacatggggagtagctcatctcaacgggaaggagaggactccggcggtggatggcgagggcgatggggtggccgaggtgcggcaccagacggagaagccgacggaggtaatggcgaccgacgacagcggctagggcggcgatgattgttggccggaggcggcaaaagcagcggcaacctcgggcttgcggtggggaggtggttccatctatggagaagggaaatagagcggaggccaaggtgcggtggggtgcggtgagcgcggtggaggcagtggcgcagctgggcgaagcggcgcttgccggcgggaagcggctggagttggcgacggtggcggagagagatggtgaatgtggcggcggcgtttcggcaatggtttggggaaggggagcggtggacggggtgcggcaacgcgcggtgaagccggcggcgcaaacggcgcggcgcggggacggcggcagcagcgacagaggcgactggagggtcgccggcaagcggcggcgcttgggctcacgtggggagagcgggagagagcgcggggagctcggggaggagggggaaacggaagaggagagcccggggatcccttttataggctcgggaaggcgggatcgagcccagtagaggcgacaaccgacgatggggtgggctccggcgacgtgggtgaagtggggcggtttggcgctggttttggaggggagaagagggggaaggggtggagaacgtgaaggggatcgtgcccacggccggtggactcgcgcgcggggtggagaaggagggcggaaacagcggcgtcatggggaggctcggccggccatggcggcggttggagccggaggaaggggatgacaggtggggccttgggtcccacctgtcggggagatagagagagggaaaaacgggctaaggaggcgaaatagactttcgcgagggagatgggaatcgggccgacggcccaagaggagagggggaaggcggccgggccggaggaaggaaggggaagggagggagttgggccgaggcggcccaaggacaaagaaagggagattttatttgttttctttttattttaattggttaaatgaactttgtgcttttaaaattatttcttgagctccgaaaattgacggaaaaatccggagagtatattagggcacaaagaatattacaaaatattctcggccaatgatttttaagggaaaatttaatttccttataatttcacttgattaaattgatttaacttttatttaatttctagaaaatgcattatttaatgatttttattcccgaacgaaaattggggcgttacatagtgtcaactcgcttcgcgggattcccattgcgtccagagtgccagcaaaaaggagattgcttgaactgccgccatcgatgagaacccttgcgaccttgatgttccgtacagtgggttcaaccacgatcagatatcttcctgggatagttgtagtcttcgggtggtccgcctccaagaactcgatcttgtgctgcgaccacttaatcttggcggtaattccttgtgatgtagagcaaacttcgcgttctatctttttgtactctctttttgaggagtacgacatagaaccgccgaagatgtgcgtgacgtggaggtcaaactctgagaacgcgaagtcggaattcggggtactcgcatcagcaggtgcctcgactactcgtactcgctttctcttctcgaccgccaattgtcttgcaagtgccttcttaaagacgttgcaatcctccatggtatgcgtgttagtcttgtgtatcgggcaccattgtcgccgtgaatcgtcgcgctgtcttcagctccctcgatcacgttcacatctcgcggtgaactcggagaagattcctggtctgccagaagtgtagaaccgagggttcgtgggggtcgacatcaacgaatcccacaaaccgatcgggtgttgtctctgtgtcccgttcctctgcaacacatcgaggttgagctcgtggttgtcggatctgaggtcgctgaggcttgaccgtaccgagaaagactttgcagcttgagagatcatgcttctttgatttatgtatcggacaccaggtgatatcggttggtgaagcatgttgaattccgcactctttgcatgccttgagttcagccgccacatgacgtaccaccgagcaatccgacagagagtgcttggatgtcttatgaatgtgacaccaagtgctcgatttctgcgtagctatccttgtcggcgcctgattctgatttcttgaattttgccgcgggaggaatcatcgttggggggtcgtttctcgaagtcacgactgctccgttctcgttcccgacagagattgggttcgatgagatcggtacgacagtatagatcggaaagacaattgatccgacttgagtccacatcagcgatgtcatggtcggaactcctggagcagtattgatgttgacattgttgtcgaaacgttttgaagtcatgtcggcagaaccttgagcaccaagtccccctacctggcacgccactgtcgacgggtgatacccgtagaccagctgaatagggtatttgggtacgttggtatgagaatctatacgatacgacatcaagcaaacaagaaaacaaggattatactggttcagaccccttatcaagaataaccctacgtccagtttatatgatattgatatggaaaaccacagattacaaatagaacaaccaaacttgatgaaaccagcgagatcgtagtcgatggtttcgactagatgccccggcgagaaggcttgacgtgctccggcttcgtaaactatggtgtatttgttggtgggaagattcgatgcctgtaacccctcggggggtactccttttataccgtatatcaccttgatctccaagtaagactcggagatatcagaccccgtacgatatagaaagagccaaaccctctccgagtaggactctgttgtcttcagactcgttgaggtattttccataatatctatagatttccttaacaaatacgggaacaatacccgtccatcatggtataccgtatccgtatattctatgagtcgtaggataggaggtatgccttatccgtaaccctgacagagatcacttggaataggactcggctgtgttcggtaggtcgaacgggatcgagtcggaagagctccccgactggttcgaatccaagtcggagagagaaagcttgccgaagtcatcggtgacgagctcaaggctaccaaagacgtatgtctgcccgggtgggaagacgaagtcatcgacgcttgatggagatcccattccactagtcggtgaagaaatcgacactgccctacctggcgcgccaactgtcgaaactagttttcggcaatatgaattgggggttgcgtatgagctcgaaaagtgcgattgggacagacacaaagctttagacaggttcaggccctctctcttgagaggtaataccctacgtcctgtttcggggattgtgtccgccgggtgtattgattgtggaaaaagtcttatgccccttgggggcgtcctgccctccttatatagtcggaggagctaggattacaatgaaaatacctcacctcatacggttcggtattgtattgcctatgttacaatagtataggactcggactcctaagttattaccttaatacataaggaatcacgtaacttgggcctttatccgtataatatctatacatgaactacccctacttgtaatcagacaatccatgccatgtaggtatgtggtatccataatctcctgtttccattttcagagggcctctgaaaatcaaatattttaggtgttttcttaagaaaaccactctttagaatcacccaaatttataggcggtgtttgacagcagtcttagccatcttcataggcggttaaaaatttaaaccgcctataaaatgaaaggactgcacaaattattttttaatgttttgcacggtattttcttcgtgtgattgtgcactaatttcatgctgccttagttggttattttggtttcgtcgagatgaacaaatatatctgaaactctgaattggtctgtccggacctagaaaagtgagatggtacaatcattgtttaacgatgcaaaacttatttcaaaaaataaaaagatccgatggtgccgatcgatccaaagctgattatctaaaagaaaaacagatccaaagtagatgtaagctttggaggtgtattaaagtagactaactaaagttttgtgagatgctttggaaaagatagtaaaggaagcagtggtcctaagcgaaaagttgataaaggtctatttatatattcctttaaatcttttcttttgagcttgccaggtgttcttttttttctgctacatcacatttgcatttaccaatgttaacacatcatacatcaatagtgagtaatgaagtgatgaaggggcctcacgaagattcatgcttttgtatttaattactatctgcttatttttccatatatgattgtacttctgtgttagtttgggatttgttaaatgtgtctatcagatacaataagttactctctctcaatcctaaaatatatatacctttagactttttaaattaaaagaatatggtgaaattaaatgattgtcatgattaaaagttttaggtggtgtctaatttagtaactaggtttatatattttgaaatagatagtccaatgacattcatcaaaaagctattccatacagacacacgacttcgttaaatatgacgcattgtgtcacatgtacttcatgtgggaagaaaatttggtaagacggaggtcctacgctaataggaaagacttcatttccaagcgtgacacgtgtgagcaccaatcctaaagcaatttcatcctcttcttcaacctcacgcctcacgacatgtgtgggcaccaatcttgcagtccttgtctgcccccatgttcctagcgagcttgcacagaggagcacgcacatgggagcttgcccttccttggtctgcgagcggctcacagcaggccattgggggagcagtggcgaacctccagcagtccagatgaagtaatttgtagcaagcttgagtagttgagtaaattgatgggcaattgagtctgaccgtagggtgaggagattgctgacctctcgcaggccaccgcttcgcctccaccagtgtggcgttgctgctacgctgaacaagaaggtgtgtgagctcgttgagacgctgaatgggagtgaggaatcgcctcccgctgatctcctgttctctatgagcgagagcttgccgccggactgaactggatgaaggaatcactgctgtgccatttcatatgtgccaacagaggagaactgagagattgctttgagattgtcacgttttgaaacaaagtctttatgataagcataagactttagtcctaccaaattttcttccattcatgtgggcttggtgggccaccgttgaaaacagacaagaatcaaaatcatgattggcgctaattaccgattctgcgtgattttaataaccctccatgcaacttttttttcctcaaatggttgttaccattttttgctaaataaattgaaatctatatgaaaatttgaaacttattcgaatcaaatttgatattttcaagcggacttaaattctgtaactttcaacttaatttttgaaactttcaagtcaaatatcaaaaccttcatctcaaatttcaaaaactgttaacatgaaattcgaaaatctcaactcaaatttaaaactttatactcaaaatttaaaactttcaactcaaaatttagaaaaacagtccccatattttgaaactttgaactctaatttaaaactttgaatgcaaaacttaaaactttaaatcttaaatttgaaactttcatcttatattttaaaactttcaagcattaagcgcgtgaatagcgctaaacatattaacctgcacctaacagatatgcatgcattaggaattaacccgtcatttatactactacatggtactccttccatattttaatacatgacgccgttgattttttaatcaacgtttgaccattcgtcttattcaatttttttttaaatataaaaatatttatatcatgcttaaagaacatttgatgataaattaagtcacaataaataaataataataatattttttaataaaatgaatagtcaaacgttagtaaaaaaattaacggtgtcaacattaaaatacggaggcagtactacgtttggatgtagcgagtatcaatgtaaggcaccgtccctgtgtcggtgcgtatagccctataaaatatagccacatccctagggcaaggctcaaatcgtagggtaacccacagcttagctagcaagcagcagcaagccaacatagtagctagcacgtacaaatgatcgccatgactcctcttggactactgctagtgcttctcgtcctctgtagctccattcttgttgcccatggaggagacgctgcagccggcgcctatatggtcatagcaaccagcaccatgaaaccgaaaactttctgctccggccacaagggtattattgaatttctaactttatatatatatatatatatatatatatatatatatatatatatatatgggggaccagaaaataaaatatacacttttgtataaatatcatatgctcctaaaatattggtcaaagtaattctcatctctaatttttctctactattataaatattgaaaatgttttcgcagaattttggtacgtcatcagtgtttgataaggtatttgagatccaacgagaaatttagacagatgtttttattatgtgaattgtattttctcaaaggtaaattacaaattcatgtaaaattaatctcattatagctcctaaatagttgttgtatcattgaaaaacgtctttacccgttacaacgtacgggtattttttttaagtaaatatataaagccaacatattttttaatggaattaataaacgtagctttgctgtcaacgtcatttgatgtgtatgaacatgtatatactatacccaacgtactgagaggtcggagttatgtgacatacgggtatgtttggatggcatctacacattgccacacttcgatctttttccaaatcttgtcacaagaatgactgacaatttacaatttaacatatagccacacttgtggtaggtttggaaaaatgaagtgtttgatacgtacgccagataaaagtatgaaatggcaggtcatagttgtgacactgaatcaaacatactacattgatacttatctagaaaactatatatgacgtacctaacatttgacataataaataaataattaaaaattgtggcatccaaacaattgcgcatatatatatatatatatatatatatatatatatatatatatatgcgcaaaatctccgcataaattatggtctttttttatcacttggatctccatacggttttattaattacaagggaacctctcatcaccggccgcatgcttgtaccacagttgctccaggggacgtgccgtcgccgaacagcacttgggcaccgttgcatcacctgtatgggccatgctcgccggcgccgtcgtcggccaacagcaccgccgccgacgtcgccgcttccatggccgacatggtcgacgacgaccaacgccgcgcggactacatccaaaagaggctcaccggcgccaccgacgacaagcagccgatggccttttcgagcagaacctcgcaatacgagaagaacggccagtacgccactaatggtggcttaggcagtgtgcctcacctcaaagtaagcaacgtctctccttaattagcttgcttgatctgtcaatatagtaggagtactaaattaagtgtgtatattatactaattgatttgttaataaataatgaagagtttatcaacgacggcgacgacgaattcggcgccggatggcacgtcggcggtgacccagacggtgataatcgactccggcagcgacgtttcatgggtgcaatgcaagccatgccccttgccgatgtgccaccggcaacgggaccccctgttcgacccggccatgtcgaccacgtacgccgccgtcccctgcacctccgccgcctgcgcgcagctcggcccctaccgccgcggctgctccgccaacgcgcagtgccagttcggcatcaactacggcgacgggtcgacggcgaccgggacgtacagcttcgacgacctcacgctgggcccctacgacgtcatcaggggcttccgcttcggctgtgcgcatgccgatagggggagtgcgttcgactacgacgtcgccgggtcactggcgctcggcggcggctcgcagtcgctggtgcagcagacggcgacgcggtacggcagggtcttctcctactgcctcccgccgacggcgagctccctcggcttcctcgttctcggcgtgccgccggaacgcgcccagctcatcccgagcttcgtctccacgccactgctgagcagcagcatggcgcccacgttctacagggtgctcctccgcgccatcatcgtggcggggcgcccactcgccgtgccaccggccgtgttttccgccagctcggtcatcgactcctccacgatcatctcgcgcctgccgccgacggcgtaccaggcgctgcgcgcggcgttcaggagcgccatgaccatgtaccgggcggcgccgccggtgtccatcctcgacacctgctacgacttcaccggcgtccgcagcatcaccctgcccagcatcgccctcgtcttcgacggcggcgccaccgtcaacctcgacgccgccgggatcctgttaggcagctgcctcgccttcgcgcccacagccagcgaccgcatgcccggcttcatcggcaacgtgcagcagaagacgctggaggtggtgtacgacgttcccgccaaggccatgcgattcaggaccgccgcctgctaagtgctaattcaaatttgcttgcttgccaaactagcgtattgttagcttattattcgaatataagctagctagttgatgaaataattagtcaaagtgattgttgtttatgttttgatgccatgtttatcctacatggcgtactagtagagcatctatctctatggaaagggattaaagtagctagcttaattgcagcattgtctgctaaagtttaggctagctactaaagctcttttatttatcttgtctgcaataatttgttatcttgatgtgatttcggtcgtgtgagattgtaatatcgagttatgcatctccatcttgcatgtcaagtgatgtactactttttccatatctagcattttatgcataatctgttgactatttgtgcgcacacaattaactagagatagattctaatctcccgggtggacgtccacctagggctgctccgccaacgcgcagtgccagttcggcatcaactacggcgatggctcgacggcgaccgggacgtacagcttcgatgacctcacgctgggtccctacgacgtcgatcgtcagggtcttcctcttcgggtgcgcgcacgccgaccggggaagcaccttcaacttcgacgtctccggcaccctggcgctcggcggcggtgcgcagtccttcgtttagcagacggcgacacagtacggcagggtgttctcgtactgcatcccgccgtcgccgagctccctcgggttcatcacgctcggcgtgccgccgcagcgcgccgcgctcgtcccgaccttcgtctccacgccattgctgagcagcagcagcatgccgccgacgttctacagggtgctcctccgcgccatcatcgtggcggggcgcccgctgcccgtgccacccaccgtcttctccaccagctctgtgatcgcctccaccaccgtcatctcgcggctgccgccgacggcgtaccaggcgctgcgcgcggcgttcaggagggcgatgaccatgtaccggacggcgccgccggtgtccatcctcgacacgtgctacgacttcaccggcgtccgcagcatcaccctgcccagcatcgccctggtattcgacggcggggccaccgtcaacctcgacgcggcggggatcctgctccaaggctgcctcgccttcgcgcccaccgccaccgaccgcatgccagggttcatcggcaacgttcagcagcgcacgctggaggtggtgtacgacgtccccggcaaggccattcgattccggagcgccgcctgctaatcgatcgatctagctgcttctaatttgcttgcctgccaaactagctatcttggtttattcgaatataattaagctacctagctagttgatgaaataattagtcaacttatcaatcgctgtttaatttgtttttcttctgatgccatgtttatcctacagtactactccagtagagagagcatctatctctatggaaagggattaaagtagctagctagcttgcagcattgtctgctaaagtttagggtagctagcaaagctcttttgttgtctgcaataattagttatcttgatgtgatttgtgctcgtacgtacgtgtgagattgtaatatcgagttatgtccatcttatcaagtcatgtactttactacttttcccatatctagcctttttacactcatttttaggttttaatgcatgatttcattaatttaattttatcatacattaaaccatttttgttatttaaaattttatgtaaaatatacaagtcatgtttatagtatctttaataatgaaataaatcacaacaaaatgaatgataataacataatttattaatggtaaattttcctacatagcacctaaaatttatgtaatttgtttacagacatcgtaaaaaatgtatcatggctaaacgatatttttaaaaaatggtaatttaccgaggatattttcgacataattagagagagaaattcttaaaaagacgagaataatcaaatatgtctccgaggatatatcctggactaaaaactgaagggagtatttttagtgtcggttacacggcctaggaccctgaattcagacagtgctttgcatttatatatgaccagctttggtgctctacaccctgcccctttaaaatgcgtccgaacaaagtgtacgtctatggaccaacatacatagttacaaaagaggatctcactccgtctctttctccgaaaagcgaaagaacgtgcacatggctcaatgataagccaattaactcgccttcatgcttatggctagttttggagagctgcacctgacactgtatctctatcgatctcaccatttttatgcctatgattgatcaagtttttttagataatggaatataatatcccggcctttactcaaaagagctacagccaattattatatagtagttttcatgaacatagtgtaaatctaaatgaatagaacgcaccgaagagaaaaacaaagaaaccagcctaacgtaaggagatcacaattattgaagtctatttgtaaatctccaaccataattggcaaatagttgcataaccgtggtctccaactttcagcacgcaactttcagaaactcttcatcttcatcacacctttgtagttgtgcccaaaaccggagccaatgagttgccctgaaaatgacctgcatataggaaaatgatggtgatttgtcaaaaaccatatcgttcctactcagccatattgcccaacaaatggcagaagctccaacaagtatcagtttactcattttcttatcaactcccaaaagccacacattaaaaatatgagatatactaactggaagattaaaaccaaaagagaatagaactgctctccataaaaacttcgcaaaatgacaatccataaagagatgttgaatagactctttcttcaaacaaaaagaacacctcaagctaccattccagttacgccttgccaaattatccttagttaacacaacccctttaagcaggtaccacatgaaaattttaatcttaagtggcaacttaagcttcgaaatacacttgtttctctcgatatagccattattaattaaagctaggtatatagacctcaccgagaacaagcaattctgatggaaattccatctaaaactatcagacgaatcattcaactgaatatgtactatagaggcacacaactcatgccaacaaacaagattctgaccaactaaagctctcctgaaagaaacattaagcggaacagatcccataacagtggcaatagaagatgttttcgtccgaacaattgcgtacaaagatggatatttatccttaaaagccaagttaccaatccatctatcttcccaaaatctaatttgttccccatt

SEQ ID NO: 12216 - DNA, 2044 bp, Oryza sativa
tttcttatggtcatccccttgccaaaaaaaccgcgatctataataatcaattttatgaagaaccactttcggcacctcaaaaaaagatatcataaacatggctaaacttgaaagaacataattaatcaacaccagtctaccaccaacagataaatgcttgcctttccaactactaagctttttctcaattctctcttcaataagtttccaatctttattagaaagcttcctaaaatgcatcggaattccaaggtatttaaaaggaaaggtacctaacttacaaccaaaaatatcataatattgttcataacattcctttgtctgaccaaagcaaaataattcactcttgtgaaaatttatttttaggccagataacttttcaaataccgataaaatcagtttcaaattctttgcctgttgcaagtcatgttccaagaagataatagtatcatttgcgtattgcaagatagacaaaccatcatcaacaaaatgaggaataaccccattcaagagtcccgcctctttagccctcttaatcaatagagtaagcatgtcagctactatattaaaaagaataggagataaaggatccccttgcctaagacctttgtaagtttgaaaacaattaccaatttgatcgttaacttttataccaacatgaccaccttgaacaaaagaagctatccattcacaccatctaggagaaaagcctttcattctcaaagtttgttgtacaaaaggccatttaactttatcataagctttctcaaaatcaatcttaaaaattacaccacttttatctttgcgatgtaattcatgtaaagtctcatgtaaaataaccaccccttccataatatttctcccaggaatgaacgctgtttgagaaggactaattaccttttgggcaacatccattattctatttgtagcaactttggtaaaaatcttaaagctaacattaagtaggcatataggtctatattgttgaatctttaaagccttagcacacttaggcaaaagaatgatagtaccaaagttaagcgaatataaaggcaaactcccagaatgaaagtccttaaatagttctaaaaggtcaaatttaatgacattccagaaaacatggtaaaactcagcaggaaatccatctggacccggagctttgttatgttccatctggaaaatagcatccttaacctcattttcagaaaattctttagttaaggcttcattctctaaatatgaaacttgaggaatgtcagcaacataattctcatcaaactgaaggtcagactcatcaggagggccaaaaagacctttataataagtggtaatatgcgactttaaattggcatcaccccttattaaatgatcaccctcctgtagttgataaattctagttttcctatgttttccatttgccactaaatgaaaatactttgtattagagtcaccctccaaaatatccttagtcttagcccgctgataccatttaatttcttcttcccttagaatgacagataacctactcctgaaaaaccatctaatatcaacttcctcttgagacaggagaacagtctctgcctttttatccagtgcctccaacttatctaaaatctgctttttctcttttttgtataaaccgctggtatgtttagcccatcccctaagatgctgtcttaggcggcgaattttcgcttgccaacgctccataggagtattgccctcatcaaccccagaccaaacttcttttaccatatcaacaaatccatcacgtaacagccaaccaagttcaaacttaaaactatgttgagcgttactaaaagaggaagattttgtatttaggagcaaaggagtatggtctgaaatatctctatcgagagcaacaacagaggataaagggtatttttgctcccattccgtggacactaaaactctatccagtttctcataggttgggtgtgccaaattatttgcccaagtaaaattcctaccagtcatttgtatctccctaaggcacaactcatcaataatagcattaaacaag

SEQ ID NO: 12217 - DNA, 27254 bp, Oryza sativa
tcagataaagcaatacaatcaagttggtgttctttagttaaatcagaaacaaacttatgttttttcgggtccttgaacccatcacaattccaaaagattcctttcatttaaaactaattttattattcttcttcttctttttacccttcttaccattagaaatactattagaagaaggtaccatggaatccaaagtggactgaatattaccactattcccacttaaatccatcacctcctccataatttcaccacataaatgttgtagtagagtattatcatcgaactgatcgtctaactcaccttcaacaattacatcaggaatttggttaacagaggaactaatctattcactcaacctatttttctctacacactttaaatcttctataacattattgagaataacatttttatttgaagtaatcacacctagattattaagggaagcagaaatttgatcatttgtaaattgtaaaaaagaaacattaacatccatattacctttagcatggggtttctccaagttcttttccgccttcaacctttcagctctttcaaggacaagctgatcactgtcagaagctctcctctggcttttcctggatggagaaattaacgcctcgggaatagcagagattttttcaaccagattttcttgctcaaccaacacggtctcctcatccaacccgtcaaaatcttcgtcagacgcagtcaaaccttctgactacggtatcaaactcaactgagaagaggtaaaagaaggaccacccctctcagtaagattactatcagtagccatactcacatcagagacacccggtccagacttatttcccatgtccttctcattttccccatcgtcatttctcttcccatcaccatccccaaaattatccatatccaaaggaacaggatccccagcaccaatatctgactccactttaaaagacagctaatacaaatgatcaccaatggccacatcaacaacatcagggattagagatgggtcaaggaccaaaacttgtaaacgagctatctcataccttctagtaaataacatatcaataactgtagtaatcccaagaatagaaccaactgcacaaataattaaatattccctcaactcagaaggaatccccttacactgaacccaaacttttggaatgacatatttcacctcattcccaacacctctttatatgatctccatctcagcctcaccaactttagtgtgcacctttccccattccaccatgcgattcagctcagcagcagaaggaaagatagtacgaaaagtgttatcaccattgtcatgtaccacccacctccatttaccaggaattaacctctccaattcagatacaacagccttaactgtcatctgaccattagatattttaaccaaggccgccctagggtcatgcctaatcctttgtccagctgggaggggaatatgaaaaaaactcaaaccatcacccccataaccacataactgagcagtcaagaatatgataataagttctttcttaattagtatcctacatttttatacgttaaattaaatataaacagtatgaaagaggatgaatcatgagtaagggatggttgtcatgttctctcgtgaatttactacttcctccgtcctaatatataaagcacaatcaccactaaaatgaatttagaaaggggcgagcaagttcgagcgtgacaatgtactttgtttgcggcgttcgaccagcacggcgatggcaaaatctccgtggcggacaggtacaatatttttaattatccaaatagttcagttgaaaagaatttaaagctaggtactgcaggtaccataggccaatagaaagtcacgggttgctatctctttattatttgcagtataattggtgtggtgttgtagttgtggttttcgctcaattttctctgattaactaggcactataaggtttagtcatgttttctttttaaaatggaataccttcttcttaatataaaacgtcagcaatggcctgaccgttcgaaaaaaaattatttgcagtatatatatttagatcacgtcgaaaccaagtagtgaactgtttacttttgtgtatggaattatcagcagacaacaggcaaggagtgaactgagcaaatttaatcttgtatgtacttcctccgtttcataatgtaaattattctagcattgtccatattcatatagatgttaataaatctaaacatatatgtctgcctagactcattaatatctatatgaatgtggacaatgttagaaagtcttacattatgaaatggagggagtatatgttatttaaaacacactctggcctcgcctgtatggtggtagctaggcaagtacttataaattaaattaaagcaaccactcactagtacatgttggatcatacatatttgtagtttggtatagagataaaccacttgatctctgtctaattgtagttgtactttcaaaggagtttctttttgttatttagcttaattatcgatttacaggaaatcaatgccatttaaagggtcaaatacttcaacctttcagccaactgttttaccataaggctctgtacatgtcataattaatccaaaaatcctatcggtcgagtgcccgacggattaggaaaatatcgggcgctcttccaactacccccacccatttccgtgactctctctcgtttctctcgctctctcttctatctctcgtttctctcgtcgcagggctcaaacggcttgagcatggcgagcagcatcgccttgagaagatgtgacagcaccttgtggccggcccccgtgcctcctccgtggacaccgccgaacgccgccccctcccagagccggcagccgccgccaattgctcttcttttgcgcggcgacgccgctgaatgccgccacctccccgagcaagcggccaccgtggcagaggccacagccaccctcgcagcgcgacgcccctgccaccgacgtcggcgacggtctgacgaagctccgcggcgtcgacgacggcggctatatggatgtggtggagctcagcatggcatggacgcagatgtggttgctaaccataagagtggtggaagaggtagatctaggttttcctcttgaatttgttatgtttcaatccatgtaccgtgatgttttatcagttaaatttgaaacgttgcagtgggtttttcgatggtgtttcatctttttttggatgtacttggatttgtttcatgtttcggtacattcggaaccgttgttttatacgttgtagaaaaatgtttcattgtgtgatttgattgtgtttcacaattttcagcactgaaatatttttaatttgatggtgtttcattcttttcctcgatgtattcggatttgtttcatgtttcaatatattcaaaaccgttgttttatacgttatagcaaaatattttataatgtgatttgattgtgtttcattctacccgatttgtatgcgcttcctaattaatcttaacaaggtgtgggcaaatagtttttggacatatgaatttaattaatttctggctttctggagtacattttatttctgataagctgaacttccacttgagattgcattgcgcatgcactgagccatctatccatgcttggacctgtactgattggaaaagttttttttttgtttgagcaagttgtaatcttataattagttctgatttctgaattaacttttatctcctcgcattactgccatagaaagaacattcagaagaaatagattgccctgatgctgtgctgcttgtttcagccatagaaacagaaatacgacattgtcttatttcttcccctgtttcctctcaaaaatgtttatattgtagaaaagtgaatttttatcattcttaagaaggtaccaacatataccattcaaatttaaccgttgatttgctagatacacaatgggccaagagtaaaaatagcgatgctcggtatctttctctgttccttgcggcagacgtgggaacgggatgagcggataggaggctacccaggtacctacaggtgcgttatggcaacgcaagaacgagtatagagtgattaattgacttttaattattacaaacttaaaaaatagattaatctgatattttagaacaactttcatatagagtttctttcctacatgtgagattagattgatcaaggtgtaggatgccttgcaaggggaactcacatgacggcacacaatttgagtttaatgctttgatctgaaaaggggaggaattgggaggagggtgaaaggaaataatgcctaattcaaagaacgaaactctcatgaaacgatattatttacattaggccaaaatttttgggtaattaccaacccttaaaaggtatctagatgtatcatattttctagtataaaatttggcacctctagataaccttaaggtaaggtattttctcaagtatcgtaaaattcctcaattttttaccttgtttttagttcatcaataccaagctgccaattcagcttgtagctggtagcatacaaccatttacgtttaattcagcaaaccccacaacacaaatcgtagcagcaagaagggccggcggaaaaaagaacaattcaaggtgtccgccacggaagagatcagccagagattgagggcggcggggatcagctcggtactgaaccagcagcgggaggagcggagcaggcggagggaagttgagctggtccggccactgctgcatctgccatgctcagctcgtcactgtggccatctcctcgtcgctcttgttgcctggccgcttgcaaactcgaggaggcctcccagccgccgccctcaaccagatctcggcgtggtgaggtgcgaagaggaagggaatgggctgcccaggcggcgccgctaactacgagcggagtagacttgtcaaaggagattcaacgcaaaaaatacaattttacccctcaattaactcatccatgcggagtacctggttgacgcgttggaggcggtacctctcaaccgtttgattctagtatctacggcttgtatttggtattttccttaccttaaggatggtaaaatttctcaacagaaaataccttaccttaaggaccttgttgatcatcttgagaggagattttgcaactctttacttggtgttgtattgctttaaaatataaatgcttaatttgctcatcaggtaaagttggtaatttactctatatattgtgtcccgccttctccgccgtcccctccgcggcctgcttctctgctttccgcattgtccctgccatggccactacggtggcctttcctgccatggacaccgtcgcccctgccacggccactgtccctgccgcagccaccgataccatgggggccaccgtccccttcaggcaatggcggagctacgtataatctgtggggtcagctgacatcacaggtttttgcaaaatagctcaaaaactattgatatttgtgttgcaacaataaaaaacttaagaattttacagcttgaccccataggtttaagcagctggctccggggccaccctggccgctaataccatcggggccgccgtcaccagcatgtggtatgcgtacgccgtggaagtacacttctgcaccgacatacactacttcgccaccgtacccaccgacgccgcctggtctgagggcgtcaccgtgtggcggccgcggtggccgtggcggacgccgaggcacccaccaatacctctacatccgccggcgcctccacggtcgttgcggccaccacagccgctgcgaccagctctcctggttggcagggctcgccgggttggccgtccaccggaaactctcctccgaagttggcggccatggctgctacggttgatcgattggggcgagttgggtgaggaggtgagatattccgatgcatgggagggttgggggtatgtagcaggtatcgtatttatgggatctccttcttttttttttgaacaactcgcacgagacggtgcgaggtaatattgatagagcaggaaaaaattacaaaattacaaccctggagggtcgtaaccaggaaaaaggaaaaaaaaaaccaccacccacacatcgacatcgccaacacaccaacccaggagaaggctagcaccggaacggccgccgctaagcgtgaccgaccgccactagaccaacaaagggacacagacgagatcgcccccctaggggatgccaaaacgacgtcttcaagaagagaagcgacagaaaaccgccgccgccatccgtcgaagcttaaaggagccaagactgggttttcgcccggcaaccacccttgaggggtaagacagcacgacaacgccctcagaatcgttgtcggtccggccgaggccagactaggttttcacccgccgctcaccacttgtgaaaccacggctgatacaccgatgctccaccaccacacaagctctgccgacatgtggaacccctgcaccggcgtcccccgccggccagccttcgtgcgccgaagaccgcgccactcccactggcagctcctcctcacacctaggtcgcctcctccaccgccggccgcgccactcacgccaaaccggcctcctccaccggatgcgcctctcgcgccattccagcctccctccatcggccgcgcctctcgcgccaagccggcctccatttccgccgcccgcgcctctcgcgccgagccggcctccactgccatcggctgcgcctctctgcgccaagccggtctccgacccctccaccaaacgacaccacgccggccaaaagcagccgtctgccacgccctcggctagccatccgagtccgccatgcctccggtgaccgcagacacggtcaccgccaccgcagccgttgctgccgaacgcccagccacctcgctagcaacccgcatccgccgacgtcgccaccgtccacagccacggccgccgtcgccactgccatcgatgccagcctccgcctccgcaaaccgttgcgccgtcgtcctccgccaccaagcagccaactcgacgccaccgttgccagccgacgacgctgccaactgccacgagcaccacggcgggcacgattgtcgccgccgtcaccagcagccgtctggccggtcagcctccgctgcgtgccggccgggctgctcctccgagccgcgttgccgccgccgccgcgagctgttccgccgagtcgcgcccccgctgccgtgagctcgaggtcgcgccgccgtcgccgcaagcacgaggtcgcccgccgtcttgccgcgccgccgtcgtcgagagctcgaggccgcccgccgtcgccgcgagctcgggccgcccgccgacttgccgcatcgccgtcgccgcgagctcgaggccgcccgccgtcttgccgggccgccgccgcccctctacagatctggccggcggggggccagatcctccatcggggaggccggatccgcgtccggcgcgaccggattcggccccgcggccgctccggccgccgccttccgccgtgcgtgcgtcgcgccgcctcccacgccgaggggttgctccgccgccggcacgttttccccgccgccgccttcccggccggccgcacggtttccggcggcgggctccggcggcggcgaggtggctggaggcgttgggagggggcggcgcgggcggctagggtttcgctcccgagccgctcgcgtgagagcggcgcgagagcttggggaaaaaaatttaggaactccgtggcggctggtgaccgacacagtgctgccaacctgatctccttcttttggtaatcagtccaatctttccttaccttagtgtagtgataatgatatgatatgtttccaaatggaggggatcaccagctcagtcttcatttcctttccgaattaaggctgatgctccatctccgcgcacctctgcaattcgaaacacgtggaaaatacgccttcgaaattggcttacgcacttctagccgatctctaaagaatatgctctcatttttaactttcaagtttcaattctgtactggaaatcatgtatatatcttgcgcatgttaattttaaaagtaagagcaattttaaagtccttaggaggtaccacgaagtatcaaaaatttagtgtaaaatttagtacgttatagtaattaaatactaagagataccaaaattacaatagaaaaagtggcccctcatggtattttctcaaggagtataaaattactctaaaagtaaactgtgcaaaaatcttctttcagaaccagaatgaacatgctgacacgcataaggttcaggctgaagcatagcccgccataattcccgaagtaaaaaaggatcatgtttctttgtcactttatatgcgtgtcaccatgttcattttgttttgttttttttttaaaacgtaagagtcttgcttgtcaatatattagtataaaaaaaagacttctacacaaccgcgacccgttgacgtggtcatggggttacaggggggagacaaaaaaaacattggactgactaggagaaaaccgggcccggaatgttcattctagttgaggaagaagatttttgcaaaacccgtattacagtatggttacggaaaagatcacagaggtagagtttgagaaaagaaaacctacacgctaccgggctcatccacgtcgttgaacaactttgttgcggcatttccaaatgttccagagaatacaaagcagcattgagtgtagtacgacttgagcgtatcctgaaggtcttttttatacgattatacggtaggcatacacccactaaaaaatactcacaaatctgcaaatacgtccctaaaacacgctcaaagagaggtccgtggcatacattttggaagcacgtgtactgaggcctgggcttaaaggcatctacaaggcccagtgccagccagagcacagctgcagcagaatccttcaaaaatccagcccaatccagcccaggaatttgttcacctgggcctgatcaccatacaaaaatcgaataaagcaaactgaatctctctgctgagccagcttgccagatcacctacctaccaattcgaacaaaagcatcccattatttgatcgatcgatcgatcgatcgatcaattagctcgatatccattagcaagctgttgttgcatcgatccatggttgtatccattgattaatttgattagctgcaagggcaagaacatcatatctgctagctagcttgtcgtcgcaatcaacgatggactacttcaacgggacggacgcgcactgcggcggcgccgtgggcgccatgggctcctacgtctacaacctcacctcctcctacgccgaccagaagaacgaggtcaacatcgtcgccacctccctcgccatgctcctcctcgccgcgctcctcctcgccttcgacctcctcgccggcgccgccacgctgcgccccgccgcgcgcctcgtcctctccgtctccctcgccctcttcctccccgtcacctcctacctcttctccgaggccaagaacgacgtccccggcgccgccgccgccgacgccgagctgcccctgcgtgcgcgcctcattcttgcgtggatgctgctcgtcgagctgctccgcaagaaggtggaggccacggtcgccggcactaagggcgccagtggcggcggccccaccagccgtgccggccgtgtcgccttcctcggctacctcgtcttcttcaacgtccacggcgccggccggaaggcggtgttcggcgtgctctgggtgttcgccgctgccaagctggtgcagcgcgtcgccatcggtgagttcgtcaagcgctccttcgccttcggcaagaacccgcagctcctcgccggctacatggcgcagacgctggagcagcaggagcggcgcccgcggcgagacgacgagctcatgacgagctgcaagtacgccgtcatgggagaggagaacctggagagggaggccggcccgaacggctacctcgtcgacctgaacaagacagtcgccggcgatgacaacgccgacgacgccgtcgtcgtcaccgtgggcagggtgtggtcgctcgccgagagtgaccagctgctggtgtccaacccgaagctgaagcggctctgcctctcgtacgctctcttcaagctgcttcgccgcgagttcgaggagacgccgttgaccgccgcggaggccgccgactgccgtgagctcatcttccgaggcctgtgcaacgacggcggcgccgccgccgacagggcggcgacgctgttccaggtgttcgacgacgagctcgggttcgtgaccgagtactaccactccgtcctccccgtgatgctggcgagccccttcttcctcctcgtcaactacatcgtcttccccgtcctcgtgctcggcctctgcctcatgaccgtcgtgctctgcggcaacggcgacatcgccttcatcgccggcagcatcaagagggacaactacgccgtgtcgttcggcttgctgaggatgacgaggtgcctcctgagcagagtattccggtcgccgtcggcgctcttctcctccattgacctctccatcacgttcctcctcttcctcaccatcctctacgaggaggcgtgggagctcgccgtcttcctcctctccaactggctcaccgtctccatggtctgcgactacgccgtcaagccgccgagccggctccgccgctccgccatccgcggcgtccagtgggtgacgaacaggatgagccgccgcaattacctccgtgtcaagcagtactccgtgctctggttctgcaggctcccgctgaagctgccggcggcggccgtgccggaggaggcgaagcaatccatcgtggagtacctcgcggcgtacgacggcgccgtcgccccgctcagcgccggcaggtcggcggtggcggcgaggaacaccctgtgcaacgcgtcccggctgatctcgtcggcgtgcgagagcggcagcgtcgccgaggttatactcacatggcacatcgccaccagcctcctggaggtgaggtgcccgccgcacgcggaggaggaggcggcggcggcggcgaggtcgagcacggtggcgacgcggctgtcccgctactgcgcctacctggtggcgttccgccgggagatgctccccgacgacgtcgactgcacggcgcgggtgtacggcaccatgaccacggagctcaagcgggagctgggtctcaagggctactacttctcgacggacgccacccggtacgggaagatgatggctatcgccggcggtcaagaagacgacgaggcggcggcggaggagacgacggtggtgcgcaagggggcgaggctggggaaggcgctgatggacgaggcggccggcggcgacgaggcggcggtgtggaagctggtggccgacgtgtggacggagatcgtcgtgtacgtggcgccggcgagggacgccgagcaggtgagggcgcacggcgaggcgctggcgcgcggcggcgagttcgtcaccgtgctctgggcgctcgtcacgcacaccggcattgcccgccccgccgccgcgtcggtgtgatcgcggcatcgatcggatggtgattgaggatactgatggttggagtggtacagtaaagattggtttgcatgcatggattggctaatttttggattgattgattgttaatcacttcattatgattaatttgcatcccaatggattggtgtaacatcatatatctgtgtgttgatgcatgtgatatatacatacatacatgatgtgtgttactgtgttttttttcatgtaaagatcatgttgtgtatgttccgaaaagccatcaaaatgtttgaaaaaaaaacaagataagccaatatttgatatatgctcaacaaacatataaatttaaatttaacttatacacattattcacagttttttgtacttgtattgtaggttgaatttgaatttgcatgtttgtgtaatgaaatatatctatcattctatttttaaaaaaaaaacaaatagtgactatttaataacctagaaaaatgagaggatactctaagggatgaaatgagttttcccatgttatatgttgatgatacgtacatataaatgcgtgtgttttaatggaattgatttacatttgtacccatggaatggagttactagtcacactacaattcgtacaaatgtagacattacacatcatcgatcaacccatgcattacaccaaacatgttattgatgttatacatattaaaatttcaatcatatttgcaaaatatgaggtagcgtcacaaacggttcagaccagacctcgcaatacaccaatcacacaacccaaaatcaaaccatatgcacacgcatttacaacacaaacacatgaaatcagccatggcaatcaatgggcgtagacgaagcggcggcggcggcgctcttgttgtcggcgacgacgaagtagacgtcgctgcaggacaccctgacgttgtacggcctggtgtacacgacgccggcgaccttgaaccgcacctgagccgccaccgctacgttgaacggcccggttctcctcccttcgccggcgacgatctcctgcacaaacctgtcgtccagcgtccgcgccgtcacctccacggccgtcgcgttgcgcggcggctgcaggagcagcgccgcctcgtcggcggcggcgaggccgacgaggaggaggctggtgttggtctcgatgtagtcggtggtgccgtaccagagcatgacgtccagcgcctcgtactccacggcggcgcgcccgctcgggttgccggccaccagggtcaggttgaggaacgccgccttgttctcgtcggtggcgccgctcctcgcgtcggcgacggagaaggcgagcggcggcgggcggaggacgaaggaggcggcgatgacgagggcggtggcggcgatggcgccgacgagggcgccgaggagacaccgcctcggatgaccacggatcttggtcatggcgcccatcttgacacagctagttcttgctagctagctacctaatgtgcaagcgacgttgcatgcaactagaattaaaaggcgccattgaaccagcagctgatcacagcctccatcagttcagttgcatggattcgatcgaataaagttaggcaattgcattatttctgaattctgatcggcagcaggaacgctaatatgcatgtcagtaggaattatattcgaataaacttattattagctgttcgtataactaaaattttctagtaggacaatgcatgagacagcttaatgagcaatttttgtatctcagctgcgacatgtgagcagaataggttctctttttttttcgccgggtcggagcagaataggttcttgcagctgcagaaactagtgattagcagattgcattagctagtgagggtgaatgtcaattcgatcagcagtgacgatccacacaggcatatataatccatgcattatatccatccgtgtgatgagcagaataagttcttccccctacggacggatcggagatcaaacatttaataagatgcttgaatgaattacgtaccatacaggccttgttcggttaatcccaatgaaaaaaagattggagaggatttattctacatctattatggtggagaattatttcccttcaattctcttcaatcccctccaaaccaaataacgtctcaatggtgaatagtgtaatggcatcaacatcgcacatgatacatataaagggaaaacacaattcatcctaggggatatcccctatttttgcatgttacttaaaatgtcataaaaaatttgaaaaaaaattagtaggatatatcaatatgtgatatatcacttcacaaacatgcaaattcaaattcaacttatacaagtagaaacaaaaataacaaatttgacaatgaatagaacgcgtaattcacagtcaaatttgttatttttttgaattgtataagttgaattttaactcgcatatttgcgaaaagatatattatatattgatctattttaacatttttttaaaaaaaattttgataacattttgaacgccatatatagaatgagaggatatctcatcgagggataaaaatccacttcccatataaagttgaaatgactgatcaatgacaattactaccaaaggaaagagccccaacgtttgtcggagaaatataaacgagattcacattctatcagctgctcggcgcattataaggtgtcaaagcacgaactggcgaaggaacttttgtactaccctgaaggcctgaaccaatggaaatttggttctcatctttgactactcctttcttttcccgtgcctaaatatgaatttttaattcaaatgccatttaggtattcaaaccatccctctcaaataaatcatgaaaattccgaagtgtcactattcatctaggccgttaatttatccccttctttctccccaagaagcccaacccctccttcccctatgctcctttcctttcgtctaccgagtcataactccttatcctttgattgctctccatcttgagttgccttcctgattcatcccgcgggcgctttgcccagtaggccatatttgacgcaaccgagccacctttatgggagtggattttgatcactcgaggggatgtcccctcattattgcttaccacttaaatagttatgaaattttttaaaaaaattaagaatatgtattaatatgtgatatatcactccacaaacatgcaatttcaaattcaacttcacatctcgtaacgaaaaaacaaatttgactgtaaatatgcgttaactagctgttgtttactttgtttttttcgttacgagatatagatgttgaatttgaacttgcatatttatagagtgatatatgatctcatgttaatacatcttctcaattttttcataattatttaagtgacatgtaaataatcgaggcgacatcctctctagagatgaaaatagtctcccacctttctgcaaccagtctatatatctgcctcgtcatgaagtcataatgtctctcaccgtcatcttgcgccaacaactttgaagaatttccccttccacctcagtgaaaacttagccacacctcggtaacgtaagtatggtacatattcagcgttacaaacattttccgaccaatggacagaataaaaatgcatggaattattaattcatgaagatcggtagtatagcagactctataaccacacatactcatgcacttacagtagtagagacattttcacaacaaatgaataaaagaaagaaagaaagagaaggggaaaataacattaaagaagagaaagctgcaggccaaacaaacacacattcacgcatccaaaagcaatcaatcgatcaagcaagcaagcaaatttacacacattagctagtgacgatggatatcgatttcgtgctgcttatcgatccggtccggtgcggatttttgttgggacgacgacgtgctggcgtcgtcttgggaaattttgagagcgatttcgcggaggcggcggtgtcgggtaatgccggtgtgagtcatgagagcccaaagcacggtgatgaactcgcctccctgccatagcacattcttgtgcgccatgatagtacgctcctcgttggacggagccacgtacacgatgatctccgtccacacctccgccagaagcgtccacatcgaatcatgatcattcgtgtatttttctagcaacttgttggccaactctgcgcccttgtccacggttccctccttgttgttattcttgctgttgatgttgttgatgatggcgtcggctcgctcacggccgcacgagaagtagtagtggtaacatccgagcctgtctttgagctccattttcatggccttgaacagatcctccgccttctcatggtagtccggaaggagctccggttggaacgccaccaggtacgcgcagtatctggacagcgtcgtcgcgacggtgaaattgtcactactagtgttcttcttcttcttgttcggacagccgcagcagctcatccgcttgctgtcggactcggtgatcatcacctccggatcaggcggaggattgaggcgttccaggagaccggtggcgatgtggcatatgaggatcacctccgcgatgctgccgttctcgcacgccgtcttgagctcgtcgaagctcgctagagcagacttggtggaggcggaggcggaggcggaggcgagggagctgaggaggatggagtgcttgactgggacggggacggggacgggcttggtggagacgagcaaggtgatgagagggatgggcatggcgagggtgagcggcggccaacggaggtcgagcgcggagaattggttgatcatatcttggggatggagatggaagcccagccatgtccggacggagaggatgcagcgggcgaaagcacggaaggcggagttgtcgcagaagcgggtcttggcgacgtaggcggagagcagcgagaccgcgaaccagttggagaggaggaagacgaacaactcccacacctcctcgtagatgtagatgatgtagaggaggaaggtgacggcgaagttgatggtggcgaagaaggcggcggccgagtgatgcgcggtcaggaggaggcacatggtggtgtcgaatatgcccgaggagatggtgaagttgtccgtcttgatgctccggaacgcgtacagcacgtcgccgccgccgcagaggatgatggtcatgacgcagacgcacaggacgacgacggggaggaggaagtagttggcgacgaagaagaatggggaggccaggacgacggggacgacggagtggtagtactcgctcaggaagttgatctcgctgttcatcacctcgaacaccgccaccgcgtcgccgctcttgtagaggccgttgaagatgacgtcgcggcactcgctggtctccgcgctgctcatcttcggctccggcaccggcagctgctccagccttcgtcgcagcagtttggatagcgcgaaagagaggcacagcctcttgagctccgccttctcgtcgccaccattatttcccgttccaggtagcccttgctccacccagattttgccgacggtgacgagggacgacttgctgtcctccttcaacttgtagccgtcggcggtggcttcaacacgcgcatcttcctctcccgtcacgatgtacctgcaaccctttagcatggcgtcgccttgggccggcagcgacggcgaggtggacatcatgtaggaggtgataatccaagggttcttgccgcaggcgtaggagcgtttgccgacctcggtgaaggcgatccgttgcaccaccttggtggcgcagagaacccagaggacgccgaacacggccttccggccggcgctgcggatgttgacgaagacgaggctgccgagccagacgacacggccggcacggtggatggtgcccgagtagcctttcatggcgatctcgtccaccttcttgcggatgagctcgacgaggagcatccaggtgaggatgacccctgccatgaacgggaggtccgtcgacgatgcgcggccgatgccgatgacggtggtgacctggtcgagctccttggccgtgttcttggcctcggataagaggtaggacatgacgaggaggaagagggagagcagggaggtgaagaggaggcgcacacgcgggctgagtatggcgcccacgttggagaggccgccgaagaggttgaggatgaagaagaatccggcgaggacgaacatgagcacggaggcggtcaccatgctgccctcgctgctcgcgtcggcataggtgaagttgccggcgacgctgcttgttccgattgaggatgagttgcagtaataattgctcatctcgatccctcccttccgtttattacttcattcaattcaattcattccagctactagcttgccttatataggagtattatactagtagtgcatctcgactacttcctccgttccatggctcctaatctaaaaattcttcagcttaatttgacctgcttttcaagtttatgaaaaataaatgtaacgagaataaatatattctcaatacggtggattttaataaaactagcttgttttcataaatgtttatgcactttttctataaacttctttaaaaagtcagaaatttcacgcagaagaaaaactaaaacacattagttatagatttttatttaatcacattagaaacacatacactcttacacatctgtgcacaatcacccatatgagagcacacatgtgcttcctatccctacgattgcatccgttttatattataatgttttgattttttttctagttaaacttttttttaagtttgaccaagtttataaaaaaaacatatagcaatatttcaacacaaaacaaatatactatcaaaatatattaaatattagttttaatgaaactagtttgttgttgtacatgttgcaaaattttcctataaacatggtcaaactagaaaaaagttaaaacgacttataatataaaatgaatggttatcttatgaacgcacacatgcacactctacttttatgatcacctccgaagactagtaccttaagaacgcacacatgcacgctctactttacaaacacttccagagactagtccggcgtattttgaaattgacgaagtcactacggacgacacaatatcaacaggtatgtcagctaccactcgaaaaataactagccgtaaatacgagtattacgtaaaatctgaaacttgaacctggatgagcatattataccacaagggaccttactagctaagctacgcccagtttgctcttagttataaattgtgatataataaaacaaataaatgcactatgaatacaaaatttatggtggattttaatttgatattacacatgcatgtacatttttttataaactttatcacgacagtccaagtttccatcttctacttcatcctttttatgagcacgattcctaaattgctaaatgatgtatttttgaaaaaaaaatctattagaaaatttctgtgaaaaatcatatcatttttttatgttttttatagctactccatccattccgaaatataagtcacaaccacccttaactcaaagaccaagaaataattgttatcacctcatagtttggattaccctaataaataaaatgcatgcacccagtaaaattagagatgttgatggtggaggatttaaatagtaacattttagtggaaaagatgtgctagttaatgacatgcatgcatacacgtcttatattatgaaataagtttaaaaagtagttgtgccttatattatgaaatggatggagtaatacttaattaatcatgcgctaataaaacaccctattttccatgcctgacaaattaaaaaggatccaaaaccaacgtatattggctgcgttctaaggtcaaggttcccaacttctctcccttattttccgcgcgcacgtttttcaaacggttaaacggtgcatttttacaaaaagtttctatacgaaagttgtttaaaaaattcatattgatccatttttttaaaaaaattagctaatagttaattaatcacgcgctaatggactgcgccgtttcccgtgtgggaaggtagggttcccaacaagtgggaacgaacatagcgtgtggccgtggttgtaaacttgtgataattattggaaggtagaaatgactacttaactgttataatgttaaaagtcgttggggtacatattctaagaaattaaaatttatatatataatagttttgtttttttaaaatcgtttagtagattggaaagcatacgcgcattcttctattaagttaaaaagaatataactatgcatgcgctgcaaattaaagaaaggttgcttcattcttttttatacaatctaggtgcgtatacaacggcccctgcatgtgaaactcgttcactttaataatgatgaacagaagtagtaaagcaaaaaagagacgcacatatataacgtcgcgcacgttcacccagctaataaggaggacatgaataggattccgacgaccaatctttggaaaataaaagaaaaaaaaaggaaaaggaaataaaataaaaggaaaaagagattaaggaataaattccgaccaatctttggaaaagaaaagaaaaaaaaaagaaaaggaaataaaataaaagaaaaaagagattaaggaataaataccaaagattgaaaccaaaaaagctggtagctttcacgtgttgaagatactgtatgagctagcaaaacaacgatgatatgatgtccgtcggcaactcggaaacctggctagttaagctctttaaatatatattctcctctccaagaaacgtgagctacccactactttaacaattgcattctttatatttttattctaactccattccatcctatctttatctaatagtaccggacttgctatacaattaactcttagattcctaactcacatacgtaattatattatgtatataacagatattaaaagaatgatgatatttaatatacaactctttttcttctgtaacgtatttttttattatactagcaaacaagcccgtgcattgcaacgggtgaaaaaaacataatgataatatacggctttcatgcataaccatatcgatgacaatcagaaaatcagaaaattggaacatcttaatggcccaacctcaatgatgacaaccttaccgatgtttgctttacctaaaataattggattattcatatgacaacatgcatataatctaaaatattcttttaatctcattcttgcaaccaatcaaatcctacaccgcctcgcatgttcaagtctatacaaaatagagtcactatgcactcttctctaaataacaatagaaatattttttctcgcatgatttttatacggactacggaaacctttttttccagcgcgttttcttttgcgctttttttgatattttttcctcgcgcgtttttttaaaccgtttttattttcccgtgcattttttctttttaatatacgatggaaatttctcattttaaataggtagattagattagattagagatagagaagagatatgtacggactactaaaacaacaaatagaaattagactttttttgccgcgcttttttctgccctttttattttttttttctcgtgcgttttttttatgaacggtttttttcgccactttcttatagagtcagatctttctagattttttttggttttttttatttttttacggattttgtttttgtttttcgctctataggaatcggacttttttttcattgtgggaatcggatctacgtttctttttttgtttttttcaaggaaacggacttttttttattctgttttaggtgggaatcggattttttttctgaatctacgtttctttttttttgccaggtatcggactttttttttctgttttttcccgttttaggtgggaatcgattctattttttgctagggaatcggattttttaggttgttttttcgctttttttttattttaacggacgatgaaaacatgttaaattttttaagtagtagagatgtaagatttacacatgcagcgcacaccacactaaacattcaagagtgcgcctactaacatacgctaaaaaacaaaaaccaaagactactggtacatagggttgaaagtgattcggataattttcgtccgaacggaccaattttcggattcagataatttcggtcgaaaatatctggaaatttttgaattcggaaacgaattcggattatttttttcagaaatgaaaacgaatactgtagaggtgatatccgttggaatcggaattcggtcggaaactatccactattttccttcggatatccaagctatacctcagaccttatagctatccagcccagccagcccaacccaaggaggcaaggaggcagcgcagcccaagtacatgatgtaaccctagctgcttgctctgctaagttgatattctggtttgggtattcctccgtattcaatttcggttggatggctatgtgtcacgcccgagctagccccgagcggaaccagcccgtgacgctccaaattaacctgttaatcgataccagtcccaggaaacagtgctggtatcacaggaagacagaatatcacagccacagaggtctctttattatagagtaggattacagtcatgttgggctgtggacagaccccgagctcacaactgcactacaaaagaggaaagcggaagccaggacttggaccaatcatcacaggcgcgacttgggaactagatcgaaaccctaaaactcatcgaagccgacttgctcctggaagaactcctcatccgcgggatccacttcatcttcttcggcaactgggggggattatttatatagagcaagggtgagtacaggagtactcagcaagtcatgggaattaagtgtttaatgcaggcttcaagggagaggctgttgtttttgcaattgattttagttaaactcctttctgaaacaactaggtgagtgcttctcaaacaacacggatgagacagtgtgtctcgtccggtcggagtatgtgcaatgtatcagtctttgattttctcaaggttggcacccggccaacagctttcaaacggccacccaggcctggctgatcccaccagcggcagagttccaaacaacgaacccattccacaacagcaatttcacaaagcagtagtcaaacaaaactacgctaaggaatcaccttacatccgcccataaccgcgggcacggctgttcgaatagtttaataacctttgcagagggggcacactttacccacacgacattactaacccggatcacccagcccgtgcagaacagccacgtctggtgaccttgaggctttcatgacaaggcatttcgagagccgacacaggtttaccatatgccgacgagaggggtcccagaccaacaacaggttaggtcccagaccatcctgtgccagaaagcccaggggtcctccccgacaccaccccagcaaatccacatgtctctcgacatcaaggctcccctgattagctaattactcagccaggggtgtcccattccacccatggtcgtacttgttatatgttcggatgaaattccaaaggaaacggtccttaagtgcaagagcgggaaaccgtgctcctggcatgtccctcggtctgcgattttggaaattcatttagttcgcaagcaccgacccaggcgtcgggttttccaagtcttttgtaaaacccaagttttacccatcgttggatattttaaatttgaggggaggcctccgatgtgcatgcccgaaggcccgtacatcgaagtaccacatttgacaaaggagttttaagtattcgatcattaaggagggtgattgcaacaattaggattggggggggcaggctaccttgcaagccgtagccgaattactcgtgttaatcctaatcatgcaatatttgcggaaaagaaatacttagatttaaattataggtgcaagatgatcaaaggtgacttgccttgctcgagatcttgagcttgatcatcgaaatcctcgcactgcgggtcttcgggctccgaagctatacgcgaacgagacgactcaacaaacggtgaaaataaggccctattattgacctctaagtgtgccattagatagaactcgggatttgagaaattttggaagttgaacggagtcaaacggatgtacggttgggaagatatggaatttctaagattgaaggatttattgaaataaaggaaaaggatttattaaaatactttttgaattagaaactaaagagggaggggatttagacttcgcgggcggcttgagcgcggcccgagaggggttggcgtggctcggccatgctattgggccggccggccttgagaggcggcccaagggggctcgcggggagggtgaggggagagagaggttctagatggacgcggtccatcgtgcggggtccggggcgggcccacgagtcagggactcggtgcacgagggagggggttcacgtggcgcggtgctaaggtttcaggagggggaggtgtggcgcacgcagggttcgcggaggacggaggtgcggcgggcccacgcgcagcctcttggctctccgtgggttgcgcgcacgagcggggcaacggagggaggcggctaaccgaggtcagcccgactcggtccgaggccgagctggcaccaatgtggcgccttcgtggctgccacgtgggccggctggaggaggacgaagggaggctggccggaacggacggcggacgacggcggcgctcactggagctcgttgggacatcttcggccaaagggagacgcaccggtgtgatgataagaacgagagggatcaagccttcagctcggatgcaccggaaatggctcgacggcgaggaatcgcggcagcgcacgccggcgacggcaaaagaggggaaaggcgacgggaccacgagggaccgattcctcagagcaagagcatctacacgacctcgggattgcattcctagcaccggattgggcggagctacaccgagagaagctggcgacgagcggcggcttgcggcggcgagcggcaacggtggtgatgccacgccgggcggtgggaagggcttgggcggcgcccgcgagcttctaggggtactacgagtgctaccacgtaatctaaggggaggaggaggagcgaagagggagaacggaggagagctctaccgagacaggacagggcgctgtgacgagaggccgacggcacgttagtgatctctccggcctcgggccagggaagaggatgaagacgagcgccctgagtccccttccgcgtccacggacgcgctggctcctccggcacgcgtggcaacgaaaggcggcggcgaacagacacgggcgaggcggcaatggcgagagacgaaaaggagagagattggtttggggaggggcttgggtttatagggtggcaatgtcggttcggaaaccgaccttgggtggtcaaagagcgagctggcgctccgacgctcgcggccaaaatggcggcagagggcatgacgccggcgagggagaaaaagaaggaaagaaggagggaaaggaggcttgcctcttgccactttgggaaaagaaagaggaagagaggccggcccggcagagggagaaggagctctgcctccatctcttgaaagcatgcgcgcggtagtggcagggccgggtcgtgacgacgacgatgacggcggggcggtttggagtggagcggcgacaagggcggcagacgcgggctcaggcgcggcaggcgctgacggcggcggcgaccggccggtcggccaccacggcgcgcgcgcgcgggaagcaacggccggtgtggtgatttgagcggcgtcggcgggaagcgacagcgagagcagagagggagggagaagagagagggagagggagagagagagagagcgctcagcgctcgagtggcgcacgtgcctcgcacgtgcgggcaaggatggaggaagggggagagatgggctgagagggaatgggccgggggagaggagatcggcccacgaactcgagggaggcaaaatagactttttcgagaagatttgatttgggagggatttgagattagggtttggatttgacgatggatcggggaattgagatctggaatggcacggacactagacaacatacaaagaaacaattttcgcatttaggatttttaagagatagttttcccactagacgccacgacggaacgggcgctacactatgacgaattatcataagaaactcgcagtcaagggtagtgtctcgaaacaccaggagggcattgtaaaggggtattggttgcatagttttaatactagaaagtatagactaatgatgttggtatactagaagtataggaatggattcttttcttattctttctccacttagtttagtgttagtattagtgagagtattttagttcttctgcttcgtgtcactctacccctgaattaactaacccttgtttagactctgatttataaaagtaacatataaattattagcatggttttctcttataaatcttccatcgggattaaacaaatacgataccttggaatagtctgcatagttgttacaatggtatatccgtacgcttgtggatataatctgtaaccataatatactacggatatttctacgctattgctgggaattatattcatagtaatgtcgttaagaaatacccacgctctccttcactctcacattggatagagatacaacggatatttctgcgctattgctgagatctatattccttattttaatttctaatttctattatttctaaattgtatttctatatgaactctaaacttatgtttcaatatttttttaattacgaatttcagttattgttaaattgcatttctatatgcactctatattcttcttctaatattccttattttttttaatttcgaattttcgttatttctaaattgaatttctatatcgactttaacctctacttttaattttcttattttttttaattctgaattttcattagttctattgtataccggtatggactcttgtctagcttctcttcctatatttttttatttttaatttcgaatttcagctattttaaaattatatttactctttttttttctttttctatgctatgagatctaacgtggaggcttattttttattcctttaataagttaatgtatagattaaagccgtcgttccatctcctccgaccgcaagcatttgtggatacccatccgctggactccttgctcctggccaattaaacgaacatgctgtactgttcatccgtccatcgtgctcaccgcgcgtgtccgcggttacaacccggctttgggtgcggcggcaaccaacacgccaagtttaattatctagctaataattgaatcagctgtaggtatgtagacttaggggtgggcattcggttagactgagaaattcggttcggttttttggtctttttaaaaattcggtcttcagaatctcaagatcgattggtctccaacaaaactcaagactgagaaaatcggtcttcggttagtttggttcagtctcgcggtcatagaccgaactaaccgtgacaaaagtttaacagcaaaaaaaatggtacaagatcgatgaatcaagcaattaggtcatacataacacactacaaattgatgtcaccagcaaatcgagcactatttggataaaaaagaagcaaatcgaacacgatttataaaagaaatcgg

SEQ ID NO: 12218 - DNA, 4104 bp, Oryza sativa
ggagtcgccaaggcggagggcggaggcggagaaggcgaagaaggcgccaacgtggtaaaggcagtagtcggcgccggtgcggtcgaggcaggaggcgccgaggcggcgggcagagccggcgagcgcggtgactgtgagaagggagtgcggggcctgagggagcagtggtagggattctagggttttttttactgggcttattgggcctctaggcctattgggccagttcggtcatctcgggtatttcggttaacggagcccaataaccgaaatactcgaaataaattcggtcttttgctagctgggaccgaatagctactcgaaataaattcggtctcggtcttttcggttcagtctaattcctgcccaccccctatacgtagtatatattattccacatacttacatagcaaatgccaatgcacaagctgagattaactgccagatcatgtaactcattaactcaatagctatattatatttacacgatataatatatgtggaaggagattaattattacgagatacattgccaattaaaccagttgtacatgatttgaggcaagattgcataggtaataaaacatgtagtgcatgcatctggcagccctgttgtaaaaatattcaaaagtatactacaagtcacgacaagattaaatagaaaagttcgtataatataactttttagtaagacgaatgatcagacataataataataataataataataataataataataataataataataataataataataataataataataaatcaacggtatgatttattttatttaagaaaacaaaacattcatgaaactttttggctgcgaagaagaatatataaattggcgtttttttccccatcatgtcctagtacgtcagccggtgcagatgggcggtggatgaggcggcggctggttgacggggaggaagacgacgcgagggcagcgcacggcgatgtcgtacaccctgctgtagacgacgccgattttgaaggacacctgcgcggtgacgacaacgttgatggaaggtgttgtgctgatgagctgggaggcgaggaggttcgactttgtgttgaggctgtcccccaccaggagcagcgacgccttgatgctcgcccgctgcgtcgcggcggcggccggcacgtacgacgtgccgttgccgggcagcggcgtctggagcggggcgcggtacatctgcagctgcatcttgtctttctgtatcgtcttcgccaccaggtccacgaacaccttccggtactgcaccatggcgcggctggtggtgctcctggcggtgacggtcaggttcaggtagatgcccgtgtcgttgctgccgatggcgatcttctgctgcgtcgctctcgccaccgcgaactcgacgtgcaccggccggaggatgacggacacggttatcaccacggcggtcgcggccacggttccccccagagctgccagcacgatcaaatggcgccgggcttgccaagatgatgatgctgctgctttattgtcttttcccttctcctcctcatcatgatgatcacccatgcctagctagctagctatgatcactatactctgtgtgtgtgtgtataagctagctagctactagctcaaatgaaacgggactcatcagtagctactacactactactatatataaacgtatgcatgtattgatcgatcgagcttaattaattaatttacagacgactacatatatactccatccgtcccattatatgtgcagccataagttttcatgcccaacgtttgaccgttcatcttatttaaaaaaaatatgaaaaaaaatttaaaagttaagtcacgcataaagtattattcatattttatcatctaataataataaaaatactaatcataaaaatattttaaataagacggatggttaaaattggacactgaaacccacaactgtgcttattatggaatgagggggagtatatagtatgtacttctctatatcaacgcatatatatagagagagaaaatactaacaaaatactacgaatctggacataccatataatattaggtgatgttgaggaaactccaaattggatgcctaatcatctctaaaaaaaaatcggacccggtcaaatgtttcagttaaccaccggtgaaacattaatataagttatacatgatgaaataaaaaaattagccactaaaatatttttctgtgaaacacggtaaagacaaacgttgaatcatatcgctattacgtatgaaacatcgagggttaatagattgaaacatatgctttttttatcggaatatagtcatgtgatatcttgttgtaaagatttaaatacaacgtagaatataacggtgtgatatcttgttgtaaagatttaaatacaacgtagatcgaatataacggtgtataggactgtataatgaagagatagcaagacacaagtaggttgttggttatagggttggagcgctcgatcagatcggtcgaccaaaccaaagcgaatctcgagtagcattagttcctatatttatgaaggaagggaatagcatcctattttactctagaccgacaaccttcaacttcaactgtcaaattatgtgttggccattgcattgagtacccgaatcggaataaagtcttttattacaaaagttgaacaatcagaataaagagtaaacggaccatggaacttttgctttgctatgctgcttttgtgaaaaaaaaaatgctccagggatactcaatccattatcttctttttttttttacttagtcacatctataacatcgatcgtacacatgttttacgaaagttcttcaaatcgagcgcccgatgcgggcacgtatgcatcgggcgcccgcacctcccacgccatccccaccacgcaccccaccacatgcgccgttgcaacaaatcacccgcaaattacgaaaacgttctattaagggaatccgtttcattttttgttccaccaacaatgtttcagcaagtatactcgtgttgtttcactatgtatagattaaatgttccagtgaattgaaacatcattttgctatttgaaacattgtttctatatatggtgaaacagcttcaaaaccgttgtttcatacgttatatcaaaatatttcatgaggtgattcggttgtgtttgaaacatttttgatctaattagtgaaataattccgatctacttggtggaacagcgctcaatttattttaaaaaaagatcgagcacccgatttgtaggcgccttgcatgttttacattgcctttttttatataattacactacatatgcatgcgcaaacaccattacactcacacaaacgaatacaacctctaacacatatttataaaactataattaaaaatgtattatctttttatggcatgtatatctaattaaaaagtctatttatcccttaagatgacgcccccttgttttttcatgacaccttaaaaagtcataaagaaattgaaaaactttgccgcaatatatcaatatatatatatatatatatatatatatatagagagagagagagagacacacacacacacacaatatgagctggcgtgatgtgtgtctcatgcacacccataatgtgattcataaccaatcaaccataatgttattcggatccctagatataaccgaaaccaaaaatataaaggtctatgggtttgtacaggatatggattttcatccctcaagtgaatatcccctcgttatttgtatgtcatctaaatagttataaaaatgtttaaaaaaattgacaacatatatagattaatatgaaatatatcactccataaacatgcaagaccaaattcaacttctacaagttgcaacaaaaagaacaaattaaactgaaaatagttatggtacaatcccatttatatttattatttttgttataacttgtataagttgaattttaacttgtatgtttgtggagatgatacatttcatattaattaatctatcttgccaatttttttaaaaaaatttattactatttagatggcatgtatgaaacgagaggatatccccttgagagataaaatcactttcctgttagaacaacccaataa

SEQ ID NO: 12219 - DNA, 4480 bp, Oryza sativa
agactaaacctaatactacctccatcctaatatgtgtcccatgcatcctaccctccgttcatagttagagtttattttttttttgggcagaataatatctatcaatatttttttttggggggacagaatagtatatatcaacatttagggacggagcaagtagcttctttcccatgcatccatagctggaatcagatgctatatatattaacagaaagctagcttgggttccatagatagaagctagctgaactgaagaagtagtacgtagctagtgatagtgaagctagcttgggttccgtagatatccatatatatttaggcatgagcacggcatcggcaggcgtcggagcgaaatcttcatcgagctggagtagtagtacatttttccggtggatcaaggcgttgaggtacgtagttgcggtggcggtgatcgtggcgatcgtggtgatgatagcgtactccatcaagatggtcgggcgagagagaccgctggtggtgagtgtgaccggtcatacggtgaaggtgcagcggccgtcgaacatgtccgggaacctcaccttcgccttcaccgtcagggccgccaacaccggcggcttcggccaaatatactacaccaacatcaaggcgttattggccggcaggagcgcgtcgtcgccggcgtcgccgacatacttcgtcaaaacgggcctcttggacatggccgtgataccgcggctgacggccgtctcgcagtccttcgtgatgtccggcatcggtgccaacggggacgggacgatgagctccaaggatctcaggccctacttcatggacttgtacaagggcaacaccatgcgcgacgccgtgctccggcttaacggcacgctcatgaccgagatctactccggctacaacagcaccgcccgcaccgttgtctactgctgcgagcccatcttcgtcggcgacgacgacgacgccccggacacgcctgagagaccctgcgtggagcagaacgaccattccatcgacatgacaaataaaaaaaacatgctaagctgcgagctcagctagctcgatccatcattaattattcgatccttatctatatattttcatactaattaatttcttcgacgctctattatatatttaattacgtacgtatgttccgatgtatccatctctcctgcctctctctatatatgcattccttttgcttgccgtttcctcactttacccacccattcaattaatgaaaatggcttcattttattcacgctaccagtgatatttctttttttccctctctatctctcatttttatataaactagaaaaaatacccatgcgttgcaacgggtaaacaagagcttagcaataaattaaaatattaggatcactatacattataattgaaaaggttaatgaaaattctaacattagaatcgctatatatagattataattagtgaaaatcttttctgggttttgggccgaaagctttccttcctttttagccctaggcaaatctactatctccctctgtttggcctgcttcccttcaaccagggagtagtggaaccgtaaacccaactcgcaccgtccactaccatcttcaacctcccgaagatagtcccatacggttgactgtcacccaaaatctcctgaagatagaaccatacggttctgtcacccaaaatttgttgatgatttttgaaccactcgatctactctttcccctttttttttccaaaatcagagcgtaaaactcgtgataaaaacgactgggaaagatcaacgtcatcattggtaactgttaaacggagattaaatccagcaaattaaagccgagtcgaaagtaaaaatcatggagaaaatgatgagggggagggggtgaggaatcgatttttgcaatcaaattggaggagatcgaaatcgatatggcggcggcaggaggcgtgcggcgaacatatcggattaaaaaaccggatgagtaaaaaaagcgcacgggagaaaaaatagcgacaaaaaattgatgaaaaaatcaaaagcgcccaagaggcacgcgttgaacagatcagaataaaaaaacagacaaaaaaaaccataagagttagggcgtgggcaaaaaaaaataaactctttcgtgtgctaaaaaaaagtcgggaaaaaaactggtgccaaaaaaaccaaacggactttttctttttttgttactttttttagtcggaccttttttcctttttttacagacgaagaaaatttattgttcttcttaagtaacgtagagatagagattgaaaacaaaacataaaattaaagccgattcaaacatagatgatgtaccaaactactagcaaaaatatctttaatttttataatattagagaagagatatatatacactccctccgtcccacaatataaaggattttgggtggatgcgtgtgacacatcctagtacaatgaatttgaacatatcatctggctagattcattgtactagcatctattacatccacccaaaatcccttatattatgggacgtagggagtatatatgtcctctcattgtttgcatatcacgcaaatggttatgaaaaaaatctaagaagatgtattaacatgtgatatatcactccacaaacatgcaggttaaaattcaacttctacatcttgcaaatttgttttttttttgttacgagatgtagaagttgaatttgaagttgcatgtttgtggaccaatatattacatgttaatacaagtcaatagtattaactcatctagggtttttacttctactaatttaaatataatatatagttttcctatcggtttagtttaaaagaacaccatccattgatttaaatattgacatttaaaacaagggaatgcctataccacattcaaaagaaaatccccctcaatttcaatcagattttggtctctaatatttgtgctgccatagggaaccttatttctttccgttcttccccccccccccctacatagtcttcttctcccaaattgcgttctcgcgtacgatgcttctgccacctcctccccaccccagcgcgccacccatcgcctagccctcaccggtagtcaaaaggtacgaacggcgctgacgaggcccaccacaccagccacctaccccttcccaactctctcttttctctctctccaacttccattgctaacccaccaccctccttcatccctgtggctctagcattgccactggcgcctcggcgcccgcccgtgtccaccacccaccaccgagccgctgcctctccgaccattcctttaagtctggagaaaccccctcttccctatcccccaaccctccttctacccccacccccaactctagaccctaacttggtcagggtcgccaccatcggtcgctggagttcatcaaggtcgccaaagttggagaagaagcccacttgagcacaaatcgtgaagcagatgtgaatgtaaaaaatttgcaagatttggttctcatttttctgtcaaatgtagtttagcaattccgttaaaacaatatatgcatgcagattcctctcgctctctcgtcgcatagattatgtcatcatcgtctatagctcaatcaactttcaaattacgatacaacattttacctatagaagtcttaaaaaaaggaacaattattaaaaagttaaacatttgaagttggactgtatacattctaggacagtgtttaattaaagtggtacatggtagtactgttactactacctgaaaactcggagcttataatggtagcttatgagaacttggacaacttgagcctcccagcctcagtgcctcacatctgggaatatagagataaacatagtgtgtctaaaccatatgtcctggtactagtaggtccttgatgttttgccttttttaatttggtcatcatatactaggattctttttgagactttgtccctttcatttacatcttatcataccaaagtatggtatatatgtgtaggatttctgtacgtataatactccctccatcacaaaatgtttgacgccgttgacttttttaaacatgtttgaccgttcatcttattaaaaaaatttaagtaattattaattcttttcctaccatttgattcattgttaaatacacttttatgtatacatataattttacatatttcataaaagtttttgaataagacgaacggtcaaacatgtttgaaaaaatcaacggcgtcaaatatttagggacggagggagtatatttttattctttttggaaagtatacagctttatagttatatcaacatgcatggttgcatggaccattgcaacaatacacgggagggatatatgcggagcggagcgagcaacacctagcttacacacacacacacacaaagcttgctaccaacagtgtgtaaagcgaaaggtttgcaacacaagatgtgcaacgaaaggcagcgtgagtgtggatcaggggcggatccaacgtgggtgc

SEQ ID NO: 12220 - DNA, 1869 bp, Oryza sativa
caaaacgatcaatgaatttcataactaagtattcgtaagaaaaagaaattcagcttttgacaatatataaatacatacttacagatcactacagtataatacaacacacgtgatcgatgctctttttctttcaccaagtttaaaccttttcctttgatcagtgttgaaaaagcaaacaaggtgtaagccagttgtactgagatcgagttgttgcatgaatagctggcctctcctgagaaactatatatatgtataaaaagcatcaagcatccctaaattaagacagacaacgtgttaatattcacacgtgctttttgtggtccaaattaataattaaggacgatgtagtagcttccaaagctcaagcatctatatatttctgtacaaaaagaagcttaagcatgcatgattggcggcatatctaataaagcaagatctcgattgatgccaagcacctagctaggaggagtactggagttaagcaaaagccaccaaattatatttgtgtttaattggaggagagagaaattaaatgtgctatagatatagagccagctagctacaacacgagctcgaacaaattttgttagagaaagagctaagtcgggtattaatggtattagtatttacatgtactctctctctcagtttcaggttacaagatgttttaattttggttaaagtcaaactgttttaagtttgaccaaatttattatgaaaatatattcaattaattattgatttgatgaaaataatttagtattataaatataactacgtgtcgtctataaacttagttaaccttaaaacagtttaactttaatcaaagttaaaacgtcgtaatctgaaagggagggagcactatactttgctttagcatgcacgtggagaggcaaatgatctgtccttgtccttcgcaatactttactttgagcttttcgtgagacggatacacacacataaatctacaacatcgaattaatttaatcaaatccatcattcaatatgtttttatggtatatttattttgggttaaaatattgctatattttttttaatttggttaaactcaaagaggtttgatttaggacaaacctaaagtgacttataatataaaatgaaaggggaatatttgttttattttagcatcgtcttcaaaaggttttattttagaaacagaggtttgatttaggacaaacctaaagtgacttataatataaaatgaatggggaacatttgttttactttagcatcatcttcgaaaggttttattttagaaacagagtacaaacgtacgcgctcacaacgtgcacacaggtgtctcgctgtcgacgggtatattgggacaactaaaagaaactagccgtaaatatgagcactcgtgttaagtgaaactctgctctgcctccgcatgctcatgtggaaaagggatccttttggtggaaggatgttttcagattgattccaatttgtagagccatttctttggtacatgttgggcttggtgacaacgcttttctggaaggataattggtcagggagttttttacatgatgatcgagcaccctattctcatttgctaaaaataaggacatctgtgtcaaaggttttcaatctctgagtcacttagaagaggtattttatactccactccccatccaagcaattcaggaatggcaccttctttccagcactgtgcaacccttaaatttaaatcatatggaagatcaatggacatacatctggaactcacctcaatatcaatcgaaaagagtttatgacatgttttttactcatattccccctgaaattcccttaactctaatctaaaaaagcaaatgcacactcaagttcaaagtgtttctttgg

SEQ ID NO: 12221 - DNA, 8126 bp, Oryza sativa
tgaaaacatttcaatacccaaggtggagctacatgtgttacatgcaacaactcaatcacagaagactctcttcatctcttcttcgtatgaccctttgcccagcaatgttggcatatcctcggtataaattgggatctaaacctgaatttcatgaacatgatcattgcagcgaataggaacttccctcatcccttctttatggaagttttggcaatctgttgctggcatctctggagtagacgaaatgacttgatcttcaatggtattcaagcaaactttggcaaatggaaggctgatttcaaggatgagtttactctgcatatgcatagtgtaaaggaaacagaaaaacctttgtggcaatcatggattaatagcatatcttaattagcttgcctttcaggcagtctttttcttctttcttttttccctcttgttgtacccctgtacagtttcccctcgtatattggctcttttaataaaatgtgcagtacgagcctcttctgctgttttaaccgtaaaaaaaaagactctcgaatagataaggcgcactgtctccatcttgatcttgatcggctgaccgtcgtatcagtgacaggttaaaaatcaaaccagttagatgtgatttttcatctctaacgatatatatctaaaacccggtccttaaatgaagcccatcatcgatgacccctcaacttagagctaattcaacttaggtggtaacggacgaatagcttgcacccgtcaccgttgacccctcatcggtgatggggtttggttgaggcccgtcacagatgtcctgtgtcgggctgcaaattcaactcgtcaaagatgaggggtcatcggtgacgggtttggccatgaggaccaatattcaagagggatttttttggcccgtcataaatgagtgcctctataacgggctgctgactgccgtcatagatgggttgttcaggatgctttgttctgtactagtatatcatttttttaacaacggcaaagcttgccatttattgaataaagcagggagcaatatttacatgtaaggagtaaaagtaatatttacaaagaccgaataggcactaaggtaacatctctgctaggcgtttggttccccccgtagcccaggttttttactcttctttaatctttgcggtgaggggcgccgtgcttagctccttgtttcggaagattcggcgattttgctcgttccaaatttcccaagagattaggagaattagggatctggtccccagctttggtaacccttggcatgtggcgagagattcccaccattcgtgaaccacgctcgcctgtgcccaatttgtcggcgccatgggcgcacaggctaaccggttgacaatggcatcccatattttcttggtgtatctgcagtctgccagcaggtgaatagcggtctcattagtgtgtcggcatagcgggcaaacatcgttgttctgccatccccgggtcgccaatctgtcggacgtctagattctattttgaatgattagccatgcaaagattttgcatttgcacggtgcccatactttccagattaaggtttcaaagtttgttttgagcgatccgaagaattgtgccttgtaggttgaggacgttgtgtattctccatgacacgtgagcttccaagtgattttgttgtcttcatccggggaaagtgtgacctgttggattgtcgtccagagagtgacaagctggttcaggagctcaattgtcattccatcattgatgggtaaggcttggtcatctagccactggccgctttcgattgcctgcgcgagtgagcggttcttccgcctagatatcgagaacacgagtggtgccacatccttcggccagcgcccatcaagccatgcgttgtcccagaattttattgtgtctccattaccaatcttaattttcaaagcagacgcgaataggagtttatcgttctggtcacacggtgtctccatccccgcccacgctttttctggtgactttcactcatgccaaaaccaacggagtcttagagcccttgtgaacttgtcaagattcaggattcccaaacctccattcaccgtcggtgagcagatcttctcccagttgactttgcatttgcctccaataatatcaccagaaccagcccacaggaaacgcttgcgttgtttatccaggactttgagggatccttgttcaccttgagagccgttagcaggtaaaccggttgcgaggtgagcactgatttgaccaaggttgttcttcctgccagacccaggtttttccctctccagcccgccatgcgccctgctgacttatcgaagaggggctgtgggtgaaccttgtgcagccgccctagcatcaacggcaggcccaggtattttagtgggaaagttgcacgtgtaacctacgactcctccaggatgttatcgatgtcaagatcatcacacctaatcggtgccaccaaggatttttgaaagtttgtgcgtagaccagtagcatctccgaatctttgaagtaggtttgtgaaggcgttgacatctctgcgtgcatggcgctctccttcctgccccggatttgggtatgtagcccactagtatatcatatttagttatggctcggtatatttttaatctttgtacccccattgaaaaatttctactgctgccactattcaaaagcgtgggtgtgcgtacatttgtgaccgcttgtgttcactacaagaaatcttatgatagatgacgcttcatttacatcaaaaaacataaaatttcgtcacgttttgtaatatgtgacgctcgcgtgacgaaaattcatccgtcacctatcatgcgtctctaatagctccgatgtcacgagaaattcatcacagaaggtcatatttcttgtagtgttgtatcgtgtttagaaaaacaacttaggtggtgtttggatccagggactaaattttagtccctatcacatcggatgtttggatactaattagaagtattaaatgtagactaataatataattaattgcataaatgagagctaattcgcgagacaaattttttaagcctaattaatccataattagcacatgtttactgtaacatcacataggctaatcatagattaattagactcaatagattcatcttgcgaattagtttagggttatggaatgggttttatcattagtctacgtttaatacttctaattattatcaaaacaaccgatacgacaatgactaaaatttagtctatagatccaaacagggtcttactcttatgacctcggaaggcagctagcacctcaggaatcttggttgcttgccgtttgccgacgccttcataagagaactcgatcacgattataactccatcttacttcttaatatgtccaattatccatgcaatcaagcatctagagtgctatttaagaattatcttctccatgttcttaaatcaaaaggctcaattaataaaggcaagtttttatattacacataaatatgggtgcttcctcgagcgtatatcaattaatgcttcaagattagcacccatattatatggctctctcattttcataatttaagtcattagttttattctaataaaactaatataggtttgatcgagtttataaaaaaaatacaccaatataaaacgccaaaatatttccacaaacacaccatgcatgatatatgttttaatagtgtatttatttaatttattaatttagatgttgtattcatcaaccatctcggtcatcgttaaatgagtttgacttagaataagactagctaaaatgacttacgagatgaaaaaagagataaaaattgttaactctttactatcttcatcccaaaatataagaatttaaaatcggataaaatattttctaatattatgaatctgaataggtagcttgtctagatttgtagtatcccatctagttagatacttatattctgaaatggagagagtaattagtaagtagagtaataataagcatctgccttggagatatgatcaacaacaactctccattattttgtaaagttattccctacgtaccacatgcacgccatatatataatgcctttaatgccccccccccccctatatatagtcgaacagggagctagctagacttggcacagcacatcatcatcagtagcacagcacaaatacaggagcggcccggctatggcaatggcttgtgcagcactagtgccgttgctactgttgcttcttgttgtgctctctggctctacatctctcgctgaccacagtgcaggtgtagatgaggtcaactacatcgtggtgctaaccagcagctggctcaagccaaattccgtctgctccagcctgagtaccgtcttaatttttctctctcttcttcctactctctccgtaattttttcatatataagtttatccaaatttatagaaaattagcaatacttctaacacaaaacaaatatattatcaaaatatattcaatgttacatttaattgaaaactaatttgggaccgtagatgttgctacgtccttttacaaatttaatcaaacaaaaaaactttgactagaaaaaaaataaaaacgactttatatatgaaacagaggtagtagtacctaagattaaaacttgaacgtttttaataagtagttaagtcagagcaattatactatttcctcctattataaatataaatcatttatcttctcgactctttactagactttgccgtcgttgggcaacttttaactatatattcttccttgtttaccttggtaaataacctctctaacaaatgaaacgaattattttggcatttaataataattattattaatatatcatattaataaatataattgttgtacgtggatgttagtgagcccacaccccaacgtgaccaactgggtcccgttgagccgaccgtacgggccgtgcagctcctcgccggcgaagggtagggcggcgccgtccaccgtcgacggcatgctctggtcggaccagcaccgcgccgactacatacagtggaggctctccggctcggtcgccggcgtgctgcagccggccgacgacgtgccggtgtcaactaactacgaacagcagtccatagaaggagatcttaactatggcacgtactaccctgcacctgcaccaatgtcatcaaaggtaaaattatttaacccacacatatgcaaaaagaagtaaaataattatataacaataataataattaacctattactagtaattaattagaaagctaagtttatataattaaaaaaggttaataattacccacaatatataatattaataaaattggctagaacttcttatgcattattgattgatctgatgaaaagaataatagatctagaacttattacattattgacgtacatgctgcttatcaaattcaaattcaacttctacgtatagtaacgaaaaaaataaatttaaccttttttttttacaattttcctttttcttcctggaagtatcttcttaagggaggaagagatttcctgttgttgttgtttagattaaatgagagatcaagatgtagtaaagaactggattctgatgttataatttattttttcttttatatattaataaaatcttaacggtggtggctttccctgctgtggttcttaaaaaaacttcttttttaagatgtagaagttcaatttgatcttacatattatttgtgcagtgatatattacatgttaatacatcttgtcaaattactttttcataaccatttaagtgatatgcaaattaacaacgtgaccggacatctcctcgagggatcgaaatatattaaaacgtactcacatgctagctgtccgatctcaggcgatgaatccggccgccaccggcggcggcggcggcgggccgggagtgacccagacgatggtgctggacacggcgagcgacgtgacatgggtgcagtgctcgccgtgccccacgccgccgtgctacccgcaaaaggacgtcctctacgaccccaccaagtcgtcgtcgtccggcgtcttctcctgcaactcgccgacgtgcacccagctcggcccctacgccaatggctgcaccaacaataaccagtgccagtaccgcgtccggtaccccgacggcacgtggacggcgggcacctacatctccgacctgctgaccatcacccccgccaccgcagtcaggagcttccagttcggctgcagccacggcgtgcagggcagcttcagcttcggcagcagcgccgccgggatcatggcactcggcggcgggccggagtcactggtgtcgcagacggcggcgacctacggccgcgtcttctcccactgcttcccgccgccgacgcgccggggattcttcaccctcggcgtgccgagggtggccgcctggaggtacgtgctgacgccgatgctcaagaacccggccatcccgcccacgttctacatggtgcgcctcgaggccatcgccgtcgccgggcagcggatcgccgtgccgcccaccgtgttcgccgccggcgccgcgctcgactcccgcaccgccatcaccaggctgccgccgacggcgtaccaggcgctgaggcaggcgttcagggaccggatggcgatgtaccagccggcgccgcccaagggcccgctcgacacctgctacgacatggccggcgtccgcagcttcgcgctgccgaggatcacgcttgtgttcgacaagaacgccgccgtcgagctcgatccgtcgggcgtcctcttccagggctgcctcgccttcaccgccggccccaacgaccaggtccccgggatcatcggcaacatccagcttcagacgctcgaggtgctctacaacatccccgccgccctcgtcggattccgccatgccgcctgctgagtccggccgccgcccccgacgtctcgatcgggactctactactacaggccggagctgctcttgctccggtgataccttttaattttcataaagctcgagcgctcgcgtctttaatttgattcctcctatttatttttgcgtatgcgtacacgtgctacaagatcagctggctggcgtcatgtatgagccagattagcggttgctttgatatgtactcttccatccatgtgggtatatatatatatatatatatatatatatatatatatatatatatatgcacgaagaaataaaacttaatttgtttgcctattaactgtactgtacaacccttttcgaattcgtcatctcatctttaaaaaacctcttctaatttgctgctgtcaaccagccatacacgcatgggttgtcattcacaggggtgcagggcgaccgatatgatattttggtccaatgcatgtatctgaattcttctagatatgaagcacttcgttacagatatggatatggattaataccctagctagtatgtcacaatttatgtgttgcattcttctgcatgtgtggcattccgtttcagagatgaatgggcttatctgaagaatcatgcttgtaactttttttttaacgagttctattgataaaacagaaaaaaattacaagattatgacactggagggttgtagccaggaaaaagaaaaaattataccaccacccacacaccgacattgccaacacacaagcccagcagaaggctagcaccggaccggccgccgctaagcgggatcgaccgccactagactaacaaagggacccacggctagcgcaccgatgctccaccaccatactagctctgccgacatataggacccctgcaccggcaccccccgccggccagccttcgtgcgccgaagaccactccatacacaccagcagctcctcctcacacctaggtcgcctcctccaccgccggccgtgcttctctgcgccaagccggcctcctccaccggacgcgcctctcgcgccaagccggcctccatctccgctgccgtgcctctcgcgccgagccgacctccgctgccatcgactgcgcttctctgcgccaagccggtctttgacctctccaccaaatgatgtcgcgctagccagatgcagccatctcccacgccctcggcaagccgtctgaggccaccatgcctctgatgaccgcagacacggtcaccaccaccgca

SEQ ID NO: 12222 - DNA, 2001 bp, Oryza sativa
gacagcaccacctccagtagctcctgccgcggctgacgccgccgcagccgccgcgacgggcgctcatgcacagagctcgccttgctaccgccaccaggtcgtcgcgagctctgctgcccccgccacgagctcgcccgatccggcagccgggtggccagatccaccgctggggggccggacccgcctccagtgcgcctggatccggcgcctctgccgacgtcgccaccgtcgccatccccgccggcgtcgacccagcctctgccatccccgccgccgtcgacccagccgctcctctaccgtcgccgtcgccatccccgccgccgtctccgtctccgtctccgccgccagccgccagctgccacaccgccagatccggccgaggcggcgcggatttagcggtcaccgtcgccgccgtcctgggctgctccccttgccgcccgaaacgaggcgagctcgacgaggaacgaggagccccgccgccgccgtccttgtggccgcgcggctttgccggcggccgctcaggcggcggcgaggcggaggaggaagatggggggagggggcggccggggttcgatgcctcccgtgctgcccctaggggagggcgatgcgagagcgttttacaaaccactatgctagtaacttgcagtgctagtaactggtggatcgcttgcatgaagtaaatattttgccctcaagctgccactcttatatatttaagtgaaatcccaatctgctaagctgccactcttatatatttaagtgaaatcccaatctgctaagctgccactcttatatatttaagtgaaatcccacccttgtatactcttatatagcaaaacaagcatagtggcccgcgcagattgcgcggctagcatcattatattttctctcatataatagtatatatgttttctcattatattattcaaatatattaaaatgacaacataattttaaattttgcaataactttacaaaactactaatgtgtaatatttatattatattttatatacgtgttagttattaattatttttaatatcaaattttagttatttgtaaattatatatattcctatatggactctagactcgtcttttaatatttctttttttaattccgaattttctgtaaattgtatttttatatagagtctatgctcttcttccaatattatttatttttatttatgaatttttattatttctaattgtatttctatgtggactctaaactcatctttcaatattctttaatttttaatttcgaatttcagttgcttctaaattatattccaatatttgtattcctatattgaccttaaattcttcttccaatgtttttcttaattttgaattttagttatttgtaaattgtatttttatacagactctaaactctacttttaattttattatgtttattccaaattttagttagttttaaattcctatatggactctatactctacttctaatattccttatttttttaattccgaatttctattttttttctaaattgtatttctatatatactctatactttacttctaatattccttatttttaattccgaatttatattatttcctaattgtatttctatatgtactctatactctacttctaatattccttatttttaattccgaatttcagttatttcctaattgtatttctatatgaactctatactctacttctaatatttcttttttttaattctgaatttcagatatttcctaattgtatttctatatggactctagtctcctcttctaatattcctttttttcattccgaatttcagttatttcctaattgtatttctatatagacagactctagtctcctcttctaatattcctttttttaattctgaatttcaactatttctaaattgtatttctatatggactctagtctcctcttctaatattccttattttttaattccgaatttcagctatttttaaaattgtatttctatatgga

SEQ ID NO: 12223 - DNA, 1549 bp, Oryza sativa
aacagtcatattttgtatgtaataattttctagaattatttggactaatatattgtcgacgttgtagatcctgactacgatggtgctggggtatacacgagatcgaggtaaaaaagacagagacaaggattttatactggttcaggcaagaagccttacattcagtttatatgtaattatgagaataggtagcaattacaaaggagaacaactgagtcacggaataccgacgaactcccgtcaagatcagtctgacgagaccaatcggtgatatggctgtgggtcctccagattgctttggctatggcgagatcaaagatagcgctagatccatcttgtcggcctccaatagcactagacggggtctgtttaggtttatctctaatgtcgatatcttgcggcgagtgttgatctctctatgttcgctcccctctctcctcctaaggggctttatatttatacccacagatatccctttgtctaagtaggactacggagacaagtatggatacgatccgaatagttcatgtggaactctgcttctccctccttatccgaactccttctatatacgaggtaaggttccgtataaaaaatggtatatggtgggtcccatcgagcttaattgactagtattgggtatgtgttctctataaccctgacatatataacttgtaacttctgtagatacaatcattttttttagacaactaaaaaaccgacatacaccactataattttgatctactacaagggaatggtcggtgtatttcctttttctattaaaatgttaatttcaaagccttagaaaaaacacggtggtggctttttttcaagctattttgataatacaaattaaatactttccctgcatgcatttgtatggaattataacttgcaaaatacaggtcatgcatgcaactttttcagtaaattgtgcttgtaacatcattattgtaccacggttggatgggactccagaggagcaaagctcatgccgtgttggcatttgcaaaaaaaaaaaaaaagaataagaaaagaaaagaaaaagatctcctgggaagaacatattcatagttttgtttctgtttacgtacaaaacatgaagtcatccaaaaaaacacgccggaactaagaatatcattaagaatatccaaaaaaagactcagtgagagcgatgccaagatgtgtgattgtccgtcttcgccatgtttattgtctcacgtatgcaaagtataaactggttacaagtacccggtccttattagctaaagtataaaagaacatggtaattattgcaatttgcaagcaccacatgcacagccttgggagtcggcaatctattcagaacaagacatcgatacaaattaagctaccaagtacgaactgatcctatttaattacctatatatatccttttcgcaagcaaaattaagcaccaccccggtggcttcaccactgaccatataagttaaaatgaatcctcatgaggccccttcatcactacttccaacctccaatgacagctttggaagtagggatgaaaacg

SEQ ID NO: 12224 - DNA, 3077 bp, Oryza sativa
atacggattatctcgaatacgaataagaatcgaatatgaccggacacgaatacggaaacaattttttctcggtacacgaaaaccaagttaacttctaatagaaacaaatatcaacttatataattagctcactttatattaaatgtagtataatttataaatatttttaaaaatttaaataatattaatagtgtggactagtgttaagagataaaccactattaaaatctaaaaatgtatattgaaggtcatagagttataaagaaatggggtatgtctcatggcttctgcggatatccgaatagcactgttcactggatatccgaattattatccgtatctgacggaaatcccgataccatattcgtatacgtatccggcaaaaaatatccgtatcagaactatccgagaattatccgatctgaaaggtatccgtattcgtttttcgccggagcggacggaaactatccgctccgttttcatccctatttggaagttcccaaatgactgcatgggaccactttacctcgttctcttagagcaagtttaatggtatagctaactattgactattagtctatattatagctaacttggagtataatagattaattataaggttggctctattttttatattctctttttctttccctcactatgaatttaatgtaaatatcttggaacatgtgtatagctagctcttgcattagagccaacacccctcatttttctttatctctctcttccacgtaaacattggcatatagcccactattatccttgctcttagttgtactaaatggttcaattttcgatttgttatactaaaagcaagtttaatagtatagctaattattggcttttagtctatactatagctaacttgtataatagattaactataaggttagctctatttttttattctctttctttctcttattcataatgtaaatattttggaacatgtgtatagctagctcttgcatgagaaccaacacccctcacttttctttatctctctcttccacgtaagattatagttgacatatagctcactattatccttgctctaaattgcatccacacatctctcactatgaatttaatgtaaatatcttgggacatgtgtatagctagcttttgcatgagagccaacatccctcacttttctttatctctctctttcacgtaaacttatagttggcatatagctcactattatcgatccttgctcttagttgtactaattggttcaattttcgagttgttatactaaattgcatcaacgtatcgatcaaacctgcagtgagctattgatgtagattatagtttttttatacaattattagtgtgcggtattttctctctctaaccttttagtccatgaaatactttttttcaatcgcagactcaacttttcataactaagatccagactagactagctagcatcatcaacagcgcggtgagtttactagccattatgcatctgaaaaaataaccactagcggcaggagggaggcaagcctagagtagttagggcttgagctctaggcttctccaaaattataagtaaattaccatgtaattttagagaaaataaataattcattagttgagtcctagctaggttagtcctagtgtttagtaattatttctggttttgccactaaccaccaggctttagtaaatattgtagacgttgtgagctgtatagctgtcgtgacgttaattctgtgggtcaaaattcactcgctgacatattgaaaggtagatccggctccttgtgtactccctccgtctcaaaaaaagaaaccctggttttcgtgtccaatgtttgaccgttcgtcttatttgaaaaaattacgaaaaaaattaaaaagacaagtcacgtataaaatattaatcatgttttatcatctagcaacaatgaaaatacgaattataaaaaaatttcatataagacggacagttaaagttggacacgaaaatctatggtttgccttttttttgggacggagggagtatgttaacatatattggcaaatgtggtgtagcagaaaggaacacctggccagctgcccagctcaaaaggagctagctaggatacagaacggatccgttgtcaagctttggggttaggaccattaattatattggttccttttctatcttttccgaagcatcttacaaactttaatttactttgtgtacaccttaattaaaagcttccatccgctttggatcttcaccatctgatcttgtgaaataagagattttgccactaagcaatgattgtaccatctcactttttctagttctggataaaccaataattcagagtttccgataattttgttcatctcaactcacaatatataatcaactaagacaacatgcaatgcacaatcacacgaaagtgcattatatattcatctcggtcaatttgttcacaggaatccacattgtttcttctatgccctagctacctatattaagcgcttcagtcctaaggacttctttgtttggtggcatatgtaccaatggtatatttcaacctaaatggtttttgcggttgcttttgttgatgagttccatggtttctccccctatgaaacgtagactcccagcccatcccatagcttccgaggtatctagctaattaagagaacttcaaagggaaatttaactattggccactattaggtttgccaattatctaaatacccttattagatttgtccttattttttttacccctctaaagtggtggcatcttaactatttgtcacttttgcccatgtggtatgccaacatagcaacacagtgtaaaaatcgacgtgggacccacttgtcagtctcacagctctccccttcctctctctccggtctggctagccccgtcggctgctcctctctttcccgcggcgaaccatgtcggtggtggcggcggcgtgccggctcgtggctgcggagaaggagggggagccgagcgccaccgggagtccgacctcggcagttgcgagtgaactagctagatggattttcgcttgtgaccccactgctctatg

SEQ ID NO: 12225 - DNA, 974 bp, Oryza sativa
actatcaagaggggttatgacctaaacaaagagatgatcaaaatgccacattaggtcatattgcatttggcacactttattttatcaaaaaccctgagtttccgcctgggccggtctgaccgggcgtgtaccgccggtctgactgcaggcatggcgccgatttgaccggccaggtagcccggtctgactggccggctggatgccagttgggcgcctctggatggccgatccagagccgccagagacgcagccggtcagaccgagccgatggcggtctgaccgagccgtggccggtttgaccggcaactctggtgcggtctgaccagccatgtgtgtcaggtgtattaaatgcacggcaacggctagttttctagccgttgcagagtagtccggtctgaccagccactatatgggggtctgatcggcactgcagtgaggttggggatttcgaccccaacggctagtttttgtgggttgggctatataaatccccccaccagcagcaagggatctctcttggcacttgcttcacttgcatacatcccttgcacactctctcacacactctagagcttgtgttcatctttgtggtgtgattgagggttgattagccaagagtcaagtgcatttgcttcattctagagctagtgtggcacttgaccaatctccgagccgggtcatcgcttattactcttggaggttaccgcctcctagacggcttgtggaggagttgcccgatgaccactccgagaagattgtggagaaggcccggcaccgtttgtgagtggtttggagttcaccaccttcggagtgaaggaagaactaccctagtgatcgaggcttgggtagtcctctccgtgggccgggtcccaccttgcccaccccttgacgaagggggtgtgcggtggcttcgtggttgagcggtagagttgggctcgtggttgagcggtagagttgggctcgtctcaacaggg

SEQ ID NO: 12226 - DNA, 1614 bp, Oryza sativa
atatttggagcattgtgaatgtaggttttgttatcacgggaagccccttgatggaggttgatcatagagaccttctactcaatgctcaagcaatgaatgccttgttcaactcattgagccaagaagaatttgatagagtgagcaaccttgagacgacttatgagatatggaacaagttgagtgagatacatgagggcactagtgagtacaaggatgcaaagctccatttcctcaagatccaatatgagacctttgccatgttgctggatgacagagtaaatgatatgtatgggaggctaaatgtgatagttaatgatctcaagggtcttgggcccatcaacaccgaccttgaggtggctcaaaagatgcttagagctttaccggacaagtataagacccttgtcaccttcctcatcaactcgtacatgtcaaggatgacacccgctagtattttgggcaagatcaacgccaatgacatgtacaagttgaagaagaaggagatggaaaaagcatctccatccaagaagactagcattgcccttcaaaccgaggtggaagacaagggaaagggcaaggtaaatgaaggcaaggatgacttggatgaagagattgctcttcttactagaaggttcaatgacctcttgggaagaaggaaagagagaggaagagggtcaaacaccaatagaagaaggaatagaagacccaacaagactctctccaacttgagatgctttgagtgtggcgagaaggggtactttgcttccaagtgtccttccaagggtgatgatgaggacaagtcatcaaagaagaacaagagtggtggatacaagctcatgaagaagctcaagaaggagggcaagaagatcgaggctttcattggtcaatgggactcaagtgttgagagcttcgattctcaatccgggtccgacaacgagagtgatgatgatggaagctccaagaagaagaacatggccggagtagctatcaaggaggctccatcactattctctccattttgcctcatgccaagaggctccaccaaggtaacatcaagtagtgatagtgaaagtgatgatgatgttgatgatatttcctatgatgagcttgtgagtatgtttgaggagctccatgcttatagtgagaaagagattgccaagtacaaggctctaaagaaagatcatgcttctttggaaaccttgtatgaggagctaaagacttctcgtgagagactcaccatttctcatgagaagcttaaggaagctcatgacactctccttaccactacccaacatggagctcacattgatgtttgcatatcttgtcatttgcttgatgatagtgcttcttgtcatgctatatattttgcatcatctagcatatctacttcatgtgatgatcttatggatatgcctagctctagctctgtgcttctatttgtgatgtttcacttgtggttgtgaacaatgagctcaaggagcaagtggccaagctcaacaagagtttggaaaggtgcttcaagggtaagaccactcttgacaaaatcttgagtgagcaacagtgcatccttaacaaggagggacatggattcattccaaagaagggtaaaaaaacctt

SEQ ID NO: 12227 - DNA, 756 bp, Oryza sativa
caaccgacctgaccgccttagcttggcggagtgtcgggcgccgccccccgcggcaatggcctccccctccgcggtagcacagtccagctcccgccgccgattgccgtctcgccgcgccgccacctagggtttgcaaatggggagtggcgcgagggagccgagccaaggagggatgggtcacggagggagagcgagagggggctgtctgaaagagtgctagctaagtgggtcaactgatgtttgatgggtcatgacggagtaggtcgggttggttggaggcatcgcaagagaccagttgtgctatgtttggatcaaagagttgaggatttaggtgtacaaatatgtgtacatgtgtatatactagaagtatacttgttttctgataaaaaatgttgggtattcccgggaatacccgggaatcacggtggctccgccactggattagatcagtccccttttgcctcacgtcgcgtaatattgcacatctggtttcacgtacacgatactgtggataacttgtgttgcactcttggcatgccttgagtcaccggccggccttgatccacaccaggggcggatccagaaacaaaaagttggggggactcaacataccgagtacattgatataaacacataatctcagtattaaactatgctaaaatgctattataagacctttagcacctcctatcttatcaactatgatgaaaaaattgaagggagggcttaggggggtatccatgggttttgtgggtg

SEQ ID NO: 12228 - DNA, 185 bp, Oryza sativa
catttcctaaaatgatgatctcattattaactattctggcaaaaccgctccacagaaccgccgttaaccattgatcgttgaggaggcgtattctcaagggacccatatataaaactgtgttaatgggggcgtggtttggtaatacgccaatttggccactattagtagataaaatgatttctttc

SEQ ID NO: 12229 - DNA, 516 bp, Oryza sativa
atgcgaggagataaaagttaattcagaaatcaaaactaattgtaagattgcacttgttcacaaaaagagagagagagagagagagagagagagagagagagaagcttttcctatcagtacaggtccaagcatggatagatggctcagtgcacgcacaatgcaatctcgagtggaagttcagattattcagaaatgtaatgcacaaaggcgagcagaaacatcatctgtccaaaaactatttgcccaccttgagattaatctgtatacagagcttaatggtaaaacagttggctgaaagtttgaagtatttagcccttggcatcgatttcctataaatcgatatttaagctaactaacattttaaaagacctctctgcggtattgcagaggatccgaatccatctgcagggaattcggacactgttccctcacatatccccttgaaaagcattggcgcacgtgtagttgctctacccgaactgagctatagcccttgtcagagatatcttaatatat

SEQ ID NO: 12230 - DNA, 483 bp, Oryza sativa
catcatgcttctattcatcgataatatctttcgttttgttcaagcatgcatcggaggtatctgccttattagggagaatgccctctgcagtgggttatcaacctactcttagtacagaaatgggttctttgcaagaaagaattacttctactaaaaagggatctataacttcgatccaagcggtttatgtacctgcggacgatttgactgaacctgctcctgctacaacatttgcacatttggatgctactaccgtactttctagaggattagcttccaaagggatttatcctgcagtagatcctttagattcaacctcaactatgttacaacctcggatcgttggcaacgaacattctgaaactgcgcaaagagttaagcaaactttacaacgttacaaagaacttcaggacattatcgcaattcttgggttggatgaattatcgcggggggatcgtttaactgtagcaagagcacgaaaaa

SEQ ID NO: 12231 - DNA, 13176 bp, Oryza sativa
tatatggactctgtcttttctttttctccgattaatgtgagaatttctagaccatgagagcgaacttggatttttttttttctattcctttaattatatggggaattccaaatttctttctaaattgtatttctatatggactctagtcccctcttctaatatttcttatttttaattccgaatttcagctatttttaaattgtatttctatatggactctgtattttctttttctccgattaatgtgagaatttctaggccatgagagcgaacgtggaggctcctttttctattccttaaattatatatttaattctgaatttctattttttcctaattgtatttctatatggactatatagtctacttctaatattccttatttttaattccgaatttcagttatttcctaattgtatttctatatggagtctatactctacttctaatatttcttatttttaattccgaatttcaggtattttctaattgtatttctatatggactctagtctcctcttctaatattccttattttttaattccgaatttcagctatttgtaaattgtatttctatatggactctagtcccctcttctaatattccttattttttaattccgaatttcagctatttgtaaattgtatttctatatggactctgctttttctttttctctgattaatgggagaatttctaggccatgagagcgaacgtggaggctcctttttctatttctttaataatataatagatcgctttactggagacttgctcgatgttgctaaatgcactgacagtgatacagtacaaaccatactatattttagatagaaagttaaggctaaccaatgaatgggttgtcaggttttgctgctggcaattttcttcatgaagctctcccttatcctgttcaattcaatggcatgcaagcagcttcgtatgtcaaaaacgatgcaaacaaaatgctcgacggggacggtggtggaggcggcagtgcacgcgtcggaagaggcgagtgagactaaagcggcgagggcggacgagtcatcgagggcggctaaggtggcgagtgcgaggagagagggcagcttgggttagtgagtctaaaagatgattatacccctctgtaaataattttccctggacaataatacccttctatgattcaactaccattaagtgaggtggtagtagaaataaatatgaaccattcgatcaaatgaaattaatggttcagattattttctactaccagtagagagcatatcggagtgggactcaaagagtagtggagtttcttttaaaatttggacctctcccgatgaaagcgacaacgaataaagccattactgtatattagcagtgcgtataatttcgattaggaccatgaggtggagtaatgaccaatactctgatcctaagctgagaaatcaatgtatgtgagcagaataagttcttgcatgcagaaacagctcgtgattagcagattgcattagtgggtggactgtcaattcgatcacagtcacagaaacgacatgtgagcagaacaagttcttcctcctgcagagatcgaacattggagagatgacatagcggtgacaatggcgatttggcgattgcatcaacgtgttgcacatatataaagctagcgacaagtataggcgatgcgtgtgcttgacagtgtacagtgcagaccatgggtggcgacggcaagcgcaccaagttgccgtggctgggcgtggcgaggtacgcggtgaccgcggtgctcgcgacgacggtggcggcaacggtggtgctggccattgtgactttaggagaagaatttggggattcaacagtaacattgatctaaccctaaagggcaaatataaatgtatacaagtgatgcgaaaatactaaactacccctaatatcttaacacccccactcaaatgcaatgtgtatacacattgcatttggagtgtaaaataaatatgagaacacaagctaaatattggtctatctccaaagtcttgatgatgtcgtcgaagtgtgtcaattcttggatgatgaagaagaaaagatgtatctcttcctcaatgaagtggacctcggagccttcaaaaactgttcttcagttctcagtaccttaaagcctttacaaaccgttcttcggctcttcattgattcagagacgtggatgatgatggagggcccttcacaaactgttcttcggatctccacatatttgatgacgatgacgatggtgatgatgaaggaccttcacaaattgttcttcggtccttcattgattgatgttgatatcaactccgatggggagctggtgatatgatgaaggccaactctgtggagctagtcatgatgaaatgacaatgaagagatggactggcacaactttgacaaaatgaaggatatgcaatggaatttgctggattcaatggataacataggaaattgatttgtaaatgatactaatttagtagcaaaagacacatggatattgatataccacagcagtagcaacaattgatgtgcctggtggcacaaccaatcaatcaccaacaagccacatgtgcattggacaaagcaagactcaggacaacagtctgaagatgatggagaatagtggtggcacaagatgaaggtgatgaataatcaaacattgatgcatatcccaaaataaattcaaagcaacgcaacatgcaaagcaatggatagagaatgagcagagcagaggtggatgataactgccgagaagaggctcgtggctgcagcagaacttgaatggatacactagatagaaaacaaagaaaatcgatttgtagatgacattgatatgctagcaaaagatataatggtggttgccaaggaactgcagattaaccgattctatccaatttggtagcagagagcagcagctgataatgaaagaccacgagtactttcagtataatacgagtttagatagcaaaagtatgatcaggaaactgtgagcaaccctttgaagcattttgtcgaacaccttgtatgcaacttggacttggtggtttagaggcaacaacactcaagactaaaggatctactgtcggcagtggccgcaacgacgagcggcggcaacaggcagtggcatgtggagaccgcgacgagtggcaggcaggtgacgacctgcgacgaggaagacggatgacacgctcgacgagcaacaggcgtgggacgacgacttgtcaacttgatgcggcgaatgagggcatacaacgacgacggttggccctgcgaagcgcaccggtgaggatgacgacagccagatccacaacagccggcgaggacggagttgcgattgacgacgagccgcagctgggggacgactgggctgatgacatggacggggttgccgtcgccgatgcgcgtggatgcatgtggacgaggcaaggacaatgctcctggctgctgcctgcaacttggcggatgacgacttgatgagacgacgaacgacgatgctgtgcctgcaacttgacgaagatgacggatggcgacttgacaagaggacaagacgatggctcgccgacggcgagcccgccgccggcgcgccggcgagaacatcagatcgacaactagagtttggatccttgctctgataccatgtgactttaggagaagaatttggggattcaacagtaagattgatctagccctaaagggcaaatataaatgtatataagtgatacgaaaatactaaactacccctaatatcttaacagccatcaggatggtgctccggccggtggagctggacctgtcggtggccagctgcgcggtgtccgtggagcggccggagtcgccgtcggccgcgtcgctggtcaagtacaaggtgacgctccgcgccttcaacccgagcggccgcgtcgtggtccacttcggcggcgacaacctcgtccgcctcatctacggcgccgcggcgcagacggatagctcgccgcgttcacgctcccggcgttcgtcgtgccgcagcaggagtcgcacttcgtcaccaagtccgcgttcctgaacgcctccgcgctgccggcctcgctcgccgcgaggctctacgacggcgagaccgaccaggtggtggtgcaggccgtggcgtcgctcagcttcaccatcggcggcgcgcgcggcgtgagcgccggcaagcgcggccacaacttcaccttgatccactgctggccggtgtccatctccagctactacgaggtgtccggcggcaaggcgtcgtgcagccaggacaccaccgaggcggcggtcgccggcctgacccacgaccgctacatcggcggcccttgcccggagacgtacaagaactccggtaagtgctccaggaatagcaccggcatcaaggggtgatcagctaagttcatttcgcggggtgtaatttgatttccaaatgctactgtaattaactaatttattacaaattgaagaaataattgtattgaaattgtgcttaaacaatgacaaagtggaaactaaaggctttttgatttgttgccacatttaacccgataacatgtattgtacacatcttttgttttagtgaggctatgcctcctgcgttgtaaactttgtgtttgggatgtccccaaaacaacacctcccccacccccccccccccgcgcgcgcgctttcaatataagccgggccgctagtctttttctaaaaaaaaaaaaacatgtattgtacccacaagttttgagtgcactctcagttaccacacacaccagctaacaaataaaaaaaaaatctagacatacttacaaatacgtgtacacgtactacaactatgcataaagtgtcaacttcaagtttaactaaacataaattgatcactaccaaaatatgccaattcaaaaatttccgctcttgccaataaattaggcgtccctattataaactaaatatttatatagatatgtaacgtaacaaatcaaagaggaaacccatccaccatgatcctatatattttgccggattgaccaaagagcgaacaaccaccgcaccacatccgcatcttgagcgaaatagcatgcaccggcggcggatcggcgggccgctggtggaggcccaggcggtggtggtgcagagctgttggtggcagcaacgtgatcgagagcgggtccaggcggccgatctaggagcgcggtggccatggagggagtgctcgctacagggtggcggaggcgatccgctgtcgaggatgcttgagatcgccggatccggcagcatggaggccttcccaccccggtctgtgcggtctccgccttcggccacttgcgtctctctctccacggctgatcttcgcctgccagcctcaccagtcaccactagcactaggtgccctgccaaggacgattttgacgccgagtgcaccgatgacgcccatgaggtacatcaatcttgaaagagtttgagttgcaacgcacaggtgtattgatcacatccagtatacatatatacatgccggtgcagctcaagagtgccaacggaatcctgataaaatggatcgtagactgagcacggcggaagaataggtcaaaaagaaactgtaatctagcctatccttatctacatgatcagccatcttgacaccccccccccccccggcggttggtgcgtcgtcgacgatgcacaaactgtatcggaaatcttcaaacagcgctgtgggcaatcccttcgtcatgatattggcgagctgttgtcgagtcggaatgtgcacgacgcggatgtccccaacagccaccttttcccggacgaagtgtacatccagctccacatgtttagcatgaccatgatgaactggattcttggacaggtaaacggcggagatattgtcgcagtacacaagcgtggctttgtcgagcttgatgtgaagttcgtcgagaaggtgacggagccaacaacattcagtagtcgcgttcgccacaccccggtactcaacctcggcactggagcgagacacgacggactgtcgtttggaggaccacgacaccaaagagtcgccgaagaagacgcaaaagccggacgtcgagcggcctgtgtcggggcagccggcccagtccgcgtcggagtacgcggtgagcgacggtgtagaagaacgccggagttgcagacctttgtgcgtcgtgccacgaacataacggaggatccgcttgacaagtgtccaattgttaacaaccaaatttggtaatctgagtatcgaagaagaagattagatcgatgcggaatcgaagacaaagatcgtttcggaaacagagcaagattcggctgaaatccaaatcggctacgatcaaagacagctgagttcgagtcggacaaggtagccgattaagccgattccgacaatacgactcggtgtgtgtcatcgggttgagttaatgtgcttcacacggattgccacactcggattgagtcctgaataggcaattgtatctattaattaggatattttatataatttccttagagataagtttgggcaaaagtctgctgcaaagacttatggtatcttagagttggttagagataacagtcgtgtccgatatggacatattttgtaatctcgggtataaatagaccccgaaccccatgtattcaattaacacatgttcaacaacaatctcggcgcattgccaccctttacttttgttttgctttcgactagttcttgctttcgggttgagctgcatcggtttcgatcttcaactagaggtacgacttgttatggcggcttgcgttctcgggattagtgcttccatcattatgatactctaatcttgtctctgtaagttgtcgagttatcatatattctatataatcttcggcaatattgttatctaaccttcagtcggctaacatctatcactagaaggcagccgattaggttaaataccaacgttgacttagattatatagaatatctaccactctatgaagctcccaatggcttgattgtctagatattgtctttcttttcatacttatggctgcatcagttaggtttgacctcataagtcgtgcttagaactataatctctagcctgcttcttggtttccgattagggtagcatcggagtttcagccaatcttacctgatttagctttatgttttatatgcttaattgatatgctagatccgccctttatgttaagatcctattgcatttaggtgtattaagctttatgtttgatatattttacttgctttaatatcttgatatagagtggtatcggagtattagccgatacacgctagatctatctgatcggctatgctgtaaacgtctatagtctccttggtaatatatatttcgatctaagtgatttatactgtctcggcatggcgaccgatctatcccaattacttaatttaagtatatatcgacataaagattatatactgttaacatctacagccaactgccgatcgattcacatatgacatcggctctcagataaatgatatgtcatcggtagctggccgatcggctatcgtttatggatttaactgcggtttccttgtctttatttcttgttgattgcaggatcaaatcaattggcacgctcacgaacctcaaaggcaagatttttggacctgcactggagttaagcagatctcccaggcctcgtgttttcgcatcaacaccagtgcacgtcccgcagcgagtgcatgtgaaggcagacctgttgcacagcgtaagacaaatccggccgtctgagcgtgaggtcctggagtgccccgacgatgctacgatagaacgtcggatcactgtagggctgccctgtcgtactggagaccttggccttcgtgtccacaggtgtcggcgctggcttacaggcgggcgtcggtcgtgtcgtcgatgtgatcgaggaggccgaacttgcggaaagcaatggtgaagaaggtgcgccaggtgccgacgttggagtcgccgagatcaaggatcacgggaacgtgggacttgatgttgatgagttgcgccgtcgccgccgagatggccacagagcctgccgcgaaggggttgacatcgtcagaagggacagtgcttgacgccacagagaagaaagaatggagaagcagcagaagatgattaggatcgagaagagatctactaagcaattggcaactaccgaaagtgctcttgttatccactttacaaccgacataatccgaatcggaatagccgactagcttgaacttagaaccttttgggtaccacaagccaatagttgaggaattctttaaatatcttagaatccttttcacggccattaagtgacactccttgggggtggcttgaaaccgtgcacacatgcaaatactaaacatgatatccggcctagatgcggtaagataaagcaagctatcaatcacagaacgataaagctttaaatctaccggtttatctccctcgtcatggtcgaggtggctattggttgccatggagtcttgatgggctttgcatcctccaagacaaacctcttgagtaggtccttgattggtttggctcacaaaggtcccatccttgagttgattgatttgaagtccaaggaagaagctcaactctccaatcatggacatcttaaattccctagacatcatatcaccaaattccttgcaaaacacctcattagtagaaccgaatatgatatcatcaacataaatttgacacataaagaaatcatcaccaatgattttagtgaaaagagttgtgtcaactttgccaattttgaaaccctatgataaaagaaaatctctcaagctctaggagcttgtttcaagccatagagagcttttgagagtttgtaaacatggttaggatttttaggatcttcaaaaccgggtggttgttcaacaaagacaagttcggcaatttcaccatttagaaaagcacttttcacatccatatgaaaaagctttatatcaaagcatgatgcaaatgcaagtaggatgcgaatggcttcaagccttgccacgggggcaaaggtttcaccaaaatccaaaccttcaacttgtgtgaaactttgagccaccaatcttgcctttttccttaccaccaacccgttctcatcttgcttgttcctaaaaacccactttatccttatgacattgtggtttctacgtctttcaaccaaagtacacaccttgtttcttgcaaagttgttgagctcttcatgcatagtatttatccaatccggatcaccaagggcttcatttatatgttttggctcaagacaagaaacaaaagagtaatgctcacaaatcgaagagacacgagatcgagtttgaacacccttactaatatcacccaagacttgatcaattgggtgttccttagagagagcgttgtgaattcttggtggcataggtggatcttgtgccttttcatcctccacgtcaacttgagcttggcttggcgtagcggaagtagtttgctcaacttgagtagaggtggaaggcttgtcttccacttcaacgggcttgatgtctccaatagacatgttcttcatggcgctcatcaagccctcatcacctacatcatccaaattctcgtgcccctcttcagagccattagtttcatcaaattgaacatcggcggtttcttccacaatacctttgttcttgttgtagacccggtatgccttactatttgaggcataacctagaagaaacccttcatcacaccaactttcaaatttggttagtctaacaccttttcgataaatatagcagttgcaaccaaaaactcgaaaataggcaacattaggcatcctcccaacaattagctcataggaagtctttttcaaaagacgatgcaaataaagcctattgattgcatgccaagcgatgtttatgtgtgacatcccagcagcttggtcttggcttggcccaaccatgcaagcgcagcaacagcccaagcaacgagtgagcagcagcttagacactgtagtatcgcgtgtactgtagcacgcgagtcactgttcaccgaatagtaccacctcgcctagctagcttgaggagcaccgagatataaggatgtttgcctaaacacgtgtaacaccgattcttttgtgtgaaaagcgatgtcacgccccgaactagtctcgaccggaactaacccgtgacgctccaaattaacctgttaatcgataccagtcccaggaaacagtgctggtatcacaggtgctccttgctcctgggagacagaatatcacagtagaagtaggcgcgacttgggaactaggccgaaaccctaaaactcatcgtagccggtttgctccttgctcctggaagaaccgctccaaattaacctgttaatcgataccagtcccaggaaacagtgctggtatcacagggagacagaatatcacagtagaagtaggcgcgacttgggaactaggccgaaaccctaaaactcatcgtagccggtttgctcctggaagaactcctcattagcaggattcgcttcatcttcttcagcaactggggggatatttatatagagcaagggtgagtacgggagtactcagcaagccaggggaaataagtgtttaatgcaggcttcaaggaatggctgatgtttttgcaattgattttgtttgaactcttttctaaaagcaactaagtgagtgcttctcaaacgacacagatgagacagtgcgtctcgtccggtcagagtatgtgcaatgtatcagtctttagatttgaacaagattggcacccggccaaaagctttttaaacggccacccgggccaacacttttcaaacggccacccgggccagcaactttttaaacggccacccgggcctagctgatcccatcagctgcaggttttccaaacatcgaacccagtttcactacagcaatttcacaagcagtagtcaaacaaaactacgctaggaatcacctcacatccgcccatgaccgtgggcacggctgttcgaacagtttaatgacctctgcagagggggtacactttacccacacgacattactaacccgggtcacccagcccgtggggatcagccacgtcgggagacctccaagctttcatgacaaggcatttcgaaagccgatgcaggtttaccatatgccgacgagaggggtcccagaccaacaacaggttaggtcccagaccatactgtgccaggaagcccaggggtcctcccctacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgttccccggtccgcggttttggaaattcatttagttcgcaagcaccgacccaagtgtcgggttttccaagtctctttttaaaactccagttttacccaagttgttactcagattttaagtttgaaggcgaccgtcgatactcgcacagagtgcacgagtatcgaggcgcaactgggtggttacaaggggacatggtatagcaattaacaatggaaggatcaaatgcgacaaattaggtgagtccgccaatctgccttgcagacgggacaacagattaagtgtgatcctatcaatgcataatattttgcaagcaacataattaaatttcaaatataggctcaagatgttcaaaggtggcttgccttgctcgagatcgggagcttgatcctcgaaatcctcgcactgcgggtcttcgggctccgaaactacacgcgaaacgggacaactcaacatacagcgaaaataaagccctattaatgacctctaagcgtgccactagatagatctcgagatttgaagaattttggaagttgaacggagtcaaacggagttacggttgggaagatattgaatttctaagattatcggatttttggtctaaaggaaaaaggatttaattaaatcctttttggaaaaagaaaaagaaagaagggagggagggaatatagacttttctcgggcggctagggtgcggcccaagagatttggggtggctcggccgagcttaacgggccggccggcccaagacggcccaagcgcgcgcgcgcgggagggaggagagagagtccggtggaccgggctcaccacgcgcggtcccgggtgggacccgcttgtcagcggctcggctcaccgtgcggagggagcacgcggcgcacgcgcgcgggcggggaggaacgcggtgcacgcgcgcggtttgcggtggacgcggatgcgacgggcccacgcgcagcctcacggctaaaggtggaacgcgcgcacggggagggaccgaccggggtcggctcgacccggtctaggctgagctggcgccgacgtggcgcctacgtggcggccacgtgggctggcgggaggtagacgacgacccggccgcgaatggacggcgggcggcggcggcgagcgtcggagcgaaccacggtgatacgggcaagagcgagcacaccgggcggttgcacgggacgaggggagacgagccaacggctcggatttgccgggggttgctcgacggcggcggattgcggcggcggcaaccggcggcgggagaaggggaaaacggcgatgaagctacgaggggtcgattcccggcggtgagagcatctacgcggcttcgggaactcgacgctagcgtcggattgggcggaactacgccgagcgaggccggcgacgagcgggtgctacggagctcgggcggcgacggcggcgagcacacggcgagcgaaggcaacggttggggcggcgccggctagctacggggggtctactcgagctactaccgaaagctaggggggaggagacggagcgaggagggagaacggagagagacatcgccgagaagaggaggggcgctgtgacgagaggccgacggcgcgggagtaatctctccggcctcgggccggggaagaggaaggagagggcgcggccgaagtccccttccgcgtccttgctcgtgccggctcttccgacacgcgcaacgacgaacggcgacggcgaacagaggggcggtaatggcgcggaggtgaatgggagaggaaaggaaaaaggggggggctggggtttatagggggcggcaatgtcg

SEQ ID NO: 12232 - DNA, 1884 bp, Oryza sativa
aggggaagaaagggggcttgcccctttgccggttcgggaaaaggaggaggcggggcgacgcggcagagggaaagggagagctcggcctccgtcccttggcgggttgcgcgcggagtggcgggggccgggcgatgacgacggcgatgacggcggggcggtttggagcggagcggcgacactggcgacaggcgcgggcaggcgctgacgacggcggcgaccgagcggtcggccactcggcacgcgcgcgcgggaaaacaacgggaggcgcggtggtttgaacggcgcggctcgggcgacaggcgcgggctggcgggaccgggcgcgcgcgagcaacggcacgcggggagcggcagcgagggatggggagacggagagcgagggggcgctcggcgcggcggtacacgcgcacacgcgcgcgcggcgcgcgggcggggcggagcggagcggagggagagaggcgctcggggcggctctcgcacgcgcgagcagcgtgcgagcgaggctgacgggggggggaggagcgccccggggggggagagagagagagagcccgggagagagatgggccgagcggaattcggcccatcgaaccccggggaggcaaactaaacttttgcggagggatttgattcggaattgaactcgacgatagatcggggattgagatcttgagatggcacggacactagacaacaatcaaagaaacaaatttcgcaattagggtttttaagagataattttcccgctaggcgccacgacggaacgggcgctacaagcgagtacgaaaaatgcggtgtgttgcagtgtaggtgtggtccaactaaatgagatgatggacacaataccgttttcgggtccagggctgttacattatggcttccacccaaaaggaatcggaagctccatattcatctagcatagtccttgccatctcaatcaatgtgcaatttttcctctccactacaccattttggtgaggtgagtatgtagcgaaaagctcatgcttaataccaagatcatcccaatagtcctcgatattggtatttttaaattccgaacaattgttacttcttattttcacaagagtgcaattaaatttattttgggccctttttgcaaactttttgaaaagctcggcaataatagacttgtcatgcaaaaagaacatccaagtataacgagaataatcatcaacaatgacaaggcaatgactatttccaccgatgctcttataggttgatgggccaaacaaatccatatgtaagagctccaatggtctagatgtggacataatgcttttggaaggatgagagcatgcaacttgcttgctggcttggcaagcactacaaagtttgtctttttcaaacttcacattttcaagcccacaactagatcatgttttaaaagtttgctcaattgatgcataccaacatgggctagcctcttatgccaaagccaacccaaagaaattttcgcaaccaaacaagctttcaaatttgcttcacttgagttgaaatcaaccaaataaagatatttataacgaaaatctttgaagatgcaagatttgtcatgaagactagaaacaatcacatcttgagggttgaaagtacatgacaaaccaagatcacaaatttgtgcaacggaaaacaaattgaaatttagtggttcaacaagatagacatttgtaattgatagatcattggtgatagcatctttacctaacccaattcctttcctttgctattatcaccaaaagtgactctctcttgatctttgcctcctacttcaaatgtggtgaacatctttctataaaaaaacttgtgttgggtgcacccactatcaagcacccaatggcttccaccggtgtagtagttcacctataaa

SEQ ID NO: 12233 - DNA, 789 bp, Oryza sativa
acgccgacgtggccgcgcgcgagaagagcgaagggcgcgcgggctcgggcttagccgaaccggtacgcgaccgcgatgcgcacgcggggacgcgggacccgatggtcaccggcggcgcacgcacggcagcgttaggcggcggcggaagcggcgacacggcgcggagacaaaggagaaggccgacggccttggggcagccagggggaggtcaaggggatccccgggagcgtggcggcgagaggaatcgacgcgagaggagctgacgacggcggatttcgacggcgatcgtcgacggcgagcaaagagggaaaacttcactggggcaacgggggttcgattcgttggagctggagcatctacgcgaggtcgcgagctcattccaccggtcgagagggcacgggcgacgccgagagaggccggcgacggcgagcgacgcccgggacagagcaagggcgcgcggcgagatgtgacgcacggcggcgggcgcggcgcggcgtgcgacaggggaaaagggggttcagtggggagctcaccgacgagagaaacggagtcggcggcgcggatggagtcgcggcgaggcggacgcgacggcggggcggcgcggcaccgagagggcgcggccggggaagaagagatggagaggcgcgaggatgggggcggcgcggagctcctcgtcgactcctcatgctcgcaagctccccgacacgcacgacggcagaggagggcgagaacgacgacgaacggcgaggcggcggtggtgtgatggaggagaggaagcgagaggtatgg

SEQ ID NO: 12234 - DNA, 6399 bp, Oryza sativa
gtagtgatcgggcttactcaaaaagtaaaaagcacctgtcccttgtgattatgtcattgtttgtatatctatgcagattgttactcttaagccgcacaggttttatagttttgtcaaatatcagcttttgctacatgtttgtactttttaggagaacagtagttctattgaaatatatatagtatgaagaaaaaaagtcgacaaagaaatttttgcaagggttttgtagaaaccaaagatgactaaacaacatgaacttctagataacagaccaagcttataatcccaggcaaatacattagtagagcatgataaaccctaaaaagatcaaatatgttatctctgaacacctggagataagtgttgacaaacaagctgatgagattcttaagggtcctctcatcaggttttggtcagaagctgtttgcatttgatggtacattactggagcagctacatatttcacagtgtgtgtcatgcatacctaccgatgtttactacttaaattatctttatgcaatgaacttaaatatgatatagtattcgtgttattaagtagcctgtatggcataccaccctatttcaagtaataagacacttaaaatttccagggaaatcgatatgttgctattgaattagttagttttgctcttctgcaattgtaaacaaggataagctattttctctttctgtatcttgtagctcaaatatttcaaaaggttttcaatatatagttgcacacgtacatacctacacctactttttcttattgcaatgctaccttaagtgtaatctgtttagttcgctataatatatagtactagtttatgcaggtctctgcttgcttggatgcattcgttgtgagggagagagaattaaataattcatgtattttacttcaatgggattaaaatttttggtttgccttgtttattactttattgtttatgctacactgcaactcttgaacagctttatcgatttgcttatattttttatcaggtagcaattgactatatcctttactgttacatgtatttactatcgtgggtacaaaataatgactatgattatttttgtcattcatctgtttttacacttgtatctggtctggaaagttcatgatctactcctgaaggatatgcatgtcatcctgcagtaaactatgggataaccaatactcacagtctagatgtagcctcattctgcatgaccggttcatcaacatgataaacattccaggtacatttatcatactttagccatcatggaaagtatgtgtcaaaggttctctataaattatatttcgcaaaagaaccttcttcaggaagatgaaagagcatctgctttcatcttctttttcattgatcagatgccttacggcagacatgtggttcggtattgacgcattagcgaatttcttgtgatacattcctgctttgcagaattttttttattggatattattgtaatgtcaattcatttgtcaatttagtgataggcaagtggcgttgcgcatttagtattagaaacaaaatttgcatgtttgatacggacattatattctggagaaaagcttacttcatgagctttgctggcacggaagtctcttagcaatgaaggatttgagagcaatacctttgattcccttctgcgttgatgattttgtcatgttgtttcctagttccttttttgcatatacaagtttctctgcattggttttgtgacattagtgaaggttctgcctgttttccctcaacggagctttctaaggtatattcaagtttaatcagcttgtgataaagttagtgtttatgcagatcatacatataatacttgtcggctcagggggaaaacataagttatctgcacagtttggattgaattttggaatgaagataaccaaggtaactgactgtttaaaacatctattgcatggtggatcaataatcctgtcaccaacttgagctaggatttttggacatctatttggcatatctttgcttgtgtatttctgaacatgactttgagtggatgcaattcttcagcataaatatagcatatgtagttgacctgtaatatcaaccagacaaccattgaaccatgttgccattatttatgccctgtccatgactattacttcagatgaatgacattgcttgtgagcacaattccatcaccatcaaagaactgattcgtgatgtcttgtataatactgtgacttgacttccatttaggagccaggcaattggctaacaatgttatgctactcttagcttggcttaagttatgtgtcttagtgaagttctgtaaaacctatcttgaactttctgacaaatgaaccattttccatgttttcaccacatcgacaaaacttaaatatagtaactgcctgcattagtgaatttaaactgtaggaggaggtgggcgaggggaattgcaaatatgttgtatcagattaaccccccccccccccccccaatattgattatagatttctattacctcttttatctttaagttgtttcttttagtggagaggtaatagcaattctcattgatcaactttacagtcctgaaatcattaagttgtttattttagtggagaggtaatagcaattctcattgatcaactttgcagtcctgaaatcatttcacgtggtagggagtagcgagtagggactcgagctgttgattttcatcgtagagagcccaggaaacagccgtagggaaaaaaaatgcatcattctggtcattctttccttccttttgatcaaaagtagataaaaatctatcgttctttactgcttagctcctttactgccttttcttttctgcaagctcaattcataggcattgcacgtacggatattgctaggctattactagctacagtgagggcttaacagccctatactatcttttcctcatcggaaactctattttagagaaaagaggatacaaaggctggccaatgcatggtgcgaccccatgcatcaaccttgtagttggcaccgaatcccactctccaaggcagcttcaccatgacacatccatctctttgcttcatctctcactgccttttcttttccttttggctcttaaaagttgcgtatctttagctctttccaagggagggggtacttcgagcccacaatgtgctactactactcactggccactatgcttgcatttcctatttggcttccgcaatgaaatctgaacctgtctgaatgagatctggaggcctttgtgtctactggcttctgattcccctccctggttttgaactttcaagtcctgcttaattaaaccaacagtgcaccttctttctgcgattgattcgtggtactttaacggttggaggtgtgaaaccaagctacgactaaaatgtgcagatgttggaggggggaataaagcgaactcttgtccctgggcgctttgcgagtcgccggcacaaaccacattttagcctgtttttgtattgcgagcaatttggatggctgaggaataatgattcacgaaatacctcgtcagaaatggtacattttggcagtacagatacgccttgggaaagatgcaccgtgtctgagactggatcttggcctcacttactttgaagttttgaactgtggtaccacttttttctgaatttatcagcaagcttaacatccatctctgtaactactatgcaggtctcttgccagtttgctcctgcagtgtcccgtactccagtgtggccacttgcctgccagtggcgatgaagaggaaacagtgttaaggcatgcagtgcagcaacaagctcggccggtttaagagtgatgacaagcacgcggtccctgctgcggtttgtgcccagaatgggactgtgagcatggccgggacagatagttttgttggattggatgcacactgccggccggcctgcaccatcgccgtcccgtgtgtcacgggcactcgtacgtcgccggccgtcgccgtcactggcccacccgtcagcggcacacggtggggttgttcttgttacagtgggaagctggaagagtgttggcaagagaacagtgaggctggttgttgctggctatgatgttaacctgacctattgctactgctcctgctgcacactgtggctctccagtgactctccagtgagcccatctcaacctatccggtttgtgcatgcggtgccatggccattctggagctgagtcccaggttaaagtggtgtacccatccaatgttgctgctgctgttcttgatgtgcctgtcctgaaacatcacaagtgaagtccagtcaagttctgttcagtgtccccctatcttcacgagacgagctggcgttgcattgcgagaagagagatgacaaacggtgtggctcaaactgggagctcatcccaagcaaaagctccatctcaaccgatggaagcaggcaaagcattttagctcctactacttcattgtatcacggtgaggattttggttttgttttgcatgatacaaaagattgctgttcatcgttgcagcagttgggggtaaggtagtaactcccccgtcccataatataacattttttttctatgaatcaattgttcagatttatagctaaaaatatttatattttggaacggatggagtaactaaaactaggtaaggtaattgagtgaggattaggagaggacaaaaaacggcgaggccaagaagcaacatgccatgagtgagtgatgcaagccacatgcattcttgtgtagctgtttggcaacaagtcgacacattggcacgctacacatgggagttcggtgtggctgtgcctgtaccttagggtttgggactttgggggaaggcatgtgtgggtattgtgtaatctgaggctgcttgttggtggctacaagctaagttagtagtagaaagatttgtttatgcgtagttcatcgatggcatgcatcggccacttctgccaaccaaagtatttgtttagcctttaaacaaaacaaaacactactgctatttgtttagactggtaagttttttattcggatgttaaacaaactaggggaaatcaaaccagatctagccatggcaaacgccaaattatggagcacatgccttagcaaccgagcatgagcaagcaatgtatacttaaaaaaaaaaagtagagcggcaagcagggtttataaatgcgacttgttactgttttacaaagtattatgtccatcttaaaatataactatctaatacaggatataatgtttcaattattatgaatttggacagaaggaaggagtacgtttaccacttcctatcggctccgttcataaaccccggttaccattcattattcaataatgaaagataaaaagatgaaactaaacatttttttcgatttgaattttactttcaatattagccatgtttgaaatccaattacaaatagacttcaaacagctctgaggagtacttttattactccatccgttctaaaatataagggattttgattggatataatatattctagtattatgaatctgaacgtaaagcattaataaattcgtagaattaggacatatcacatccaactaaaatctttatattttaagacgggtgagtatattgatttagttgtcgtggacttgcgccttagcaatcgctgccgaacaaagcctattttgaacatgacaagttcacaactttaccaagcggttatggtcgcattttgaaactaccggtaataaggattctctacaatacgactgtccacacacagtttatgacagccacttacacgtgggcccgttacggcataggatccgtgccctaaaaccatggtggcaaagggttggggcaggtggggcccacacgccagtttggtggcgccacaccgcccgacacggattggatcatcggatcgacaagtcctcactgaccgatgctgggcaggcgtgggtggggcccggggcccagtcagtgtgtgtgtgtgtgtggtcaacaggttcactgcatgaaaagagagcagcagcaggcaaacaggtctgtgagaggctgatgagcagcagtgactgcgagagacaatgcagggattctatgaaaatttttgggaatggccccacatgttcgtcttccagccccatgctctcttggtgaactccaatcctggctgcaaatgcattgcaagctttggagtttggacagatcttctgcctgacttccactctgttatgcttcttgtggtgctattgtttttttttcctttgtcctaatagagtagtgtgatttagatcattggatggattattgtgtatgattgaaataagtggtgtaaacaatggttaggtgacacatttataagaaaatgtacttttcaaagtgtgcagtaaataatccgtttcagtaattcggtga

SEQ ID NO: 12235 - DNA, 4421 bp, Oryza sativa
catccttaattttcgaaatcgaacaaataacactgttcatagtgattttacttgaaatgacaatgatatttgcttgtttaaactcgtgttataaatgtttttgttgatgtaaatgtcatcgatggaatttatatatggtatagcaagtcctcaaaaccacaaaaaatgtatatatggtataacaaggacttgcatccataagtttgagcatacattgccctcttgtaaacccaatgaggtgatttccagtctcactcgctcagtgatgatgccatctatatcttacaagttacaatattattctcaacctcaggctaattggagaggatgttttattccccatcgttaaccagggtgcacaaaacgtggacgaattcggtaccctaatcaccttaccctaagatgctttgccgccatttcagtaaagcatggacgctttacaccatgattgccccccttcctttgcatctccagcacaggcagaggcagcagctggagaacaagcaaggattcggttcatgttgcagtgaagaattctgtcatgatagatggggaaaaaaccaagacaaaacgcgttggcaccccatcaccatatgttcttcaatgtgcaacagtgcttgccaaatgcaatgcccttatctgaagcttttagactgacattatattctgacaggattttatttttctctcccccatatcctcctacttccctttggttcttttcagcttggggtgtgtttagttcctaaaaaaatttagaagtttgaagaaagttgggagtttgaaaaaaaagttggaagtttatgtgtgtaggaaagtttttgatgtgatatgatgtgatgaaaagttgggaatagggggaaactaaacacggccttggttcaccggattatttttccatgtttcggaaaatatgagtttttgaaaggaaaaactttatctattacattgcttagattttttttgtttgtttcatgttattgttaattttgtctctgaaaatgtttaatttatcctcataattaaattgatagtccttcacaataatatgttcaataatctaaattaaatgtggccttccagtttggaaggagcagattagagagcttaattagttaggctgtcatgtgtccaaacagttgagttcggattgacaaatcatcactcccctgtggtccagtgcaaacagaattagaggtgcaaggcaggagcataaagcaataacagtaacaggatggtggtgtgcttcagctgcattgattaacagtaaaggagccaatgtttaagtatgcttttaattatgtcgtttgagtaacaaggaagccaccatgaggcccagacaatggcaacagtacacattgcctgcatggctaatctctgtatttttttttacataggcttgttaccatagtattactgtataaacagtacacatgtctgaagcatggacagtatactatgcagaacaagaagtgacagataccaaaacatattaatagataaatgatacgttttcttaaaacataatttcttacgctgtaatacctccgtcccaaaatacttattgctttgagtttttatttgtaacttttaatcattcgtcttattaaaaaaattatgaaattattatttattttgtttgtgacttgctttattatcaaaagcattttaagtataacttatcattttatatatttgcactaatttttcaaataagatgaatagtcaaacgttataataaaaaaaagtcaaagcgaccactaatttgggacggatgtagtattgtttagatctcttgtcctaaactagtatttgttaagtttatttattaaaatatttaattaatatctatagtcttattggtaatcattttcagtaatccaataaatgtattaatactagtatagtaccaatacattacagtaacaaactgtacacatctctgaagtatggacaatatatactattatgcagaacaagaagtgacagataccaaaacatattgatagataaacgatactactactactactacactacataggcagacagggtataatagaattatgagtagatggaagatgcattgctgaagaagccatgagcccatgatgtagcatgaattatgattaacagctaaggaggcaaggcaactaacctaatctagtgttgagctttgattagccaagtctgtcaaatatagggggcttgtttgttgctgggcgagtgcagttcagaatcccactcgtagaagaggagctaaaagaaattgtctgacgcctttatgcttgcttgggtcgcccatggccgctttattcccaatccttgtttcttctagttctacctcgcgattgctacctccggaggctgctgtttgcaactgtgtgtgctgctatatcttaaaaagacacgaatattagagaaaaacataatatcaaataaatagaagaagtgtggtttcgaataaaaccaccttgtagagctattcggaaaacctgaacgtttctcgtgtgctcctacgtcctaaccacacgcaaattcttgtctaatcctgcctgctagtatctatctagttacctttccagttgtcttattactcttggagagtgaagcataaacgtgtattccatttttgcgtgaaatttttttctctctcggttttacgggaatgtaatggattttacgaaacttccgcgaaattcctcgtggaatttctaaatcaagtgtaagtcaattggccacaaatcggtcgttttttaataccttttgcactcttttataaacagaggaattcgcgaggatttcgtaggaactgaactataatttctacatattttttcgtataagaatcgtaggaactgaactataatttctacatattttttcgtaaaattcttatgtttcaaaggagtccttacaactaatacaataaccaggtgtacattccatcgttttctctctctttctttgataagagggctgcacaaattgtacaaacaggaattcagaatacgacacaaaaaacatgtcaaagctggtgatcaaaatggaagaacaaattttcaaatgccatagccattgattttcacggggaatcgagtagtaacacagggggatggatggatggatgatggtgaagtagaatgcgccagctactgtaccagtacaacaccattgcgacatggcactctgcatctgcacaagcagaagcagaagcagagccaagctgcaaggtgacacgacaatcttaggacactcagctcactgatcagctcagctgagatcattacagcaacacaaagaagaagaagaaaaaaggagtaaaaaaaagttacacaaaaagggtaaaaaaacacttgactttcacttggagaggaagaagtagcaggatcattagtccctaactaaaatccgcggctccttgatacgtcggctccacggctgcgccgctcgccggagacggcgacggcggcgagggctttctagcacctccacgccgagacggacacgagctcgccgcgctgccagtagaggcagagcgagccggcgcgcttctcgacgcggaaccccctgacgtgcaccttgctcagcagcgactccgcctgcgactccgcgaacgtcgtcgcctgcaccggcgcgaaccccgccgccgcgaacgccgcgcgccacggcggcggcggcgccttgtccatggcggaggcggcgcggtggctggccaaaacgcactgctcgatggcggggtggatgaggttccgctcgatcttggacgcggtgtccgggtccgtgcccaaggcgtcgatggactcgaggaggtagacggcggagtggaaggagtggaagaggtgcgccgcgaagaggaggtcggagcggtcgcagccgcggtcgacggagaccaccaccttggcgccgaggcgcttcacgaggcggagcacggccggcgtcgcgacggcgtgggcggggccgacggggaggtgcacgcccacggtgtcgcccgcggtggcgttggcgaggagctcggcggggtccagggtgtcgatgtcgaagacggtgaagtggaagaagacgcagagctcggcggcgaagccggagaggttctggtggatgagctgcagctcgagcgggtggtgagacgccggggacaccaatgcggtcaccttgagcgcggcggccggccggagctgcgcgagctcgtgcatcagcgacgcccactgctcgcccatgcggatgtcgaagtccagcacgtggatgcatccggcgccgccgagctagtcgagcaccgcctggactcaggtgaggtgcgcgaactggagcaccggggacacctccgagaaggccttgtaggcgccgagcttgacaccacgtcgtacggcgtcgacgccgatggcgctggggcgtcgccggtgggggagagcgttaggcgc

SEQ ID NO: 12236 - DNA, 790 bp, Oryza sativa
  unsure (1)..(790): unsure at all n locations
gtcgagctcgagcaccggcgggtccatgacccctgccatcgcggcggacgcgtcctcgccgccgccaatgatccagcggaggaacgtgttgtccggcgccatccccgacgtcgccgccgccgccgcgtcggacagcacgttcccggcggcatcccacccttcgccggcgccgagccccatatcaagcggcgtgagctggtgcacccactcctncttcgccgccaccacctcctcccccccaccacctcctcctcccgttccccatcccggcggcggcggggagacggagacgttcttggcgttggcgccggcgagggccgccacgtcggcgagaggcgacgacagcgtggaagccgaggtaggcgggctggggctcgggctgtggcggtggtcgagcaccgaccttggctcccagaacccacctgctccggcggcggcggcggcggcggaggaggaggagacgagcttgccggccgcggcgaggccaacgccgtgtatgaggtggtgttgcagcagtgtccccgcgtgcccctctcgcgcgctcccaccaaagggcattcctctcatctaatccaacacctcataacaccaacacacaaactccttcttcctcctcctcctcctcgcctcgaccaacaacaacttcttcttcttgcaatcttgttcttgcttgcgagctcgatgtcgtggtgggtggtggagtttgatttctctctctcttggtgttcttgctcttgatgtgtttgtgtttatgtttgtgaggaggagaggagaggagaggggggggggg

SEQ ID NO: 12237 - DNA, 15322 bp, Oryza sativa
gcgagatgaatatattaagcctaattaatccatcattagtacatgtttactgcagcacaacattatcgaatcatggagcaattaggcttaaaaaattcgtctcgcaaagtagtcgtaatttgtgtaattagttatttttagtctatatttaatcttcatgcaggtgttcaaacgttcgatgtgacatagtgtaaaatttgttaagatggatctaaacaggccttagcaacatcactttctctctccctgaacaatgctgcataaaaacttgtcttaaagggagcacggctttggggctactgtatctatcaaagcattttggtggcaacacaacagggacgaaaggctagctgtgcaaaaattcctgatgatgcaggggagtagtggtagtagtaaaaaggagatatctgaatttcttcagacataatactgtttgcaattcatgtgcactgctgctactactgctgttgctgctttgttcattgttgttttgcttgccagaaacttctgttcatttcaagctcgactcgccattttgttgtttcactagtactccagtacatttttcactttgtaccggcaacaaaatgaccggtctctttcagaatcccacgctgccactcatgagaattttactgccattttgccgaaactctactgctcctagaatggaagcactacacatcgacagcagtaataagatgtgaaaagagaaagaactaaaaatgaaacaccactacttcaattcgcttccatgtgaagttccatccactgttcttccagtgccatcaatgcagttccatggccatactaccaaatttcatcagctcatcagaaagcataatagacacttaataaaagtgtcatcatgtgtagtacactccattgcagttcattctgcatcatgagcctttttttttttacatccattgctgctatacatgctacatcctgttcgtgcgagcttgcatctcgatgagcatgttcacgactgcaactctcacaaaggcgacgagtataatcaattggcaaccaaaaggatggagtaaagtgtaaagctggagctgtgctgctgctgctgcagctcatccaaaatgcgtcatcatttgttgcctgcctcgatcggcttttgggttttgaccctgacgatccaccagttgaatgaactctctgaacttctctgaagatctcaagcggctgctgcagtgcagcagctcactgcttgcttcagagttcttcgatctccaatcaatcaatgcaccatttcttcagttattaggccccatgctgcttcttgccggctagcaacatttcaatctgaagccttcctctccctgaattttctttgcttgacagcgtgccaaggcaccatttgcttttatcgacaaaaggtgcaatctttcatagctgtatttaattctctcatcagactatcagagagagtgtaatcttcaagactttgttaattactagtaagcggttagtagtagtagtactttctcagtttcagtaaaactgttccttttgatgatgtcagtaaaattgtttggtgttgtgttgatctactacaagatactgtaaaaactgtcatgtgcacagtcattagtggggcattggactactgtgtacatgtgaaagagttggtgaggatttaactaggacccaagataaatattgaaatcgaatgttaccactatgtttagtcagcctaaccatggcccatgggagaagtacacatgaaagcacagttacagtgctttggaaaatcattagtagcaagttagcaatcaatccagcctttagatgagacgatcggccttgttcttttcagcttattcacgggatattaaagggattatttgctcattgctaacttcgaaaaatatatttctcaaaaagcatttcttttactgtattactggtcaacttagacggtttgttttaagctatttattatgtttattttaaaactatttaattcatacttaaaattaagttgtaatcccgcaacattaatcagctcaacaatctaaatcaacagggccatcagattatcacgcctaatttggatttgcaaattaaaacgtggttcaatgcctcaagacagtgctcctctcactgatcaacgccacaggaatgtgcacggatagcagcttgattcgtcaccctacgattaggatgctgcatgctgctactactcgttgacctaaacatgcttcgtcttagtctttcgtcacacaataatttatcgcttgtgtgttaattcttcgaactacttagctagctagaattgttttagacgccaattgcaactaacatacccatatcattggtatagctaaaagaacaatgaaaacacatacacaattctcaaattaatcagccatatcaattactgctttcttaaaaaaaacaacagtgttatagttacaattgtagatttttgacaatcgagatcaataaaaacttccattgtctacaaaccaatatagtttcctataaaaaaagaagaagaagagagatctctttttttgggatgaaagaaacaaaaagatttgatgcatgcatggaggtgaccacaagaaacaggaaaatggcatctggttctcgtccattttattcggacgagacgtctcaattttgaggtgcttctaagccaggatttgatcaaagcgtgcgacgtctactctctgcctgcctccctatctatcttagctgccctttgtcccggtcaaatctctcattgtgcggccctaacaacgccacaccaatcaacaaaactgacgcagatatccaactgcagatcgatgaactcaacttacttctatcatacctagattaccatgctgacagcctgacaggccgtgttaatctcagtaacagccacgaaccaacttaaaaataacttacgagtaaaacttttatatatgtatgttattagtgatttaaaaagcgttgtttaaactacaataatgaaaggaaaatcagctttaaaattaactttaagaatttagattttagctgcgacagataaaccaaacgaggattcagacatgtcgttctcgcttgagcaatctgaattctgtagtaggagattgttgctcattctgaattttaatttgcagcactgaaactgattgttcagctgatttaaaaacggatgctttgtttgaagtatactatatttttttttgcagagattggaggagctagaggagacatgacacatcgaacaatgaatgccatgtgagcccctgaatactttatttcgcaatcccaaacacagactgatgattgattaacagagaccgaaaaaagaaaacggattatcgattgattaatccctgttcttccccccatggggcagttagctaaccgctcgattaatcgtacatggccctgtcggtgcagctgccagtagtctgattgcagcagcaattaaattaatttagtctaatctttttttcttctttgagaactgcaattagtctaatcaccatcgagagttcacacctccatggcatgagctaattgctcggaaaccaaaactaaaaactgattggatctgggctgcaaattgggacagcagcagagaaggcgaccctcaacaggagacaaattttatgatttttgcagtctcgatttgtgccaatcgtatgtaggaccctccggcaccatgatatttgatgtggatgcttgtggaaacatctgcatctgatgtcggtactatgtttaatctcgtgcgatggatgggttaacaactgcaacttgggagcgattaaattatttgattatcattcagctggggttagtttatatatgttcatgttcagttaagtaaagctcgcttgcaaggtactaaacaaacaaattgcgtgatgatatggtatcggagtaattaagcagcagacgtatctgtcaagagatttttggctagatttggcatgaacatggtgccgattacggtgtccagagagagagagagagagagagagagagagagagagagtagatactgttgatataggtggtagagactagagatgacggtgatggagatgggagaattgttatctcgccgacttagacaatagcgacatgaaaccaatcgattagcaggtgtggttattaagtggagggagaaatcgtgttcttcagaaaaaggctttaatctcaatgctgacaagtgattagcgactaatctcaatttctacaaattaagagcagtacttctgattacgaattttttgaggagaacgagaattacactaccccatgatgcaaattaaattatttccctaatctttcggtatgatttgcacacaagtcgttcatgatttccggttgccgcgcgagcggggggtccgaacctgtcaagaggcgtttgggccaaaaggagaatgggccgtttcgtcagtaaatggcccagtcactggcccaccacacgcggtagctgcgacgaagccagcaccgatttgatgcaaagactgttcagaaatcagaatcagatttaatttacaggggagaacgagaaatcagaatcagatttaataagacttaatctgtgtttcgttttcctagctaaaagttgacgacttgttcagttgttcttgatctgcacagcatgcattacaggggagaacgagataggcttgttcttcgactgcggttataagatgtccttgataatacggtgataagaagtgtgtgatttcaatttataattccatgtttgattctcaataggtttacaatctcttcttaaaaaatgtttcaagggacaactctccctccaaaccttgtttttgtttttttttttactgcagtaacgctcaaacttggctgcataattacgcagcgatagttcagttaactgctcgcttcgaatgcactgaaaaattgcgtgatgataccacagtaagcaacgacagtgtatggagaaattcaatggtagctggctcgaatctacagtggagagtatgtactgatagggttgacttatggcagtagggctgatgctgaaagagacgtcagtgttgtaatctcaccgacttcgaaaatagcgacctggaattaaacaaaacagtgctgcatggtctgcattaattctgtctcttccgacatggaaccagtcgattagcaggtgtggttaaggtgtgtttagtttacgctaaaattgaaagtttggttgaaattggaacgacgtggcggaaaagttgaaagtttatacgtgtagaaaagttttgatgtgatgaaagaattgaaagtttaaagaaaaagtttgaaactaaacaaggccttagttgaaattaaacgtcgtgttcttctgaagctttaaacttgggtttcaatgtttactagggatttaatttcaatttcaacaaagagcagtacttgtgattggattgtacggatctgatgcagattaaactttttttctcctaatattcggcatgatttattgatttgcacataagtcattcatgaattttttttttgcagataataccagtggcggaggggccaatcccaagaggagtttgggccaatcgctggcccgtctctctccatcaatcctaagaaaagttgccgccggcgatggcgacgacgagcgacggattatggagcgcggggagtcgccggtagctgcgacgaggcagcgccgatttcgcgcaaaggttgttcagatattatcagaatcagcagcttccctgttcagtaagactgattatctgtcaggttttccacttctcctagctgaatgttcacggcttgttcttcgactgcattacagactagagagcagaatgatttcaggcttgttgttggactgcattacactgcaacctggctttcttaattatgcagtgatagttcggttaagtagaattttcatttcaatatgtatgacaccgttgactttttgcataacacttgactattcgtcttattaaaaatctagtataaatatgtaaaaaaaaggtttagactgtagtttcttggatgataaaacaaatcacaacatatttatacatttttttatggataagataaatgtccaaactttataccaagagtcaacagcgtcatatatttaggaggaagagagtagttgagttagctcgcttcgaatgtaccactaagcaattgagtgacgatatcgcagtatctgatgaatgatatcacattttgggagatattcaacggtaaatgactctgatgctgatatatatagacatcaatgactcagggtgctcttgttattatgtgaccgacttggataatggcggcctcgaatcaaccaaatagtggctttagttccaaacttttttgttagaaccctagcactcgatttcaccacgaactcaagaacacgataggtagctggaactttgtatttctctcacgatccaacaggatcggagccgccgctgccttcaccgccgagttccagatcgatgccgtttcagacagtacacagtagtttttaatctctctctctctctctctctctctctctctctctctctctctctctctctctctctctcttcagccataccacaaggtctcagcccactctagcctattacatggccccttccggcccaacatatctaggattagtaatacgctggtgcttctctctttcaaagacgccttctgctcctccgccttcatcctgtacttcgtcagagtccttgtcgcgcctcctcttggtaacgtcagcttccttgcttatcctgacattctcccttccttggaaaccggcttgcccccaagccagtgcctttcttagtaatgcgcctgtctaggaactgctgcggactctgccaatggttccactgaaatggttcggtagacagaacatgaggattatagccacgagcaaccttgagctgagagacatggataactaggtgaatgtggcaagagggaggtaaagccagtttataagcaactaatcccacccgctgcaacacttgaaaaggtccaaagtacttgaaagatagtttatggtttgctctgcgtgctactgaagactgcacatatggttggagtttcaagtaaacccagtctccctcctggaactccctgaaagtacgattcttgtcggcataagctttcatttgttgctcagcttgatgtaaatgttgttgaattagctgattgatgagatccctatccttcaaccacaaatccaaatctggtatttcacagtcatgcatagagatgccaaagtgagtcggctggtacctataaatgacctcaaaaggtgttttatgcacagaagagtgataggaagtgttgtaccaaaactcagcgagatataaccaattggcccacttagttggagttacatgtataaagcacctcagaaaaatttccaagcaccgattcacccgctcagtttgaccgtctgtttgagggtggtaagaagagctcatgtgaagcttagtaccagacttggtgaataaatgttcccagagttgacttgtgaataccctatctctgtcagagataatgacttgaggcataccatggagcttgtaaacattcttcataaagacagtggccacagagaatgcagtaaatggatgggtcaatggtaagaaatgggcatatttagagaatttgtctaccaccactagaatgcagttatacttgtcagaagtgggtaatccttctatgaaatccatgctgatcacttgccaagcaccctttggaacaggaagaggttgcaatagacctgggtatttaaccctctcaggtttggcctgttgacagatctgacattgcttcagttgttgctgaatttgctgcttcattcccaaccaagcaaacagatgtttaatcctcctataagtgacaggaaaaccagagtggcccccagcaggattatcatgtaattccttgatcaatttcagctgcagatctgtgttattacccacccatattcgacccttgtacctaatgaggccttgctgcagagtataatgctccctagccttcggattcaaagacaattcagctaagagctgggaagagaacttgtcctgctcatagccctgtattacctcttggagccaagagggagaacaagaagatacagccagaatctgagcactgtcaccaaggtcttttctagacagggcatcagcagctgaattagcactgccctttctatagacaattctgtactggagccccaggagcttagtaaatgccttttgctgccaaggtgtatgaagccgttgatcagacagatgagtcaaactgtggtgatcagtgagaatcatgaattcttggtgctgtagataagatctccagtgttctactgccaagagtattgccatgcactccttctcataagttgacaaccctttagatcttggtcctagagctttactcaagtaagcaattggatgaccttcttgagataacactgcccctatgcctccatcactagcatccgtctccacaatgaaaggaaaattaaagttggtaatgctaagacaggagcagtaatgagagcttgcttgatctgctgaaatgcaacttctgttgcagcagtccatttgaaagggactcccttccttaacaactgagtaagaggtttacagatcaaaccaaaatccttaacaaacttccggtaataaccagccagccccagaaatcccctgagcttcttgacagtagtgggtactgcccaattctgaacatccaaaatttttctaggttctgtagacacaccatgaaccccaattacatgtcccaaatatgatacttgttgctgagcaaaactacacttactgattttgacttgccagtgatctcttctaaggagttgtaaaacttgtgttaagtgctggcagtgtgactgaaggtcaggactgtatatcaggatgtcgtcaaaaaataccaaagcacacttcctgagcactgaagacaatgtgtcattcatggccccttgaaaactagcaggtgccccaattaatccaaaggacatgaccttgtattcataatgacctaagtgtgtctggaatgcagtcttatgttcctctccaggtttcatcctaatttgatgatatcctgctcgaaggtccagtttagtgaaccatttggaccctgacaattcatcaagaagttcttctattataggcactgggtacttgctcttgacagttaaggcattcaggtgtctgtaatctacacaaaggcgccaggtaccatccttcttcctcaccaaaagagcaggggaagaccaagcactctgacttggttgaattacccctgagtctaacatctccttcacctgacgttcaatttcatctttgagttcggggttatacttgtagggcctaagacttactggtttggcaccttctatcaagggaatctgatgatcacagtacctttctggtggtagttcagatggttcatcaaagacatcatgatattccaagagaatctgcttaatgctatctggataggactgctcttctgtgttttggtggtcagtgattttcaccatgtacataatagagcccatcttggccaaactcatcaattgttccacagatatttctgcatagctagtagtgctactgctgattcccaatactctgagccactgattttggtactgaaactccacccatttgttaacccaataaattttcatggggctatactgctctaaccaatccattccaagaattatgtcataacctcccagtgggataagcttgaaatcattactaaagttgtgcccctgtgtccaccaactacagttaggaattacctgagagcacactaactctcctccatcagcaatttggactttcaagggtttagtcaacaattttaccccagacatagatttcccaattttctcatcaataaaagagtgggagcttcccgaatcaattaacatcaatagttcagtcccttgtatccaccccctaagtctgatggagttgcgtgactcagttccatttaacgcttgctgagatatggccataacaatgatatcttccctttctggtgaactttcagtaggtgagtcctcccctgaatccccctgtaaaacttccaacaactcttgaacaacatgcaattgtactgcagttgcacacttatggtctctcccccatctctccccacaagtgaaacataagcctttcgacctcctatacgcctttaatgctgccagcctatcttcctttggtctgttagaatcagcagttctcctttcttcagtgttgatttggtttggttctcttgtcatagacagagttggggctgtgagcttgctggatgtcttgacataattgctgccttcagtcctcttataaggtgtgggtctacttccttccatagcttcttcctgtaacaaagccagagaacaggccacatccatatcttggggcctcatcatcataacagatctcctcacctcatccttaaggccatcaacaaattttgtgacaaagtacaatgcaggcacagtctggtcatatgccaacagccgatgcattagacagtcgaatcgctctacatattctgaaactgaattggtttgcctgatgtgtatatattgtctcaccatagcttcatgcctatctcgagtaaatcgagcacagactctttcacataaatcaaaccaagtaatgccaatcaactggtttcgcacagattgcaaccaaaatgctgcgttgccaacaaaattcagcgtagccaccttaacccactgcccaggaggaatgccgtaaacattgaaatacacttcacaattagccttccacatctgtggattatccccattgaactgaggacatgtcatgggtggaacacttccaacaataattccagtacttccactacccccttctggtactcctgctgattctaccacaaaaggcgaaatagaattcaacataggatctctcataccatggataaacgatggagttggtgatggcgatgcagctgttggttcctccttgatgtctcccaccgccttctccgccttggcctgacgaagcatggcgctctccagttgttccaccttagcactcaaatcccccagcgacgaatgcaaatccccaactcgtttctctacttgaggcaacctcgcttccaccgccgccatgaactcattcagatctgctctgtttctttcttccgcctcagtccgcatcttctcaatatcctccagggttttaagcagcaaatccaacatcccttcctacgccatgatttgcgcagcctacttcgtaacgtaccgtggtttctccaggatcaaagactcgcaaccgctccgaactcagccaacccaaacgcagcaagggaagcgagttccctttttgcggattctgctcgagagcagattccaatccgcgcttcgtgattctacggccgagtcaagaggatatggttggagatggctctgataccagattgttagaaccctagcactcgatttcaccacgaactcaagaacacgataggtagctggaactttgtatttctctcacgatccaacaggatcggagccgccgccgctgccttgaccgccgagttccagatcgatgccgtttcagacagtacacagtagtttttaatctctctctctctctctccagctgtgccacaaggtctcagcccactctaccctattacacggcccattccggcccaacatatctaggattagtaatactctggcgcttctctctttcaaagacgccttctgctcctccgtcttctgctcctccgccttcgtcagagtccttatcgcgcctcctattggtaacgtcagcttccttgcttatcctgacatttttcttcaaacttttaactttttcatcacatccaaacttttctacacacataaacttctaactttttcatcacatcgttcaaattttaaccaaatttttaattttgacgtgaactaaacacacacggtgatgcatgatctgcatcaattctcggatgtcagaggagatctccgaattactcgttttcagatttcggatgaaggctaaaccccgaacaaatgcaagtgcccagtggttcgtcggaggtggaatccccaaggagacatttgggctaaaaagagactgggtccacgcggcccctctcactgtgtgtcaatcctaggaggggtcgccgccggagacgtacggatagcacggacgtcggcgagtgcgaggagatttcttgcagactgtacgttctgaattttcatgttttcggtgagcgagtgagactggatctctgtctcattttactcaagctgttcttggaaccgcattacagattatgcaatttgatgggtaaagaaccgcgcgcaacttagccgcttaattaaatatgcagttagtcagttaactaataagttgcttctgaacgtaggagtactcactaataagtaataaagtactaattgcattatgatatcacaataagcaacagtacttgtcaagagtatatgggactataggactagattctacagtggagcacgtaggattgacttgtgccatttgccgtgtggttttcttcagaaataccgtagagacagatagcactcatgagtcatgacctgaatactcctactccatccgtccaaaaaaaagataaaccctagtttccgtgtctaacatttgatcattcgccttatttaaaaaaattataaaaaaaattaaaaagataagtcacgtataaagtattaatcatgttttatcatctaacaacaataaaaataataattataaaaaaatttcatataagacggacagtcaaacgttggcacggaaacccagagtttgccttttttttgggacggagggagtagctgttagggcacccacaatggttatttataggctatctataagagatccatgtcagcatattttcctacttgaaagagattaaataaagagagagagcaaaattatctactaacctagagatagtctatagagaaaaacgagacaatggattagagagctatagatacccatgtagacatactattgaggtggtttactattaatctagtctattgctgagatgtacatgttttattagatagattgtgggtgctcttagtgacagagatggagggactgttatctcatgacctactttaataatggcgacctggaattaaccaaacggagcagcatactgtatatctgaattaattatggctcgtccaaccgcgcgtactgtactgttgagtggaaatgtttgtgcgctttctgaaacctatactgatcgctgatcccataattcatgccctagctagttcattttggcaacatttgcaaggtaggagtagtagctagcagctcatcaccttagaccctgtttaattcacattaaacttttcctaaacttccaactttccatcacatcgcattaaatacaaaatttttctactcacataaactctcaacttttttttaaaactattaacttttcttaaacttcttctcaattttaggaactaaacacagccttaacaactgaactgaatatgtacgtgtgactccatcagcagtcacctatccagaaagtgcaaatttcgtccgacaatttctcatatccagttttcggatcaaccgatcaaaccaaaacggcaacaaaaaacaaaaaaaataaaaaatatatatcgctgatgcgcgtgtgatgattgctgtggttttattctccgaacccccaaaagaggcgtttgggccatgcagcgactaggccgtttggttgacccaatacttgccttctccactcggcccacgggcccacaatgcgaaggctgaactgaagcccacctacactcctgcgtcttcctcctctccgccgccgccgccgacgagcacaaccgcacacgagacgacgtcacccacaaccgcacgcgcagatccgagaggcgagagcgagagcgaggtgggaatggcagggaggctgaccgcggcgggatcccgcgtcctgggcggccagggcgccgctgcccgcgccgcggtgtccgcgctccgccaccgcgccggcatgggcctccccgtcggcaggcacatcgtccccgacaagcccgtaagccgtctctcgccacacctctccccccccctctcatcgaccttgtgctcctccgatttctctctccgccgatgcgatttctccatctaatcgattcgatttgcggggggatttggggaatttgcagctgccgacgaacgacgagctggtgtgggacaacggcacgcccttcccggagccctgcatcgaccgcctcgcgccgcacatcggcaaggtctgattcccaaccctcatgcactgaatcacatggattcgtgggggtctcatctggtttgatttgatgtgatgctatttggtcagtacgaggcgctggcctggctttgcggtgggctcggattcttcgctactcttggcttggctgccaccttgaacgacaaggcctccaagatcccctatgtgagtgccaaatacttcattgtgatattttactttctgttggatggacaaacagtagaattgctagcatttcaacaacagtaggagtgaacaaagtaatactgtaaggttagaccaaatagccaagaaaacattgcagggatggggaaaacattaagatgggaaatggccactgtgattcaatccctgtgtcatagttaaacctttatttcgcccattaggacctgccgttgtttctgcaaattcctttccttccattttgctcacatgattctctaggtggcacagttaatatgtctaaatgttatatctagtcattctcaagttagaagattttgcctccagataacttctatgaggattaggccactaagggagtatgctgatcatctgcattaattatattattgaattaacaatgcacattgaagttttctgttgaacaatagctccttgggttcgatctgttccttgctactatatagtatatactgacaagtaattctatattgctcctagctatatagtcatatagcaaagagtaattttatattgttcctaccctccaatttatagaatcagcaaaagagggaaaaaaaagagtttgaaaatgatttaatggaattgagatcattgttgtccattttcataaaaagaaatcatcactagactaaacaatcatagacctagttgtactgtaagaaaatatgatgaatagatggcatttttgaaggatgtatattttaaatcctaaatgcaatcagtcatgtgctcttatcctcttgtatcaaccagttacaaatatatatggcgtatt

SEQ ID NO: 12238 - DNA, 15372 bp, Oryza sativa
  unsure (1)..(15372): unsure at all n locations
catactggcactagtttgagttgaatcatggagtggggctgtgataataactttgtgtggtctttgtagaactctttaacccttcaattttctgacctattagtctcctttctcagcacctatccaatttcgattctgaaaagggagttttttttaggggaaaaagggaggtgtttggtctagcttcatagttcatagagatatcatggtgacatggtgtggtaggctaaactgttgcgaactttgaagcatgtaggattttatttgtacatattatccgtgttcgatactccgtacaggctacacagtctcttactttctctaagttgcttctctgccatagatgaaatccccccaagagttgatttgctccttaaaagtgtcagcagatagcagagttactatacatgttaagcaacttgcctcttcagtgttccaggtctgtaacttaattgaagaatgaaggttcacaaaagagagggggcaatactgtattttcaatttatctccttatatttgccagaatgctattagattgtgcgatcagtcattaaagtaacacttgttacagtagcaagcctgttgcatattttgtcgccaatgggcaaagaaatatgcatactatttctgagcatagaccggatcaagttaagataatggttcatcctaatcacgacaaatgatgcctgtctgcttttgatttgcttttatgaacaacttgactgaggattttttatatttcttcatgcagactccaaaagtctacccatttgacaatttgagagaggaacttggtgatagaccatagaagaagaccccacttcctcaagtgatgtgatggactgaattctcttgccttctttaatcagagaaaaaaacaggacaattccaatgttcctgatggttgtctttgttgtcgctgtatttttataagttacaatcttgtgatttgctgaatcctgccaagcatggctttgttctataataatgcgatgagtgtctttgagcaactattgcacatgctaaggaattgactcttgacgatttaaagttagaattttcaagtgcctatatttgccctgtaacttcttacagaatgccctggagtctgaaccacggtttgcgccattcatctgttgggcaatgttctataggtgcaacctggctttaagctgtagaaatgagacgagttatggattctggcattgtttccaaaccagctcttggccctgttttgggggtgcctatagcagctttaactttgagaataatccccggttgctctaaacattccatattttgacttgcattctgataatttgtagttgcagaatttcaaaagttggcaaactcattccttttcagattctcgctagtttactcaccggttgtttctcggaatcttgctccatgcatgcagattaaacactgactattccatattcagctcagattcagaatcacatatacggtatattactcgagcaacatatattcaacacaagatttttataacgaactttagcacgcaaaagcacaaatcaactccgaggtacatgtagatgtaatgtcactcactcaagcacaggaattaattaactcaacatcggtcatcaaagtagtaagcatgcgctacacgatcacacacgacaccgaaagcaattaacaacaaatcaaataagcgaacaataacaatagctgcatgagctgctcatcaagcactaattaattcagatataatcaaattagctagcttaattagctagttgctggagcactggaagccattggggagcttcctgctgcagcggttgacgaggacgctgagctggacgtgcggctcgacgccgacgaggccgagcacgttggcgcgcagcgccgtgcagaggcacacggcggcgtccacgtcggcgaggccggcgaggagcccgcagcactgctcgccggaggacgacggcgacgagttccccagcagatggcccaggttcagcagccctcctcctccgccgccgccgcccagcacgtcggcgcacgccgccagcttcagcgcgtcgaacgggcacttggcgccggcggcgcggcgcgccggcgccggcgtcggtttggcgcaccgcgatctgcaggcgccgccgttgcagcggccgccgcatgcctccgacggcgccgcggcgaacacgaggaggctcatcagcgccacaatggcggcgactgcaagcttgtttctactactgttcttgtgcgccaccgccattgctaattgacacactagctatagctctagctaagggatgagttgaagtgtttatgtgagagttcagtgtgtgtgttgtgtgcagtgcacaagctagctagtgaatttatagcaggggattgagctgagctgagtgagtgagctaggcatgcatttgcttgagtcggcccggcatttgttgttccggcaattacataacaacataatactagatactgatacattttagtatcacgaatctggatagaaattaggttgttactctctccgtttcaggttacaagatgtttttgactttggttaaagtcaaactgctttaagtttaaccaaatttatagaaaaaaataataatattttcaatccaagataaaattattataaaatatatttaattattaatataataaaactaatttgataatataaatattgctatatttatctattaaatttaaaacagtttgattttgactaaaatcaaaaatcttataacctaaaacagagagaaaaacagagagagtatatttttggacggacttaataattaactaagctatatatctgggtattctacctgtactcttaaacgatcttgtggtcgacaatattggtgcatacagtatatccgtgcacgaatgaagtggcatcgatcgatctgtaatgttcatgtgaagtacaccttcaccttcaagtttgcggtgcttaattaagtaagctcatatgacgaggcatgtatgtgccggagaccatagggtcagggcattattagattcggcgccgtcgcgtcatcattcgatgggcaaattaatgggatcactatatatgtgtgtggctttgtccgattggtgcgggcacctatgcagctcgatcaatgtagaacctaattgtacacaaataaatgaattaattcatcttcaatctgtggtcttcgcttctgatctagcggtggtttgtaaaggcgctcccaagtcccaaatgatcgttttaattaatttggtccaaaatttgtggaccacactcaatattcatctgaaattgatccaaagagggaaggacggtcattgcctctgaagactgaagtctgaactcttgagatgcaattaatcccgaaccaatgagctagctagctgatttttgctgtgccccgtgtgatcgatgcatctcaagatgtaagaggtgtgaacttgtgagttgtgatgcacccatgactgactgaaccttaccttcatgtgcttcacacttctggagcagtggagtcgattgaaaaataaacttcgatgaaaaaaacctcaaaatcaacttcaaatttaaggttaaaaattcaaattttagctaacaagtataagcataagcgaaaagatgagatcattcaattttcatgtcagaatatctatctgaattttaagttttttttatcatgtactcacaaagtcgcgagtcacaagctgggtggaatgccatcgagaagaagttggagtaggataaggggtctgtgtaacaatgccggtgaacggatggcggcggagctccggcggacggcggcggattccaggaaggacgtgagatggggccgttctgtgccgtcatgtcctgcaccgttagattgaaatcgtgtggttcagataaaggaggatgaccccgcagcagattcatgtgtgtttgggccgtgcaacgaatgggccgggccctttagtcgcgatgtctgcatatgtgggccacagcccacagccccagtttgagcactgcgcgcggcttctgttgttgcgctccggatcgattcggttgtggtcacaaacagaaattcagaattgatgcttcgccatgatatggtcgtcagattcattagcttgatcgatcgatcgatcttacgtgttcatagatcagaaagaacgatcatattaaaaatgaaaatatattaattgatgatgatcacaatgcattggttatacaacaacaaattacaagtgagtgattccaatggtacaacaaattaatgcggatgcaacaaattaattaaactaacacaaggggggataatagcttattcaggccggcttactcatgcatcatgcaacttaccaatggccattgcatgaaaacaaactcaattaaatataatataaatatgcattaattttgcgcaaatggtttgagcactttccatgctcaattaattagcaggtgaagtcggaggggcaggtcttgccgcacttgttgaggatgagcttgagctcgacggggacgttgaggttgacgccgagcacgttggccttcacggcggtgcagaggcagacggcggcgtcggcgtcggcgaggccggcgagcagcgggcagcagtcgtaggggccatggccgacgttcacgccgagcgcgccgttgagcacgttggcgcacacccgcagcttcagcgcgtcgatcgggcagcggccatggccgtagccgccgtagccgccatgggcgccgccgaacgacggcagtggcaccaccaccgtcggcgtcggtatgacgaccgccggcgcgccgccgccggagcagtggggctcgcagccgtgcgccgcgacggcgaggaggaggaggctcagggccaggacgggagcgaccttggaagcagccatggatgcagctagcgagctagtgatcgatcgaacagtgagctcagctactcggctctgctgctatggcttgtgttgctttgggttggtttgcttggggtgtcatggcgtcttgtatttatagccgatcgagcctatagcaagagtggtttgcatggatgcgttgctactttctctccagacggaggccctgtttggcacagctctagcttcaccaaacaatttcagctgagctgtgtagagctatctccaaaatgaactagacatgcaaagttgggtttaagcagcttcatataactctacttcagatctaactcttgaagctaaatttaggagttggagctctaccaaataagctcttataatactcgttgtttcggacaaaattaagatcgaattttaaaatatttgattataaataatttataaaataattttcttaaaaaatatgtactcctctcgtcctataaaaaccaactttcagggatgaatatggagaaatgcttgttaagatctaataaaattatatatttgttaatatttctatatatattataatagaaatagtaatcaaagctattttttaagagaccgtgttgttcactgtaagtattatcaatccgaagtaagcagatgcaatggtacgtgcatgtgggggtgtcagatgcagggtacgtagctaggttgtctctggggtgcatgtgcatacatggccagttgttcgttagagtactcagagaaagagatgtgacaaggaattttccatgaggaatcagacattcagacgttgttgaattattcccccatgcatgcatgtgtaagagggtaatataatctcgatcgagcaatcatgcaaatactgatacatgcgtccatgcctcgatcgatttatgccgtgtctaagctagggttcgatgttcatgtggactaatgaaagtatgaaacccaaagtgttatatatcggttcatctactttcaaaatctagctagctagcaccgtgcaaattcacgcacggcaatcgtatagctcgccccttctggtaaagatgggatcatgggagtcccaattttacctgtgcgtacgtaaagattcctttgggataaaggagaactgtagaaattatagaggattacaattcattgaaaaatgttcctatattgtccttacgaacaaatgaatgactcatataaaatcctttgaaattcatatggaatggctcatttcaacaaattttggaggaaaattaacatgagcctaaatctcatgttttctcttcatcatgagtcgtgactcctaattcctttacttctcctatggtgttaccaaacttttttttaaaaaaaaaaattcagtggattcatttcctgtaacatttctttaaaaaaatcctgtatgatttgttgtggcatgctattctatttatacgtttttttatccttgtgtttttgaaatcctgctgtgttacacaagggctgaaaaagcgcaaagagcataccattatgctgaatgtacaaaatgttacacctgactgtgaaagtgcaaattgttcaacactagggccatgctccgattaattgctctggttaaaaattatcagcaacatggtatattagatggttacaccatcatataaaataaactgttgagatcagctgcagatcgagaggtgttgaaaacacccactgccattggttgtgccggaccatctatgtcgatcgacgagtacatgcagcatatgtgagcttgcaggatgaataatagataggtgtgtgtagccccagtacccagctggtttgcagcacactttttctgcatgtcgtgatgtgttgtgtacaacgcattgacacaaggcatttgttctccattgcaagcaaactaattaatatatatacatatgcacagtttgattattattccagctattttttcgccccagtgattgctaaacaacaaaagagagttctgaaaaggagtacactgtccatgatatattattattgtgacagtgttgaacaatgaacagttctttaaagagtcatcttgtgtgagtagatgacttgtagatactaactctacaatctgcaaactgcaacgacgtgagaaggacgacaaagcagaaatcatgggcatgacaaccgggcctgaagcttttcgatacggttacacgcattgcagcctttcagggtttttttttctttaatttatatacacgtatcatatgcacgatacatatatagtcaacattatgaggcccggccaaaagacaaacacgaatacaagcatgcgaaaatggttctcacgcaccgacaggctgaaaattaaaggatatatagaccggataaaatcagccacagtgttgtaataatcatgataatttagtgttatctaatccctctgttttagaacgtaagatgtttagcttttaatctgaagtcaaatttatataagaaaagtagtaattaacatggtttagaccaaccaaaattattataaaaatatatttaatagtaggtttaataaaattaatttgctattgtggatgttattatatttttctataaatttagtcaaatttcaccaaaatatctaacattccgaaagagagagtactatgctacggaaatactataaaatgctatccgatatagtttacatttgtaaacaccatcctaatgtcatcatgttacctagataccagatctggtatatgggtatcacgtcgggtactcttgataccggacggacccgtacctaaggtatctgctaacattaaaatgctacttaggtgccataacctaatacatgtgagtattggtacctacggtatcatgctaatatcatggtgacatcagcatgtaaaatattccattgattgaatggtataccgttatctagtcacaccaagacagtgtttgaatctcctgaagatgtagatgaagataaaaattaagtgcttcacgcaaaatgaggtggtaataacatgtgattaattgagtttttaattattacaaacttgaaaaatgaatcaatcttatattttagaacaactttaatatagaaagttttcacacaaaacacaccgtttagcagtttaaaaagcgcgccacttttatccagtttttgttagagaaaataacagtgcctaagaagcattcatgttcatggcggtggggaggaaagaaaatgctactcctagttaattcaaagctcctttgcatgcatatgcgtgcgcgctgctagcatgttggtcgcaatggcgcagtgattctccatcttttgctggacaagaagacgtcgtacggattcatgcaagaatcggacggaggctgcagcggtggacggacgacgaacgcaagctcgacggcggcggcgttccggcgagaaatcaccatgcgcgcgtggctgctgatggatcgagccagccatgggccatcccgtcgcgccccggcccattaacgcggatgtgcgcggagagaagttaggcccatccaaatttcgatcgcttgggttagccggatttggccccatgggccgcctaatcgcatttattttgtataggatgggcctttgtgcttcatggtgtcatgaagcacaaagcgaatgtgttaatgatgattagtactactatactatcttgctggtaataatcgttgtcacaacaatcttacaccacagatatttcattgatgaagcacaaatcggttttacaaaactcgttaactcattcaattcgaatacaatacaacacaatacaaaattgatataagggaacagagtaaaacaacaacacatcttattctggatgacatagccacggcatgcatgcagctagctagctagccatcatcgaatgaaatagataagcttaattacgaatattgtttctgcgcatttgtccatgtatgcaagcttgagcagctgagcttaattagcaggtgaaatcggagggacagatcttgccgcagttgttgaggatgaggctgagatcgacggggatgttgaggttgatgatcccaaaaacgttggcctttatggcggtgcaaaggcatacggcggcgtcaaggtcggctagccggacagaagcgggcagcagtcgtcggggccagcttcgatcttgacgccgacgagcccgttgagcacgttggcacacaccctcagcttcaaggcgtcgatcgggcagcgcccatgnccgtgcccaccgtggtggtggtgcgacggcggcgtcggcaccaccaccggcggcgtcgggatgaccggcggcgcccctccggggcagtatggcgcgcagccgtgcgcagcggcggcgaagaggaggatggtcagggcgaggaggggagcgatcttggaataagccattgctcaagtgtgatgaagtgatcgagcttagctagtagagttaattagctagctaaggctgctttaattagcttgtgttttggattggggctgaggcgtctggtatttatagatgaacactgcagctagttgcatgcacgatgcatgtgcactgggtttgtgtccatggatggatttgcatgcatgggcatgggccgcttgttttgctagagatcagatgcgacaaggatttttccgtgaaggaaatggctagctagattggttgttgattaattatttcagccatgcataggcgtacgtgcagagcagcaatttatcaatcatgtccagtatctaagcctaatatatttgcgcaatatatatatatcacacaacttcacgatcgatctatcgactattgtttttcttacagttttatatatttcagctaagtggcctgtcacgttgtttatataccttatatatatacgagtaaatatctcagatcaagcgccgaacttgctgataactaactacaatatctgaaatcacacatatatcagtacatatacatatattcagaatatcacatataatggttcattagcaggtataggcgtatagttaactgatacttcctcagttttagggtataagacgttttgactttggtcaaaatcaaactgctttaaatttaaccaagtttctagaaaaaatatatttaattattaatttgatgaaactattttagtgttataaatattattatatttatttataaacttagttaaatttaaaacagtttgacattaaccaaagttaaaatgtcttgtaacctgaaacggagggagtagattattatctgcagcttgatgatgagtttggagcttagcccactggaggatatgcgcgcgcacggtatacgctatactccacacgcacatagtatattcagctctctgattaataccccagtttgtcgctcattttcatgcatgcatgcatgtggcagtggatgtattctggcaaagtattactcatttccaattaagcaactttgcataatttcctgttgatttgattttctctttagctgtagcctgtacgtataggtctctacagaaaaaagaaaaacagagttaattctgaagaaatgtacagagaagcattatgcatgggcatatctaaggcattattaattgaaagatgggaattgaagctggtatcccgaggagattacataacagctttacaggattatattgtatatccacgcaagatatatatatatatatatataaataaatacgtacgactggctggacaatttgatgaataatgcagggatgcgtgggactaattgccgactggtctgaaagtctgaactctgtacaactctgaagtctgaagtgagaactgaaaacaaactagcttatagctggaagtcgtctgctgtctctgcaccagacgacgaacgtataactagctagagctacgacctttatccccatgatataatgagctgtgctatatatgctcattttctaggtttgttatattaccagtttagctagctaatcgatcggtaaaataattcagtagctcgaatcagttttagatgaaattaaggccatctaatcgaattaagtatgaaaaccacgtgcatgcattgacaaaggatcgtacactggcaggcggcggacgtccggcgacggagacggcgtcgaactacgtacggtggcaacgcagcaaggtgggctgtcttcttctaaacgggcctaatctgattaatcatttcaagcatgggccggcaggaaagggaagcccaccaaaaatgctgcgtttgggaatatgttaggcctgcaggcccggcccaattagttttgaggccggagcaagatcagatcagaatccgagtcggatctctcatcaattgggatttgtccccataaagctcgggacgccgcccaccgccgccgccaatcaccgagcgcatcgcggcggccggcgagggtaacgacgacgagcaccgccggcggtggagcgcgcgagtaagctggatcaagagcgcgacatccacaccatggcagaagaggaggagaagaaggcgatcaccggctcggcagcgacggcggcggcgcctcctcctgctgctgctcaggtcatcgccggagcagccaagtatgtcgtcgccgactagcagaagaagccatgcgctgctgctgcgaagaagaagaaggtgcggatgcctgacaactacgtcgcttccatcctgacactgaagaggaacccacggcggagccccgagtacatggagagcctctcgccggaggagcgcgagggggaagtggaggacgccgagctgggcgacgagttcgaggcgttccaggaggaggttcgccgcgccgtcgagaacgacggctgctacatggtcggcgagagctacttcgctgagacggcggcgatccaggcggcgatggaggaggagtggaccaagatcgacatgagccgtgtcatcttcggggactgggactacgacgaccccgaatccgtacagtacctgtgaattgtgattaattaatttcagactttgtatgaaatggtgtatctgattgtctctatcagttggttgttcaaaacagagagattaatttgattcatgctattataaatttgacaaaaagaatatatatatatatatatatatatatatatatatatatatatatatatataatgtttattttcgtgatctctattcgttgtgttctagtggaaatctcagattattattttttttgttacgcggataaacgcatacagctagctagtccgagcataatacggaccgagaaaaaaaatcttttttgttattacgactagctatgctccaggtcgattccaaatttccgatccgcagtgctccagggcacttcaaccatcttagcagcttcttgatgcagtgctcagtgactgatcagcaagatgttcgcaccaagaaaggcgcccctgggatcttaaaaacaaggcatctttatcttgttgcagaatacgacgagatggagaagtgccccaactggaaagttcagtttttttgcctggctcttgactaaagatcgtctcccaacaaaacgcagcttgcataagaaaaccatagtgccggctccaacctgtgatctttgcaactttgctgatgaaacagccctccacctatatatgcttccagtgccccttcgctgtggccttctggggcgcgatgaatataccggtcaatgttgcgacgcttgctgagattgcttctctccccaccccgcctcaagttcccttgaagcactttagggtgttctacttgctacttcctccgtttcacaatgtaagtcattctagtatttcccacatacatatatatctatctagattcattaacatcaatatgaatatgggaaatgttagaatgacttacattgtgaaacggagggagtatgcttttggaacatgtggaatcaccaccacggggttgtcttgagacacgaggctccctctttgcgccgtttgctgcagcaatgtatcgaggacgcctccctcttggggggggggggaaatcaaagttgaagacagacatgtaatttccacctggaaagatctcttttcttcctccctccgctctctcaatatgtaatgctctggactttgtaaaactgccctttgctcccttttaatgaattcaggtgggaaagctctccccccagtgaattttccaaaaaatacaaaaaattccgatccgctttatatgtgttaaacatgtgtgaataaatcaacatcaaatatatataggtcgtgagagcgtttttcaagccatatgaaagctatctcgtgaaaaacaatactccctccattttaggttacaagatattttgactttggtcaaagttaaactacttcaaatttaactaagtttatagacaagtatagtaatatttacattaacaaattagttttataaaaaaaataataaaatatatttttataataaatttatcatgggttaaaaatattactttttttaataaatttggtcaaacagtttgactttgatcaaagttaaaacaccttataagaaacagagggagtattaaggtagctcacaacaatgaagtaatcattattaaagaattaatggtacagtaaggtacaatacaatatagaacgagctagccacaaatgcagaagcgagtaaacaagataattatttcaagattaattaatctttaatcatgcaactcaagccttcagagccagtcattgcatgaggactaattatgcatgcatggttgagctcaattagcaggtgaagccggatgggtagatcttgttgcacttgttgaggatgaggctcagatcgacggggaggttgaggttgatgcccagcacattggccttgacggcggtgcagaggcagacggcggcgtcgaggtcggcgatcccctgcagcagcgagcagcactcgttggggccggctccgatcttgacgccaacgagcccattgagcacgttggcgcacaccctcagcttcagggcgtcgatggggcagtggccatggcggtcgtacgacggcgttgtcggcgtcgggatcaccggaccaccggagcagttgggctcacagccgcgcgccgcgacggcgaggatgaggagggtgaaggcgaggaggggagctacgactttggtggtggaagccattgctaatgctaactgatgaagtgatcgagcgagcttaattagctagtggtgtgttagctagctagctaggctgtttcagattgtgtttgctttgtatcgtttgcttggggcatctggtatttatagccgagccgatcgagctagctctgttgggaaactatgcgtactgaactagtagtagctagaggactagaataaggtcggatccttatatgccactgaaaattggtcggatctcttatatatcattggaaattggctcttttcttatatgccattggtccaaatttgcgcactctttcatgccactaccgtcagtttaaccgtgtgttgaccgttaactctcaagtaaaaagacatatttgttctgtctaagttgttaggcatgcatgatggacatatatatgattgcttggttgtgtactgcatggaccagctggtgtacttcgcgagaggttggacaaaagattttgcctggagggaaaaatgatattctttcagttcgatcgtcgatcgattcatggccaagcaagcaagttgacgaattgcatttgttgaaatatatggccggaagtgtttgtatctgctgactaatacttgttctgatcgagcatttctgacatagttgcatgccttggagagtttttatttttgcctaaatgtgcatcgatatcgtagtgtcatagcctccttaatttcttccaccattaatctactactggccggatcggagctagcttaagcagagtcactataatgtatactctatatatacacgcatagtgacctccatgaaaatttgtagcccagctgaccatgcacgcgcacttacctgcacgtagcgaccgattttaacttccgtttattagctcttaggtctttaatgaacaaattaaaacggagttctgattctgaacaaattaagtacaccagctgtgaattcttgacctctatgcctccagaaacatggtggacaagaaattatgggcttaattaatttggctactggaatcggagctgtgatctccatgaccacgttaaaggattatattaatttatcagatcagtctaccatgcttatccatgtttacagatgaacacacgtacagatcggtgatcgaacaaaatcgctggaagagagtaagtccgagccagacaaattaagtagctagcaacgtaacatgcttacatgcatgatttgggctccatgatttaatgtgctaagcatgcttgtttctttagccatatcggtttagttaattaatgctagcaggtctccgatcgtgttatcattccacactgtttattcgaaccattacgttctctgtcagtatttcagcatatcccatatgcaagtgttctgcagtctacgaacatatacaaaggaattttgctcaattaccactataaacatgtaggcaagatttgcggcatgc

SEQ ID NO: 12239 - DNA, 1683 bp, Oryza sativa
cattattttttttattttggatataattgaagaaaaacatttagaaaattaaagacaatttgttcctagggtcagatgcttgtaaagccgatcagggctgcgttcatttccatgagttcccaactccctcctcttgttttccgcgcgcacatttttcaaactactcaacggtgtgttttttgtaaaaagtttttatacgaaagttgcttaaaaagatcatattgatctatttttgaacaaaaattagctaatacttaattaatcacgttctaatgtaccgctccgttaacgttttcgtgcgcagcagctgtgttgggaacacagagtaaggccactctcccagccacgatcccctaaccctagaatctggggacggtaatagcttataatctagttcttgtagttggcttagaagcaattaacttcagacataaaattgtttttttttttgtgcaaagactgggttatgacacattgttctgtgggttgctctatttgaagtggacctagttagacacatcttgtcatttgggtcattcatcttttctaaccctttttagacagaccaagcttagttactattttaataggacggaaccagaagttcaccaatacgtcgaatgtgctttgtgttgaaacgaggcacacaggtactaggccgaaaacgagcatggtacgtgcaaggcctgcattcatgcctagccccatggcttacatgtgtgtgcctgtttgaggaaatcgttagatacagatcaatcattttcactcgccattatcactaaatatacgatgacgtcccatgttttgctacggaatatgtagaggaatatatgttaaacattgtataaatgatagataaatttatatgttgatatattgtgaaagtgatgtgggatgatgatttagcatgcttgaatgttaagatttagaatgtaaaaaattatagatgtaattgctatgcttgcttgcatcttgagctttagttatttagtggattgatatgatatacttgcatgttaggttttaagagtagtaataattactttgttgagtattaatactttgtgggtcaattatacagatggtatagataaacgctgtgagacgaacacgttttttgcatacatgaaaaagaaagaaattaaggaggacaagctatataacaattatcatgtggagaacaacattgctataatgcgttacaacttacaacaattaagtaattcaagaatgataaagtaaggtacaatgtagaatgggctgcaaaaatgtagaagtgaataacaatataattatttcaagattaatctttaatttatcatgcaactcagatcaatcctcgtcatcgcatgaagattaattatgcacgatcgagctcaattagcaggtgaagccggatgggtagatcttgctgcacttgttgaggatgaggctcagatcgacggggagattcaggttgatgcccagcacgttggccttgacggcggtgcagaggcagacggcggcgtcgaggtcggcgatcccctgcagcagcgagcagcactcgttggggccggctccgatcttgacgccgacgagcccattgagcacgttggcgcacaccctcagcttcagggcgtcgatggggcagtggccatggcggtcgtacgacggcgttgtccgcgtcgggatcaccggaccacc

SEQ ID NO: 12240 - DNA, 4865 bp, Oryza sativa
gagtcgagcttgctgtttggatctatacgtgtactgcacgagctaaagcttactccctccgttcaaaaaaaaaacaaatcttaggattcggtgttcaacgtttacccgtccgtcttatttaaaaaaattgttaaaaaaattaaaaagacaagtcacgcataaaatattaatcatgttttatcatctaacaacaataaaaatattaattataaaattttttatataaaatagatagtcaacgttggacatggaaacccagagtttgtttttttttttgaaggagggagtagaatatttgcatccgttatgattaattgtttggttgtgtagtgcatgtacgtgatgatttatttgcttggttgtgtactgcatgggccaggtatttacgagagataggacaagattttgccaggagagagaacatatattctcgtttaattaattcgattattcatggggaagaagcaagttgaccagttgcatttgttgacattaatatatggatgtgtgctttatatatctgccgaataatacttgttctgaatataatgctttctgaaatgcttgctatggacttgtaattttgcatacatcgtgtcatacgtaaccatccatccattcctctctcctgcattattttaggtacttgagctggcagagtcaatatgctccatttgtacacgcatagccgggatggcctccgtgaattgtattggctagctggatgtacctaaagatggatctagcttgagaacagctaagtcttagccttcgctactgacaatatgatcataggagcttaattccatgcgaggaattcccactaatttttttttcatacatgcatgcaaagtgagggtcgttataactttgtctggttagtttagactctgatatttctttgtggagctgatcccgaggatcacgaacaagattatattagttaatcacaccgtcaaaatagtactattatggatcagattatgaatactcgatcacatgaacaggctgactcgatgtgaacaaaatggctagccagcatcagagaaaggtggcaacatgcattattaggctagctccatgattaatgtgctaagcatgctaatttgtttaacagtatgggtttaattaaataattaatactagcatcaggtcgaatcatcgtcgtcattccacatgcgtgtgtacagtttgttcgagccattacgtcatcagtcactcagtcagtatgtcaagtgctctgcaaatcgagctaagctagctataaatttttttttttgagtgaattgcactttgggccgattattattgcctgtgttttattttggactaggttatatctaacattttcactttggttcaggttttcttaccttctactgcacattgggccactattttgtttgccacttcttgatttcattggcgggcttacccgcaacacaacaaaccaattaatattccatctgatcttgatttatttactcattgatttagctgcttgacttcaaccttttttccccgtaaaagttcatctgagcttagaacaaatcattgcatcgagcttgcgggagacaggtacagcaaccagctaaaaccagtcttgattttgatggttcttcaagctggggaacagagcacatagagaaggaatcctggtgctttgcttgatcatccctcagatccatggcgcagctgcttaatagagaaaagaagggaaagaaaggagatggagaagaagggtggtccaatttaaaacttttgtaaatttatctagtccaaagtgaatataacttcaccccttgtccaaagtaaaactttgttaaattttcctagtccaaagtgcaattaactcaaatttttttttgctctcccacggtatagacatgaaggccctttcaaaaaaaagagagaaaaacttatgaattttacaggatttgtattctatgataaaaatcctataaagccttttaaaacaacggattgatttctactaataattccttcagaattcatatgaaatgtgctattctagaaacattttggaggaaattaaatagcctgaagtctcaattcattctttctatttctgtaacgacccgcctctcccaggccaggcccgcttacatctgatagctttcctaggtaggcccgcttatatctgatagctttcataggtcatagactgccctcacagaccaacacatgtcttttctgcacactttgtcctcactcgtgtgcacccgggaagaattttaggccaagcacgcttaaccctggagttttttggagattggcttccggaaaagaagttgcaacttgttgatatgagtattctattaatcctattaagtcctaggccgggatgttacaatttcctatatgttttctgtgtttttcctgtgtgcccatcaaaaacaatttgaaactttccagtgtttcaatctcataggaattgaatgagtattatattctacttttatgttttttttctcttttcatatgttttggaaatattggttgggttatgacacattgttatatgggctagctgctctatttgaagtggacctaggtaggcacatcttgccacacctggttcttaaacttgtatggtttgtgtcattcagattcctaaactcttaaaatataaatataaatctcaaaacttattgaagtgtgtcatctaagtcccagatcgtcacaacccatctaaaatcctatatgtcactcatgtgacatgccacatggacgtgattggcagtcatctgactgacaaacgggatccacttaaaacattttcttttctttttttcttttcttctctttttcttctgcttctcttttttcttcttttcttctcctttctttgtgacctaagcaccccatgcggcgatggtcttgagaggaaggaggagaaagggaaaaaaagagaaacaagagaagaaaaaggaaaaagagaaaagagaaagaaaaaaataaaaatgaaaaattttaagtgggtcctatttatcagtcatgactatgccagcatgacatgtcacatcaatgtcacgtacaaatctcttctttacccttattaggattcaaaacttagtaacccttctaatcagccaaaacaggaagcagcccgccaacatcccaaacaaaacgagatgcacgcgacatgttgggccaaaagagactaccatgatgcaggacccacatggctaggaacatgtgtggaccggcttgaggaaataggaacagttaggtcaagaattgccgcatcgcccatgattatcacatatcgtgcgagtgtttttatgcacggatagaaaagaaagaacttaaggtgaacgtgtaagctatatggcagttatctttgtgagaacaaaaaatactactatatataatgggcgttacaatatacaacaaccaagtgattcaagaattttacattataatatagaacgagctgcaaatggcgaatcgagtaaacaagagaattatttcaagattaatgtttaacgctgcgtcgggaatcgggatgaaagatcaaactcatgaatcatgatatccaacatgctgcacgcacggtttgagctcaattagcaggtgaagtcggaggggcagatcttgccgcacttgttgaggatgaggcttagatcgacggcgaggttgagtttcatgccgagcacgttggccttgacggcggtgcataggcagacggcggcgtcgaggtcggcgagcccggagagcagcgggcagcagtcgtcggggccggctccgatcttgacgccgacgagcccgttgagcacgttggtgcacaccctcagcttcagggcgtcgatcgggcagcggccatggcggtggtacgacggcggcgtcggcaccaccaccggcggcgtcgggatgaccgggccaccgtggccgcagtagggctcgcagccgtgcacggcggcgacggcgaagaggaggaggctgagggcgaggaggggagcgaccttggtgatagccattgctaactgatgaagtgatcgagcgagcttaattagctagtggtgtgtgctagctatagctatgtttgcttcggtcggcttgtgttgctttgcatcgtttgatttgggcgtctggtatttatagccggattatggctagaatggatgtatttgcggttgctagttgcatgcatgatgaatgattgcttggttgttgtaggtgcatgggccaggtgttcgcgagagataggacaagattttgccaggagagaacagatattcgtggaaatcgatcgccgactcatcacggggaattgaagcgagttgaccagttgcatttgttgaaatatgtggaaatgtttgatctgccgataaaaatttcttctgagtctctaaagtgatacattatattgctgaaacaaaactgaaaatatacctcttttaaaaatattttacgtttatatatctacataaaaaatatttgcataaatatacctccaccgcatgacaaggatgcgggaccgagacagtgccgccttgccattccatgggaccggtggttgcgcagtacggccgtgcggcaccgtctccctcccgcggcgcggaagcgcggcaccggctcgctctcgtggctcggagagaagcagcgcgggaacgcgtggtcccgagacggtcccgcatcgccgttgcgcggcgcgtcgccgatgcacggaaccgcaccggtcgcgcgtagtcgttgagcgggaccgcgcgttcccatcctctaccacgcgcctgctatataccagaaaatttatactgcgcggcactgtttagtactgatttcatactgtttggcaatattcatgggcgatcccgcatgttgaatgtgcggaagcgctccac

SEQ ID NO: 12241 - DNA, 10113 bp, Oryza sativa
gaccgtcgcgatcccgcattttcgttctgcgggatgggtatatttttacaaaaaatttgtatgcatatatataaatgtaaattattgaaaaaataagtatatttgtaaaaaaaattcttatattgcttgcctgatgttgtaattttaattggaattgcttcaatcaaaatctttcaattttttttaccacaggattatatttcctacacgatttgtgctccaatgactacaactccttcactagatctggcaacccttctcctacatctccgataacctcgacgaatggcagtggagtaatggtttagggtcccaagttaggattggttgggggtgggaggaggaggcagatcatcgggtgggtttagagggatggccgtgagagatgacggtttgacggtggacggtgaacctagacaagcaaataggcacctaattaaaacggtgccgataccatggggatggaggggcagtgggccaacgttggatgtggggcgctaaaataagtacaaatatatttatttattatatataatattaaaaatatagttaaatatatattttgaagattgtgttattgtttaaataacaagaattgtaaaactagcaagtataagctcaagatctagtttaaatagtttaatagtaggctataagtcaactataaaacttacagggaggggaggatagtggaaaaataagttgtgttagctctaatgtaatagttaactattcataatttaagataactaaattaaatacataggtgagagaaagagaggagaaaaaatagagataaccttattattcatctattataaacgttatctgtaatattagcttatacttaatagttgactctgctgttaaaactagttcttagatggtctgacatctatgaattgtagcctagctggattgcacacttacatgcatgtggcaaccgattttccttttggctctatataagtaggtcgctaacgaacaaaaactgagttctgattccgaagaaagtacaccagctgtgagtacgttcttgatgatcgataccacgtactgcctctagctagaaacaagaagacaagaaattatgggcttaattgagctagctgcttgcatcgggagctgagatctgatccccaggatcacgttacaggattatattaattaatcacaccatcagaatattaatcagatcagactaccatttatgtgaatacgattagagatgatgaacacacacagatcgatcgttgtgtgaacaaaatggctggaagagagtactgcaaactgcaaagtccgcaccagataagttaaggtagcgacgtaacatgcttacattcatgatttaggctccatgatttaatgtgataagcatgctgatttctttaaccatatatggattaagttaattattaatgctagcctgtcgaatcgtcatcattccacagtttattcgcaccatgcattacgtacgttctatccgtatttcagctcgattacagtataaaatgtacaaatttaagtcagtgatgtttagatgtttatttctgaactactcgtattaaaattcgtatctccatatgcaatagtgacctggaagaaggcggcggcgattggacgctggagcatccggcgaaccatgacggaactgtggtattggcccactcaatttcggccggatagtgcacaaacctgacggcctaattaggcccatataaatttgggccgtgaaaatgttgggctacgtgacacgttctatatgggccactttgtttcctatgggcctagcacatcttgccatctgggccgctgatcttttctcacatcacatgtgcaaataatctttttttttaaaaaaaaaaagcgaaaagaaagaaagaaaaaaaaaatcagcgaagttatcacgatgttcacgatgccggaggatatcatttcattaaagtttcaaaacgtcattaccaaagtattaggagtttattcaatgggacttattcagatgagtaataatcctaataattaatttgccgggaaaagacacctgaacgaactgtgggggttcaggatgtgcacggtgccacccgccaaatccctttcctttccttgccgtgtgcttcggcccttccgagttcaaacagttagttgaaaccgaagcagcagattaattttgtacaccctccgcattttaatgtatgacgtcattgacttttcgatcaacgtttgaccatttgttttattcaaaaatttcgtgcaaatataaaaatatttatgtcatacttaaagaacatttgatgatgaatcaaatcacaataaaataaataataattacataaattttttgaataagacgaatagttaaacgttagataaaaagtcaacggcgtcatacattaaaatatggagttagtagtatatgtaaccgatcagtggagacggtcaaggcacaagacaaattatataacgatgcgactgtgagatgtgcaagttttcttttcaatgacaaggctatcgatgacgctgatattggcgctagttaattaatcatcacttaattttggtggaaaattggaaatctccatgcggttccgtgtcgtccaaattaatgtgtcactgttaattttgccttcttcttcttcctcccggtcgcatatggtgcctgtcaccatccaaagtctccggtctgtacgcccaaagccgcgtgttcttgctagctttgtacttatgctaactgaacattaaattaactggagctaagcttgacgagaaggtcggtcgatggcggcgccggagaaggtgttcgtggcgctgccggcggaggcgaagtccggcaggtcgacgctgtcgtgggctctcggccatttccgggccacggccatcgtcgtcacgcatgttcatgtgccgccgcagatgatccccgtcagtacgtaactgcatcatccgattgtttttcttctcttcttcttttttttctgaaagatttcatggttatatgtatggttgtccggccaaaaattcatggaaaccatggattagttcatgggtttgtgactcctcttagccctttcaattcagaagactgagaaatttggctataatctgtctagtgttgtattgattctgttttggtcgcagtgggagtcaagttccatgccagtaaactgaatccggagcaagtgagcttgttcagaatggctgagcgtgacaaggtggacaagcaattagatcactacgtcaatcaatgcctgaggatgaaggtgtgacgggttctgttaattcctgtgaattcattatctcaagatggctttggcttgttattgacagccgttttttatttagaactacagcttattgacagtttttttttcattgtctgtatatttcagatgaaatgtgagaagctagtcattgagaacgaaaatgttgtagacggtcttgttgaactaatcaacttgcatggagtgaccaagctagtaatttcagctgccccagacaggaattactcaaggtaaatatttcttctaagaaaatataacacttgaaatgcaaagctttattttgtaattgaagacaaaataaattatgcagagagctgaccaataattgttgttttctgtttcagaaaaatggacaaacctgcatccaggacagcaacagaaattatgcagagagctgacccatcatgcaagatttggtttgtctgcaaagaacggttaatctgtacaaggtaaaaaccttttagtagtaattttgcgatttatgatgattactgaatagtgaagctcaaaaatctctgattcattttccatgatagtggcgtggaagtagaaattgcacctggacatacgcctttcattcctgatactggtcacgatgctctgcagttgacacttcaccaggaacaggttcttctgatcttgcaatgccatcttatggtttcgaatattttgtcttgtaagagtgatgacataatatggtgatttccttttccaattatttaggatgacaacaatgaatcggaactgggtttttacgatgagatcaaagaagcatgcaaagcagctgacaacttaatgatgagagctttaagagaatcttacagacggcagaaagcagacgaagaagtagtttcatctcttcagaaagtaattcgttgtcctttgactattttattcagaaacgagaccacttagaaaaaaaaacatccagatttcatatgaatatattcttcagaattttgatcagaactctgaaccttacaggccaaagaatacgaggagctgtacttggaggaggttaaaaagaggaaagaactggaagaagcacttctgagagcaagcgaagaaattgcacagttaaaacaagaaagagatctacccaagaatgatcagaacacaaccatggaggaacagaaagaagtgatttcagacaatttgatcttagaggcctccgggcaaataattaagccgctgcaagagtatcttgatcatgatgagaactgtgtcagagaaccggagacgttgctcatacaaaggaagctagctgcatcattttctccatcatcagtgatgcagtcgcctttcgatgaagactgctgcatcccttcatacttcatctgcccaatccttcaggtattcaatgaaaagttctgcacataacttagcactgctccttgtgtagattaacacaaatacttgtcacttgtgatgaattgaaatagaaatttgatcatttgcattgtaatggcaggaggttatgagggagccttgcattgcatcagacggattcacctacgaaaccgatgcgatcagatcctggcttgatggaggacggagggtatctcccattacaggacagccgattgtgcaccagcagctaattccaaacctttctctccgttctgtcatccaagatcatgcaaggaggaatcagtattcattttcctgatgtaacctttaattacgaactgtattggtggcatatatatatatatatatgtgccattatttcctgtaaatttcttagctatcactatgacagtatagccagttcggaaactgcacaactcacagaatgcagaaagaaaatgctttgattttgtctaatcctttgtgctgcgctccttcaccttcaattttactggagtacttgttttgcttatgtttatgcttatgtataccgcttattaccgataaaaaataatttgcgtgcaaaagttttatataaacattcttagcgattttttttaaaatgctgtaaaacaaactaagatgggaaaactaaaaatttcaactctaaaatttaaattttagcttacaagtctaagcataagcgaaactatgggtctataaattggaaaaagttcagccaggttcaaagcataccggatggctgcacggcccgtgaaatctggcaacggcccacgcaacacggcccatatattccgcccggcctaactctggtctcgtcgggataggtaaaagtctaagccccagcccatcatagtatatgggccagattttgctcgaaatttcccagcccacacaagcaaacgcgccagcatttgggccattgtccaaacgaggcctcgcgctcgcggagtcgcggtggcgcactttactctggcccaaactggcggattcggcccgtttaatccgattcccgtgtactatccctcgtgggccccgaggctggacgccttgtcttctccggcggcggcggcggcggcggctcacccgtcggcgcaaggcgtcaaaactcaaaagaagaagtctcctttttcgctgtcaagaactgcatgcattgctggtcagcagcagggctcggctggcaacactaccacgagcatcgtttggtcgatcatatcgacatatcatatcacagagcaaagcgacgacgacgaattcgagtactgccatggcttgccatgccgtgttcatcgtcaacttgcattagccacttgatttcagacttaaagactttcaagtactcactcaattgcatcgctgaaatgatctcaaggagcattttggctttctcccaaaagccggatcaatgcaatgcaatttgatctgtcctcaaaaaaaaaaaatcaaggagcatgcatgtgagatcaacgggatgatatgatgtgcattacaggaggtgacatcgatcgatcggtgcatattgtttgtataatataattttaagttcgtcgtgggtacccatgccggccaagcatgcacgcatgtgaacctgcttagtaattaatctacgttcaatcaatcaatcaatgtgcacgtatatgtttaaatgtttaattaccatttgatttcagaaataccgtgatctgcctaccatcagctagcagctagcacagcctgacagccacacggacggtctcacacattttgttgcttctgaacaactttactgaaaaaaagaaaagaatttctcaagtctgaacatgcatggatggagcatggagtcaacaaattaagctactactacagctgatcagatcgagccgagtaatccacacggatcaagcgagttcgaggaagcgagctataacatgcgacaaatcagccgcggattatctgggttcacgggtggcaaaagagatcggatacgagcttgattaatcaggccatttgcttgttaatttgctttgctagctaattcgaccattccaacctagctagctatctcccttcttctgtactgtactgttgtgttctgatgcatattcttcgtggtggtgaccaccgtgatgctggttttgatcgtgtagggctccggtttttgatacgcgacaatgactcgccttgtctgaacctgaatattccatgaaccaagttgagctaaagctttttagccttgacatgatctctcgatcggtgccagccatgcgttttttgtcacctgctggagaagattatggcattttatcactactcattatgcagtggccgtactgtctggatatatagctgaaagttcttctactatctatagttacaacccagctagttatatatatagttaattgacgtcattgatctagctaactgtacgatctgagatatatagatcttttcgtgtcactcttgttaattacagttacagtactagctagctagttactatcacataaattgatatacatatagttgtactagatttatcaaatgtactacacatcatatcaaccattcgttatacgacgatttaggtttcaactttaattaatcgctttcgcttttttttcttttttttttgaccaatggtttgttgcacatatatactagatcagcttgcagacagtggcagatggaggggaactagcagctgtgccttggctccccacaaggtcccaatcaataatatgatttcttaattacacccaatgtctttctttctcagaaatcatttctctatagtttctgattaaaatcattgctatatagtgtacttcactaatcagatactaggtatacacatgtagctacataccaaatatgcagtggatatttcattatatatgtacaatatattttggtttcaacttacattgttctcgcatttccttatcatcattgcccccacaagaatctatataggagtatttctcaagagaaaacaatatatgttatatgtaaatatattgccttttttattattttttaaaatatctattagatcggctgtggttgcgattgcgcacacttggaatgccgcctccccaatgggatgcataccagcaatttaacatggaagaaactaacagttggctagaccatagcacaaaaagacatcacacttcacagtggttagacgagattgttgacgacaactagtggtgcaactatgtctctaggagccaaatcggcgcatcgatctttcggccgtgacgaattcttacattttggtacagaggttgcatgttatcagtcttatattcatacctgtattatagagttctacaatcattacttcacgggtaaatttttaccatccttgaaaagctaccggaagcaaggtactatattttctagtgtaaaatgtggtatctctaggtactaggtacctcgaggtaccaaaatttttagtgtaaattgtagtatctccaggtattttcttaggaaccgtataatctctcttacttcactactccttctcttccttatacttgtcatacatgggccactgtggccacgctatgccagcttcagtgtattggctatttgccgagccgacatcgccttagttgcatatctatccatgagacaatgacatgtttccttacctagttctcaaaacatgttaaatgttaaataaaacttgcacattcttttgtttacaccactcaatggaatgaattttgtaagatataaacagccaaaggtactaagacgtaaggtattttagcataagatcgatttgatacctcttgtatctcaatttgggctagagatttacaaattgacttattactaattgttttattcttaagtgttggtgtttgttagttgttctttatgggttacttaaatgtttgctctctttgagaggattatgtaataagtggttgtagctcctttgaagtaaagattggtttaattccattatataaaaaagttgtatgaattaccgaattttataatgaataaagggatatctcttaatacctctcaaggatcagacgtataatatcactcagttcggtaaatatgtatttgtgtccacatgtaacgctccgcttttcgtgaggcgttaaaaactaattcggcaaaatcctaattgcgaaaattttcgttccttgtgtgtgagtttaagttgtgccaagatctcaattcaaatccgtccttgatccctctcgtcaccatcagaaattgccccatcgaaattcctcttccgactcaagtctccaaatcaaactctgaaattctatccctctctttgaatcatcgccaaatacttccccagatccaaaatatccaaaaccccgtcttgaatcctccgtctactccttcctctcatcgagatcccaattccaaaatctaagtcaaattccaagttcaaattctcttcgaatcaatctcctccgaaaaagtctattttgccttcctcggatttttgtgggccgttttctcctcggcccatctcctctcagccgctcctcctcctccccctcgcacgtgcgttgcgcgtgcgccgcgctcgagagagagagcgcccactctcttcccatcctcgctctctctctctctccgtttctctctctctccgtttctctctcccgtaaaggctcccccaccggcgccgatttcccgccgccgccgttcgaaatccggccgcgccctcgcatccgcgcgcgcgctcgtgcgtggccgaccgcccggtcgccgccgcgtcggccctgccgcgcctacgcctcccggccccgctgccctgccgcgctacagctgcacggccccgcgcgcgtgcccggccactccaagccgcgtgcgtccaactcccggaggcagagccctctctccctcctcctttctccctgaatgacgtgggcagagcccccttttcctccctccccttttgctttttccccgaccggcaccattcccgcctgcgccgcgcagccgcccgcgcccactctgccgctgcccccacctctgcgccgcagcgcgcgcgtgtccaagacgcggaggcagcgcctctctctcccatgcgctctctcctccctcagctcgtccaaaatcggcaaggagccgagctcctttctccctcccctttttgctttttccccgatcggcgtcacgcccgtgaccgcctctgccgccacttggccgctagctccgagcacgaccgccagctgccgccttgatcgccctaaggtcggtttgaaccgacctcccgcgcgaactgacctcgcctccactataaagccgagtccctcctctcaaatccctcccacttcagtccccaccgctgcagtgccatcgccgccttgctgccgccgtcctcgccttcctccgccctcgcgtgtgccgggaagccggcgtgcgcgcggagccgaagaggagctccggccaccctgcttcttccccttccccggcccgactacggggaact

SEQ ID NO: 12242 - DNA, 24745 bp, Oryza sativa
ccctttccccgctcacccttgtcccctctagcttgtgtggtagctcggtagccctgcgaacacgcgtagatgccgccccaaggaccgccgccacccggcatggccccgccgccattgccgcccacccccggaggccgcctctcgtcgccggctgccctcggtgctcctccgtcccatccggcgccggaaacggattccttgaatcccggatatgctcccaccccttttaatcgaacccccgttgctccggtgaagtccccccccttttctcgccgccggcgtgcgccgccgcgattcgtcaacgccggcctccctccggcgaatccgatccggtggctcacttcctatcgtccgtcccatcgttccggtgtactccctctctctcgaatcgtcgcgacgagctccggtgaactcggccgtcgtccgccgtccatctcggccgccccttcttcctcctcccgccggcccgcgtggctgccacgtaggcgccacgtcggcgccacctcggctttgaccgagccgagccggtgccgcctccttcctcccccccctcccgtgcgcgcggtccacggtgcgccaaccggctgcatgtgggcccgctgccatccgatccacccggggcaccgcccgcacaccgcacccaccaaaccctagcaccgcacccgcgtgcgctctccccaccgtgagccttgccgccgacatgtgggccccacccaggaccccgcgaggtgcacccggtccaccggaccgctccctcccccttccgcgcgccctaatgggccgcctttcccgcgcccgcgccggcccaaatggcttggccgagcctccttcgacccttgggccgcgcccttgccgcccgaaaaagtctaatatacatccctccatccttttctttttcagggatttaataaatcctttttcctttgtcccataaatcaattccttgttacaaaattccataaaccattttctttggtcccacatgacagtgactgtcaataatattcttgagaatattatttctataaattccataaaccattcctcttattccagaaattccaattaaacttccaaaattcatatcacccactccgtaactccgattaactccgttccacttccagtaattccgtaaaattgagatctatttagtggcactactaattagtctaaataggatctttcttttggtcttttgcttaggttttcagttgtttgcgtatagttgcggttatcggattttcgtcgatcgcgggttttctcgaagattcgtgaagcttcgtgaagaccttgagcaaggcaagtcaccctttgatcaattgcccctataattgaaaagtcattattattttgtttgcaacttgcattattagaatcacacacttaacttgcttggcctcggtttgcgtgccaaaccgacggacctacccagtagtcgcactaattttcgtaggtcgtactaccctgaatccttgtcgctccacccttgtggtacctcagtattcgtgctctctgagcgcgtataccaaatatcccacatacaccgttgtttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaaagtacaaccacaaggtggaatgggacaccctggctaagtagctagtcggttcagggaaacctcgcatgccaatagttgggaacgccggggcggggtcggttggagccaaaccgggttcctggtaatgcaagaacgagaagcttgctgaattaccgatcgaggtggttggagtttgatttgtgaacgcctaaaatggcctatgtttatgtgaggatttgatccttctatgtggcatgaggtatccctgggtcggcttgggaaaggctttgtcgcgaacctctgacaccggccagtgtctggagtaagtttgtgtcttgtgggtaaagtgtacccctctgcagaggttaactaactgttcgaacagccgtgcccacggtcatgggcggatgtgaggtggttcccgttgcatagatttgtttgcctgtgctttgtgaaaagttgttgtggtgtgggaatcgtaaccagaatcagcctatgtggcagatggatgacctgagtggtcagaaacgaatctgtgtgattcgggatgtctgcgggcatcatagactaggctttccgagtggaagcggattgttgtgctgctgggcagctggactctgggagtccgagaaaatgaaaaaggctctgggagccgattaatcaagtggaatggctctgggagccgagaagtaatgatctgacctgggaggtcggtacattactaaatgagctgttgaaaagcatctcttaaagtcgaatcgagacgcaagtctcttttcgcccaaacttaaaaagaaataaatcacttagtgatttcaaaaaaaggtcttcaaataaaagatttgcaaaacaaccttgcctctcttccaagcttgcattaaacacctaaattcccgtgacttgctgagtacgaaagtactcacccttgctctatataaatatatatatatatatagttcctccgccctgaagagaagataaagtgaagtgaagattagggtttcgtcctggttcctagccgccgcctgtggtgttgggtgttagttcgttggttccgctgctgctgctgttgttggtgtttcctcgtccgtgtcgtcggttgcattctcgggttgttctgagttgcaacctaagttaaggtaaataagtcctctatttattttaaggattgctatgattcatatttgtcactgtgggtaccagcactatgtcctgggactggtaccgagatcgtggtttcgtaggaagcggttcacgccgttttccctacgacacgctcctgtcaggtgccgttgtacggcggtgccagattggggtgtgacaccacatcctttcttacttaaagttataacccaatgactcctaaagcttaacatgcaaagatgccacatcatcatccactaacaatcactacatttaaacatcatgcaaatatgttatattatctataattttataatttattaaattttagagctttgaaaatgcaagcatgttaaatcatcatcctacataattcacataatatttcaatatatatcttcattatttttttataatatcctatgtacttatatagtttaacctcaattagttaatgttatttctctcttctctctctcattaagacacaacacatcaattgtttttagtgtgtaaatgattaatctatggtccaaattatctccaccttttcttcttcattaagtcatatcacctcagttatttttagtctttagatgattaatctatggtttgaactttctcctttttttttcttctctcataaagtcatataaccttacttttgcatttgaatcattattccatatactatttaaatttaaattatcataaaccacgttaactttatgttgtctagctattttatatattattttttacttattattatcatactgaattcccacagtaacgcacggggtttcacctagttaatgtataattctggtcctcagagcttgagtttggactttgagtagcaatcacctggtacctatgtagagttcatatccaaattccagagctccaaatttacaaaagaaaatactaattgcaacttcgattgacatctgaaccataacagatcataagcacaaaaaatacatatatattgaccagtaaactgatcacccggggtcacaaccaacacttacacatgtaataatacatactggccaatggttttttcccagaactaattaaactttgcaagcataaacaaagacaaaacagacagtttccaaagttcagagagttcagactgctcacagtaaaccaaccaacaaaaacatgtagacgacgtgtagcacactgtcaatcgatcgatcgatcgatcggctgcagtgtcccaatgtgattaagcacactggtagtcggatgggcagatcttgccgcagttgttgaggatgaggctgaggtcgatggggatgttgaggttgaggccgagcacgttggccttgatggcggtgcagaggcagacggcggcgtcgaggtcgacgaggccgtcgagcagcgagcagcagggctcgtacggcgccaccgcgccgatcttggccttcacgaggccgagcacgttggcgcacacgtgcagcttcagcgcgtcgcgcgggcacgacccggcgccgccgccgggcgtcggcggcctcggcgccggcggcttcggcttcggcgtcggcggctccgggcagtaggtgcaggcgctcgccacggccaccaccaggaggctcaccgctagaacgagcgctgccttcgccgccattgctgcaattgatcaagcaaaagctagtgaagaagatgagagtactaggtagctagtagatcagctcgaggttcttgctttgtgtgtgcttggagtgtgcatggcgagtggtatttatagtggccatggaggaggaggagatgatgagaagaagatgtgtagatggatgagtacgtgaatgggggcctagatgatcatgcgtgtggtacccaatcggcgaatcaagaatcgatcgaccgtgagtatggatgattgattggatgaactgtattgggattgtgatttatattctccgtgtgtcctagttgcaatatattcttttcatcacaatatattgctagattttcccggatcaattaatactagtgtaatacatgggtactgtacaattagagctcgtacaattatggtttcagatcatctagctaaggtccgtaacttctgtttgggtttatatattgatcagtatataagttttttttagactggtcaccggagggcgaaatacccacctgaatatattacttccaacgatcttacacaaggtgggtttcgcctatgcaagcgcaggagccctagaggataataggaaaaaatacacggccggggacacagagaagagaatacaaacacgtcataaccttcctaccatgcgcacacacagcggcaaagagataaactgagaagctttgacgtttgccacctgcaaaaacacccaatcaaatttcaaatcaaactaatgctagaaccctaaatcgacatcatccacttcacatgcagacttaaacaccaggaattgaaggtgccagagggtctcactgccacatgtatgctggcttggttcattggcagtcgaaagactgtggttattgaagaccacccacacaaaaggtaggtctcatagctaaagtatataagttagaatgcctaaacttaaacaaaaaagcagattttaaattaaccttctattaaacttgttgtaagtaaccgtagctctctaagaagttgaaaactagatttgagtagctttttttaaaaaaaaaactttttattgatttggatttacgtctcgacttttaaacttgctacttgaaaaccgcatgctctagccaaagagctaccataaaagccaaggccaaaaaaaaagagacctaaagttttagctatgtttctatatatatatggagcatggacaactggttcaattcacatctcaatctaacagcttaattatatatcagcacaaaaggtaggcaagaagtttggctcttttgctggaataaggcagatatatatgagggcccaaaccattccacttgcatgctgaacaagctaggtacgttaggtggggaactacctcttgggtgtgtgtggtttgtggtgttgtacatgacttcacctgcatgccaagccaccaaagggtgcatatattgaatgcaattcaatattttataagattattcatgcatgatgttagtttgggcctatctattaatatgagtgtgagacatggtgtgggactgtgcatgggtgtgtatttccctcatttctgcattctcgaaaggtgtcatgcattgtgctcatcacttagagtcgtttcaaattacagactttgaaacttggaaacgtatcatatgcacacaagccagctttcttttatatacatcatgcatatcaactaacaaaacttcatcaattttttttaaaaaaaattgtacatgtgctttcagtagtatcatatttatatgtaaagtctcatcttcaaattcactatatatatgaagcaccaaataagacaaaattatgaccgatttattcccttgaaactaccagaaattatagttttttttgttacggctagagcataatgaatttgagattaagactttacacatatgtgtaatataatgctattggaagtatatgtacaatttctttctctagattttttaaattttgttaattagtatgcatggtgtgtacatggaaaggttatgtgtacaggatacgttcccttaaaacttatactacccgtgcggcatgtgagtcatcctagtcatactctcccttgggggtggaccttcccttgttgcaagctgtgccatccaccatagctacttgccagcaagggaatcccatgcatgccttatgtgttgaacatgctaaccttggaatcccatgcatgtatttttctttgaggtactgaatatactaacccttgaaacatagcgatgaattagtgcataattaattaagtattaaaaaaactagattttgaaagcaaaattgaatgtatatacaattcttgcatctcttttcatgagtacaggtatattttatatacaactgtaccagtcaaagtatactcttataacttaagagatatttaggtacaataactttagtgcaaaatttcacctagtaccgaaggtacctgctcaagtacggtagaatcactcataatctaagtctaccaatctaccgtgaccaaacatttgcataataatagctattggccggaatgagagtataatagcttttagaatgaatatggtgactccatttcgccctctctcgtaaattatctttttatataattgcaaaccaaaagcttaacattcatgatgacacaacaagagacgttagatatctcccctcaagcgtgtcaatttattgtgtgcaattattgttccctattaattgctataaatatataatctagcttaattatttagtaccactaaatatagctatttgctaattattcttgccgattttttttttaaaaaaattaacatttcatcctgattgttcactatcagttatcacagcaatgtgcgagctagctttcagctgatctcaaagcatacgatcgatgaaaagtagagcttcattttattggcgaatcattcatgggaatcaaacaacacatggaaccaagagatagatcaagaactaaagtactccaaacaacatcaagatacagtagtactctcaagctcgcagccatggtcatggagaaacaagtgcaacaaccagctctagtgcacgcacttgaagtcggatgggcagatcttgccgcagttgttgaggatgaggctgaggtcgacggggaggtcgagcttgatgccgagcacgttggccttgacggcggtgcagaggcagacggcggcgtcgaggtcgacgaggccgtcgagcagcgagcagcagggctcgtacggcgccaccgcgccgaccttggccttgacgagccccagcacgttggcgcacacccgcagcttcaacgcgtcgcgcgggcacgacccggtgctcggcctcggcctcggtgccggcgggcagtcggtgccgcaggcgctcgccgccacggccacggcgaggaggctcaccgccagaacaagcgccgccttcgccgccattgctatcgatcgagcttaatttgctaggctgcttcttgtagcttgtagctggttagctcgagcttgctgctgctgcttgctgtgtggctgggagtgtgcatggcgaggtgaatttatagggaaactattctaatttcttgagaggatgttccctcgtttatttaaaaaccatttaaacggttatgaaaaattctgaaaaaatttgacaacattcatacaacacatatatacaactccacaaaatcttaagtccaaactcaactcacacgtcgagatataaaaaagacaaattcagcatatgaatagtagcgtactgtttatatctaaatttgtttttttgtttctcgatgtgtagatcgaatttgaacttgaattttggtgcactggtaggtatcattatactctacattgtcaatttttttcagattttttcataactatttacatcgaatttgaaagaaaaaggtatacgaggggatattccctcgagggattagtggccatggagaagaagagatgagatgaaggagaatgtatggatgcatatgtcgtgtgggggccagatcgacgatcgtgcatgtggtccaatctggcgaataaggatcaattattcccggttttttatattttcttcagatttggatgtgcatgaaattgattggctgtgttgtgtgcttgtgatttatattctccagcgttttctgtcccagttgacatatattcttaattccagatgttcagagggttttcctcaggtatacatatatgtgtaaaataggctgtgtacatcgtttcagttggatgtagtggcctgattatccattttctaaaagaaacatacatatatgtgtataattatgcttccagatcatctaggcactctgcttagtctctcattctcattgtgtttgggcttataccagtttataagtctgaaagcaagggcaagggggtgtccaggaacccggtcaagaaaattgtttagctatacttcagttattttcacctgtgtgcaccctctgaatacaaacttagacatccacgtcaatttaaacttgatctaaagtagagtaagactgcgtttgtttccctgtgttgggaactcatttccttcgcatggaaaacgaaacgactcattagcacacgattaattaaatattaattattttttaaaaaaagaattaatatgattttttaaacaactttcatatagaaattttttgcaaaacacacaccatttagtagtttggaaagcgtacacacggaaaacgagagaggtgagttggaaaagatggggaaataaagaacacaccctaaattaaacaagtggtaccctatttcatttcgttctagcttcgtccctgtctgaaagcctgagcttcaaacaaacaattaagtaactttatcattaacgcttttgtggaagttgtaagccacttagtttagatatatatgtttagaagccaaagagcaaaaataaagaccattcaaaagcctaagttgaaaaaaaaggcctaaggttttaaatatagttcatgtggacaacttgttcacctcaaatttaacagcacgtcggcacaaaagatgtattggcaataaaccagcttgcattggctcttttgctagaatcatggcaaacataattaagggcccaaaaccttccatttgcatgttgaacaaattaactatacacaattttgggcgccgggggggggggacaacttagcgtgagcacaggagtttggcaatacgaaaacagagttagtacttaagcatggtctaatggggaaaaaaataaagcttcctaatagcgaaaatgaagtgtcgataattttgatactaatgcaactaaagataactcgtacagaaaaattactaaaatagctaaggaaaaatttaatctctcttgctaaggatgacttttggtgcttgttttgactaaactaatagtatatacacatattatacctattaaattgcatattttttgtcaaaaaaaataaatttagggatataactgtgccccatatgtcctattgagatcccccttctctcgggtgggtgcagtggtgaagatgctatacatcacttcacctaccaagccaccaaaaggttctatgaatataaatgtatttttttacacaaccatattaatcaatctacactcttataatctgaaaatacacattatatatatatatatatatatatatatatatatatatatatatatatatatatatctaattaacgtggtaatttcctagaccctaatatggttgttcttattttattcttcttaatgcttagtacttactccctccgtttcaaaatgtttgacaccgttgactttttaagtacgtgtttgaccgttcgtcttatttaaaaaatttaagtaattatttattattttcatatcatttgattcattgttaaatatactttcatgtacacatatagttttacatatttcacaatttttttaaataagacgaatggtcaaacatgtgctaaaaagttaacggtgtacggagggagtactgtatacagttaacttttcctcgacatgcatggtgcatgcgtcctgcttgagcttgtttgggcatgcataaattaattcatccgacagatattccaaatcttagagttccaatctctgaccattgcatatatgcgacaaaaaaatacatttccattttattgacgaaactataacaaatcatgagaaacaaaaaaaaatacaatgatcatagcgctaccaacggatcacgaaccatagaatcaaaagaaaaaaaaagcaagaaattaacaacacatcaagatattgggggtaaaaacaacatgaagatacggtactcccagccatggagtgatcaagtgcaacactagctctctagatctcgatctagtgcacgcactggtagtcggatgggcagatcttgccgcagttgttgaggatgaggctgaggtcgatggggaggttgagcttgatgcccagcacgttggccttgatggcggtgcagaggcagacggcggcgtcgaggtcgacgaggccgtcgagcagcgagcagcagggctcgtacggcgacacggcgccgaccttggccttgacgaggcccagcacgttggcgcacacgtgcagcttcagcgcgtcgcgcgggcacgacgacccgccgccgtagtgaggcgtcggcggcttcggcctcggcgccggtggcttcggcgaagggcagtccgggcaggccacggccatggccaccaccaggaggctcaccgccagcacaagcgccgccttcgccgccattgctgcaactaatcgagctagtgtagctagctagtagctcgagcttgctgctgcttggttgctgtggttggggagtgtgcatggcgaggggggtatatatagctcgccggagatgggaggggaggcaatgcatgtggatcgagctggcggatcgaggtgattaattaatcatagcgctaattgataaatgcggtttggatttggacgtgcctggggccaaatgtacatgctgattagtgttgatcagtgtgtggagttagggcctgtttagtttccaaacaaaatttttcacgctatcacatcgaatgtttagagtttagacacatgcatgcagtattaaatgtagacaaaaaaaaacacagttcgccagaaaattgcgagacggatcttttaaacttaattacgccatgattcaagaatgtggtgttacaataaatattttataataacggattaattaagcttaataaattcatctcgcgtttactggcagaatatgtagtttgttttgttattagactatgtttaatactttaaatgtgtatccgtatatcctatgtgatatatatgtgatatgtataggtaaaaaaaaaatttgccaactaaacagtcccttagctgtggtgagcagtgagctttgtactctgagaatgtgacccctctgcacgttgtgtccagatcacaaatattcttgtgtgtttgtttgctagcttactgtatggttcaacatgcatgtgagggatgcaatataatgcaaataggagatagctcgaatacggtcgatgatataacggagtactgattactggcctaaccatgtgtttgtggtacgataatctatatgccatctaagggggggtttcatattccttgaggagatatatatgtttcgttctcccaaactactacatatgaatagctgtgggaatttgtaaaaatatttgatgtatattggtatcatgtatatggagtatattagaaaatgagtaaatttcatctttaaatatgggtggttttatgatactatgacttatataaaagttctatggatataaactctaaaatatgtagttatttgataactttatcattaaatatgcggttttatgatactatgccttaaatatgtagtattatgataaatttgacgatatatatgtggttttgtgatacacatttttaaatctatagttttgcgatagtttcatcaaatatctgcagttttatgatatttactcttagaaatcaatattgcagtttggaccacctaaactttttcaatacacatcaacaacctcgagcaaataacaactctcttatctatatgtaggccatatcttatctatgtatagaaaagagagttggctgatacaaattagaaatgacaattgtccaatccaaatgaaaaataataggcaaatcttttgtaaggccttcggccaggccatttattctctctaatatattaggtaaatcttatgtcggctgttttctaaaaaaaagtaataaaattagttcaaactaaaactttggtagtaaaaagctatccaaattacaattcactgctctcagaatttttttactgttatttgtattgtatttgagtgatgaaaaaatatatacgaggggacattacttgggatgaaaaaccatctccaccatctgactctaggatcaaaagattcagaggttggatcagtcatatttctctagtctaagaatctagatatgacactaagggctcattcggaatagaggaaatgtgaaggaaaaatggaggattgatgattctttgaattgggtactgtagatgcattcgtttcaaagggttcgctaccttgaatttcagaggaacacctttccctgcccatgttttcatagtaaaaaaaaaaagaatccactcatctctttgtaagaatcctgcacacgaagaacaaaaaattcccatgttttccatttctctattttacacatacaatcttactgtattcctatgttttccctattcctacgttttttctattttgcattccgaagaagccctaatacaccatccattcgtttaaacttatgacagatttcttacaacttacaatgcctaaaaccagtgtacctgccaagaaattgggccgatcttctggctgaaactcactgcaatgtacgtggcctatcacgctccagcccaggtccagatgagaccagttattcagtgcccagcccgaatacttgtgaagactcaggacgactatagccgagaaagctagttggcggtcagtcgcgcgcccccctccccgcgtgactgggcacgtgtcgcgcgcggagattgggtggcgacgcgccgcgcgggtgaggaagagcgagttttccgttttttttttttttgtttttttccgtttctgtacggttggtttaccttattttttttccggttcggttggtttactttttattccggtttctcttctgtttttttctcggtttttttaaatttttatgaatgcaaagtttgtattcgtatgtatactaagtttgtatttgtacgtatacaaagtttgtatacacgtataaaaagtttatatacgtggatgcaaagtttgtatacgcgtatataaattttgtatacgttgtgtattttttagtttttttatttttaatacgtatgtatataaagtttgtatttatcgtatacaaagtttgtatatgtcctatataaacttcgtatacgtgtgtgtgtgtgtttttatgcattaaaaatatatatttatatatatatatatgtatgtatatactatatacacacacacgtatagaagtagtagattagatacagagagactagaggaagggggcgactgatcgcgcgctcgcctccccgcgcggctgatcgtgtatcagccgcccccgactatagctggctcggcctgaatatcagtacctcacatgaggaatacaaggtagcacagcacacgagctcaaagacaacaacaatacaaatgagtcccaaactcataatcacaaggcgacttggacacgctttgcaatagtataaatgaaatgaagcgaaggcattaatttatgaaagtgagaatggtaggagttcaccttggagatcagttcctttcaatacaccaaggcatatatggtacaagaatagattgagaatcctatctgttattatgtgctgccaacggtcgacagtgtgggctcaaaaatctataaggcttcaaacaaaagcgctacttggaattgtcatgcagagtcatcatacaaatgcctctcgcgattcagtaggcagtgtcaactcaggctcaaattcacccaggggagcaaagtaagaatcgaccatgtccgctgatacatactcaagggcaggtggatcccactgcaagaaccacattttttttatgaaaaaaatgcagaacacaacttttattttctattttttgcgatttaacagcatagattgtgcaaccagctatgtaatttacctttggagctaggtccttctccacaagacgtgctctgacaccctggcatgattgaagcaacatttataacataattaaataaattttcaagtcacagacagattcctaattacctcaaagacttagcaccgtggttacttggtcatcaataaataatattcgataaacctgtgagaaccaaaaagaaatgcagtacagcatacctcacgaaattcatgagaaaatttctctgagattccattgatagacatgcggtattcacgcacaaggcattcatcaagtgtctggtatctaccttcacgtatctacaggataaccatacacaatctgtcaaccatcgacagtcaaaggcacaaagagtgaggtttttcagattttttttttatttaccgatcgcagtgaaactttcaacgcaagaggagaagcctctttcaaccgtttcagggccaaggtagaccaatcttcatttaacctagctgcttcaatttcctggttacaagagcatagcccttaagttctgaagcataagcaaaatttctgctgttgaaacaaaaaccttgaaatgaactatctagtaagctaaccaagggaatgaaattaatgccaaaacaacaacaataactactgtacaaacagttaacatctagaagagattctttttagtaaataatgatatgggaatagaaggtagcccagcaagctgtggtatcaatcaacagcatcttattcatgttcaaatgaataagaaaagaagccattcccagagatttggtagtaaaagcaactgacacatcactcaccatggcatccacaatctcctcgactgtttcaaggctgaaacatttatctataacctccagcctagagtaacacaaagggcacaaatgagatatacattgattccataaagcataaacattgtattatagacatccacatgaaaaatcatgcacattcaaaacgcatgtcattgtatcatttattattaacagccaattatattaccaagagaatcctggtcccgaacaaatataaaagcacagttctacagctaatgcaaagattcacaaatcacagcagtatcacactctgcttgattcaaggattaagaataaacacacattctaaatataaaagtaccacttttaggatacttctgcatgtctttctgcagagtaatggcattacaaagaaacaaacgatgatctgaattctgaaatgcagtccaaaacatcaaggaaagcaaagcatctttcaattcccattctactagctatattttgggatggagggtgtatgtttaaaaaaaacaactagaagacaacataatctggaattccagcagcttctgtagtatgacatgctaaagcatttaataagacattgtcagttcagaattatatttactttttgtacggcttacctatgaacaatgctactcttatctggatacacaagatctccataatgtgtaagggaagtatcaataactgatggatcatcagttaacaatgttgcaaggcgttcatcaaccagattcaaccgctgtaaaaggaaatgggaattataaagttaatcaactagcaaaactaataccgagatagaacacaagaaatccaaaatgtatagttcaattaaaaggatcttacatcactcatggaatagtgtgtagcaaggccaagtgcgatcatatccactccattgagtttttcaccagtcaaggccaaatattcacctaaagaggaccaacggtgaaatgcacaggttacttaaaagggctgggggttacaaagaagagatgaacggggatatcagatattaaagaattcaattgaaagggaaaactgaacactaaccaacatgaccagtcagatgggacaaataaaaggaggcagcagcatcaggatggaagccaatatgtacttctggagttgcaaatacctggaaacagtcatggtaagtaaataaatatttgtttaagttgaactccgcatgctcataaatgcataacataagggcacacccaggcagaaatgctactgcacaataactattagtccccaagcacaaaaatacaaatcaacaaaaaaaaattgcataccgttctatcagtgacaatgcgaaatgttccgggaatggaaacacctccacctccacccatggtaacaccatcaagaatggcaacctacatcacaaaaggtaatataaattttcgagcgaaaaataaaaacaaaattagtgattataagttgaagtccatgcacttacatgtggcttcaagtatgtgcccagaacataaataaaactgtacaaagtcttgaagaaatccttacactcgtccaactttcctggttttattttttaaaaaaaaattaaaaaaaaaagagacagggttatcactaaaggaaacctttggacatgcaaaagaaagaataaatcagttggccatgtatatggttccagtggaactgtccatttggaaccaaatctcttcttttgcagtgttgtaaacaacctttatacaagtgaaggatgtcacaaaagaactggataccactatcattctaagctgtgtcacaaaaaaaatttatatttcaacaataatacaagcatggcaacctctgaggctctgatccagaggctggtgttctaaacaaggaaacgataattataaaccatgcagggcctagccactcaccttcacttataagctggtgcaacctaacaacatccccaccagcacagaatgctcggccgctgcccttcatataatataaaaatcaatttagacctatatagtggcatcgataccatgcaaatgctgaagcagcataccttcatcatgacaaagccaatatcagggttgtcctcccatgacatataaaacttattgagcctagctccctgtcaagacagtcagtcacaggaaatcagatcaatgagccaccaagacatgtacaaatgtctatgtttcatcaagcattatactcaaaataaaagtcaatttactgaaaaccgcagtataccattaaagaataaatgatcacataggaaagccacaaaaatattgtgcccttacaatcaggtgtgtttcatgcatcggtagcaagagcacattctcactagaacgtgcaggccctttataggagtgtggagagcacgaatgtgaacaaacgtcacaggaacatatcacctgataccacgcacgcattttatcgaacaggaaaaggcgtacgaaccatggtggtcgtgagcgcgttgagatggccggggcggttgagcacggcggcgcgcgcgctggccttgccttccaccagcacctgccgagacacgcgacgtcagccagagaacctcacacctccgatcggagtcggaggcggccaagcggcggcgaaaccagaaccgctgcgttacctcctcgctggcggcggctgcggcggaggaggaggatgaccgctggagggatgagagcgaccgaaccccgcccagcacggcgtatcgcagtgccccgccggcgcggcgggcggcggcggcggcggcggcgagggtcggcatggtcgtagggtttaggagggcggagagagtaagcaaaagtgggagagaaggaagtgaccagctgagtggcccatgtgaaaaactccgagatgaatcaaaatgggccaatgtgggcttggcctcatttcgattcgtcgaaacggcccaacaaggcccatatatagtcatcttaggcctcgtttgggaaggaagcacattttccggcccgttgagccatagtcggttcatattggaataagtccactttgacttcattaaaagtgacccgaatctaatccatgaccctaaaccgtaaaactgggtatgtcgacccccgaactattgaaaccggtgcaatttgactcccttgatggttttggaggacggttttggtgacgtggtgatgttgacctggtctatagggttgacgtggcgcttaggtggcatttgaattaaaaacacatatgtgggaccacatgtcatcatctctctctctttattcttcctcccctcttcttcccttctctctttctttctctttctctctcctttggccagccgcggggactagagcacggctggagcggcagggctagagtggtggcggtcggcggaagctgaagcagcgacggcgggttccagagcggcaacgggcagctcgatgaccggcaaggaggcgggagaggacagcagcgccgacgccgacgccgatgacatcgagcggggggacggtggtcgacggcacggcacctaagcgccctaaccccagtcctcacctccaccagcacggcaccctcaccggggaacaagctccctgctccctctgccacctcccgccgtccgtgataacaagatccggcactctggcctctccgccgattgcaacaacaagatccgggcatctggcatatgcgacaagctgacgacacggccgacatcgagcctgtcaagctggttaggggcgagggctgccatcgagctacgccattcagcattgcaacgacgacgtcgtcaagtcattgctcgagctcgctgcgtggccgtcaactcccgcgccagccccatcatcgccaccatctcatcccccgttgcgtctccttgaactagtgctgctaaggccacaagcatcacaaaaatccaaaaataaaattgattcatttagcaactaaccagagataaaattgattgttagcaggtcgttcaccatccactaaagaataggatgagtaggcagaggggagcaattaattttgtctcgcttgaacacgcccaagatggccaccctctcggggatacttgtgcttgcgtgttgcgtcaagcggcaccgacccggacatcatgtcggcgatgagctagctcaggtcgctggtgaagcagtcggcctgcagggcaagcgccatctgccgccgctcccaccgccgccaccgcttcagcttccgccgatctggcccccacccgccaccgctctagcccgtgctcccccggcggcccagccggccaaaggggagagagagaaacaaagagagaagggaggaagaagaatgggtcccacatgtcagtgggccccacattttttaatgtatgaatgacaaacgggtcccacatatccatttttaattcaaatgacacctaagcgccacgtcaaccccacagactaggtcaacaccgccacatcagcgccacgtcaccgaaaccaccctccaaaaccgccaagggagtcaaattgcaccggtttcgatagttcgggggtcgagatatcccgttttgcggtttagggttatggattagattcgggtcacttttaagggagctaaagtgaacttattccgttcatatttatggcccatatgggccggaattcaaacgatgaattattattgggccaatttacgcatacgccaggatttggtctaaaattagtttctttccatcaaatttcgacagactcataagaaattgacagttttaccgtgttgaagtcgtatgcagtttagctgtcgtcaagtccggagcagatttatttttttcgaataagattttgacttgaatgcttcagcgcaagtgggtttcctttgctttgaacaagcaagtcactctcgttgatgagtgcgtttacaagcaattagccagttaatttcaagttaaacaagcagaagattccacagcctcaggcaaatatacaattggttgcatcaattatcgttctaattacagtagtttgcagggccaatgcacacaagttgacttttagaagggcacactggaataacagctacaaaacgttgcagcacactaaagaacaaatgaacaaccagttgtttacaacttgccggtagaataaataattgcctaagacgacagggacaggaaccaaaatttttcagcatacatgtgtatatattttatatatactaaaggaacagaactaataaaagaatgaaatgtctcagaatcccagaaacataagatgaaagtgagaccaaaaaagggtggtttagggagcctcttatataataggatgccaaatcaaaaacattttggccagacttatttgttagcagtgtatattttgctcgtatttatagttggtacttctccatatcctcaaaaaacgattctgttatgttcctcccttctgcttaagtggattcctccttccaagatgccagtttcttcaggaattccatcacctaaatacacaaagaatgttttcatactcagttgattcaatgattgtaaccaaatcagattgttcagaatctattgtcgacagattacttaatgcagatagaagacgaattacctcagctgggtcccgtacggaatagaaagcatcagtatccttgggcacagatgacaccaaaattccaaagccaatgctgtttgccttcagaacctatttgagccaagtgagcaatattatacatcaagacatggaagtagtaattgatattttgcaggtaagagcaagcagaccagtttatggcttaccttgaatgcatcctcatcagtcttgtcatctccaacatagataggaagaacatcttctttcccacatagtccaagtgactccagcaaaaattccacagctttccccttgttccagtctatcacaggtcgaacctcaagaacctgaattcaagagcgcagttgaattaaaaacaaatacaacaatggtacttaaccagtgcttcgaaacagctgtgcggttgtgtatattccttacctttctcccatgggtaagccttagacaagggtaattcttcaggacggcagtcacacgttgatgaacttctccgtagtcctaagatgtaacaatgagaataatattcagcaaacattttacaccacatatttcctgtgtgaaattaaaatcttcaatgcaggcttacatgtggtgctacattgcggtaatgaacggacacacagaatttgttatcttccatccttgcaccatcaatgtccttaatactttcactgagctttttgtacacctacaggtataaaaatgaataattttcaaccgtgcaacacaaaatggtatcctaataattaccaagttcgagatggaaatacatacctcgctaatcataggtaaaaactcacttgcaggttggaagaggttgacctctttaccctatgagccaaaaagcaataactaattagaattttgtcacaagagagaaatttgtctgtggaaaaaatcaacaaagctgttgcacctctgaatcagtggacctgatacattccacatgctgaccactcgaatcagacttcctaacaggccccatgatatccattccatgacttccagcgtaatacagttcagttagtttcacaaagtcaaaaacctaaagaacaaaacacacataagagagagtcaacaaagagtgaaaaatgcaaaaggttagcagggggagtattttacatgtgaacataaattccttaccttatcacgagatcttccactaatgatcgcagtgggaaaaagtgatgccacatgcttcacagcagagcgcatctgtcgaatagaatatttacaaaactgccagataaattttcactgataataatgaggactaaagaacataagaggagaaaaagaatacctcgtcagacattactgcattttcaggattgtccacaatcggtgaaagagttccatcataatcaaggaacagtgccaatcttttacctctggcaagattaacaatatcctcaaatgatgttaaagcagatggatggttcacctacaaaagaaaaacagtggaaaattttattgtttgccatgtttgatgtacttcagcaataactatagattcaaaaacataccacccaattacggtatagcaaatcaagctcgtcagcttgaacatcattggcaaagtccttagtctgcctcttgcgaggtggcgaggaggccagcatgagatcaagccatccagcggcgcggacttcttcgatctttccaggcagaggcttctttttcggagtgttcaagtacagcccggtagaggggaaactcgtaggtgtagtgtacgtcatcacagcagatggcaaggctaatttagggagaggatcagcaataacaggagagttgcttgtcttcaaatccatcaacagaactctccgcagagttgttgtaagaacagttactaacaacacaagagcaagcaagtagactataggattccttaagagttagacactcaaccaaccctcttgtcaataaaaaaccaacgtttcaatgtcttcttgtcactgcaaacgtgcatacaacgcatccagcccattaagcgggaagttcctgcattctgcaataatgaaaataatttcaactaccaaaaaaaaagacaataactgaaaaatgataacatactgctcaggttcctactggttcatcgccatggtggacacagatcatttaaaaggaaggctcatgcatctgatcgctcagctccaaaaacaataattgtatacggtcacaaccaacactgcaatagaacaaagacgacaaacctttattatgtaacagaacaccagataacctaatgcaggaagagctgacaacaccgatctgattgccctacagtacggttactgtttttgtctttgcaagttaaaaaaggaaattaattagtacaacttttggtctgaagattcccgagcgacaatgaaaaatggggcacgccctcaaccggtgatgcctgattcactttaggtagcaccaaaaaaaactagtcggaaaacgacttttcatccatcatccatcattatcaatccaaagaaacttagacaaggaaatccctttgtaaatctcatcaattaacagctaataaacacatgcaaatgagctaaatttaggacaagggcacatggcttatgttgagcactcaacaggagcacctaaaaagaaaaaaaagtcgaaacttccatcattcattcgttgcattgatgggtgattatctattccgacgacgctaacacatcgattggatcagcagtgcatcaatcaatcaatctgctctcgcgtcatgtggccaggcagatgcaacatgcctccccgaaacggcggcagtgaaaggaaaccccccaaccaaccagaactttcagcgcgcattatatgcgacgacaagcccatatgtactgcgaaaatcatcaatcaaataaaaaaaagaaattcttgaaaggaaaaaaacaagaggatccttttgtcctctccttgctaatgcatccaaacaaaaattgaggaaaacggcaagagaagctactgctactgttcgtcttcgtcctcgtcctccgccttcccaccaattgaaccaaaaacaaatttgcatatattttttttcggtttcgtcccgggtttggacagctcaaactcgtggccgccgtcgcagacgtggaccgagcatccaaccatcgaacacgccaaaaaatggcacacacacacaacccgatcacgacgagcaatcctccccacccgagatctaatctagacctcccacaccaccgcatcaccacgcgcgtcagaaaccccacccaaaaaaccaaaaaaaaaatcaatcaatcaatcaatcaaacaacgggaagagcagaagctgatcccggagagagaggccggccttaccccaatgccggcgagcagcccgacggcggcggcgggagcggcgatgcgaagcgaggaaggcaatggaggggatttgggaggagtgagaggggagaggagagaagatggcggagcgcgtgtattaataggcggcgactctctctcttgtttctctctctagagcttctctttctttttcttagcttttttttttctttttttctctctctagagagagaagaggaggagagggaaaagtagttagcggttgtttcggtgcgtttccgtttcgttttctgcatcacgggattagttgatttttttttaataaagcgaggcgatggggcccacggggtgtggtccgctgacgtgggatgatctgggggcgccacgtcgacggaagc

SEQ ID NO: 12243 - DNA, 20810 bp, Oryza sativa
  unsure (1)..(20810): unsure at all n locations
cactttctcggctcgaccatggaccaacgcgtcaacgcgtgggcctgcgtgggctccacgggatctccacgtgggcggaccgtggccacgagtggcgccacgtgaccagcttccgcccaaccccacccatgattcggcccgggacaagtcgaccgccctcgtgcgtcgcgcgtgacgcttttgcccttcatctctttggttaattttgcttccaaacatatttttttattactataagcatgtgcacacatcactgtatatacaacaccacactttaaatgtgcaccatgcgagcgacatatccgtgatctcgctaaaatcctgttgaaagtctatctatatagctacatgcgtctaatatttgtggccatcagattttgaacgcttagcggtagagtcaaatttgaaatacatttttttgggtatatttgaaaaaaatgtcaacaactacaccaaactaaaatcaatcgtgtgaatgatgaggagccggtggttaaattcttctgcgtgtttgtgggagcaatgtgaagcgtcctttttaaaatgtggtgttttattttatattatgcttgacggtgacaaactcaaacactactaaaaaacttttactgtactaattttcttcgccttttctggtgggggtaggtggtacggccggcgttgccctttgggaggaggagccgcaaccgccggggcaagctagctagcacgagcagtgtatagatgatgagctggcaatgacgtggatccgccaaacatggggaaacagcttcatcaaagccgagcgctacaggtattgtttgaaaatgaaagaatctgtagttgcttaaatattaaaaaaaagattatctgaattgtgaggggtttgtagctgtaaaattcgaaaaatatattaagaaagtagaagctagggcacccgaccaatgtttttgcatattctcatttctcggaatctcaaggtctcttaaacatgacgatagtcagcatctctgcttagaaatgttaagataataagccatgaaaaacaaataaaaaatatttttaagtaaatttctatacctatataattagctagcgatacaatataatgaaaaggtcttaaatatttaagtttaaatttttagctgtggctgagaagctactaaagcagacaacaaggggccggcttaagtcgtcatggattttctttttcttaaaatttttcgcggccgtacagtggcacgagaagaccaggtatagattggagaaggggaaagaaaacaaggggagattaattcttgccatttgtggtcaatttgcagtgttgctcggatcttgtcggaccaactgctgcatccgttgattggatgcccgcacggggcactcatccccatgatgcttttctcactttgtttaattcaacctatactttacgcatggtaggtgtgcccaaaccaacaatggtaaaattggaatgtgtttggttaccgatcacattttaccataactaagattagctaagttgtgacagtcacaaaagtataatgaacgaattaatagtcacaattatgataaagttgacaaaaaaattgagtctataatatataggacatgctattgaaaaagtgtgacgagccacgaaccaaactcatatctaataaattgtgtcagcaaaaaatatggtgtaacaaaatgtgaccataaaccaaattaaacacccctttaacatgttctatcttagcagcaaaagccaattgactgacttcaataacaaatgctagtagatgcaaggtgaggtcaattattgtatttataggacttttctctcaaagctataccggctgctaattcagctagctgcatatatgatcaatctcacagttgagacgtccggattttcagacatgtgcgttacttcgctcgcattggctagctaagctagtttaatttctactagtaatgcaggggtcagtcgatcacagtattcatgtgacgctaacagctaagctagcgtcggccatgcgagacagctgcatgtcctaacttatatcagagctttccagttagtagcccgtcgtttcatcagcccagctgaaagcctgaaattgcacgtcatgcaatcggcaatgtgttttgcgtgcaaggccatagcaatgtatacaaccaattaattacctaacgcattatatatatacttaccgctagctgtagataaacattgtattgttacctccgttctaaaaatactttacgattcgctccggtccagaaaaaaatacctgagggtactggtacctcatgatagtacaattcagtatcgtgagatactctgtactcgtaccccaagatattttttactggaacaaaacaaatctcttgttttttttaagttatacatctagccaagtcaattaatataatgtaccgaacaagtttcagcaatttcgaaggtcagcaaaaattaacgtgagatcgatctgcacgatggagctggtaaaatctggaatagctggtgctaagattattatatgtagagacagggatcagctagtactatagttagttagttcgttcctcacgataattaaactattaagcacgcgattatacaaatggctccacgcgttgcaaactagcttggtttcccaagcaaaatcaaaccgatggggaggaaacagcggcaaaattgtcgggacaggaacatgcctgctactactagctataccaccaccatctcgatcacctagctagctatcacccgcgtgtaactaattaatcttttggtccagaactaatggtttatttggagagcttctaaatactactttctctggtaatcaaaaactccctaaatagttcagttttcgttcagtgcctgttcagatcgtagccaaaataaaccttactaaattttggcaatgcccaaattttagcaagatggtaatattatcaaaattttaacaggatttcttgtgtattgactaaatttgacaataaactaaacatagacattttttgacaactttactaaaaaatggtatggttgaaaaaatggcatcaaaagtgaacaggctctcagattttgaaaaaaatgtattatagaatccaggaaaatgaacaagaattctgaagctggggaactaggccagcccctctccaaattgttagaagctagttaccacccaactgtttcttgaaatttaagctttttcttctcaaaagttgactaccatctagctacatcttataattttaagttctcccaaacagattctaagactcttttactaattagtaatcgaaaattttagctacctcgcttaatttgcgtgagggcatggaagacgacgacgaagaagaagataccctgcagattcttcgattacgacgacccccaaaaccctgtgtgctaattaataacgctcttgtttaattatgcccaatttggcggctaaattaatcgcgaacgatcgatcgagttggttaatttagagtccagatcgattgcgtgtgtagagcgatcgagacggcagccacatcgatcacgcgtcagatcatgatcgagacgttttgattttgtcggtgcaatttagctgcagctatgcagcggcggcggcgaaacgtaatctctctctctctctctctctctctctctgcagacgaggcgctgacgacgacgacgcatacgaatgtatttgtgtgcgagatacctgtcgaatcttcagagaatcgcaaggaaaattcagagaaaaattcatggtcggtgcgcacatatgtccgagtcatgcattgcttggcaatttcagcagcaacttgcgtgtcatatcgtatatttgaccggatgtaggaagggattttcggacatgaatgaaaaaactaatttcataactcgcatgaaaatcgcgagacgaatcttttgagcctaattaatccgtcattagcacctgtaggttactgtagtacttatggctaatcataaactaattagactcaaaagatttgtctcacgatttcctcttaactgtgcaattaatttttcttttaatctatatttaatactccacgcatacttccaaatattcgatgtgatgtttttttaaaaaaatttttgggaaactaaacggggccttaactaggtcaagcagaagcaggcagatcatgaacagatggaccaacgaaaaattccttctcgacacaagctacctaccagtaatacgttgtacagtgtagtcattaaacaagaggttaattaacgaaagagtcaaggtcatggaatcgcgtggtacaactacaagtatagtcattaaacaagagattaacggggagtgtcaagctcatgaaattgtacggaaacttcggagggatgtcgtgaagtatgtacgtccacatcgccatgactcatactgtgtgtgtacgctgatcgattcagacattgacaggggctaattaaaaattttctgaatcttttgccggacagggactaactggacaggttgattattgcgtggagatttaccttctacaggtgacacgtttaatttctagagacgctgtgtcctttgacaaaacgaaggaagctagcaaagcttgcatgtcttgtcctccaagaatgaattgtactagcagggagtacaagtacctgctctgtttcaattaatcaaatgatgtttcttccttgatttgtgagttgaactaggattaattaggagcagtagctagcatcaatgaaactaagcatatatgcccaccgtattagtatgtatggttttgcattaatctgcgtactcaaactgttaatacagttcaaacacacctacacgctgatagctagctagtaccagtacctattgcatatgccctcatttttcagtgtggttttcaagtttctagtacatatatgattttcactacatatttttcatatttttcttgtttgtgagtactcaataatgtttttttgtctgtccctacagatggtgcagattaattctttagtacttgcttcggacaggcttatgaaatttgccaatcactagtagtacaattgtacttgccatgtggatgatattaggccagtcacaatgggggtttcactggtgtgtcatgcacatttaatatgggtaagactgaataaaaaatgattattggcataaaatggtgatcagagagaaggaaagagtttcatcctggtgaaactcgtcagcgtcgtttccaagtcctcggtancagagtgaaacccctgtgagcgcgattcgtttcattcaccggatgtcttgcgtccgcctccgccgtgcgacctctgcattctcccgcaccgcgccgaattttgggtacaaatgatcccagctacttgtatcaattaaatgctttgcttagtcttggaaacgtcaaagtgaaacccctcctctgtggggattgtttcataaaagatttcatttgagagaagatggtataatattttgggtagccgtgcaatgacactagccattgtgactggccttattggagatatcatggagtagagtacttctcattaatgatattgattttgcctatacaactatgaataatgcatgcgtaaattaaggtaaaaagtttggatggttgcttgtatctataagtgagtgcagagacaggaagttcgttatttttcttattgaaaacagtgctgaagccaaaaaaaggaagttttatgtaatttggcatgtaatcccgttttctaaaaaaagtagggcttacctaaaaaagatcaatgcattccaattaagataatataaccacgaaacgatgctaactacacaacaagggaaatatgatgaatacaatagtacatcttcacgatcgaggccagattaatcaagcttcgagacaagggtcacaaaggtatttcttggatgatgtctctgcatcgttccaacaacttgtctcctaaactatactactatagcaactatatatattagctccttgcatttttttaacagaaaatggtacacctcacttgatcgagatgttcctcccagcggtacaataacaatactagtctggtcacgatcccacaggtttaattaggcaaccgtttaaccaattggggcaatggttgcacatggtaccccgatggtgttggatcaagatattgcttattagctactgctgattgggcggtcaaacaattctaaccctaacgattaccaatattaatatatattttctcccactgtgtcatgccagcgacttcaaagttcttatatggcaatacaaaattattcccaaatctatttgcatctagtagtgtacatgtctatgtctatatatgtgctagtgacaagcgagatcatacatgtgttgatgtgtacatgacaatgctggtgacataatagagtgtgatcatgtgtacataacaacagtcttgacgttttcgccgtgccacatgacacaatagagtgtgatctaacagtcttggcgtccacttgtgttttcttttactggaactcttgttttcactgttcatgatttgacttgtaagacatactcatactccctccgtcctagtaatacgttcgttttaagctccttccatttgttcaaaaataaatttatttttagagtaattattgcatctaagtttttttaaaacaagaaataattgtattagaattagataaggtggataatagttttattgagatttaataaagtatatgagaattctagtttttttttcttttgtattggtatgtgtagtatggatgaaaaataaactcataatgcattgcgtgttgtttttagctacggtttattaaccaagggtatgtgaacaaaaccaatttgaggtaagacttttggtacttttatatattttttccaaaagttaacgatagtattgaaagcgaccagcacactggtaaactagcttcgaaacgagaggtcgtaaaatttaaaaccgattgctgctagctactttcacgatgtaagattttctagcatcgtcaatatttatattgatgttaatgaatctagacacatatatgcgtctagattcattcatatatgtatgaatatgggtaatgttagaaagtcttacactgttaaatggagagagtagctaacttcaccgcaacattaatttgtcacacgatttgatggtaacctgtggcgcaacactttcttttgccaaaaataaaatgctaaggttgccaaacgttaatacggaggagtaatatctagcgatagattatgccggcgttcgtgtgagaccaacgcgacgaaattaaacccagcgcgtctcgatcgatccaacgatgtgctgacgcagcagcagcagcagcagcagccagcagctacgtacgcacaagacagaatactcctaattaacgtgtgcaacgtcgcatcgacgtgcgtacgatacacacgtgtatccgacctgtacatcatcatatcgtttgttcacgaatcaactcactcacttgtcactactagtgaatgtactcttaaccaattgcgttgcacgcacgtgttcaacaagatcgccgcctccttttgtttttctcctttctgatttcggagtgctacctgaatgtcttttccgtagagtttaatttaggacaatatatgatgtgtctcatctggtgttaattttctatactatttcctccattcttaaaaaacactcaatcctagattttgaatctgggcatacggcatacactatgtccagattcaattttagaattggatttctttgggacggacggaaacataggggtagtatatttttggatgaaactgctagtacagcacgttggatgggactagagtagagagccagccgccgtggcggctcgcaagtgctggatttaaatgggcttctcttctatggcctgtggcaatctggcccagcagcttatcagcgaaggaaaaaggaataagttcatataagttcccttaactttacgctaagttcgattttcgtccctgaatcacaaccggtgtagatgaggtccctcagcggtttagatggcggttttaactgatgtggcgctgacgtggctagtttaacttagtcctggtcctatgtggcggtgaggtggcacttggaagcaaaataaaaggtgagacccatgtgtcagtcttaaaaaatagtaggacccaccctgctctctatcttcatcgcgccgtcgtcctaatcccttctccctcctggccattcttcatccttcctcgagctccctcgccggccggagaaagcgcggagagggagaagggcgccggcggggagaagtgcggagggcgccagccattgggcggggagggtaggccggcatgcgcgcgacgggagaggagggagcggcggccggagctgcacgacctcggccccgccgccgacgaagactcctgctgcgccgccgcatcgatctgcacgagttgcaatcttcatctacggccttgccttcaggccagttaggattcaccatcgcagcagatacatatgacaccaccacaaccctcccaagtcccaaccttgcttctgaacaagccttccgcacattcgtcgtgcccgttacagcagcagcatgtgtatgaacctacaacaacatcaattcatttagctacaagaacatgacgatttaattacaactctgcagacttcagctactactgcttgttgagaaatcaacagtttcgacaaatcatttttagtagaaactgttgattttgtcgattttcagtaactgcagtctacagtttgaacaagtcaatggagaagaaaaggaattattttgctgaaaaaagagagaggtgtgcccctgggttaggggcggagaggagcacggggtaggccacatggaagacgttgttgcagccggcgatggccaccgccacgctaccgtagtcgagcaggtcggccttgaacagccgcagcctctccgcgacgccgtccagagacatcaggtgggcgttcttggcgtcgccttcgcacaaatcatccgcacaagcacaccaatcaatcaatccaccagaacaagagcagaatgccatgaatatcaaaaactttgacgcaggtggagggggttggggaagtgggcagcggcggctacgagctcgagtcccgggccccgtcaacaccacgctgtccgtgtcccgcggctgtgagctcgccgtcgccgcaactcgtgcagatcgatgcggcggtgccgggggtggggggggggtcgtgcagttccggccgctgctttcttgcctgccgccgcgcgctcaccgacctacccgtcccggttgtcggcctacccgcctgcttcttctccacgcacgctcgtcgggctccccacccgatggttggcgcccttctccctctccgcgcacgctcacctgccagctagggagctcgaggaaggatgaagaatggccgggagggagaagggacaagagagcagggtgggtcccactatttttaatgactgacacgtgggtcccgccttttattttgcttccaagtgccacatcgccgcttcatacgataaggagtaagtcaaactaaccacgtcagcgacacatcagttaaaaccgcaatgtaaacccgccgagggacctcatctacaccgattttgacagttgagggatccgttgtatctggtattgcgattcagggacgaaaatcgaactcggtgtaaagttaagggacctcatatgaacttattccaaggaaaaaataggcccagctaacaacatgctgtgtatggcccaataagaagttgctaggcccagatcatccaatatattatatatatagagtagcagcgtgtgagtttggaatatttttgaccggatgttcgtccagcgtctgaacttctgaacaagtgcaaaactgcttctcgttcggtattctttcagtgctttacacccagaaagaaaaagaataatttattgtcttgttcagttaatccctccctcaagagaaaattgaagaggaattagagggatgatgtgaaattaatcatctctaatcctcctcaacaattcctttctcgtagagattaggcgaacaagcttttccttgaaaaaaatatcaaactcaatttgaccacagaagagaaaactgtatgtaggccagactaagatcttgtttggggaggttaaggttttaaaatgttaccggtgagaatctggaaaaaactaagtttcctaacttctaagttctatttcatacaaatttttaaaatttagataaaaatctgaactgtttgagagagattctaacacctaaaaattctaagaaaagttgcaactcgccaaaaactacccccaaaacatgcactaaagcttaatccacgacatgatggcagttagttttaaccggtgcaatttaaccgctgaaaataactgcacaggagaaaaatattaaagtgtgaaatctgagccacacatccgctgaaataaccgtgcagtttcagttacacgaccacccacacattctctctcctcccaaaatgcccaatcctctcttcttcctcctcctccttgccgccgccgccgccgccaccgccggcgccggcgaaggcggcgccacgcggaaggacccgtgcgccggccgacggatccacatccgtcgcctcccgcctcgattcaacgcgcacctcctccgccactgcgacgccgggttcccgctcgccgacccgtcgacgccggccacctcgtccccgccctgcgagtcgctcgtcaaccacggcctcggcccgcgcacccactccagcagccgctcctggtaccgcaccgacacgcgcctcctcgaggtcttcttccaccgccgcgtcgccgagcgcggctgcctcgtcgccgaccccgccctcgccgacgccgtctacctcccctactacgcgggcctcgactcgctcccctacgtgctcgacccggcgctcctcgactcctccgcgcagcacggcgcggagctggccgagttcctggcgcgggacaggccgcagatcctggcgcgccgccatggccacgaccatttcctggtgctcgccgggtccgcgtgggactactcgcagccggtgcgcgccgccgccgccgccgccgccgaggcgaggctgtggggcaccacgtcgctgctccggctcccggcgctcggcaacctcacgttcctgacgctggagtcccgcgcgtggccgtggcaggagcacgcgatcccgcacccgacgtcgttccacccggcgtcgctgccgcggctgcgcgcgtggctggcgcgcgcgcgccgcgcccgcccgcccgcgctgatgctcttctccggcggcgtgtcgcgcccctccaggcccaacatccgcggctccatcctcgccgagtgcgccaaccgcaccgacgcgtgcgtgtcgtggactgctccggcggcaggtgctcgcacgaccccatccggtacatgcggccgatgctgcactccaggttctgcctccagccgccgggggacacgccgacgcggcgctccacgttcgacgccatcctcgccggctgcgtcccggtgttcttcgaggacgcggcggcgaggcggcagtacgggtggcacctgcccccggagaggtacgacgagttctcggtgtacataccaaaggagtcggtggtgttcggcggcgtcaagatcgccaagacgctggcggcggtgggccagggcgaggtgaggaggatgcgggagcgcgcgctggagatggcgccgagggtgctgtaccggcggcacgggagcacggcggagctgagcgagacggccaaggacgccgtcgacctcgccgtcgacggcgcgctccgcaggatacggaggcgggtccgcgcgctggacgacggcgagccggaaaggatatactcgctggaggacgacgccgtcgagtcctaggatcaagaaatggtttttgatgacatattgctccagtttggattttgattagtacttctccgtttcctaatgtaagactttttagtatcgcttatattcatatagatgttaataaataaaaacatatatgcatatttagatttattaacatctatatgaatgtgcacaatgctagaatatcttacatgatgaaacggaggaagcagtagttttttactttcttccaatcatcattcatacttgggcggatgtacattagatcttcattttcatctctgctgctcctcttcttgttttttgtgatgtttcaaagcaaattgctgctatgataaaaagataaattgagcgaccttcatattggccttatacttgcataaattgatgaggtgattaaatgaaatcatgaaacagttgacaatcttgagcatgatggagggaggcaagcatcagttttcacttcgcagcgatcttttttggaccctagaactcaagaaatggttttgatgacatatgctcaagtttggatttgagcacctgtagtgaatgagtagttagttttatgtttcatccaatcatccttcacacttgggcggatggatgtggagtacattggttttgttagattttcattttcttttctattgctcctcttgttgtttttttgatggttcaaggcgaattgctgctataatgaaaggtaatattgatatttgcctaataattgtatgcgttgatgagatgattaaatgaaatcatgcagcagaacagccttggtcccttgagacattgaagggagtaaccatttgtttgcgctttgcagggaaaatatagactatttaattgagaaattgtctaactaacacaacaagcacctgtggtctagtggtagaatagtaccctgccacggtacagacccgggttcgggagaaggggtgccccctcgcaaaagagggtcgcaatgaccaggcccgggtgnnnnnnnnnnnnnnnnnnnnnnnnnnnnnnnnnnnnnnnnnnnnnnnnnnnnnnnnnnnnnnnnnnnnnnnnnnnnnnncaaggaagttggtgaactgatgacagggaagccggcgacnnnnnnnnnnnnnnnnnnnnnnnnnnnnnnnnnnnnnnnnnnnnnnnnnnnnnnnnnntaccatttttttgccatcttacacagcctacaaagctcaaatgataatttcatttcccaagagactataaaaaagaccagcatatccgttccagactcaaggtttctcctttctcatgcacagaattattctcttgtttttgcttcaggttattattacaatctacaggcatcaaatgatcaaataatacacaagtaaaccaactatctgatgacgagcatttgtgcccattccagacatgaattgagattttgggtgtacagaattattctctgatgttttctgcattgcaaatttgcaatcatgtacattgaatgaaatcttcttgagattttacaagtatttcttgaaatcttctgctgcttctgccacaagatgatcatcgtcccactcatcgcggtaactctccggacgagcagccttgttctctgaattagcagcatacatcagcttcctccattgttcaattggtggatggccacattgctccgcaagccaatcatcatattcaaactggaaatgaaaacaagcttatcaagggagcataaacgaaactactgaaaaattgcaggtagatgacaatcatatttattaatttcgtttcaaaacattagaactttggtaactgacactcaaagcatctccaggctacctgacagtctgaaaagttgtgggcgtatctcttaggccatccacgcgcttccattttcgagtggaaggctttcacatcttccatcatttcttcgctcgaaggaagcttgactcgtcctgatagcacgccggcaacccatttgctttggagttcaaacaatggaaaaggaatgacctgcaagaagcaaggcaggggaatgctttacatcctatgatcatcacaagatcaagacaacttaattacaagtgcatctaaagtgaatggcatcactttttgcacacataatgaccttccatggcaatccgatgaaggacaggtgaggtgctacttctggtgggaaaacgtgcttgtatagtggatcgacacagttgtcatcaacggtgatggcgctatcatcctcaaggaatggaaaatcatacaagtagctagtcgacaggcagatgaaaggaacacattgttagtttcaactgaagtacttcctccgttttaggttataagactttctagcattgctcatattcatattgatattaatgaatctaagcataacctgaaacggaggtagtaacaaaaatgcaatttcgcacaagaagccgagaaatgggttgcagggtagtgcaggtttacatacccagtacagtgcatgatgacatcggctttgattgagctgccatcctgaaacaccacgcagccatcttcttgtgcatgatcaatctgcagcttgaaaattagttttctagttgtgctaaatgtggcagccctttcagcggataaagctaccatatgctatcactcaccacgagaaaagggcgtttaccatggaatggagccacatattatcatatccaggctgccttttgcaagtgcaggcaggtgctgatctatcagcaacatgaacctcttctgcaacacctgcaaggtcccttgagatgtctactgcacttgctgatgccccgattatgatcactacctacaagtgcaacgcatcaaccaagataacatttaagcacaaatgcatgataggaaagattgcacaggtaaagaaagacagttacttgatcgtggaaaggctctggaacgcggtaattgtggctatgcatctgctttccaggccaagcctccacccctgtcagtgtttaaagaatacatatttgaagtcaatcccaacctaacagttgagtttaattttgagtttacttaaccttcctggatttgatgatcatcataacagtgttaaaaaaatacagatttgaaatcaatcccaatctattttcaaaacttcaaacggttgagttcaatttggagttaaattaaccttcctggattcgacgatcacaacattgcaaccatacattggcaacagtacgaagtaccaaattatttaattccttgaatctgtccatgattaggagtagttcaagcaaaattgattagattgcaactttgctagtgacgaggagattaccaggtatgtgggcgacgcgaggctccgtgtaatggccattgcaaaccacgatggcatcatacacctcctcctcctcctcacgcctccccttctccccgatcttcctcgacgtcaccgcccacctcccgccgccgccgccgccatccctccgaaccctaaccacctccgtcccgaagcggacgaggccgtacaggtcgaaccgccgcgcgaactcctccagataccggagcacctcgtcgtggccggggaacctgcgcgtgtcgccgccgccgccggcctccgcggcggaggaggcgaagggaaagtcgaggaagcccatcacctcccgcggcaggttggtgcggagcgaggcgtaaaggctggagtgggcggcgccggcggcgagcgggtcgaaggtggcgggggcggcgtcgtacagccacgtgccgcccacggaggcggcgcgctcgaacaccacgggggagtggccctcccgggggagctcccgcgccgccaccaggccggcggcgcccgcgccgacgacggcgaggcggagcgacggggacggcatcgcgagacggtgcgtgcgcgatttcgcttcggatttctgttgcgatttggagggaagcggaggtgtgtggtattggagtttgtcgttttgtggggtcttcattggacagcaaattcccgtgggcttgtggttacactcgactggacatgaggctgcgtaggcatgtggtgtactctcttcgtttcaaaataaacctgctcccttcatcccatgaaaaacgaatctaaaactggatgtgatatattttagtacgataaatctagacatatgtatgtccaaatttatagtattaggatgtgtcacatccgatactatgttggttttttacggacgaatagagtatctcattatatgatgtgacatgttctagtattacagatataaacatacctatgtttggattcgtagtatatgatattcagatttgtagtactagattgtgtcatatcctatacgagattggttattttgagatagagggagtaatcctcaggtacgtataacaaagtaacttattagtacatgattaagtattatcttattttttaaaaaatagattaatatgttcttttaaataatttttataaagggaattttttttcagccgtatcgttttgcgagtttgagaagtgtgcgtgtaaataaaaagatggagatgagttgggaaggaaggggaagaagctgagaatcgtgtgtgattttgctgggtgctggatattgtagagatggggacagctaccggctgctgtcacttggcctccttgcgttggcttgagtcccttcatgagctttgactctttttcattcctcatctcttccttttgaaagattcttcttttaggccatttccaacttaagaaattagacgtagttttcataaactccaaatcatcaagaaactagtgctagatattactttttcaatacaagtaccactattttatacttaagtttaatgctatttatctcatatatgtcttagatgttgtgtagaaaccatatctcatgtaagatatggttttcttttctttcctcatttattcacttgccacatcatttttaatcctaggtgtcagcttatttaatgctatggacactatcctagtcattgggttggaaatgaccttagcgtctttcagataaacactatgtaaacactccgaggatacttacatcgtttcaaaataaatcaacatttatacacacaaatctaacacacatgttatattcaaaatcgtgtataaaagttattttaccttttaaagaaaaagttggttgacaaagagagtagaacaaccggttataattaatccagacctttaacatatcgtgtgatatagtccagacaaataaaggggaaaataaagtctctatagcaacgtcgaaattcttcgtggtcatcaggggtgcttcctggccacgactatttgcaactacaaaaacgttttgtttcaatgattctatatatggaaaaactttagcctttttttctgaggtttatattaaaagaaaactttaatatgtataattgcataaacatttttcaatccgggccagttttgaggtcggcatgagagtgaaatcggccaggcttgcacgtgcccacataactttgttgatgtgcacacacacctgttttgtgatagacaagcgggccatgtgttagcctccattattagtacgccatatatgctgtcctgttcaaccacacatgtgaaatggtcctgtgttaaggcagtgcagtactatctgcagctaaatctcatctaaaaaatgcagctctccatctcattttcgtacataccgatgtcaattattccccattagtagtagtaccatcctggaattaatagccaaacatgagacttttttgtgggttttttttccatacatgcatgatgtgatctagaaccaaaccttaattaatcaaaccctaattattagtactactagtaatgtatgaacattttatatatttttacaccgacctagtatccaaagaattctcagttgtcagttttatttcgtacatgctgatgtcaattctccattagtactggagtatattggaacaacaaataattaggagactgactttgtggtgtgttctgatgcatgattcatgtgactataaccaaaccttaattaaccaaaccctaatttattactcccatgtgaacatttttgcataccctatcaaggaaaagaaaatatcaagcgaagaacgttatactatttacttttacacacctaatcagaaaaagattctcaattatctatcacccatggagaactattgtaagattacttttacacacctaaaatagttctcaattattaatcggctaatcgctcgtaaagaaccgtcatagaattgtttatggtgactttggtctgaaccgaataatgtttccaacaattttgggtgtttatttctcatatattcagatgataaatattaacttgacaaatactaccccatcccataaaaaactaatctagtaccggatgtgacacattctagtatgatgaatttggacatacgtagaatatgtcacatccggtcagacggaaggagtagccaatagataaagattttttttcaaccagggtatggtttgcacccaaagcctttttaatcaatcgcagttgcgagccacatattgcagccagggagacagaccaatgtcactaacaccagacaataaaaagctactccttcaatgacaatgaatgactaatatacccctcgctccccttcctcctcatctgttactagtgttgtctctcttctcctgggtatcgcatttatatttcatagtgaagatggccgtatatgatatagtttgttcatcataaaataatctataattaattcaccatagtttaataggggttaggataatataattaaggtagtggatacctagaagatttacctctataataatgtttagtagaaaagagcattagataaccacgatgtaattttacttcaattctattcatgtctagtatacacttaacctatgcagtacatacttacaacaaaggacctagctccgggcactctgatactatcgagagaccacttcctgttggtataccagcataggttatggcatttacgcacttttacgtcatacctgaacatggaggaatacaaagaacaaatagaactatcactacatgcctcctacctcacttttcgtggggcacacccacatccaacaaacatttatctaatctaagcaccatgcttgtgctagtaaataatatcagtaactcccttgggactcccacccttcgaatggtcacatttgagttagagcaacctataaaggtcattggaccgttaccgtagcatggatcaactagcctaggatgaagcagataagaagcatatacttcccatagaacatgcattcaataaagaaagacataggttatgagcataaataaataaagaatataattctattaattcaactacagtttacaagaagagtaaactactaaagacatatccaaaactccgagaaaacaataggactaaagctcctaagttttatttctactaaactatagagaatgcattatgagatagagagaaagaattgctccttgatgtgtgtattgtgaagtaagaagctcaactactttaagtaggtagcttataatggctagggaggtcggtaactcccatgatcgtcattcggagccaaccaagagttgccacgcggagggtggagatgaggggtgccgaaggcggttcggctgaaccctcgacaccacctctcttcacccctcgacaccacctctcttcaccgccttttcaccagggactgataggtgagcctctacgatgatttccggtagtttggtcccactataggtcggtttgagttgaaaattttcaaaatcagactgaacattccgaaatatcattgtaaactaccacataagtcgctcgtcttaaacttaataaaagttttacattctgatatttcaatttttttaccactattgagaagttttcatcccaagggtatttcggccattaggatataaaactgtatagtaactgggacaaaattatatagttgtaataaataacgaaggctaaccgccgccgccctcgcgtatctcccccctttccctcggcgtaaaagaaaatctcccggtctctcgtctcctccgctccttgcgccatctcgccgccgatctccatcgggcgagcagagcagagcaggggatcctggtgagcatccatccgcatcctctttccgattcatctctcactcccatcgggagtgccttttgtctcgaattaaccctagtttcttctcttctagatctggaagaagctccttctcttaatttcagagccttaaaaccttaatacgagtaacagtttgttgtttgttcatccaaaagtttggggttgaactgaatccccatgccctcacctggtactaatagcagcagcagcttctgtttaggaggaggctaggaaaaaaaaaaggaggattttttttttgtttttttgcgggggttcagctgaacaacccccatgcatcacgttaggtccgggctgggaagcccagatgcttccagcaattctagtaagcggaagaggggctcctgcttcgcggagcggaatatggatggtaggaattcgatccggataaagcccgacgtcagcgtcagagcgcgggagaaatgcggcgggggtggcgggcatcgctacgtgatcgatttggagaagccggcgacgtccgacgatgatgtggagtttgtttcttatgccgggtttggcaaccggtctcaggaccgctgctatgcttcggcggagaattgctcgaccgcggtatccagtcagctctgtgtggagcggaatgcttcgcgtgtaagccctggtgagttctgaatttgctcctcctcctcctcctcttgtttattatatagttagtaatgtagtgtcttgtgcagcttctgagtgtttatgtttaattgtttggataattcgtagtggaaatatactgcttgggtatttcacaaatgcgccttgttagttacacatatctgatcttcttattctagtacagcctatttactgtatatgactgtccact

SEQ ID NO: 12244 - DNA, 10051 bp, Oryza sativa
gtatggttaacaaataccacagcctgattatgccaaacaaagcaatggactatgttaacagtctgatcaatttcatgagctaccttgttccatcaacaccatcatctcttgcacgggcggagccagcattttgagtcactggggtcatggcttttacttttatttatgtcgtgtttgaaactatatttattctcgaagctagatatttttagctcaaaattcttttggagctagagctatgagtaagttgggattgttccattttgctaaaaataaatgtttaaagtctattctataagaatttctgaggtttttaaggtctaaaaatttaaaagttatgaccatatacaatcgggcataacaaccatgtgctttttcagacatacaaatatgttctgaaagttgtttattattccatctgtctcaaaatacaactacctacgtctctttaagagatcaatgttagggtgtgaaataattgtgattggttggaaaaaaagtaggtgaaaaaaattatatcggggaatattgtgattggagatgggatggttcatagaaaatagctatattttaaagcaaatttgaatattgagtaaattgcacttacggtgcaacaacttggcaggtgggtgtaatttggtgcaataacttgaaaaatgaccgttctagtgcaacaacttggtaggaatgtgcaatttagtataagaactttataagtgatcgtataaatgcaacaacttgtaaggtaggtaggattttgctacaataaattaagaagttatgtgacaacttaattatttagagcattttttatataaattcaaatttttaagtacttattttgacaatatactagcatggatttatataaatatatttatatttttatcctaataactaataactgaaagtcaattaaactggattaagaaattattatatttcagttgataattgagaaggtgaagaaaacaaaaaattcttaaaggtaattggatgtaaattgtatatgcaacataattcttaaagattaaattcatatataaggtaatatccgtatgatcagtgtgtattggcatactgacatcgtgaaaaatctcatctagcatatgcttagctaaattgattcaataaaatactaaattattaagttcttgtactagaacgcacccacttgtcaagttgttgcactcggacgtttaattctaaagttcttgcactatattgcacccacctgctaagttgttgtatcgtgggtgcaatttactcttgaatcttagaagtaacatattttgagacagagtgagtagcttaaaaaaacacatctagtagttgattagcaaaacttcaggcctaatgcattgatatacatagcacatagctaaaataagtagttggttaatagatcaaatatgtctaattgcagcattagtagcggattgacagtagcataacacagctaacaaattatgattccaaagaaagaaactgtacaattgtttcagctttcctgagctccagcagtttatccggctggccggggtcattaagcttttgctactggggtcattagctagaaaataatgaacaattcacttgatagatcgaatgccatcggggtctaatgaccccaatgatagtactgcagctccgcccctgatctcttgcagaatgaaattccatcttgatcagtcatcttgtctagtattcaacactgctacaatatatgcacttacaaccaacctgtgatttgtacaccaattcaccaaaagaatctaaaataggcatatgtgaaaaaggttctgtgatcaaatatatgtgcatcgcacaaaaaggacaagttgtagatgcatcttttgtgatataactttctttgtttttgcagagcacataggatctttttctctcttatgattatttacaggtgcacatgttcaaacatactgggcatcatttttttaataatactgacaacataataataggtgttcatcaagtgttatctacttgtagaaactttgacaattatgctcacataatgggtgcatataaacttgagtttgtaaggttgcagttttttttttaaaaaaaaatcacagatatgcaagtcatgccttttttagctcctaatagcttaagctcatttcttttgtaataaagttgtgttgcatgtcagctccactggacctataataatttgaaatttggtttatgataaaccaagaatagggatgacatatcttttaagcaatcatgcaggagactctctattaaacttaacaaaagagaggtaacttgcaagaaaccaaaatgtggttttaaggtttcaaaaaagaaggcagactgtgatgttgtcaagatggtttacggcgaggcatttctctgctctagtacttctgaatacatctgtgccctaactaaatttccacaacttattcatgtgggagaggatgctctcttcagcatcattgatgatttggacctttagtgccactaattgttgcaaatttgacatggccataaacaacatgtggttgttggaaacaatttacttgttttattcttctgatggacgtctgctgtatgggtttcttcactgaaatctctagtaatcctacaactttacctggtcatcgagcattcatataactgttcaaccctgatggttttcaggttcagttggttcgagtgatactctggactgccagtcacctatcaagcctgataattcagaatccaggcatttgctgatcgacctgaatgtacctcaagaagaaagtctacatgttttctatgctccatctcaaataacttgtccaactttagttaattcttcgtcatcacaccctggagaattttggaatggctccagcaatgtttacaaaaaggaatgtggttctggtgttggatcatcaaaaggatcttccattacggtggttgcacccagctctgctcctgatagttcgagggaagttgtggctgcataccaatttcatgatcctaagaatttgcatggtaatatacatgcaagagaaaacagccagcatgaacatgcagtggataagttatgtggatcaagcagtcaatatttcttgccacagcaaagattttctgtcagttcctgtggcagaaatgactcatctttggccttacaaaaatcaggtgacaaccatgttgcctgccaatcaggacaaccacctctggctgtgcatactgagctccaacatgacacttctattgtaatatccagtggtgaagagaaggtcctttttgaccttaatgtgccagctgaaagcattgacatggaatcaacaataaccagtaatagttttagagataagctagtgaaaaatgatggaagtgaagaaacagtaaccgatcattctttctccaagagaaacggtgtgcatgctgaaacttctatagaagaacgaactgttggagaacatcatatatcagtcagcaaggatggaaacaccacatttttccaagaatcaataaataatgaaattgataaggcgcagtcttcagaccttataagtgttagcagcaaacatttgattgcagaaactcctcatgttgacaatattgtgtgtccagaactgcgagcatctcctgatggagcatcaagtcctcaagagaccttgataggcaattgtgacaaaatggtttgtattgcagctgagacactcgtttccattttctcaagttctgcatgtactacagattgcccaggaactgacagtcagacagcagctgaggatgtaaacgatgaaccgcagcactctttggattcctatgaggaaattgtattgaatgtagaagagatcagagatgacggggaatccatccctgtgattccacctgataaggatggaccgtcttgtgggatcaagctaagaagaggaagaggactgagaaattttctgagggagataatgcctagacttgtttctctttcacggcatgagatatgcgatgatttgcatgctataggttacgagccccggaaaactcgatctaggaaaacttttggggctcaaggttcatcttcaactagaggaaggccgcccaaacatcgtcccactgccaggaaatgatcaacagcatttcaagttcatactaggatgccacgagacgagcaattcagaagatgaaatataattttaaccttgtgaatattcatgtgtgttgtgcgcatcttcaaactcggtttgttactagtcactaaattgaggatattttctttattccttttacctcttgggagtgctgtgggccgttagcttcaaatttgagttcagcattggcaatgaaggcatagtcataccattataaaatctcagaattttgatcttttaagtattaaccctttcttaagaatcttaagtactcgtgatctgattccgatgaggattttaattttaaaagtcaaactttgtatgcttaaataaacagtagttaatatacaggtatatttgctgtatataaaaataaaaattgtaccaatagattcatatttcaaaacgcattcacacaatattggttttgtagatattaagaattacattttatgagaaatcattgggcaaagtttagttttcaagactttctacaattaaaatacaccttataaaaatgaacggaggcactgtttgtttttttgatcataatatgcctttttttttctcttgaaacatatgtggagttactgagtcagtgagagtattgtttctcaggtaatatgcatcactgccctgtggatcaattctaatgctgtctgttacagcttgcaatgatgagacctgggctcgggctgtgctgatggtcccaaatttcctgtgcaagacattactaatcagtttttgcatgcaaatttcacactccagaagaaagcaaagcatttgtttctcctgtggttcatttgatctttgaccccattgatgagcaagtgcagagatcataatgcccggtgtcacgggacatcagatcgaaggtcagttctatgagaccagcagcaattgagtaaaatttatgatgcatccagttatatttaacaccatgctcaccagtgttcagctagaatctgagtgacctcatacacctactgcctttacaattcaccccaaatccccaagaatccaggttgcagcagctatggtggtacataatccagcctgcaacaaacagaagctttgctgattgttctaaaatttgggtagatcacccagaatcttctaaccctatcgtttggcctaaacagccaaagaataagccaaaatttaaatttttaaacttgattttgaagttaattttgaaatgcttttaacataatttttgttaatgttggcttttaagtcgctacgaacaaatctacaaaagttttacttataaattaattttaattttctaataagccaaataagccattttgggccaaatgggcaaccgatgagagccttcttatctcgatttagaggatgaattgatcccattatccaaaaaaaaaaagcttcacaagtatatatctccctccgtctcgtatcctaaaataactatgttttggatggaggaagtatatccgtacacaaggcttaagcttcatgttcagtaaactgatcagtgcaagaaaacttcagaaagtgtgacatacattagtgccactggtgtgcacaaggaagaagaaatgatttgctactgttggagaagacctaagatctcaccatgatggcctgagctacttgtagaagtagaagtatactaaagcctttatgacctttgcattggccatctagtcggtctagtaataaaggtttggccatggtcggtgggcaaaggcaagtgcttgcacatcctgcatcattgttagatttactcctgttgtcagatggacatgcatcccctctcactccccatgatcatcatcacatcagatgatcagatcggattcagagctagcccaatcttcagggagacctgatatggccaagctagtcaaacagccaaagcatagtactccctccatccacaaatataaggatttcgttcacaagtacaatatttttttggtcatgcacgtcgattgccctccgtccttaaatacaaggaatttgttcataaatataaggatttctacacaaatcgttatatttgtgtatagaggtagcactatctcaggttttctttgaataaaaggtagtatagtagtactagtatttcagcaaggacattcactgttaaggcagtcaaatgatcaaggagccatacatctagaatacctataaaatgtgcagatagatagtgtatatacggctgtttgctgcaaattgtaccagcaacagtagcaatgtggcatgatgattgcagaggaggaataactggtgtgggctccagagatcaatacagagacaccggtaggcttggattgaaacaaaagcaagcccaatgtttattactgcatctgtttgaccacatggagatgttcagttgaggcaggcagttaaccagccattcaggagccctagtatctgaatcctttttaatggcaggtcaaagctacagtcttacctgtactggcaacaattaggcaacaatttatacagacatcagctgcagcaattacagtgttgcttgctgaaatgctagcaacatgcatgcatggcgaccttaatggcatgttgccatgttcccaaccggcaatacacaaaatgaccttcttccctcttttggacgcatgaattttacaggattttcgtaagatttagttcgtcagctcagactggaatatactggaattacaataatttataggatttagttcatttgttatgagttatgactgaatatactggaaatgtagtaatcttattactgtatttctatcatcttagtaccggcttactgctttactgcatgcagtgccacggggctactggaccattcttttcaggcctggagtttctgagtgtcagttaggtctagtattcatggcattgcagcattcactgtttccaaaggtgagttctccctcgcaaaaaatgctgcaatattcagaacacacataaaaaacactccttgagaaaacaagaagaaaattcagaactcgtcctattcaccattcccgaaaattgacgcaagaacaacagtgcaaaatacacttctgtcttactccgaaaataccctctctctccattcaaaaaactcatgtgtactcccttcatcccaaaatatatgaaattttagttggatgtaaattatcccagtactacaaatctagatagggatgtgtcacatacaaccaaaataccttttttaggatggaggaattatttcttatgtaattaagactaaggagaaattaactcatccaacgtgtatacaagtaataattcgatacataaacttaaaatgaaaaatgaattgtatgcctgcatgcaacgagtattaagatgcatgcttgggttctgatgaataatttaatctagaactataaaacgaaaacacaatctcttcatttaagttttggaataaatatgattattttatttgaaaaacaaactataccttagctaacacttttgggcgaagataatagcatttttttgttaacatagaaaaaatcactatatttttggatggactaggatatataccaaaaagttagacggaggtagtacctgtaaccatccaatcaatcatccatttggagggagagaaagagaacgatggtccagtagtgttggctacagtgagctggctaatggccatgtcctgagtactctctcactcttgttaggtgctttgatcacaagagacattgtaacatgccaatataatccacagccacccctaccctgcagccctactacatgcaacaagatccaaattaaagagacaaagtgtgaaaatgttgtggcagtatgctggggcgggtcccacctgtcagctatgggacccatccatgagaggaaaaatcatgtcctctaaatatctgctcacaagtcatgatcagaagaataatgacatttatgggctaacaactcagaacatggatattacagtattggcttgtcatgaaaaaagcatcaatcaattaatagaaatcgttatagcattaggggatggtctcctgttcctgcacaattaaggctgtcaacttctgatggtcgtgtcagatctttttaagctttggtgttaattagcatcttataccatgcgtgcacaagatcttgcagagtttccttttagctcttccgaacaatgaaggtttctcatgcaagcaagtaatgttactgatggggattttttttgttgtttcctacagtagttttcagctgcattgtcaagcaagagtactcctttctgttgcttctacctcgcacattcaatccgtattaacatctataaccaatctgttggtagttaacacagcagatgtactccatccttatcagaagaaccctcttatcacaatcaatgattttttttctttaacttggccatgttctttcaatatttatccttccagatttttctacagattatttgctccacgtttctaaaaatacaatttttcaaaaaaaaaaaactttcttctaccatattgctatctattctaagctatttgcaaactttttttaaaaaaataattaattgtgttaatcattgaacaatccgtgtcaataatctagggaaaggttgcatcaaaatagttgagcaaggccttttcttgacgcgacactttttccaattcctacgaaaattgaattgattcctaaaaaataccctgcagagtggaatttcctgttccataaacattataatcattggctgtgtgcgcccgcagaggccggaaatataagattttccattatcaaaaaaaaaacaaatacaatgcctgaacattatgcacaatatatcactattatatagtatatactaaagtcagcatcttgtacagcaatgcatgagcataaggtagcatagcaagcaaagccaaaacaggggttggaagaggaagacaacaaatacaatagcaagggtccaagaagctagcatccaagaagtacattttcctcttatctcccccctctccaaaaaaccagagagagcagccacgagaccggaaacttttgctgcggctggcttctcaagatgttgccaacatccttttataccctacctgccaaaaaaaaaatttctctgcaattgcatgcagatgcaaacaagcaagccctcccatggcattggcaatcatacattcataccagtacatgtttccattggttgagaggagaagagaacacacatgctgtaacaagaacacttcaaacctacggcgacaaatctctctgcctctctgtctgtctctgcctgtgaggggaaaaaaaaggaaaaagagaggaaaaaagagaaagaaacaacatatattttgctgcactgacacacaaagatgaaattgcagagcagaagcaaagaaggcatccagattacagacatgcatgcaggacaagagaaggataaaaagagaaatgtttgaaaaataaaagcattgcaaaaaaccgtttctatataccatttcaacattcagaacaaaaaaaaaaagaagaaatgagcaatcttttactgttttacacacagctctgttactacgtacttgcaatcttgcatcattgccatggcaatggcaatggcgatgcaactctctcgccaagaaagtgaaaggaggggaaaagagattaagaggaagaagctaagggattagtgctagtagattaacgagtggttaaatactgatgggtgtttgatggcaatggcggccatggatggatggatttggctagaccttgtagatgatgaggaagcatgggaggacggcgcggctgtcgaggaccaacagctcgccgttgcccatgtcgacggagtcgtaatccgaggcgtggcgggaatggccgtgctggtgctgcgcggaacggacgcggcagacgatgacgcggcacaccagcatcgccctgcggcccgggccggcaccggcgctggcgtgcgcggcgcc

SEQ ID NO: 12245 - DNA, 6005 bp, Oryza sativa
gctgtgccgcacgaacgccaccgagtccctcacgtcatccttcgccgccgcgcacgacaccggcggcgactgcagcttcttgctcggcgacggcgccacgacggcgtcggccacgccgtacgacctgcagctcagcgaccgcacccacgccgtcgccattggcacgacggcgaacgcacacacgcccaggacacggacctcgccggcgacgtcgtcggcagcggcggcggttgagctcggcgtggacggattggtggtgatggccgcgagctctggcttagctctgggcgttattatgggggagggtggatttatttgcttcctaccctgtgctgggtcactgtgccactggcattgcactgcttgcctccaagctccctcccctatcacacccacacactcccaacctcacccccaatgacaggtgggtcccaccactgaagctacattgtgggacccagtggcagtgagtgggcatttttgcaataaggtttgtactgcagctttgggttgggtactcttttgagctgttgtgtggtgtactgaatgagagagatttgatttgggataaatcttttcgaaatttgttttcatttgggctcatgatttggggggaatgggcccatttttcttttttttgagtgaagtgtggcaatgatcatttggatttggatgcctttaggacctgtttagatcccctagtaaaattttcatcctgtcatattgaatgtttggatacatatgtaaagtattaaatataaaaaaaataactaattgcacagattgcgtgtaaattgcgaaacaaatcttttaagcctaattgctcaatgattggacaatgtgatactatagtaaatatttgctaatgacggattaattaggcttaataaattcatctcacggtttacaggcgaattctataatttgttttgttattagactacgtttaatatttcaaatgtatgtctgtaaattcgatgtgacacgccaaaactttttacctctagatctaaacacagtcttagtccaagaatttcttctcagtacactctctttctactggttttctttcttttcctttttgtttccttcttttgtatctttctatttttcttttgtgtttttcagagctccttttttgtgatgaagctgtgtgtgtgtttgtgtggtcggtgtctttcaccttttttctgtgtgtggatgtggagtccagtttctcccttggttgcaggcacgcgtttgatctgtctgttcgttcgttcgtggtgcttctgatttctcgtcagaatttgcaaaaaagatgcatctctttttgttatctgtctctttttttcttgccatgctagtgaccaccactttttgttatttatttcacaactattaattttgtaggagcaagaagaggacatgaactctttttatgtttttttcaacgaaaaactttgaattgaagaggtacatatcacctaaatgctcatcatttgcatttacagcgcgtccaaaattcagcttcgaacagctcgtcaattgaaagtagttaaagtttcagttcgaatacgcctgcatttttccggggtttctttattaacttctaccgtgtaatcatttctgcatatgcggctcattaaaattgtcagcaacgcggcaatatgattaatttgacggttagcatgtgttagcgctgaccagcaaaataaaaattcccccaaaatcgcacacctattttgttttttcctccgaatattcgcattattcacgttacaaacaatatgttcaacacgcatgattaattaattggttaactaatcgggtcagattttctgagattacgtacacaaagattcgatctctctgaatcgaattaatttccctattgcccagcatgcagctgcgacatcccattcgtcaacaaccacttggccaactgatcaaatcgtgtactaataatagtttattaattttcctatttttctctgaattaattgtgtgttaaagagttgacgtagttgacaaatggaggtctcgaactgcatgtgtaacatgacactgaattaccagtccacattactaagcttattagttaacttctataccttgcaattaacaagtgcctggagtctctgaaccgacgacaacctaattgcatcgccaatataatgtacttctactcaacatataacatgcaattgcatacatgttttcagatttgcgacccgatcatctctgctgcttatgcatagaaaactgacgagatgtttctgcagctaaccaacgcgttaattagtagtttaagctgaccctgataagatgcaacttaacttatgagacgcatttggacatggagcagttgccatcattccatggctctgcaactgctagtaccgagaaagctcatttcaagggaagacattgctgcatggatgcatgatcaatatcgtcagaaaaactcactcactcactcacttcgactcgatcaatcgatcgaatcctcctccaatgcctcgccgcaaagatctcaccgaatcattgcggcatcaagaacaggagaaaatgcacgcagtgttctcagcacggttctatcatctcgaatcctcaatataattgtccgagttcagtaaagcttcagtacgattctactgcaatttgtttttagttgttgctaattcaattggttggtatctttgccattggagacatgttttaatgcagtgataggctctgaaagtggtcttccaacttatgccacacctaacatcgatcacttctttacaattccttcagaattcaggctcatcttgacacctcaaaaaaaaaaaaacactgaccaaaacatgtcggtctctgaacaccacaagctaaaagaacctgtcctcttgcagattggatggcatctctcttattactaatcttttgccctcttgtagactgattggctgatgtgcaagtcagatgatgatcacctgcatttgccaacgacgacctaatcaagagtttttcctagcagggcaagtattcttcagaaaagagaatgtgtgcaagtgttaacatcaggatgttgtggtctgaccaaacaaaccaatatatgtatacaagattgattccagccaatgtgctacacttgtacagcatcccagctgcctttgcttatgcttggtatccaagagaagtgtactgtgctagctagctagctgatgtacatgtaccagcatatctaatctaatctactgtttgatcagcttctttgtatacaatgcactggtcttattgtagtagagtactcctccgtttcgaaatgtttgacgccattgacttttttaaatatatttaaccgttcgtcttatttaaaaaatttaagtaattcttaattcttttcctatcatttgattcattgttaaatatatttttatgtaggcatataattttacatatttcacaaaattttttgaataagacgaacggtcaaacatgtgctaaaaagtcaacggtgtcaaacatttcgaaacggagggagtactaacactacaagacaattgtgtgtcaatgccttggggtagttggattggatggatggttctgcacttcagcttctccgtggatactgtagtttaacgaggtttgcttactgctccccagattatcacactctgattgtcgctttcagatatggataaccagaggtaaacagtcaggaaaagtaactaattgaagtagtactgtagtacataatggccgttgcttaaacagagaattggagcggttagcgaaagcgtcgatgtcaggtaagacaagaggcatccgtcatctatcggtaaacggggagcaagtgcatgcatatgcttcaactcctttcacggtaagtaaattagatatgggctggtaaaaacgaagcaaaagttggcatacacttgcatttcagaagcaggccaggttgcaaaaggccaacgagaaaggcaccaacttttgcattttttgacacacacagagagagattcgagagggaagagggagcaaatgctagagggcagcagatgggatgggaatattcaaaagatacacaagtaatataaaaaaagagagagaatggaaaaggaagagattgtgagatggcaacaaaagcagagcctggaaggaaagatcaaaagatgcgagcaaaggcagcagcagcagctgcagctatagtactactcttcagtcttcagaacagaaaagaaagcatcagaatttggaaccaactaccagcacagattgttaaagaggagtgtatcctacagtacagcatctgtacatgtaatgaaaaataaaatgtgctttatttttccgtgaacgcgtaaaaaaattacactaaaaaaaagttatagttacacaacgcaatcagctagaccggcttatgtcagagaaagagagaaaaggcaaaataaaaagctgaagcttagaaaactacagcggctaaatacaaactccaagcagcgggaaggggctgagctacgctatactctcaacaagtcccaaaaacagcaacgccagctaaagaccaaagatagccctccttgtgaatggactccagaaccaaaaatgtgctttagatttcgtgccactgtctcactgacccagccatgcagtggctgccgccattggagagcatcagaatacttcttcttctactacaaatagtggcagcaacagtagtaggagtacgtatggaaatggagaaggatatatgtaactggggattccgaggaggacgacgacggccgggcagtgggccggcggcggcctgaatttggaggcgacaggcgagctcctccggccggcacgcggattggtggggggatcgcctcggaattcgggccgagctggctttttttgttggtgttttggttggcccagctaccactcgtaataaagcttagtttgcaccttgcctgcacgcattgggctgcctaaagccttttctagtgctaatagtactgtctagtttggcttgatcagatcatcactcccagacatcatttctgatcaccactagtactctctgtacaaaaagtataaaaacctagtatcagattggataggataatccctagtgctttctaattcgtaatactacaaaatatctaatactatttttagtgggagagagtacgcattttgtgttgaagattaagattttcgtggcacgcttttcaaactgctgtttcgtgcgaaaactttttatatgaaagtcgctctaaaatatcatattaatctattttttaagtttataataattaaaactcaatcaatcttacattaaaaacacctcgttttacgtaaaaaaattaatatttatcttaagaaaagaacaccaccatactcttctctttttctttcttgcatctcatagaaaacgtcccatgtgaaatactagatctctcctcctttgctcataggtgaactgataacctattgttgcatttgtgctactgcaaaattcagcagcacgcgtgcatggtaacaccaaaaccgagttcatactacggacttgtcatctttttacatgcgagcagagagctggccaccaattctgtcactgatctgcctgccagcaaccaaaaaagcagctctcctttcgcctgcatatgctgtacaaaagccccccgtcagagattgcagctcatctaaaacatgcaatgttcagtgcacatcgtcgacagagcaagacagcaacaacctcacgttcttggacgaagctagctagctattgcaatgaacagatacaaacttttttcaggaaatcatgcggaggaacgccaaattttactcagagagatggagatatgatagtagtagtaatctgcttcaaaaattcaggtgattttcaagagagttcgatgctgctgctgctgctgggctaatgctgtccgtccactactagttgccggccatcctaatgtgtactggatcgcacattggaaggtgaaggattaacaacgtttttttggctaagctacctgtagctgtccaaa

SEQ ID NO: 12246 - DNA, 26366 bp, Oryza sativa
ccgccgcgtcgccgccgagccgcctcccgaggccgccgccgccgccgcagccaacggcgtcaggctcatcggcgtgccccgcggcggcgtcggggaccagcccatcggattcgtccctctcaaggtgacgcgcctcctctcgcattttgtttttgtgttccgtctatttcgatcgatctcgagcccctactgcttacgatcgacgaaattaaatcgctcgttcaattcaattcaaccgcacgcatttcatcacctgatctgtttaccggtagtagagcaccaatttctccagccaaattttagttgcgcatttgcttccgcgaatcaaatatctcccacgagtttggtgcgccggtttccgcgcacagatcggaacagtccagtccaaccgatgctgcatctcgcaaagcccgacgcggcgtggccgcgccacgagccgtacgttcgccaagatctacggccgagatcgctagcaagcaacagcagcagcatcacatccacactggtagtagtagcatagtacaatggctgctgctgctgctgcctaacgcttgtcggataaagagatgccttgcttggatcggagctggagcagctgggagctggcatttctcaagcgcaagcaaagctcactcactgtgaaagagcagtcttcgcatcgacttttagcgagctacagtggcgatctttgtcatggcgtgctcaggggaaggagaggattagggcacgggaacgaccggatcaccagctggactttgttcagaaaggattgatggcatggcgcctccacttggatggcattgcatgtccgtgagttgttgggaatgtaaggtggtacggaccacactgtctatagccatttatatggcctgggagcttttcccccctcttcctcttggctcctgcttcagtcagcgggctttatgttcgcttgtcttttaggcatctgtttttttttacagtgctcagttatgggttttttacaatgcaggagactgtcgagatttaagtgtactgctataggtttgtaaaaaatctatttctgggatagtggattgccagcacagacgaatactagatgtgcatttgatgaagagattgcattttggtgtactgttgctactctggttgctgattctgtaattcttttgaattgtttgtagatctcatcatttagcgaaagtaaatcggatgataaacggttctacatcattaccccaaccaagacgcttcagctgaggactggctctgctaaggaccgtgtggcttggattgaagcacttgtttctgcgaggagtgaatattctcttaacgggggtgtaccgtgtgaccagaatgagggatcattttccactgaaaagcttaggaatcgcttgcatgctgaaggtgttggagaggcaactattaaagactgtgaacagatcattcactcagaattttcacagtatcacactcagatgaagcaacggtgtgaagactatttaaacttcattggcagtcttccaagggaacttgaggtaattcgttcttagagctcatttagtgatttatataagcaactcattaagttcccatttctgatagtaattctgaatatattccaatttaatgggatttatataggttgttaggacttttgaatctagcctgaaagtcaagtaataaattgattgtatgttatctggtggtctgaaactgtctgctgattgtattatgttcttttaggtagttaattcgggagatgcatctgctattgagaagccacagtcggagttgttcaaacatgactgttccagctctggaaaatgtagtggtacttgattttattttagttgtcctgttttcttttgactgttttgattagcattatatcacatgctccatgtgcattaaatggtgttggttgcactttccaagcatatttatattgctttacttgtctatatctggtcctggtacatcattgcactttatgttattctccttggattaatctgaaaatgaaaggatggaaacagcttgaaataaaccacttcctttagttctgtgttgccgcattttgcccacaactacatgctcctttttgtgttcttctttcacaagaggtttgaaacatggctattttctgatatttttatttttattatatcagagtacagcaacactgaatcttctgatgatgctggcaaacaagaggtagggcagttgtcagatgaggatgagtttcatttctatgatacaaggcaaagtttcagtgacactgctgcaagtcctgacttgaaaatgagatgttcaaatagtgggagtggagctcacaagtttggtgaattactagctatcgacaagacgaatgaatacttattgtcatcttcaaaacgccgttcagagttacccgtaccaatagaaaaggagaaaggtgttagcctttggtcaatgatcaaagataatgttggcaaggatcttacaagagtctgtcttcctgtttactttaatgaaccattgtcttctcttcaaaagtgctttgaagatttggagtattccaatttactggatcgtgcatatgaatatggttcaagggtatgcttatttctataacttccacctttattgtgaaataaactgctagatattatatcattctgtatatcacaattgaggagcataaactttgtcgtactaaaaaacccacgaaattgctgtatcagtattttggtgcagttaattaacctcaatttattcaactgtgttgagttgatactcatatcttaatttgcatatacatcagggaaacgggctgatgagaattctttatgttgctgcatttgctgtctctggatatgcttccacggattctcgcccctgcaaacctttcaatccattgttgggggaaacatacgaagctgattatcctgaaaaagggatccgtttcttctctgaaaaggtcagtttggcatccagcccattcatgttcaggttagaatttgttgccatttagtctagcactgtcaaattcttctgtaaataattgggagatacgcaatgtgaagtttgaaagcataaaagtggcagacactgttctgatgccaggcacattaatattcttctctacatttcacacaacatatgagttaatttgttagtttattcttgtcaccaggttagtcatcatccgatggtcatggcatgccattgtgaagggaaaggttggaaattttggggtgacagcaatctaaagagcaaattttgggggcagtccattcaactcgatcctagcggtgtgctaactctacagtttgatgatggagaaactttccagtggagtaaggtacaaattcttcactggaggcaaaactcttatgcatattttctctccattttttccattatgtttgtgcatgcttggtctagagatctggagaaggtgttggatatccttttgtcaataaacacctatcatttatttattttgccatggcaggttacgacaacaattaataaccttatcattggccgagtctattgccatcaccatggcacgatgaacataagtggaaacaggcaatattcatgtaagctgactttcaaagagcaatccttcctcgatcgtaatcctcgccaggtatgatgaacaattttccatccaggttcttgtttctttcatcttcctgtagaggttactaaaatgtatggtcgtatgaaaggttcaaggacttgttacggatgctaatgggaccaaagttgcattcttgatgggaaagtgggacgagagcatgtcttgcatcattggtgatgatgcttctaaagtgaactcccgtaatgcaaatcagagtacgggtgccactttattgtgggagaaaaatgtgcctccagccaatcccactcgatataacctgtcatcatttgcaatcactttgaacgagttgacaccaggtcttaaggtatgcgcaaagcatataattcgcctattgttagttttttgtagtgcaaagcctaacgtactatttgatgatttgttaaggagaagcttccaccaacggattcaagactcaggccagatcagcggcatctagagaatggggagtacgaaaaggctaactctgaaaaattgcgcctggagacgaggcagaggatggtaagtattcttgttctaaaaatttccttaattttttttatcacagtttttaaattcttacctgcttcactgtactcgtacatcgaactacactgaattttatggtcttttatcactgcacttttatatatgtccaccatctgatgggagtgaatcactgccccggagaatcttgattctcgttacaaagtgcagccagaacacctatttccttcatggaaaaatgcagttattatctgctctaactgcagcggttatctcttcctctacaggcaaggaagatgcaggagagtggttggaagccaagatggttccaaagggacacagaggatggaacattccgttatgtcggaggttactgggaggcaagggagcagaggaaatgggttggttgcaatgacatattcggcaataatgtgtccactctttgcaccagcgcaagtatatagagaaacttctgtttagtagtcgttgacaccccattaattattgaagacggtacatagttgatcggctgctcccgttgctaccatgcaaacaagagctaacatgctctcctcttgtcatatagaaacactgggacatttatgtggatactgggatacttaactgtgaggcctgctagctaacaatgttgttattactctcagtgatatccattttttcaatctttgtactgttccacagagatactgagttatatacttggttcctaattgtaattgatcatgtaagcttctatgctcatggtcatggataatggacgttcatctttcttttttgacctctgtgccaagccaggcgagtaatcttgtcctgtatagaaatgccaaattaatatattcaatttcctgttacgatttacgaatatcaaaatgctcagattaattaagatgctaatacattgatatttacgggtttttttcttcatgcttaatatagacgggatcgtgtgtcggggatggatccaacatcaagctagaggggtttatcttccttatccagccatccctacccttcttcctcctcttcttattacacaaatcgatataacagaatatgtaataactctttgctccctcttaggaaaatcttaagtaaattaaaggacttatgcaatactaatctacttcgtatagcacatctcacaacactagtccaaactattaatatgttttaaaacttataaatatttttataaattacactatattttatatattattgtcgtgatctctggacacggacaaagttggaggatagacgggaaagtacgaattctcgtctatcctgagagtgagctcaaaagacaaatgccaaaagtgagtaaaagtatttttctctactgatatgctccttgttaaaggatcttggttggtttaaatagtgctcagccgtgtactcaagatttacaagtttgccattgcaggattatatgaagttatcatattacccttaggggcatattggtacatttcagtcgtctcgacatctagtgccagctggtgagagcaattgaggtggtccccataacacttccctaaaatatattatttgttcgatggtactttcccttaactttgattgcccgagttgaacacccgtgcttggactcgaacaagctctcccaccttttggctcctcgtcacttcatttgctttagccaatgaacctgctcaaatacaatgtcactagtgatgttaggtcaagccaagcaaacttactcgaacacattttccttggaacaagcgctcttaggcaaatgcaaattcctggtcagaagctgatgcagatgggaattttattcgagcaaatagtcgctcgaatccaatttcctcgctacccatgttttcggccgagcatggggatggtgttcagccccgctacaacaattataatattaattagacatttatttatttgtttgtattagaaatttaggtggttttcatgttcctaggaatatttgtctctatattagtgtccggtcgtattctatctttatttctattcgagataacttttatttgttttcgtatctgagctatccgtatttgttttttatatccgataaaaatacgaaaacaaatatgagatatgcgtattattcgtcctcatccgctccattttcatcagtatccaatgtgccctcgctgctaccgttgcttagctagttcatctaggctgctttcgtttgtgacggttgggaacattcccctccggcacgaaaaacaaagcagttcattagcgcatgattaattaagtattagttaaaaaacttgaaaatggattaatttgatttttaaatcatcttttctataattttttttaaaaaaatagacagactgtttatttgtttaaaaaatatgtacgcagaaaacgaaagaggggagcaggaactctaagggccgttttggtttgataccaaaaacacaccctaccaatttattggcaaattgaatagtatgtgtgttattttggattgaagccaaatatttggtagttcccttatactatttggtcattttctagaagtttcttcactgtactatgagaatttgactttatattggtagcaatccaaatggtagccaaataattttaccctaccaatattttggtagtgccaaattttgcctagactttggcactaccaataaattggtagggtagagaaccaaacaagccctaagaaacggaatcagccctaatcaatcatatcttcctttctcgtggggcctctaatcatcttcctttgggatagtggttgagcagcggttatcatgtagtcgagtcaggttaggccaaatcacacgtcgacctttgcgtacgtgttgggcctcacctgtgatggactgggccatgctcagctttcatttgggccgcctcgatcggctactttggtttagctgagccggtcaagtgggttcggggttttcttctccgaacccttaaatttttgggtttgttggaaccatgccaccctaattttgtaaaatttgagatatgccacccgtatctcaatgacatgtaggacccacatgagtcaatgacatgtgggtcagggtgacatatcacaaattttataaaatttatgtggcatggttcaaattttctctaaatttttctcttctttcgttggcagcatgcagatgagctgccgatccagccaccttggaggcttccagacagttcgatcgagccgcccttaattagctcatgaacctctcgtaacaatatttattaatgccactaaaactgatcgatatatgatctctttgccttttgcttgctttaattccaagtgcctcgtgatcttcgtgatacttacaagaagatcgatgaggtgtgatcttccacttcgcttcccgtgttcctcgtaatgcatggtatgaggcgtggtatatttataaatgaaaaataatttataaataaaatttttatatacgtgttctagctatctaaaagtacaggctgaaaaataaacttcgttgaaaaaaaaactaaaatcaactataaatttaaagttaaaaatttaaattttaactgatgaggccggaggatcgagaggatgatgatgagtactggagagagcactacgtccatcgatcgagatcgcttgcttgccattgcatggcgtcgtcgccggtcgatcgaacaaatggaccaatcaaacataaagagcagcagctaacactgttccatatcaaaggaaatcatgacccactgattcaatcaatttatgtggagtatacagtacacacacatttctcatatgaacaaaaacttttttgtgtttaatttattgatcagattgagaggtgcgcccgcacctcgcatatgcaggaatttcctcctgccctgcacactatcagtataaaagacgtataaacatatacatcagtaatacactttgtggcaaattatacattgccgtataaatctcccccttccctacgtacgtatatatcttccttctacatacaccccacgtacgtacacattaattaactccacgtagttattacgtagttggttaattaattaattatacgtgcgatgagaatacacccaaattatacccggcgaaatacgtcgaatacaatacacgaagaagaagaagaagaagaagaagaagaagaagaagaagaagaagaaaaattcaaaatacaagaaaagaaaaaaccaaagttattacaaggacgacgtacatacacgacgcgtgcagctaactggtagctagcttgcgtatgtcatgctgacgcatcgatcggtcactattagtggccgacggcgatggtgttctctttagcgaactttatgcccgcgtcggcgaggcgcttctccttgtagacgtaccccctggcggcgacggtgaaaaggacgaggttgatggcgctgatgacggcgagcagccagtagaagtagtcgagcctgccgtcgtcgaggttgtcggcgagccagccgccgccgcgggcgccatggccggtgaccttgtggacgatggtgacgagcagcgtgctgaagaagaagccgatggcgcaggtgctgaggaagaggcccgtgctcatggtcttcatccccttggggcactcgcggaggaagaagtcgagctggcccatgtaggtgaacgcctcgccggcgccgacgaggaggaactgcggcatgaggaggaacaccgtgggcacggcggcggcggcggaggcggaggcggtggcgcggtggcgctcgacggccgcggcgacggccatgccggcgatggagagggagaggcccacgaaaacgcgctggagcggggtgaggccgtgcgggttggccgtggcgcggcgcgcgacggggacgacgaggcggtcgtagaaggggacggtgaggaggatgcaggcgatgaggaagacggtgagggagcccgccgggatgagtaagccgccggcgaggcggcggtccatgagctcggcctgcgcgacggcgaaggtggtcatctgggcgtggatggtccagaacatgatggtggtcgcccagatggggagcatccgcaccacctgcttcacctcctccacgtccgtcctcgtgcacagcctccacttgctcgccgtcgccggcgactccgccgccgacctgtcgatgatcgccgcatggtccaggaacctgcacccatattacaaaccaaacacgtcaatgattattaccttggtggttctaacggtcaaaaataagtaattttcttgtggtgtttcttggcagccaaagtaagatatattcttatcggtccaaaccgacaaagttataaagttcgtaatatttttaatttgcttagtggtccgactaacaaaaaaatattctcttatggttagcagccaacaaatatgaatatccctagacggccgatagaataatgaattttggcggttttcatgttatacttgatggtttttgaccaccaaaaaattacggattattgtagtgctacttcagatcatcaggtgacatcaactagattatagattattctcatcttgtcatgttatttttccaaaggcagaaatggatgaatcaaatattaaaaacctaaaaaatgcatttaaattttgagatgagttagaattgtgttagctaagataaaccacacaatgtttattcatggatgcggattcttcgacttaagttacttaattttgagtcgctgacatataaatttactttgctacagtctcatacattagtgatctaacagtttttttttcttttgcgggaagatctaatagtcactggacttaagtaagaggaaggtatagtaggcgcgtgcaaacaagggagcagccatgcgcacgtagcagcgcggtagctaccgccactgcaagatccaagtctttgtagcggccggtgtgtcgtacgtacgttgcatcacgcagacgcaaagagctagatgagggtttttttttgcgggaagagctagatgagttgagataggcaagagggagaagttccaagcagctgatcaatcacacgcacacgggcgtgcgtgcgtatgcagcgccgcgtcgcatgtgatatttgtcacgcgagatgctgccgcgacccgtgaccaaggcaggttcagggctctgctagtttccactggagaaaggaggaatttgttgggagaatagctgaagctatcggtcactgggtcgcggcacatgcaaatgcatcttcgtgtttgtacatgtactggctaataagccactgtgttatgtacgcatgggatgtcactatgtggaggaggaggtgctacctcgcccagtgctcatcttcacttagcaactcctactctgctttggttttgattctgtgtgactcgtccatcgtatcatgctagaatcaatcttgcctctaccgactttgttaatgttcagggtcaaagggcctttgctttctgcacgtactccactttaatttacttatgggcatgtgtatgtcgactctagctatatacctggcagatggctgcgaccatacgtcgttgggactgggctacttattaggcttcctaaaaataacttgatttgacctaccttaatggtttagatatctagtagtgctggtccaagtatatacacacctacaggcttgcgagaccgtatatctatctgtctatatatgacagtgagtggctggagtggtttcagctgtcaaaatgaagatgattttcttaagaggggtgtggttgcaaatgtcacagcaacgggccaaacagtgcgtgcctccaatcatgaactccctgaatatactcgctccatctcgtaacatagcaatctaatacatgatgaaatatattctaatactataaatctgaacacattcgtagtaatagtatatgtctcgttctctactcctagctactactaagttgttatgggatggaggtagaatatatattatgaatttaatttaatttcattcattttcctacaacctggcttgctatatatgctaaattaaaactgactactagtagcactattactagatttgtgtcaatgcgtggcccacatgaatgatgcatatgcatcttgatcctatatataactcgttcaaattaatttcatcaaaattcatctgaacttaccggctagttttgtgttggggtaataatgtaaaaaaactttatctgaatactaaagatgcagagtgggtggtgaacttaccggcactccttgctgtgtggcatcctctgcttgcccttgacgtcatggccggcggcggcggcgtcgtcgacgtcgtagagcatgtctgggtcggacggcagcggcagcgacctcttgctccaggcggcggcggtgacggcggcgacctgggtgagggggctccccaccagcttcttgaacctgtacctcctggtcccggagaggaacacggcgaggccggcgaggatgccggcggcgcagatgccgtacccccaccggcgtccgacgttgtcctgcacgtacaccagcacggtgacggcgagcagcgcgccgaggctgacgaagaagtagaaccagttgaagaagcgcatcatcttcttcctctcgccgtcgacgtcggactcgtcgaactggtcggagccgaagccggagacgctggacttgagcccccccgtgcccagcgccgtcaggtagagccccaggtagagcaccccgagctgcgtcccgtccgccgccacgcactccgcgctcgcccccttcgggtcgccgcacgccggcggccgcagccccggcgccgccgtggagatcgtgagtatcatcacgccggtggcctggacggcctcgaagatggcgatggtgaggtagcggccgaggtaggtgtcggcgacgaagccgccgaggaggcagagcatgaaggaggtgttaattaagttggtgacagtgttggtggcggcggcatttcggaggtgaatcgtaccggtcatggcgtgcactaggttgacggagatgcccagagtcgtaatccgctctttcagctccgccccgaggatcatcgccgagcagccccacccgccggtggccgccctcaccgcgggcctccctttgtagtcccacgcgtccgtcagcgccttcccctccgccgccgtctccggcaacaccatcgccatatcaacaacaacaagctcgagctcgagacagagagagtaagacggcggcggcggtggtggtggtggtggccgtcggcgatggatgctgtgatgaagccaccgtgtccgagtggtggccttatataggcggagaggggggtggtgcatcgggattcgtgcactggggggtaattataggtgtgattgattaattaagggagtaattaattaagagaaatagtatcaagtggtgttatgtgggggaatcagtatctcctccaattttctaattctttctcccatgactctggcactcgttaatttaatcgctctcgagcaattattgagtacgactcgttaattggtaggattagtggaggatcaaatgctggattaggatttactacttctccaggattttcttgactaattacaacacatgtgtgtgtttggtcagaaagttgagatgatggcagtttcccacaatggacggttacaacgttaatctcaactaccacagtttacacacttggaaaatttggagaatacttgtggacaaactggattttgcagtcaagagacgttctgaaactaggagcagatacaattttgatggaacacaagtgatcttgactactgtgtatcaagatatataattttttgactgaaactttttatgtgcagggaacagtgtgtggtatgatcaatgtgtgctgcccattctctgaggctgtgatgtttagtaattagtagtagcatcttgcaaaaaaggtgaagtgtttgtagggaaaagagatgcgtgtgaatctgaaagatactactaacccgcttggagaaaaatattcactacatcagattctgatttgtcgtgtaactaggagcctcacaattaggttctcatgcatttcagcttttagatcattaattttgttttgatcatcctcgtaagtacattagttcagttaaaaccactgcccgatcgatatatatttgaaactggaagggcccaaaatatgacaaaaattcagattcagatgaacagattaattagtcggtagcaacaacaatttgaacctgcatctttctacctcgcattgaacgtatagtggtactacgacgagtgtacggccggagtatattgagaagtattttcttgagatgaagacacgaacagaaattcagactcagacgatgcccttgtttagttccaaactttttctttaaatttacagttttttcatcacatcaaaactttcctacgcacacaaacttctaacttttccatcatatcatttcaatttcaaccaaacttctaattttagcgcgaattatacacacccatcaatgtcgatttctctgagggacagcatcagctaggcatgcagcaagctatagctctctcatacagcgacatgcgttgacgttagcagctttgttgtgaagctgtgtatgatcagctcaatcgactccaccgtggatgactctgaacctgcctctccttatctctttcctgctccctgcctgtgatgtgccgacctagctagtacagtagtactagctgtttggctcttgagctgttttacagctctctcctttagttgtcttactaatatagagttaagggggcatgattaaatttaagcaattgattaagaggtaagttttggctccatgtaaatatatagctaattaacgaggaaaccagctaagctaatcaaaatacctttctatatctaattaataacactttggattaggatcctccgacgtaaagttagaggaacatgatcgctgacatatggatcccaccatcgacggatccacatatcagtgaccatgtcatttggaaagttttgtcagagatttttctcctaacacctcatatgtttcatgactcggaagttcaatgtgtgtatgaaccaaatctcatacggtgtgatatgaaagttctatgagacaaatttgataaaaataaacgtgtgctagaacacacccacatgtacacgtacgagtgtggtgcgtacatccaacttgtactcgaaaaaaaaagtctacatcattatttgcatttttcactcttaaattattgaatgaaagtcttcttttggaaatggacaaagaatgtcaacttcctagagtaaaaaagatggaattaattgtattataattcctatcctttcaaatctaatttatttcaaatctatcagtatgaaaattggtgtcaagtatagaagcaataggattgtctcttacccccttcaaggtaagattcatgacagtcgtccctcgtcagatcaaaataaatcaacagtccattagtcctcatacaatgtgatctacctaaaaaaatccttagtttgtggctaacttccccaaaactaagataaaggataattcgtaaaaacatttagtcatgaattgtccatttctacattttttttacaaacaaacatctgcatgtccatttctacaatttttactagttagttcagaagtaaactaaactgtcttggataagatctgtcaccctctttgattcaaaggagcaaagctccaagtcagctgcttgtgctgaattttcatgcatggctccacacagtctctctcagattctttgcagattccactcaatattgtctcacatgcatatagatgtaaacatgattttactctacaatttggaggggcctagctcagaatacagacaccagagcagatcatgttggaggactttatatgctggtcgatatgctcgatcaggtgcaggctatccagacaggcagcctgccagagtgtctgtggatcacctcactgattgagcttgcattttgccgctagctgcctatgacccatactgccttaattacacttacattgataaaaacgtatgagcacgtgtgagaatttcacagcaatgacgtgcagtgcatgtagtactaactctgtcccgtaataagtttatttttaagcttccttcttcatttgttcccaaaaaaattcatttctaaagtaatcattacatcaaagtttgtgaaattgtagaatgattatactgggagtatataaagtgaacaatacttacattgggattcgataaaatagtggtattataattttttttgtatttatatgtgtatgataagtaaaaaataaacttattttaagacggaggtagtatatcagtggcgaagccaccacccatcgaccgatcaggctcgtcaatagaattttgatgttaatatatagtgattgaaaataactttttcataccaaattaatacttaacatagttttatctgggccctaaaaattttctgaatttgccactgatttaaacgagtggtagccaaaattagttgctagctgaaactatataagctgctaatcaactactctagctactgatcacatgcttgaatagaaggtagatccaggaacatttcacaggtccccacaataataatatcatgtaactgctacctataggacgatacttctgcctactgaaccgtgaacttttgagcttaatcgatgatgaggagttttaatttacagaaggaaaattcataggtccccacaataatatcatgtttgttggaaaaattcacctttttctcggtagtcatcaattccaactatcagtttcattggtatacatggcgttgacgacaaaacaaggagttgacactgtacattttgacgacagatcagcatcacttgaaaaatgcacttaaattcagatgtaagtcgtcccaacataaaaatattttctaccactccttcccattgctgcgtgcctgaccgattctgccgatgattcttcaacaggacaaaattttaagttctgaaaacgtcacacattcacattattactgaatatttttgtgcttgtatatacaaatatatacaataatacgaatacatattcgagtacgtaattctcaacacctcttcgagatccgtcagggtgctcgcagattcgagtttctctcccagggtaaatgcatcttcgagttctctagggctgtttgcgacttcgagtttaaatttttctgtcggaatttatgttgacattttcgagctccgtcagcttgattgaccactatttaattcgtttacatgttcgagtttctctctcagggtgctcgcattgtcgagttccagccccccggattgtatcaaatgtttattatatattaagcaattggcaaattgtaaggtagaactgacaatacatctggccaatgtgatgcaaattgcaaaattttaaaaattaatgtaatgcaaattggtgttgtctcatatagcctcatgcaaattggagtagtttgctgactgccgagagttcaataattgcgtgcgtaaaggtgtccattctctcaatttactccaacatccccatgtatataactatatggaaggtggattttcattcctcggggatattgatttccttgttttatgcatgtcacacaaaaagacataaaaaaaatgaaaaaaatgataacatagatcaattaatgtgtgatatattactttacaaacatgtaaattcaaatttaacttatatagataaaaataaaaacaacaaatttgactataaatagtatgtactatttgcactaaaatttgttattttcatttctaattgtgtaggttgaatttgaatttgcatatttgaggaataacgtgtctcatattgatctatcatttttttatgaatatttaaatgacatgcaaaaatgaggaaaacccccttaagagatgaaaagagtttcccagttcttgtgtcagtgttcaatccaagtaatgctttatttttcttcccgaaaaagaaactaatataagaaccacgtcatttttcttcagccataaagaagtattactgtattagtaatagtgtaaaacctatactaagacaaaccgatggaatcagtcactgtctaatccttgtatgatcataccacagcaattgtcagcagcctgaatttttctaacagcagaaaccaatgcatgcatattgtcctgcaatacagacaacacaagaaaccaagtgccaatagaatccatggccagcagttgagcacttggaagttggaataacgagggtatactagaatatacgagtatcataagctacatgacatgtcatcaatggagatggctactttacttgtggtcagagaatatacagtccacacattaaccctagctagttaagctagatgatgacctagctaactgtctttttgaatcagcaatttggacggcttatatattcgccctctccttgacttaatttgctgcatcataagatgtgatgcgtatgtctgattatctgtctcgttcaagttggggtttaatttaattacttgcccggctttctgcaatcgaaaaggctatctaatgcaaccgttcatcgacaaaaccatttctggtaattcatgtccgtatgcggcagctggattatatgagcaattaatcaacgcaaaccctagataatagattctacgtatataaaatcatacagaaactgaactgattattcctattaaaatccctgcgttaatttaaatagacctgattaattagctattgtagtacatatatgcacatggtccagtgaaaattatccacgtcttgttgtgttctatacttgattctcttgtctatatatgtttggtttgcgaaaacgaaaattcagacatttcaaaaacagttccagagaaagagacttgtatggacacgaacatgcagagaggtgttatctgcatatatatatatatatatatatatatatatatatatatatatatatatatatatgcatgcagctgggaataatccatcacacggtgcaatcattcacacacactgtttacactacttgaaaatctattttcgcagacggacggcaaacttcaccctggtttgtatttttgtaggcggctatttgactctaagggctatatccgtctgcgaaaataaatacccaaagtaggtgaaaatgctttttctattagtgttatctgcctgcctggatattcaggattccccgtcctgttgatgagtatgcatatgcgtgtttggttgtacatgtacttgcatttgcatatgaactcaaagaaagaaataacagtgaagaagtttgtgacagcgatttgccgtgaagctagccccgtcgactgaatatcccctacgaggtgtagagttaagctttcatcccttgcacgaaattggtcaagaaagttttggaactggagataagttatcatgcaactaggctaataattgagctagaaaaatgtggcagaacttatttggccagctagtcttcatgttatgtggtctaaacaactgtttgctttataatcgtgagggcttggccaacctcatactatttacctaactagtcctaattatcaacagttacttgctagtagccatagttatcaattagccccaaaaggcccaaccacaaatccagttttgagttaaccgttaatttcgacgctagctattcccgtaccaaataccaaccaacaataggtttggaaatggaactagaatgatatgccaaaataaatattgtttaagctacctaatcgatgatattaattttaaggattatattgagatatagccttgtagattcgagattcttaaagacagcttgtgagaatttgtaaaaggtggattttctaggttcgggcttctaattcattattttcttaatcctatagctacaaattttcaaaatctaagtaaaaatctagattatttatgagagtattctaaaatagctacaactgttaaaagctccccaaacctaacgatagaaacatataaatttactaggatattgttcgcgtgttgaaacggaattttaatttataaaaattagcattaacctattattacataaatttattactgatatatggaccctctggtcttacgttatccttttttgcttctcacaaggagagttgatggtgggggtggttgacatgtgaactctctcccattccaaaaagttagggaggtggtggtagggacggtggcggattcaccactcaccaccactactattaattttttttaaaaaaaatgagtatagattaataagaggacccataaatcttttgcatatttgtgaaaagaaacaaagaagcatagattaggagacggatcacatatatacacacttcaggataaatcgtgcaatctcacgacaaatgtttcaagcaacttttgctctttttctgaaaagggtgaaacctacaaatatccatgaattccaaccttagcatctagtgcttggatatttgtatccctgatatttcttaatcgctttttcttcagagcaaaccagttactgatggtttcaagcagtttcggataggagcctaggagggtgacacctcgccatcatcaatcagagaagaaagctagctagttgctcatcctaaagtggactgcgatatatattatgctgcagcaatgtggctagctagctaccttcatcatccatctatccaattaatttcaacacagagagcactttttatctattaggtgtcaggacaatgaatcatgcacaacatattcaactccattcctattcgatgagttccgatgaaacagcatgatagattctcctccaaatgaggacagcgcaaaaataggacagctggaccaatccattcagtcagtggtctccaatgtccacgcagatgtgctaaaaatcagggaaattgcagtccatttctctgaacttttgaagtgatgatattataatttcacaactgaagctggcagtaacttaaccctacctgcagtgtgttggcagtttgcatgcaagatcaacctatctcctcacaaatatcagtacagcaatctccatgtagatgcatgacagaatgagaatctgagttcatgagctggggaagattaatcattcagaggctaatctccatttgaaccccacttagggagcaggaatccggcaaactgtactactgcttctgcatgcgtctcagcagttgcttgctaattaattatccacaaccaaattgtcccagatttccagctgctggtatttctgaaacaggttttagatctctgtgttcgtcatttcttgattcaggaaaaaaaaagatcaagggcctccaaaaatgattcagattaattatgaccaaagatgaattacgtcaatgttttccagtttactgcaccccaagcagattcagagagccaaacgcaagaagaaatatatactctgggttacgtggtcgagtaccagatattcaatattcatcatggctcttccaaactcgatatcgcaaaatcgccattagaatacgattaacttccttttctcccactttgttttgtaatcgagatcgaatgcgagagagattagaaatatgattggagcctacctgagccagaaactggtactactagtctctgctgccacaatcaaaattttcaattcattaaatttattatcaccacctaattcctagcttgtgtgtgtatataattctagttcattattcaggtctcactctaacaatcattttcataattccgaccagacttaattagcatatatatgcagaggcttaccatgtcatggtacacgaaccagatagataattacgtgtgttcatgcccatctgatctgaccacatgatgagttgtcttgcttataaatttgccaaatctgaaatataaataaattggactgcaattcagcaaattaaagaggattaaactcaacaggtagaagttgttcacgtccgggcacatagtatgtatacttgtttagtagacaaatctctaggtcaaagcacaattattgagcaaaaaaatagttgagagaagttgctcgcaatctctatccgcggcaagattcctcccctctcttttgggtatctccaagagccagttagacccgggcagaatatttatttatttgtcgatgtgtatattcctcacatgataagtgatcaggtggtgtgtttgcttcagtactctctcttgacgccatatttgcatattgtttagggtgcataatgcaggtgagagattagagattggactgtcaataatcagggtgattaagctgcatatcattgatgggagccataggggattcattgctgtcttctctttctttcatcttatcttacagattaatgagtttttagttgttgtttttacagaatttacagggtgtcttattcggaaaaaaaaagaagagagagaacttacagggttttttagcagcaaaaatataatagatggaaatggattctaattcctcgagggatgtaccctcatatgcaatttttctctcgaatgaaatgtaaactgttgtgaaaaaatctatttttattatgtacaaaggacatacatcacttaaaaaaccaagttcaaaatcgacctacacataaaaaaataaaaagaaaaatttagtgtccatatgcaatcaagaacgatttagtattcctaaggcggagccagaatctaaatataaaatatattgaccaataaaatgaatcacaacaaaataaataatagtttcgtgtttttgacttttttgaaatgtatatgtaaaagtcaaaaggcatcatgtattgaaaaaacataggaagcatttttggatttaggatccatttgaatcgaagaatttatggtggagttcataggattgaaatcctataagattttttttcttatttgactatttgattcaaaggattggagttttccaaatcctatacaatttctatggaatagctcattgtatttaggttttggaggagatttagcaaaaggttcgatctcttggaaaaaaaattctataactatatctttctcatccgattcatacgtttttcatgcggtctaatcaaacgattattcgtgcgtattctctgctttacatttagtcagaatcgtgtgtttttttatttctccaacccgtccatcgtgcgcccctccaacgtcgccggcgccggcggccgatcctgcatgtctcctccgcccgtgccgtgcccgcgcgcgtgcgccttgctcggcctcgctatccatctgggcgcgcgcgtctcctgccacttcacgcaacgggtggatggttttggagttttggccggcgcgaccaccaccaccaccactcctcgtcgcgcgcctcgcgccgcgcggcggcggcgacgacgagcctaaacaacaataaaaaaaaatcgcgtgtggcctcgcagctgcacacctgtagctctagtggagtaggccacgagagggagagagagagagaccgtgcgcgtgaggcaggcatccaagtcaacgtggtagagcgtacgaggcgtcgcgtcccggatgcgcggacgacgaccacctccctcccggtcggctttctgcaggggccaagcgccacaatctccgccgacttacaataaaatgcttttcttcttcttcttcttcttctccgatccatcgctgtccatctgtctgcaagaaacgcgaattcgtgaacaaactcctctctctgcagatcgatctagctaggaagctgcattatttgcaattaattaattacgctgttattgttgattggtttgatatgattccatggagggaggccgctgacgtcgtggatgatgatgatgcctgatcgagatggatggtccaggatggatcagtgatcagtagtgactagtgacatgcattttaattttttggggggcttaaacttggggacaggttgagctcactcgatcgatcgagacctgcgtgcttatatatattcagatacagatgcagcttttgacaaatatatacttcagtaaaattgatatgcagcgtttgtaaacgttgtgcgaaacacggcggtagaaatttggacacctttttgcaccaacttcttcaactgctcctcatttttttgcctgctatgatcgctttatatgcatgaaggattttaatttttttttagttctaaacgtcaactagagaaaatagagtatgctgctggacccctggacgcatgcatctcgtcgactatatttatagaagagaaaaaatatatatatgggactataataagaatcatcagactttatagtcagaaacaaaacgaatatgtatgtaatgtacttacgtatgtacaacacattggcacgcctagttcaacagctgcgtaggttaattgtatacgagttctagctgatcccgtcttaagttttcaaaaatatataattcgtccccgtttacttggatagtcggaggtatcttttcagcaggcgttgctagctgattggattgggagaaaccgacgagttttttttccttctgattgataagtgttatgacttcgcattgagctaattattcaagcatactattattttctccagctgaccaaacttctccatgatagaaaaatcaatcgatggtgttcatgctcaccgaaactaaggatgatctcttatgagattaggatatacagaagcattgatctcgtgactgaagaaaatttcagacaggcatcttgttcgcctcaacacgcttaatcttataaacccaacaagtttgtgtgtacttctcggcagcaaagttgggcccgatcacggaagcccatcaaaagcccatgctatgaagttaatagtgattccagatagacagcccatttacgctaggacacacgagtcgcatttcattaaggagctatatggctattttataactgaaaaatactccttccatctcatactattatggaattttgggtgtgacacacgattcgaattttattatggaattttaggtgggtgtgacatattctaatattacgaatcaggacaggaatggatgaagtatcggttagcagtttgggaaacatacgcgtaaaaaaatgagaaagtgaaagttgggagagtggataaacaaacacagccgtagtggcatttaggaaatgttgggaccaagaaaaagattctttggtttgatcctaaattttatactcaaggctccttaagaacccaaactccaaaggaagggctcaaggagagaactcgatgagtctatctattctcttcttcttcttcctcctcccagctgtcccggtagctgtcatccagagaccagatgcaccggagagccttctcgtatatctcccgcctccgcgcctccatgggcggctcgccgacctgcgccgccacccagtccatgtactccacctgccgttcgtcgatcgtcgcggccaccaatggccggaacatggtgagctcagaggccgagacacaaaatcatatgcatgcgtaacttcgtacgtatacgtacccagtcaggcatgagggcgtgcgtgtgccgcttgggcttcccggcggcgtccatccgccggtagtcctcctccacggcggccgccatggcctcctcgcccggaagctcggcccgccccgacagcgcccgggcgacccacctcgactccagctcgaacgactggaacatgatggtctgcacagtacatatacatctcttgcctgaattgtcatggtgtttgtttgtctgaactctgaacaatcgacgaggacgtgtcgttgttataccttgactggcaggccgacgaaggagaggttcggcgcgtgcttcggggggaagacgtgcttgtacagaggcccgacccggttgccgtcgacggtgaccccctccacgtccaggaacgggaaatggtaccgatacctgccaatgcaatcttcagtaaattcatcgaaatgcaaaccaaacgaatgtatgcagctcgaccaagtgtgatcctaccctgtgcagtaaagaaaggtatctgctgcgattgatgcagatccttcgctgaaacgcacttggccatcatcttggatgcaatccacctgattattgtatatatgatccacaattagcacattgattcagtacatgatgcctttgagcaggatttcgggatgtggattttcatccctcgagggacatcccctcgttatttgcatgttatctagatagttatcaaaaaatttgaaaaaaaattgacaacatagattaatacgaaatatatcactccacaaacatgtaagaccaaattcaacttttatactccctccgtttcaaaatgtttgacaccgttgactttttaacacatgtttgaccgttcgtcttattcaaaaaaattgtgaaatatgtaaaactatatgtgtacatgaaagtatatttaacaatgaatcaaataatatgaaaagaataaataattacttaaattttttgaataagacgaatgatcaaacacgtactaaaaagtcagcggtgttaaacattttgaaacggagggagtaagttgcaacaaaaataacaaattaaactgaaaatagttatcgcatgttcacaactatatttgttatttttgttataatttgtagaagttaaatttaaacttgcatgtttgtggagtgatatatttcatattaatctaggttgccaatttttttttatgtttttaattgactatttaggtgacatgcacgaaacgaggggatatcccctctaaggatgatttcactttcccatgatttcggggaacagtgattgagcaggagttaattaagaaagctttgaacctctgaatgcaaccaggtattctggaaggtatcaaccttcccaagccgatcttctgtgtacctagatgcaatgtgcacttccttggcaacatttgagatctctctagctatgtcaactccacttgctcctaatcctaccacaacaacaatctgcataaaaaaagtagacgatttttatctgaaactgtacggcagcagcaagaacacgtactgatactgtaaccgagacagcatcttgaacctgatcttgaaatggttcaggagtccgatagttgtggctgtgcatctgcttcccttgccaattgccaattcctgcaactcagggagtcagattttctaatctgaaatcgcgaatgcaatagatttttcaagtttagatcaaatcaaacttgaaaaaaatttcaatgctgaagattttcgctgctcctaactgaaattctggatgacactgggacaacacctcacctcggagcttgggcactagaagcacagtgca

SEQ ID NO: 12247 - DNA, 5279 bp, Oryza sativa
tcggggcttcgccgccggtgccgtggacggtgggggggagtgggtgggaccgtgtggtcagcggaagaagacgacgttatgtcagattttttttttcaatgctggtgcttgcttccaaaaaaaactcacaggtcatacctctctggaaaaaactcaagtgtgttttggagtatttgtttttttaagtacaagggaaatctttacggtaagtccaaaaaagtagaattaagtgtgaataaaaacagtcgatgatgatcctcacaaaaattatatagctactgcggagccaaacaaacgaactaatagtgctccatttttgtttcactggaagtctggaactatggagagtctagtgaaagcccaatgatacgatcacggcatagggtgtcgtttactcctttcgtcccaaaatataaaagatcttatgtgaatgcgacacatcgtaggctatttgtccagattaatagctagtattatgatatatcacattcacctaaaatctcttatattttaggaaccaaaagctctaacgggaaggaaatctattataaggaagcttagaatcctggtaatattacgggaaggaaatcttgcagaggagatttattggcaagagaggagtggggaaaaattgatgctaacacagcgtattatcatggtgtggccaacggtaagaagagaaagagcataataagaagtttggaagatgaaggtagagtgattgatgaccagatggagttgaaagatcatataaaacaatattacaagtctctgtttggttctgagtcacctccaaaaatcttcccaagtcaggacatgtggactaagaggggcagattggatcaggatgataatgaatatttaactagacctttcaccatggaagaaatagagaaagcctttaagggcatgaagactaatacagcaccagggcccgatggccttccagtctgtttcttcaaggaattttagccacagttaaaagatcagtttaaagaaatgcttgattctttatttgaggagagtttggagttgtggagattaaactatggggtaataactctaatccccaagattaaagatgccaacaatatcaaagcatttagacccatttgtttgctcaatgtttgtttcaaacttttaacaaagatcttgaccctaaggacatttgtggcatccaaagtgattggggagaatcaaacaacctttatacctggtagatttattttagatggtgtggttattctacatgaggtgttgcatgagttaaaaaaatctcaccaatccggcattattttaaagctagattttgaaaaagcttatgataaagtacactgggacttcttgtttgatgtcttacaaaggaagtgtttctgtgacaaatggattggctggatgaaatcagtaacagaaaatgggaaagtagctgttaacatcaatggggagaatggggagtttttcaggacctataagggagtcagacaaggagatactttatctccactgttgttcaacttggtggcagatgccctttccgagatgttaaatagggccaaagaaaccggtcacttacaagggcttgtgcctcatttagtcacaggaggactaactcatctgcaatatgcagatgacacaatcctcttcatgtctacctcagatgagaatatagtaactgtgaaatttctgctttactgctttgaagagatgtcatgcctcaaaattaattaccagaaaagtgaagccattgttataggagctactgaggaggaggcccatagagtagctgatttattcaactgtagaaaaggatagctccccatttcatacctgggtgtgcctattagtaaggggagattgacagctaaagatttggcagtaccagtgactaagatcgagaaaaaactggcaacatggagatgtggttctttgtcttacggtggtaaatctatattaataaattcttgcctgagcagcattcctatgtacatgatggggttatacctgttgccagctcaaacacatcataagatggatgcaattagagctagatttttctgggaaggactagagggtaagaaaaaatatcacatgcttagatgggaggctttatgcagacctagagaggatgggggtcttggctttgtcaacacaaaaatgatgaatgaggctctgctatgcaaatggatttacaagttggagtctggaaataatagtccttgttgtgaactcttgagaaggaagtacttggcaaatggagggggcttcttccaatctaaggctgaagggagctcacaattttggagaggtttgcatgaagttaagaagtggatggatctaggaagcagctatgtggtgggatgtgggggaagcagtcaggttctgggacgatgtttggttaggagatgttccactaagaacacagtttccatacatacacagcatctgctctgagcctaacaatattgttaaaagaatgtccttagacggggagtggaaaattgactcgaggagggctttggaccaaaatgagttggaggagtgggtggagctgcaggagaaactggctcctattaagctacacttaggaaaagatgttatgatttggaaactaaatcagtcgggtcagtttcccactaagtccttatatagggagatgatttttggggggattaaagacataaaactgcaggatctttggaagtctttcatccatttaaaaattaaaatttttatgtggctaatgctaaaggggagaatacaggcagccaaacaacttaagaagatgaattggtcagggagcccactgtgcaaactgtgtggagtggaggaagatgctgatcacataatttttagatgccctccagctcaatttctttggtgctgctacagagacgcctttcactgggatttgatccctacttctagaaatgaccttcttgatttaatctaaaaccaaaggggagttagaaatagatgtctttggtacctgtttgctgctggggcttgggcaatttggcttgtgcggaatgattgggtgtttaatgataagctgctgaataatgttgcctcactttctcaaaaagctctgtcgtttttgaaacagtagggacccttattgtcacaccccaatctgataccgccgtacaacggcacctaacaggagcgtgtcgtagggaaaacggcgcgaaccgcttcctacgaaaccgcgatctcggtaccagtcccaggacatagtgctggtacccacggtgacaaatatgaatcatagcaatctttaaaataaatagaggacttatttaccttaacttaggttgcagctcagacagcccgagaatacaaccgacgacacggacgaggcgaacaccaacaacagcagcagcggaaccaacggtctaatacccaacaccacaggcgacggctgggaaccaggacgaaaccctaatcttcacttcactttatcttctcttcagggcggaggaactatatatatatatttatatagagcaagggtgagtactttcgtactcagcaagtcacgggaacttaggtgtttaatgcaagcttggaagagaggcaaggttgttttgcaaatcttttatttgaagacattttgaaaacactaagtgatttatttctttttaagttagggcgaaaagagacttgcgtctcgattcgactttaagagatgtttttcaacagctcatttggcaatgtaccgacctcccgggtcagatcattacttttcggctcccagagccattccacttgattaatcggctcccagagcctttttcattttctcggactcccagagtccagctacccagcagcacaacaatccgcttccactcgggaagcctagtctatgatgcccgcagacatcccgaatcacacagattcgtttctgaccactcaggtcgtccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactccagacactggccagccagtggttcgcgacaaagcctttcccaagccgacccagggttacctcacgccacatagaaggatcaaatcctcacataagtataggccattttaggcattcacaaatcaactccaaccaccttgatcggtaagtgagcaagcttctcgtccttgcattaccaggaacccggtttggccgaccccgccccggcgttcccacctattggcatgcgaggtttccctgaaccgactagttacttagccagggtgtcccattccaccttgtggttgcactttgattatgttcgatgagtttcccacaggaatcggtccttatatgcgaatacgggacagtgccacataggcacaaccccccgcatcgcgagttttcacaattcattttattttcaaacacaccgacaccacatgtcgggttttgaaggcttcacaaacccatttcccaagttttcgacaaacaacggtgtatgtgggatatttggtatacgtgctcagagagcacgaataccgaggtaccacaagggtggagcgacaaggattcagggtagtacgacctacggaaattagtgcgactactgggtaggtccgtcggtttggcacgcaaaccgaggccaagcaagttaagtgtgtgattctaataatgcaagttgcaaacaaaataataatgacttttcaattataggagcaattgatcaaagggtgacttgccttgctcaaggtcttcacgaagcttcacgaatcttcgagaaaacccgcgatcgacgaaaatccaataaccgcaactatacgcaaacaatcgaaaacctaaacaaaagaccaaaagaaagatcctgtttagacctattagtagtgccattaaataggatctcaattttacggaattactggaagtggaacggagtcaatcggagttacggattgggtgatatgaattttggaagtttaattggagtttctggagtaggagaaatggtttatggaatttatagaaataatattctcaagaatattattgacagtcactgtcatgcgggaccaaaggaaacggtttatggaattttggaataaggaattgatttatgggacaaaggaaaaaggatttattaaatccctggaaaaagaaaaggatggagggatgttaattggacttgggccga

SEQ ID NO: 12248 - DNA, 6308 bp, Oryza sativa
cgtagagagagagagggagcgaggatgagcagagagtgggcgatctctctctccagcccggcgcacgcgcaacgcacgtgtggagggaggggaggggaggaacgcttaagagagcagatggctctaggggagggggatcaggcccatccaaaattagaaggaggcaaaatagacttatgcagagagatgatttggaagggatttggatttggaatgaaatttcgaatatgattacttggactcggggaaacagggaggagtcaaggaatggattcaaggtggactcggtatttttggaatcgggacaagtgtttggcgaggattcaaaggaggcgattgaatttcggaatttgatttcggagacttaaattggaagaggaatttcgatgaggatgattttgatggcgacgagagggatcaaggacggatttaaactgagatccacggcacgacttagactcgcacacaaagaacgaaaatttttgcaattaggatttttccgaattagtttttaacgcctcacgaaaagcggagcgttacatatgttgagcgatatggctttgtagaaatgatgtggttttgaagaatccaaactcaactatttttgcaagttatttttcaggggaacacattggacaaggcaatggttgttgttggtcaaggatgaagagagcgacactctgaagaatggttatcgccagatagagaataatgtcatggagtttttctctaaaactggatggaacttgagaagttgattggggatgtgatgtggtatcattgtgggtcttaagtactttgtaaggatgtttggagctacttgtttttcagaattgtgtgagcataattaagtgtttatgttggttagttgtgtggaaatcctttttgtgaggtcgagtctatgtacttttttgtattttagctgtgtatatatccccattggatatatagagggcgggtttttaatccattataagacattttatctaggcttgtgagatagacacttcctctgttttatattataaatcgttttgacttttttttacgtttaaacaaacttataaaaaggtataataatatttccaacacaaaacaaacatattattaaaatatatttaatgcataaaattttatggaatatgcagtactttctccatattaaaatttaagcacttttaactactaatgcaggtaatagagggagtatgtcggcatagcaaatgacaacttagacgagacacgatgagtattaaagataaggggacgattggaccagccttctgaagagctagtagcatatacgtacggtaccatacatgcaccgtccatcgatgtcgatagagagttgaacacaaacaatgtactcatacaaatgatgcagctatcacatgcatgatgcaataataatataatgctaaagcttttgtagcaccggaaaactatttatccatcatcccgtgaacccatcatggtcgtattctaagtctaatctagctagctacactctacacagggatatactctcttcttccctaaatgtttgacaccgttgacttttttaaacatgtttaaccgttcgttttatttaaaaacttttgtgatatgtgtaaaactatatgtatacataaaagtatatttaacaataaatcaaatgatagaaaaagaattaataattacttaaatttttttgaataatacgaacggtcaaacatttttaaaaaagtcaacggcgtcaaacattttgagatggaggtagtatatgtgtactactagctatatgattatatgcacacaactgtacattaacctaacctgatgaccaggagatcgagattaatcatctagctagacgtacaaaccgaccgtggattaaactgctcattcgcgcctagggaatcgattccgctaattaattacggtgttcaaacagtaatctacactcattgtatacagatatcgcccatgtaaaaccaagtaatcctccatgttacaccgctgtcacacatcgtctttcctccatcacatcaggccaagcaggtcaagcaaaaaatcatggagacagccaaacaaaccacgggctgatggaaaagaaaggcagggtcggccagccatatttctgcatcggtctctgaaatctgaatactacatccatgtgtgttatccagtcactgagtcacggcttcttgtcgcatttggcccatctcccgaagaacatatatgttaatgtaccatttctacgtactcctactccattccgttggtggcgagtgagcgatctctatataaagccgagatcccccaactcggagagctcagctcatcacacttgcagttgcagtggtggtagactggtagtgcattctcagcttaatttgcttgagctagtagctgctcgtgagctgtgcaccaatggcgtcgtccagggcgtcggcttcctgtgccctcttcctcgccctcaacctcctcctcttcgccatcaccaccgcctgcccgtcctgcggcagcggcggcggcggcggccatggccattacggtggcggcggcagcagcggcggaggcggcggctacggaggaggcagcggcggctacggaggaggcggcagcagcggcggcggatacggcggcggcggggggtcgtcgacgagcgggtggtacgggaagtgcccgacggacgcgctgaagctgggggtgtgcgcgaacgtgctggacctgataaaggcgaaggcgggggtgccggcgacggagccgtgctgcccgctgctgaacgggctggtggacctggaggcggcggtgtgcctgtgcacggccatcaaggccaacgtgctgggcatcaacctcaacctcccatccacctcagcctcatcctcaacttctgcggcaagggcgtccccaccggcttcatgtgctcttaatctctcttttcatccacatttcgcattaattaattaccatgcattttacctattacaatcttctaatttgggagtcatttagttaataagctagtgtcgtcgttgttgcgtgccaaggttttaggttagttgtgtgttgattgctagctaatgtcctactagcattgagttgtaggtaccagtttgattgctttcctttgatgcgtatttgttcgctcgctgggtaattgtcaccagtttgtgtgtgttgtaatgtcttgttttagtttcactgtttcggattcaaatttaagatggaacctgaacaatccaggtttttgaaaattcccttgtctacatgaatggttcaattcactactacttcagttaaaaatgtcccgatggatgaacaatcgcacagacaaacatattctcttgcacaaacatcctgcaagagaataaaactatagcctgtgtttgtagatacgccaacatccgcctcgggcatcgtgctctgcacagtcagactcgtgcatgaatccaggccatggagtctctgcagcagcagcaagatttttctgctgggtgcagtgcaagttgatgttcacgggcgaggtttactggcgcttgggcctcaccaaggccgaggtgatcatgtgggcttgtagggagcaaacggaaagcccactctatctcttgggctgtggcacagatggcccattgggttgtccatgtattctaaacaggcccatttttaactactctatatatactgcaagtgcaatagtagtggctgacggtctagactctcgtacgttattatctgctatgatgtactgataatacaattcccgttggttaattagtagctatcagctcatttcattagaaagaaaatggatagagtttcttacataaacaacagatatattttacagggcaaatatcattgttgactcttgggtaactcaaaggacaagcccttgaaggaataattgatatacagtttgtgaacactgaatatgcatattgcatacacctcaataactcaatctctatccacaaactgtgatattcaattctacacaccaacatgaacaccaacgcccttaaatatacgtaagatacatatatacactgttaatcaaaccgaattacatccatccatcaacttaacattcatgaacatgaaaagaccaacaaattagtgcccttccaacaaactgaacatttacctgggaaagtaatgcgaccggccaaccaggggaccatgtatctttaatttcttggtcatcgtctaattttttgttttaatttacttgtttcaggcacgaacatatacataaaaacatcagtaatgtcggctcagatcaccggtcagtccgtgacgctggtactagcattagtactctttgcatcttaatttatataagtgggcgagtgattgacactctgctccatctccgtgtactttgatgatcagaaacaccaaccagaagttgcaatcgccgggacagatgctcccatgtcaaccttctgctttgcctgaatctgaatcaagtttgcccggaggctcacttcctgcacctgcagtccaaacacaatgtaagccatgaaacagaattatttgtcatcaactaatccaggagcttgagctttcgttgcaacaaaagaacaactagactagacaaaaacaaatagaattagggagtaggcagccaggcagcactagtgctggagaaatggagtatatgacaatcaatccaaatcttagtagtacagaagatactgatctcactagaccagattagactagactaaatctggttctggtgagagtgaggcatcagctaaaaacgaccatttaccaacctgcaagctagtgacaatccttgccagcttcatggcttcctgcaggccctccacctcctgctttatcgtcgtcgacagttcttccagcgtgctgctcgtcaccccagcctgaataataatgcaccaccaaaaaaaaaaatcaatcactcatgcaaggttcatataattgcatctaaactaacctttcctagtaacctcgcctcaaaatcgcctgtttgttatctttatcagccaaaaccaaattttaaattttaaaagttagtttaagtcgttgatttttctaaggttttttcattgtagtttatttttaatattggttttaaaccgttaagaacgcagatgtaaaatttttccattagattatttttagttgctcagtttatttttcgacagtttagtggttgatttatcaaaaagctgaattaattaagcgtgtaccgtggcgaagaacatgtcggcgttggcttcgatgtcgttcaccgtgcccacgcacgcgaacatggcttcgtgcaagctctccatgtcgccctgcaaatgtgagcaatttgttgatggttggttggttgatcaaagagtgtaaatatttctgtcagagacgacgaggggagtagtggagtatacttgggcgccgtcggctaaggggagcgcggtgcacgcggcggctaggacggcgcccaggtcgtcgacagcgtcagcgtgcggcttggcgagggagtcccacgacgcgagcagcgagagctgcggccggagcagcctcgccagcttcagcttttgccgccgccgctgtgccacgatccgctttgccggctggatgttccggagctccgccacccgcagccacgtgtagaacagcttgttctgcatccatccatccatggcgcgccgtcagaacatgtacgggaagcgagctagcgtgcgtccatggcgatcggtgtcacggcctcacctcggcggcggcggtggcgcgggccatggacttctccatgcgggcgttggcgaagcgccactggagcaagcgcgcggtgagcatgcgcgcgcggtgccccgcttcctccttctcgggcttcttcttcctccgcgtcatcatgtccctgagcacggccgatcctatggtgctcccggcgttctccggcgacgacgacccccccgatgagctccgcctcggccgcctcgccggctcccacgggcccctcgccgcggccgtacccagctcgtgcacggtgttctccttgctgctcagcgcccgccgcggcggcgccgccgccttcacggcaacggcgccgtcgtcgtcggcgctgtactgcttcttgccgccgccgccgaacgaggccgccttacggagggaccgcgcgaagttggtcgacgagaagagcggcgccgggggcatcccatcgtagacgaacgcgccggcgccgccggcgcgcgacgccgtggtgctcgcgctccgcgccagcagccgcctcgacgccgtgagcggccgcgccgcgccgccgccgacgccattggactccataaattaaataaattaataaatataagtta

SEQ ID NO: 12249 - DNA, 734 bp, Oryza sativa
agctatcgatgctatattaaaccaaaagcaaatgaactcaaggggcacaaatgagagtgagacattgtattgtgtctatgttgcgattggacaaaaatgctcgactgtggcacaattagttcaataatgcgatgggcgaatgacgggaattgaacccgcgcatggtggattcacaatccactgccttgatccacttggctacatccgccccttatccagctaaaggattttctcttttttccattcatcattattctatttattctgacctccatacttcgatcgagatattggacatcgaatgccactctttaaaatggaaaaataactcagttcattcttgaatttcggcttgtagctttgctacgcaacctcgcattcgaaattagtacttacttggaaagcagggacagtagtatatggtagtcagctttgaattgttctctgtgtagaatgcctattggtttttcacgaaacagtactatatgtggtcagtacataggtatcaagaaagagggctagctctgtttgaatagttaccagccaagaaaagactactcaaaaatctgctacttcgtttccaagcaagcaaagcgccgctacttatttctttctcactcactacttttttctattttcttttgtctatcgaaacagcctaggattcaatttgatttatcctagtggtgacagcttatgcttcatttccttcgaattcttctttcgatatgcct

SEQ ID NO: 12250 - DNA, 3631 bp, Oryza sativa
  unsure (1)..(3631): unsure at all n locations
gtccctatctagtgacatcattgagagggaggcagtgttcaccttctcatggggatagaaaaggagattgcgtactccttctaagacatgaactctgaaaagagattgaatggcaagtgaactaattcctgaaagtcgtcgtgattggatcaatcagacttccccacaggaaatgccaaggggcgccctttatcatcgcccatttcttccttgtctgctgctgccttaagtgcgtaaagtaggctcaacttctttggtttctaaatatcttgtagtagtcgaaggtagtccagtccgcttgttagattgaattgaatcttatataacctacgtagctaaagagaaaatcataatagtctaagtggacctctcaaaggtataaataagtatacattagtcttactggttcggtctttttctttttctttttatagcctgcttgtttggtttgctagttcctggaaagataacccttgctttgattgaaggaagtgagcggacaatactgttcctccggtccgtggttcgacctcccgtagtggtccttgcttttctttttgaaagctccgtcaaaagcaaatgcttcgctcttcttttacaagaaaggtactatctccatatttgtgttgatatatgttgatgacatcattgttgctagttcttgtgaaaaagcaacttcggcattacttcaagatttgaaagaagaatttgcccttaaggatcttggtgcgttgcactatttcttgggcatagaagttaataaagttcatgatggaattatcttgactcaagagaagtatgctactgatctgttaaaacgtgttggcatgcatggctgcaaggagatcaatacaccgttatcaacaacagataaattattgatgaaagaaggtgaacccgtgacattttgtacccaaaacaaacgcgctaccaagctgcgctacatcccttttccaaattgttgtacagtgtcattgtacaaaacccctgtcttgttttccacatcataattttatcctccatctatatacaactttcttgtcatttcttctttttggttcctggctggatccggcctgggatagtggcgcccattcctaaccagttctgaaaaggttcgctcatgctggaggtactaaccacttagtgatcggtccgctagttcacgcaaatccgaagaagttatcacggacgagccacatgcctacttctttttgttgtggaaaaaggtctttccaccgagatcctaaagtgcattcatttcctatttatagagcagcctgtaccacgtattcctccctagttttgaagcagggcgagactactttagctaggagcctcttttccttctgcccagctccccgaaaacaannnnnnnnnnnnnnnnnnnnnnnnnnnnnnnnnnnnnnnnnnnnnnnnnnnnnnnnnnnnagattttgactctgattgggccgaacagtggtaaacctggtgaaccaggcctactactaaacattgattctctctcctaaccactcttaaatatgttaaatacatccatcgatcaaaaactacaagcaagggagtcagctcttattgccgtaaaggaaaaataaccccttgattcctttcataaagatgaagggacagaggtgactaattccccatctcatttggggcggaaacgaatcgacatctcgatgtgatacagccctttccattttcgttgggaaagaacggcgaagtccatccgaaccctccaatgaagaaataagaggagagcaaagcgccaatggcgcgcgaagcgcatgcggaaggggcacggagaaataaagaagtgtggaggagaagcagccgagctcattcccttcgcttcctgggctcaaagcagtgctttgtttcctggccaaatcaaggatttggggctgattgcaaaagatatctgaatatcaagatagatccatccatctatccagatatctaaaaaagaatcgattttgatttcataaaacctttgattcaaagaactgcgcttagcccccccactcatgaaacgcatcagcattcgcaagaaagagaaagaactcggttcaaagaatcgcttcggtctaaaacgagtcttccaagatcatgtctatgtgaagagcttgaaccaagcgttcacacgcatacgccctctgaagatcggcgagaaaaacaaatcgtattctatagaatatggtagtggtaattatataactgctttgaggaggaagagggaaattgtcaaggaaaatgccactggaggtacatgtatgcatccacttccaaattcggatgatccaacacaaaaagtatgatatttctattctctagctctcgtcatatagaaaaggtatctagctcgtccctctagcgctcgtaaaagaaatcctggcaaagggaaagccagtagagtatgccttggtttaagagagagatcccttttgattctaatccgcaatgacagtttcccttgctttgattgaattgacgaatggtaactactaccaggctttccctcgaggaactaatccactgagagtggtgcgttcccgtctgtgatatagacagagacaatcttatccttctctactctcgtaacaaaaactaattcatcgatgagtttataatagttaatacttatttagtcatgtattaataagatatcaggaccgtgctcagttttcggacgaaataaacatatcttgcttttctcattgtttgcttcttattgaatcgcctctctcaccgccatctccaaaaacttttttggcggtttgggagttggcttctgttgacgtgacaagttgatcgtggttgactatatgagttacatgtaggatccacatgtcatcctagctaatatcaccttctttggggttaggattcgaaggaaaggacggctctttgcgattaggatttcgttgactcgtcgttccaacctcgaaaagtagagtgtcattactgtcgagaatgctaacttgagcgctcgcattgccggtgcacacttccggcccacatggcccagcacgcgcgcgtttcttctttttttttcgcagtttgctatcgccgtttcttctctttcttttttcgctttcttttttctgtgatttttctccttttcttttttcgattactttttaaatatttttccatgattttttcttaatcttccaacaacacgtatttttcaaatgttttgtgttgaaagcttttaaatcttaacttaaacattttaaatttggagttgaaagctttcaaatcttgagttaaaaattttcaaatcgtaagttgaaagttttgaaatttttcgaatctcgagtcgaaagttttcaaatttttcaaatctggacttagaaagatttcgaatatcgattctcaagttaaaagttttcgaatctcgagttgaaagttttcaaatctgagttgaaagttttcaaaatttgactttaaaatttgaaacttaaatcgaaagttttcaaatctaacttaaaaaattttcaatctgttagtaaaaaaatatccaaaaatatcttcagaatcttacctaattactatcattagtgttggcatgtttggtacagctccaactcctaaatttagctccaggagttgggtctgaagtggagtt

SEQ ID NO: 12251 - DNA, 4376 bp, Oryza sativa
actagctagctagagcctagagctgacgacaacgcgccgcacggtccgctttaatttggctctccgcaacgatcgacacgacggtcaccagcgacgtcgcgggccggcggcctcgtcgtcgatcggcctcgaattgtgagtggaagcccaactacgtcgatctcctgaattaggtggggccgtcctcccagctctgctcctgcaacttttttatgccaaccgcgcccctcgatcgccagtcgtcagggacgcggctcgtcggcatcggcgtcgatgactacggcgtctcgcgtgcgcggcgcccgtggtcctacctaccgacttagctagttaacttggtcaacctgtcacattagcggaaaccgcctcccaaaccgttgaggccttgttcagttatgtccggattcaatccgagccgggaataacaagtatagtaaaaaatttatgtatatacaataagagaccgggatttattctgggtcaggaacaaatttacttatgatagggataataagagaccgggaatcaatccactggttaagaggtgttgaactaattcgaatgttttgttgtccctatcatgtaaattggtttccggcccggaataaattccggtctctcattgtatctattataaattttttattatacttgtcattccagtccggattaaatccgggtgtaaccgaataaggcttgaaggagttggtttccatcagttttcagagatgagggaaggaggtgttacacctaattttgcggtttgagactttgaggggatacattattttcgggagcaagacatgaggagctcaaatcagttcctttccgaacacagcacacccctccttgacatgggccggcccaaggcccagcacctgtatctggttacggtatactaagtctgcagttaagtaattaattaattatggtatgtgatacttttctcaatacgtaataatgttcactttgatgttattttcatccatactatttttagataaagttaccaaaaattttaactaccttaagtttattgccaaattttagcaagtaattatgaaatcttgccaaattttggcaaccttgccaaaattttgacaacttagctaaaatttggtaatgccaaaacttgataaggttaaaaatggtagcaaagtgaacaagcccgaaatggtgtgttaaccacttcggttaattaatttcagtactcagttcattaaattaattaaagaaaggccgaatccctagaggtggggaacgggtgggcccgcgcaaacgccacgaggaagaaagagagagaaaaggttagcaactttcacgggacaaaaaccagcagactagtcagatatacatatactcctcctcaacaaaacaaaacaaaaaacgcgagaagagagagagagaagcttttaattcgaattctctctctcatcacggcttcttctgcttctccttctcctcccccctcatccctcctccgccggtagccgccggccgggagcgagcagcgagcgagaccggagcccgccggagccggtctcgctcccccctcctcccttgttcgcgccacccccgaggtacatcccgccgatctctctctttctctctctcgttggtctgctctgtgattttttttttttttgccaaggctgttctttatttggcacagagattgttttttttttccttctttgcgggtgtccggttcgagtccacggggtttgactctgccggaaatggttcgaatgcggcggccggagggcggaggaggggttttggggggcgttcttggtgggttggtttgcgccgagtctttgttaatttgttagggttcttgatctgatgcggcttctcgttgccgggatgcgcttgcctcatggctgaattcaaacaggccggtctctctctccctccctctctcccgtcagccgtgtgctttgaccgagtaagtttttgaacttcgattggttgagctgggggttcttgactttttcttactccacgaatgttcctttttgcacaatggggctactaatgaatggaaagctagagatggtgtgcctaatggtgatgtgccgtcattgtgttagctcggatttgtactgcgaatttgcgagctcacatgctcagctgatgatgtgttgatccagggagtatatataattggttggtagagtacttgctagattgtgctcacgggtctcatttcaaagtccagtatgaaatcttggttgtaaagtagtactagtgttttgttaatcgttagggagtacttctcctgcatttttcttaattttttccctttaaaaactgtaggtggatttgttattagtaaagctgatttgtgccaaatagaaattctgttttatccgcagtaaggtactgtaaacagtacttgcaggcactagggtttattggcaaggttttctatgttacattttaataaatgccacctttttcttcgtcaaaagaagccacggttataaagaaaaagtgaagcattaattgatgtaaatgcacgaactacaaatttccacaaatataaaccttttaataaaatccacaaatgaaagaaaaatgcagttcacacaccaatctctttctcaaaatttacacttttcttataacaggtatgctaaattttcttaatacaaagcatatacaaaacatcacaagcactatagacattcatgacatatctgttgcataggacaatatgcagtatgaagacctggctggtcaaaacttccgatgcacatgtgaggccctatccatgtgctttcttgatttctgctcctttatggccctatctccttcaaagcccttaaacacttcaacagtgtccaatcatactatgagactgtatggatatgggcatatggctatacttttgatgaggcaatgattttttttgttaataatagtgttaataggaagtgttgaattggttttttaaaaggaagtatttaagcattgaatttgtcatttattttgactcactaataacacagatagttctctttcctagcaggaccccttacaatatctagtgtatttatggcctcagttacttatattgatgactccggttctgaggtaattgatcctccaaagactgaggtgctggatgttaccgaacttgctggtgatcctgttccgcattcaccaaaaccaaatgtggtagtttctagcagtgtgcgtgaactgcttgaatgtccagtctgcctgagcgcaatgtatcctcccattcatcaggtgcacatataccacttattgaatcttttttgcacttaaaaaggatattttcttgtatggaagtcacttgggaaacaaaatgcgtgtttcatttaattgcattgcttttactatcttgaatcctgctatcatatttgtagtctggcctgatctatttgaacttatctagatgatttcctggtttaaaacggtcgttctgagctgctttttcacatatgttctgttccactaccaaattgttacccatgtatttaagcaccaaaaaagaagttagctaagatagtatgtacaatatgcacattgttgtactatgttgtaagttgtaaccccaactctttttctgctaatgcagtgctctaatggtcatacattgtgctctggatgcaaaccaagggttcacaatcgctgtccaacttgtaggcatgaactgggtaatattagatgtcttgctctcgagaaggtggctgcgtcgcttgaacttccatgcaagtaccagaacttcgggtgtgtaggcatttatccttactactgcaaggtgaagcatgagtcacagtgccaatataggccttatagctgtccatatgctggatctgaatgcacagttgctggtgacattccatacttggtgaatcacttgaaagatgaccacaaggttgacatgcataatggctgcaccttcaaccatcgctatgtcaagtcgaatcctcatgaagttgagaatgccacctggatgcttacggtatcccctcgttaactccaccatgttagttattgtgaagtatatcactgatgtttacttatgcaaagattggttcacttgtctgctaagatagtccatatttctgtactgagttttatgagcctttctgtaaaaataaacattggttcacttgtacagtatgattgcactctgtacttttcatgtcaactgaggatgctgatcatgcagcatagttattggtctaaaataatctctcacctatgaagaaactatgcatcagaatatccatgtgcttccatttccaaaaaaaaaaaaaaaaactttgtctgctttacagcacaataatagcatttggacagggctcttgatctgcaaccttttcttgctgctttctaag

SEQ ID NO: 12252 - DNA, 916 bp, Oryza sativa
aatagccgcgccctcggttatgggcaagccgagcaatgtaccccaagttagtgttttaattcttaaaacctgcttaacaactaaaatgtggaatggttggcctgggttggcttaggacgagctgggacccagggtcgggttgccagttcggtctgaatcatcataggccttgggttaaggcaggttcgtgtgggttcacggccttgattaataacattgtatagttctaggatcgcgtttacaaaatagctttgagcaactaaacgtctttaaatgctgtttactgcaacgctaacccttattataaattcccttgtactcccttgcatttattctgcatttgtgggtgtgtcttgttgagtacggtggttgtactcagtcttgctcaatttttcccaagtccagaagaggagctccttggagatgaaggctttggtgtctagctcgtgcctgccgtcaagcgcctgtggtcgtcgccctagtcttccgttgtttcccgtttgtctttgtgtgctgggccttcgctgcccgtgtaataaatatatttacgcttccgcttgttaaactctgatttgtatcaactgttggtgtaccttgcctcctgggacaaggattaatgcacgcacgtaaggaacgcccgttgggttatttccggtcgtgacaagttggtatcagagccacctttgaccctaggacgagccgtagatcccaagccttagcaatattttcaaaaataaaaatctttgattatttgtgaaaattgtctagtctctctctgtcttgctgcttcatttatcgccaaaaatctgacctttgaaatgttgttttttttgttttgtttgtagatggccggcagcgtcacccgtcgtggtttggacatgactggtttcgtcttggagctgcggcgcatgtgcgt

SEQ ID NO: 12253 - DNA, 842 bp, Oryza sativa
ttaattgttagctctttctgtttgctggttctgtgtggggttttcagatggtgacgaccaggagaaatgctgttaccggtgatggcaaccaacccgaaggcagcaaccacaaccaccagggcaacccacctccacctccccctccgccaccaccaccaccaccagacaccaacgccattctcacccaaatcctcgcccagcaagccaacatgatgactgctttcctccaccacctccaaaatccgccacaacagaatgctccaccaccacctccacaacactctaaactcgccgaattcctccgcatccgcccacctaccttctcgagctccaacaaccccgtggatgcgttggattggttgcatgccgtggggaaaaagctagacacggtgcagtgcagcgatgaggagaaagtcatcttcgccgcccaccagctgcaggggcccgcatctctatggtgggaccacttccaggctacgcagccagaagggcaaccgattacttgggctcgcttcaccgccgctttccggagaacccatgtgcccgccggagtcgtggctcttaagaagagggagttccgagagttgaagcaaggcaaccgctccgtgatggagtatttgcatgagttcaacaatctggcccggtacgctccggaggatgtgcgggaagatgaggagaagcaagagaagttcctggcaggaatggaccctgagctgtccgttcgtctagtctctggggactacccggacttccaacgtctggtggacaagagcatccgcttggaagccaagcacaaggagctggagtcgcacaagcgccgcttggcgaacttccgcaatcag

SEQ ID NO: 12254 - DNA, 1684 bp, Oryza sativa
tacggacaacatctgtgctagtaatgagctccatttgtaaaaggattatctacacacaggaaaaagtatagcatcaacaaaagtttccatctggtgtaaaaggagatagacaacactacaataggtaaagcatcacgtgaatggaaaagaacacatttaaataaaaaacaaacagtaaatgctgctgatgatttcgccatgcattaattccttaatttgtttgctcctcagaaaaaaaaataaatccattctgctacctatgtactgaggacttcacaataccaataataatctaaaaaagccttacaggtacgtattcaaatactcaatactatgatgatattacgatatatggttaccacatagaaactgtacagactgcacaaaaacctgtctaaaacaactgtcttttctaatgcaagcgaatcaggtaataatttacctttacagcagagagaacaacagcacaatttgcatgttgcagacggggtgtaacccgttccactatattttctgcttccctggcatctgctgctttgtaccttgacagagaatccaaaataaaaacctggccccatctgcaaatacaccaaatatgttaagtggactgaatttttaatatccagataggttcaaaactcaatacatcaaaagttgcatcgtactctgtgcattcattcagagcagtcagaagctttgacagcgtatgactggtgatttcaaagattggacgagtactgctgtcctgaatctctgcaagcgcagcaacagcattggcaactaccataggattattgtcagatattaagtctttaagggcctctaggaatcctctgtcctcaactagctcagcatttatatcataaagcttagcaacacaaatagctgcagtcttccgtacatacggatcatcatcctgtgtgcaattcaagagccaaatatagacttagatagaagaggtcaacttgactgaaaagttctagaaacaacaaaaagaaaaaaaaccttgaggcatctttgaagaggatcacagagatactctgtgattttgtccacacggatgcaacccattgtcctcacagctaaagcacgaatcagtggatttggatcttgtgaatcctgcaaaagtttcatttcatgaatcatcttattagtttctatgaaaaggtcatgttttaacgtaccatatcagcattttttttccgcataacagtttgttgcaagtatggctatagtttattaccttaacaaatgtgtttacagcaagtatggcaaggtcaggttgacttttggcatagttaatcagatataaatatactagtttcttcagctccaagttctcagtctgcatgcagttcacaacgtcggtaaacaaagatgaaacatcttttccaacagtcatagcagcgataactttcttgacagcatcttttctcttatcctgcagaacatatttccaacaataaatcagatatcggaaattgcaaaaggcaacttacttgctgaatgtcaaaataaacaagaacttggtgtgaaaactttagaaccataattttgttcctgtatgcaagtacaatatttttttggtatcactgtaaatgtactgaattactgaacacatgatccgatttgtcctgctacagacggatcaggatcctctacagtcgactgcatcgtgcctttg

SEQ ID NO: 12255 - DNA, 3383 bp, Oryza sativa
taattatattccctagtgacgtatgaggtaaacatatgcgcattggggcaatccttctgtcttatgaaggtccagcttgttcatctgactacgcattaaacaatcaaagccattcagatcaactccttccagtagaagctacgaaatggatcagggaattcagtccattcacggtttcatctgccgctgcaagcaacgacaggcagcccaatccagcggcataacttgcaaaccacaattcattcttcggccaggccacgccaccgaaatctgagccctccgaaccccgcgacaaaaccaacagaaaacccgcagatctacgagcgatcgccgcgcccagcccagatctggatccggaacgaaccgaccccccacaggcacggggaaagcaagctacggagaccggagagacgggggagggggtgcgttggttgaccttgtactgggagttgagctcctccttgagctcggggatctcccccttcttggtggtggagaagtacttggagtcgtgcccgctcatctcgccccggcgagcctagcctgcctcgcccgccggccgcgcgccctccggcttgcggtggttgctcggcgatctccgcgcgcgcgcgcggcggcggcggtgggtggcggggcgggaggcgggaggcgtgggcgtgggcgcgcgcgcgatggggtcgcacttggtcggcgaggaggaggaggggttgaggaggaagagatttgagagatcagggagggggcgaggacgacgacgacggacggtggagatctgatcgactgctgctagcgttcgttgcaactggcaaggctgaggggggagaattttcgcgtacgcaaaagtagaaaaatatttagtagcacatgattaaaaattataggtgtagtagtaactattatgaatttgaaaaatgaatttataaaatttttgaaaacaacttatatatagaatttttttttgaaaaaatacatcatgtaacagtttgaaaaacgtgctaacgaaaaatgagaaaattgaagtttggagttgaaggaaagaacatggctttatatggaggagagagaatttaaaaaaaataaatagggttggctctcaatctctcatgcaatagcttgctattcacatatttttttaaaaataaaacattaaatgcatacgtgagaggtagagagaggataagagaaatagagataactttatagctcatctcttatatatgttaactctaatatgagttaaaaacttgtagatagctccattattaaacttgctctaagatgaaaatggcgatggcggtaataaatgtgtggcgcgtgtttctcacgtcgttcccactccctatcatccctcccattttctattttttctattaccactccccgttcttatcaccccctttctcattcctctattttaccgatcacattctccatttttttctcatctctctcccttctctggttttagggcccctttgaattttataatgaaaaaaatgaatgaataaaaaaacacaggatcctgataggaattcaatcgtaaaacatagaattgtaaaatgcagaacaaacacaagaataaccatttgattggaccgtagagaaaacacaataatcaaatgagaaagatatgttcaaaggaattttccaaaaggttggagctcttgctaggttttctccaaaatctttatagagttgttcatttcttaggaatttcaaatgctatgataaaatttaatcatttatctcaaaggtcttcgtaggaaattggccagacccaattgccaaggagatggatcgagtgcagtcacaaccttgtaggtgtcacctccgccatcgtccaaaggatttggcccatgcgtaggggccgggccgagtagtagcaccactagtctagcgcaagctctctggtggacaagcgacctctccaacatcaacattaagcgcaaggtgatcgcacatcagtggccccactaatttgaggacgaagctgctaactctagtgattgttcagaatagaaggataagcaaggtagaaaagacaagagagatgtccctatcaaccatgagtcgacgaggagcggtattgatggtgccatagaggtcaagtgcacgaggagcacgatgtttcagggcataaacacgaacagaaggccatgaaggactaaggtaggaggagatagagataatatgtagttctaagacaagtgaaaaaccggaagagattaaagcaagaagaagaaatcaaaatcctttcttgtggatgaacgactctggaatactagtagccaatgcagaggatctgaatccaacaaatattatttgttcagaacttcagatattaggtagtaaatcaaatgaccatgaaaatataaatgtattttcattgtaccgtaaaattggaaaaaggaatcgttatcaatgtaaaagttgtatgcatggtaatttgaaatctcatagttttactcaactaaaggagcaattttgggcaactcagagatgagctggctttagcccaaacaatcttgccaaacgaaactgggcctcaaagagcacaccaaacgctacagttgggcccgcctctgatgttatccaccacatgcgcagcgcatcacttttccttctcctgcctacacatcgatcggcccatttattgttcttcataactagatggtggcccgcgcagattgcgcggctagtatcattatattatctcttatataatagcatatatgttttctcaacgtattatttaaatatatattaaaataacaatataattttaaattttgtactaactttacgaaactactaatgtctaatattcatattgtattttatatacatgttagttactaattatttttaatatcaaattttagttatttgtaaattatatttctacatggactgtagactcgtctttcaatatttccttttttttaattttgaattttcgttatctgtattttctatatagactctaggctcttcttccgatattatttatttttattatttctaattgtatttctatgtagactctaaactcatctttcaatattctttaatttttaatttaatattctttaatttttaattttgaattttagttacttctaaattgtattcctgtattgactttagattcttcttcccatatttttttaaatttcgaattttagttagttatttttatatgaactctaaactctactttaattttattatgttttttccgaattttagttaattttaaattcctatatggactctatactctatttataatattacttatttttaattccgaatttatattattccttagttgtatttctatatggactctatgctctacttctaatatttcttatttttaa

SEQ ID NO: 12256 - DNA, 1171 bp, Oryza sativa
atttctatatggactctatgctctacttctaatatttcttatttttaatttcgaatttatatcatttcttaattgtatttctatatggacactatactctacttcaaatattccttatttttaatttcgaatttctagtatttcttaattatatttctatatggactctatactctacttctaatattccttatttttaatttcgaatttcgattatttcttaattgtatttctatatggactctgtactctacttctaatattccttatttttaatttcgaatttcgattatttcttaattgtatttctatatggactctatactctacttctaatattccttatttttaattctgaatttctattgtttcttaattgtatttctatatggactctagtctcctcttctaatattacttattttttaattccgaattttaactatttataaattgtatttctatatggactctgtttttctttttctccgattaatgtaagaatttctagaccgtgagagcgaacgtggatgctcctttttctattcctttaataagttaatagataccctcactttttgctctctctcaactaaaagaataaaaaaaaagtaaaaagaacatactaagcagtgttttaaatcgccggctaaagcatttagcgactgattttctcaaacagttcataatgggctaaaagagactataatagataaattgtatacgagagcaaataactatagagggaaatagcggtagctatagccggagatttgaaaacatttattttttgttgctgatctgttcatggcttgcacctggcactactggcaggttgctccactgcagctcgctcactgtatatagctaggtagggcgtgtattagggccaattggccaaatggtctgaacagtgagcgtacacacactacatgtgttactgtaacaaagactgtagagctgccctatcgtttacctgtgcaggcgtcttctctctcgcatagttgcatggcaccgacctaaccagccaaccaaccagctggccgtgcagtgcacagagccacagacttattaacagcaaacatgccagtgccagatttcagggattcagaagaactgaagcccccggccctgaaatcgaacagtgctactgcgtgattgcaactgatac

SEQ ID NO: 12257 - DNA, 844 bp, Oryza sativa
ttttatctttgcacattttaattgttggaggctttcacattgaattttaattattctttgcacaatttcgaggatagattttagagtcgttttgggacgcgacaaacctaccccccttaaacggaatctcgaccccgagattcggaagaactggcgaagagatcgggatgggctgccttcagctcgtcttcgcgctcccaagtagcttcttcttcggcgtggttgctccactggaccttgcaaaaacggattacccggttcctggtcctgcgctccatggtgtccaggattttcactggcttctccacatacgtcaggtcttcgcgaacttcaatttgctctgagtcggcctgctcggatggcactcggagacatttcttgagttgcgacacatggaacacatcatgcacgttacccaaggaggcgggcaactccagctggtaggcgacttctccgcgtcgagcagtgatacgaaagggacccacataccgaggtgcgagcttcccttttgtccgaaacctgtgcacccctcgcaatggcgtgacccgaagatacacaaaatcatccactgcgaattccagatcacggcgtcggttatcggcataacttttctgccgggactgtgccacctttaagttatcccgaatgattctgactttagcttcagcttctctcaggatatcagtcccgaacacttggctttctccaacttggtcccacaatagcggtgtccggcatttgcgcccgtacaacgcttcataaggtgccatttgtatgctggcttgatagctgttattgtaggagaactcggcataggggagactcttatcccaagtcttcccga

SEQ ID NO: 12258 - DNA, 1502 bp, Oryza sativa
tcacttccaaacttgtgacatgccacagttttttaattcaaaggcccacatgtcatacaaccattttttagccaaaccatgtctaagttgtggccatcaatttataagccacatatttggctaggtttggcaagaaagtttggcaatgtttgggagggaaccaaacaacccctagtcttgcatggtaggcataatacgcatggaagtctatatacagttaggcaccagcaatagaacttttttttttcatctaatcagtgcatatattatattaaacaaaagaaaagatgattataacccgactattacaagaaagaggcatataagagataccgaaacaaaacaaataaatgaactctaaatcttaaaacgtttgtaagagacgtgagcagacaggcaaaaccacataatgtacatgcatgcaaaaagtatatgaatgagcatgaacaaataaattaagccactcggttgtctgcccgttctcaagaatccgaacatatacaaaatacatataagtgtaatatgattggatctccaaatgtgtctactccaagatgccggatttcatttataggcacatttgaaaagaaattatgggaaaatgtgtacaagctagtatagtgagagaagaatcgatgcaacaaagaaaaattaccccacctctagaatatgagtcctttctcaaatcaatcttttattaaactaaatcattcctcttaacatagacatgtctataggatactttatattcgttcactgccttacctaagctacctcaatatatttaaatggagtggacatcagttaagcagatcagattaatccataccatgtttaaattgaaatcctaatttatgaatcctctatctaacactccaccctgtaaaataggttagaccaatattttaacattgttacgtatatcacctcaccattgcttatctcgaattgtttataattaattatactcgcttcatctcgatttgttcctaattcattcctccttgttataaggaataaatgacatcatgataatatcttcaaactaagcatatagtaagtactatttatcatatgcaacatttatatgaggcaagattctatgtgaggtagagctcatattgcttcacgcgttctcatgcgaaactataacaaataataataataaaaatggtggcttttatgaacttatgatatcctaccattgcacgtatggtacgcatgaggtccatctatccatgccggtgttctggcgccccggtcaggatgaaactactggcgataggtagttataacatggaccgtagattaatccattggggtttgcagaacaatgagaatcagttaaccagttctcaacaatcgcttacgattcagcaaagatatatatacaaaaaaaaaaagcaaatgcttatcaattgtatcatcatgtatatatgttgctgggagttcttggtagcatcgcaatcacgctaagcagaccatgtgttgatgaaaacagt

SEQ ID NO: 12259 - DNA, 4967 bp, Oryza sativa
tgttgctaaacattcttatctactggaatttcttttcaaccctcaaggtttattcaattatgtttgatgcataccggttaagtgtatagcttacttttctaagatccagaacaaagcaagatcatcaccaatattgattacacgaacacgaggtcagagaacagcaaacattaaaggaaaaagctgcatattgcaatgtagagttcacatccttgaaggagctactgggagtatagggccgcggttatctatcccgatgtcaaaacatgttgagatgcaaacatgcaacttatttaaggcactggtaatatgacaatcaaaatacacatggcccatgtgaattctatgctcatggtgctctccactgcaagaagcaatggctcatatatgatgctttgtgacaaacgctgacagatcttaagtagctgacttctgaaataccaggaaaaatatatagaacacaaacaaaaagatacaccaggaaaatatatggaacacaaacagtaagatacaccaggaaaatgtatggaacacaaacaataaaatagtacagtacattatgaacagtgaaccagaggaaaatgaaagcaaaattgtcttacctgaaaaggccatgcatctggtttgcccttttggtctccacagtcttggaaactctcagcttaccagattcttctttcaccacttttacttcacctgaatagtttagtgataattctcctaatggacccttagccttaataaactgctcctctaacgtgagggtcacatttgatggcacttcgatcggcttctttcctattctagattctttgcactccactgttgttctgacaaaaccaactctgccagcagggataacacgaagacgaatcccttgtgtctttccagcaagccagtccttgaattgctgatttaattccgacaaataaacactcaatcaaaactttcatattaaattgcaaataaataattgccctttacaacaaaaaccaatgcattattttagtttgacagattagtaaaacattataattcaaatccatgaagtagttactagctagaaagataggattcaaagaccaaatgagaaacctacaatttctcctgcctgaacttgtatcaacatagctctttgtttggtgttcagtttatgagtgatagcataatgccataatgaactaattaatttaaaaagttttttggcaagttaaatctttcagttaatagcacttcggagctgattttctgaaacaaatctagaccctcggtattggcccgttaacatggccatgatgtttttgaagaataatgctagcaagtaaaatttcatggggaatcattaccacaccactgatgttaagttataaggtttcagatattgaaagggtatttgcatacttttccaggttctcaactagtgatcaaagcaagaaaaaaaaaggggtattatatccaaagtgctgccgcattgcactaactgattggaaaattttccgaaccctcaaccaaacacatccaaaactgcaatccttcagctacaaaatgaccaagcccctgacctgtctgtgactcgtgtatcactgcaaattgcaggcgcggggagactcaacttactgcactcaatcgaaactctcctaggaattaaatacggcctattggcatactcctaaagccaattgcatccaaatcattgaattaaggatgatgggcaccatctccaaatcccccatttcttggcggagcaacaagaaagcaactaatgccggttcttggcagcgcaaaaaaaaaaaactgaagcagcatcgacggggtggaggaggcaggatgaggaggaggaggaggaggagggggagttaccaagggaggtggagggaaggggagagggacgccatggacgcgctcgtagacgcagccgcaggaggaggaggaggagacgctgcctccggtcactcgcagtgtatctccctgctgcgcggcgtttgctccccgcattatccacaacgatggaagggaggaaggtggcgaagaagccgtcacggactcatgggcttcaggcccgatacaacacgggcttggtggcccatgggccacacgataaaactacagttaatttgaaaaaaaaaaaagttctaaaaactgggtgaatagctcactgtcaagtgtgactcgagagatactataccatatatatgtagtcatttatttatttatttttaccaattccactgtaggagaggtctccagttaaaaatgttattaagagaagaaataattatagggtttcaagccaagaagttataatagtttgtttttacttttgaatatatgtttttaaaaataataacaatataagccatgcttttaagtacacgtaatgataaaataaatcataacaaaataaacaataatcacgtgatagcagtccaaaattcaatggagtcaataggtattgcatcatacgcatggtgtgtagtgacagtaatgtcaggcatgttcgtgatggtttaatgcgacacacatcccgaatttctatgaatttacatacatgaattttctaaaagagcattttaaacctaattttttcagcttttatcataatagaatacttcattactataatttgcgtcgattggattaatccccgtagaaaaatcttataaagttattatttatatgttctaaagcattgcgttttctttataacaggctattataattacgagaaacttgtatgtacgaccaaacagtcataatttattcaaatttacaacaacagtgttgtgtcaacaggggagtacacgctaccatctcgcacatgttccattcccatccattgcgcttaataatgtttcaactaatcgagccacccatcacctgcaagttgctactacactacagctgttttcttgaccactcttgaataataatcagaggccattattcctaaaccacgattaatatcactgtcaaatactactcctcgccgtcgtcatcgttaactccgattcacaaaaatacatagctcacccaactctccctccccttcctctcgccggagtcgccgcggccctagccatcgaccggcggcggcggcggcggcggtagccgtgggatggacgaattcggcggcggatccgtcgggccgttctccaagaagccgaggcacctgtcccggtcgctgacgtaccaccaccaccaccacccctaccagggccaggggcgctcgccgtcgttcaacgcgcggcgccagcatcatccgcagcagcaggaccacgcggtggtgctgtacacgacgtcgctccgcggggtgcgccgcacgttcgcggactgcgccgcggtgcgcgccgtgctgcgcgggctccgggtggcggtggacgagcgggacgtgtccatggacgcctcgctgcggcgggagctccagtcgctgctcgcggcgcggggccgccccttctccctcccgcagctcctcgtcggggcccgcctcgtggggggagccgacgaggtgcggcagctgcacgaggccggcgagctgcgccgcctcctcgagggcgccgccgggcaggacccggccttcgtctgcggcggctgcgggggcgtccggttcgtgccatgccccgcctgcgacggatcccgcaaggtgtttgtccaggaggaaggatgcgcccgccgctgcggcgactgcaacgagaacggattggtacgctgccccaattgctgctcttgatcgcttagctttgtgcaacaataaatcttccatgttaatataaggattatagcttataggtaatagtagtagatagaggcaagaagggatgaacacttcttgatttcttggcctatggattgtatgtgattatgaccaatttgggtgcttagtgttcggcgtttggggattatagtgtatggatttgagcctatatgggtttgtatgtatcaaatgtaacaaatattctgcagtgcgtagtcctgctggtttgatcaatgtaaatagttgggtttggtatattcagaatacagttcatgtctcctactagtttgtcttttaacttcaaggatgatagatagatagctgcttcaaagcaatataatgcgagctgatttaacacatttttagctcctagttaatattaaaacattttttttggcaagaagtgatatgcgattcaatagcttcattctaactaagccgttgtataatcatatggtagtgttatccccttttccccttcttttaagatggtagcattgttgtttgcaaatgcgcagttcacggaacattgtatcttcagcaataccagttcagttcctccagttgtttgatggaaacttcatgtagtggcattcagccagttttgacaatgctaatcctttgaccatgcaacatctgtctccactcgacaagctttgtgcgaaggcatagatgaggtatcattcaagataactagaacagtagagattgtacatgtgtctatccgatttctagtgtgtacaaaacctaataggatttaaacctaacgaaattagtgtacaatgaaccatacttattgtttctctcatcaaatatgatgtacatgattcacgactgtaattagcaggctattgcaacgctgacatatgaatcacgatgatgcatgtgagcccaaattggcgtcacttgtgtgattttagcgtttgttttggtttgttgctaaaacaaactctaccaaagccaatccaaatattgcccaaaacagcctctattaacaaaatttggttattctagaaacttcctcttgcaaaaatggggcaaagaaaaaaaaatcaaaaacacttattgagttaacaataccaaattttggtagagttgatctgggcatcaaagcaaactactcccttaacccttacttccatgagcaaattttgtgaaatccttcagataaggtgccacgtccacgacacagtagtacgacgggtgcagaggtgca

SEQ ID NO: 12260 - DNA, 997 bp, Oryza sativa
ttgtattcgattcaccctggaagcactaagatgtatcaagatctaaagcaacaattttggtgggccagtatgcgacgtgagatagcagaatatgtggctctatgtgatgtatgtcagcgggtcaaagccgaacatcagaagccagctggtctgttacaaccgttgaagattccagagtggaagtgggaagaaataggaatggattttataaccggtctacccagaacgtcggcaggacatgattctatttgggtagtggttgatcggttgacaaaagtcgctcacttcataccggtcaagacaacttatacggggcataagcttgcagagttatatatggctagagtggtatgtttgcatggggttcctaagaagatagtgtcggatagaggtagtcagtttacttcgaagttttggcagaaattacaatcagaattgggtacccgtttgaatttcagtaccgcttaccaccctcaaacagatggtcagacggaaagagtaaaccaaatattagaagatatgttgagagcttgtgttctagattttggtggaagttgggataagaatttgccgtatgcggaattctcatataacaatagttatcaagctagtttgcaaatgtctccgaatgaagcattatatggtcgaaagtgccgtacgccgcttctttgggatcaaaccggagagcgtcaagtttttgggacagacatattgcgagaggcggaagaaaaagtgaagattatccaagaaaggttgcgcgttgctcagtcgcgtcagaagagctatgctgacaatcgtcgcagggatttggttttcgaagaaggagattatgtgtatcttcgggttacgccgttacgaggagttcatcgtttccaaaccaaagggaaattggcaccgcgttttgtgggaccttttaagatcgtgagtcgaaaaggtgaagtagcttatcagttagagttgtctccgtcaatggccggaatacatgatgtgtttcatg

SEQ ID NO: 12261 - DNA, 14772 bp, Oryza sativa
acgagattctgtttaaggggggtaggtttgtcacatcccaaaaatcctaaatatataaattgatgtttaattggaatttttagaaattattttaaaagcctacaagctaaaccctaattttctaggaaaattttcaccataaaaatgagctagataaaattttattaaatactatgcttgctcctttattttctagaattttctgggaattatttgagcaagggaagtatttttaataattgaaacaacattttataaattgttttattcaaaaaaggttcaaaatctcccccttcttggtctttgggccgattccggcccatctcctctcttctctctcttccccgcgcgcggcccaagccggcccaagccgcccgcgcccgcgccctctctcccggaggctgacaggtggggcccacctgtcagggtcgtccccgacctccagccggccgccgccgccgagccgaaccctagccgccgcttcccgctccaaatccggccaaatccgattcgatctcttccaattgattgaggggttttgttcctctcggtctcctcttccttttcccccaagaatcaaagcaaatggttgaggtttggatgagatttgaattcgttttcgagtttatctccaaaaacgagtccgagttcttcccgattcaattcctcccgtttgtgattcgatctcttcaatccgagctcatataaatgttccctgtgatctcctctttcgtttgccctctctcccgagtcctcccgtgcctcctagcgccgccgcgacgcgtcgcaagtccgccgccgtcgcaggccatcttcggcaacgccgccgtgccgtctccgccgtcgccgccgcctgccgtcgtcgccaaaaggtgcgccgtgaggagaagaagcttggccgcccctccgttttcgccgtcgaccaccggaggttgctcgacgccgtcgacccgagccgccgccgccttcttcttcgtcgccggccgccgtcgtgcatcgtctcgtgtcggggtgggtaccaatgagttcgtctcgtcgcccgctacgcgttggtgccctccaatctcgccgccgatgtctctagcgccgacgagctcgcgtgcccgagccggccgccgtcgctgacgtcatgctgacgtcaaccctagggctgacgtcatcagggcagggctgacgtcatctctctctctttttccttttttcccgattttctaatagattaaaactttgaaaaatcataactaaataaccgtagatccgttttaggtggttcaagtttctaaatttttctaaaatcaagatctacatgttaaaaatatccacatgtactgtttatgcttgtttttgtactgttttgttgattttgtttatttgctttagtttccgacgttccggaggagagcgtttccgttgaggaaggttccgaagcgtttgtggaagcccaaggcaagtcacacagatcccaaacaaccctttgagcatgttgatcctgtttaaagctattattttatttcaactatgcattgttttcgaatgtcatcgggtggtgaacctttcccagttaattagtggccgaagatgactttattttcctatgggttataatttgattagcatgaaccttatatattggattggttcagctaaatgctataaataggtttgcttagccatgcttagaaacattagttaactaaaagggttaatggtaaattatactttatcattttatgttattaattatagttatatttaatggtagctcacgatggacaatcgtgtgatgataattaattgataactaaaacctgaccaaggtgggttgtgagcatatggttttgatggttgtgctcatgacaattaaggaccggttcgcgagctactgttgtgaaacatttatcgtgccaaccacaagccagcgtgggcaacggctttatctgttgtatagcataattcattatagtgcgccagactgagaagtggcgagaagtccatgggggtcgctggggagtccatgccttgttttaaagggggtgattatgatccaggaaaggtgcactgtggtgagttgtgttatgcgaggggtattgtcacaattcctttccgagataccgtggtggtattgaggcacatggtaacatgatgtggggttgtgtcttgtgggtacagtggtacacctctgatcagagtttaatctattcgaatagccgtacccgcggttatgggtgagttgagcaatgttttttcgtgattagtctcacactactcattaatggttttaatgtggtaattactttagttcctggtttggaatggttaattcctggtttggagggttcacttgttcaaccggggttggttgttcagatgtggttgggcctatgcaacacgggtgtgttgtatggtgtttatttaatattgattaattatacaactgttttactattctctgaaatatttattaaatgctgttttctgcaaatgagctatattttgccatcctttgctatcttgtgcacttgcatatttgctgtgtggcttgttgagtatgttatatgctcattcttgcaatattcattcatcagaggaggagtacttcagtgaaggtgacgatctggaggattaggcttgttctggtcaagttgcctgtggagtggagttgccatagttgttccgtcgtttgttttagttttatctttccgctgcgtagaatgtttttttttgagagggactatttacctctgtaataatttataatttgcgagtattcaatagttaattatttgtactctattatcaatgttgtcattgtgtgcctcggttgattcctggacgagggtttaacacacatgtaagcgtttggaattttggatagaaattccgggcgtgacagaatcatcataggccttgggttaaggcaggttcgtgtgggttcacggccttgattaataacattgtatagttctaggatcgcgtttacaaaatagctttgagcaactaaacgtctttaaatgctgtttactgcaacgctaacccttattataaattcccttgtactcccttgcatttattctgcatttgtgggtgtgtcttgttgagtacggtggttgtactcagtcttgctcaatttttcccaagtccagaagaggagctccttggagatgaaggctttggtgttagctcgtgcctgccgtcaagcgcctgtggtcgtcgccctagtcttccgttgtttcccatttgtctttgtgtgctgggccttcgctgcccgtgtaataaatatatttacgcttccgcttgttaaactctgatttgtatcaactgttggtgtaccttgcctcctgggacaaggattaatgcacgcacgtaaggaacgcccgttgggttatttccggtcgtgacaaccgacgccgtgacctggaattcgcagtggatgactttgtgtatcttcgggtcacgcccttgcgaggtgtacacagatttcagacaaaggggaagctcgcacctcggtatgtgggtcctttccgtatcattgctcggcgcggagaagtcgcttaccagttggagttgcccgcctccttgggcaacgtgcatgatgtgttccatgtgtcgcaactcaagaaatgtcttcgagtgccatccgagcaggccgactcagagcaaattgaagttcgcgaagacttgacttacgtggagaggccagtgaaaatcctggacaccatggagcgcaggaccaggaaccgggtaatccgtttttgcaaggtccagtggagcaaccacgccgaagaagaagctacttgggagcgtgaagacgagctgaaggcagcccatcccgatctcttcgccagttcttccgaatctcggggtcgagattccgtttaaggggggtaggtttgtcgcgtcccaaaacgactctaaaatccatcctcgaaattgtgcaaagaataattaaaattcaatgtgaaagcctccaacaattaaaatgtgcaaagataaaagtcaaatgaggcttggaggatttttgtatatttcctaaaagcctaaaatgtgtaaataaattttagtggaattttcagagcacaaataataattgaaaagaaataaacaaagtggaaaaggtttataaaaaaagaaaatcctaaaagaagttctttttcccccccctcttccctcttgggccggctcggcccacttctccctccctctctctctctcctcccccgcggcccatcggcctcctcccagcgtgcgcgccgctgacgggcgggcccgcccgccaccctcgctgacgggtggggcccacccgtcatccccttcctcgcgccgctcccgccgcctcgcccgtgccctagcgccgccgccaccgcgaatcccgccgctcccgtccgccctgcgcgcaataaagagggggaaatcactccccgtgatcccctccctctttccccccttttttccctctctctctccctcggattcgttcggaaaatcctcccctaacctcgccggcgccatcaatggcggccggatcttccgcgccgctttccttccttccccggccgccctctctcgccccgaccctatttaaacgctccccgtgcctccctcctccgtttccgccgctcaccgctcactctctccgtcagaatcgagctcgcgccgtcgctctctctctccgccgtcgccgccgagctccggtccgccgccgtcgtcgccccggacctcctcccgcttcggcgtcgcttccttcggcttcgccgcgtcctcgccgacctcgtccacccctccgtcgacccgagccgcgccccgtcgacccgagccgcgccgccgcattcccccgcttcggtcgccgttcccgtcgtcgccgtcgaccggggtgagccgtggaccgcccacttcgtttcccccttccctcccctctctcggccgccgctccgccgtgcctatggccgccgccggcgaccataggggtgcgggcgcgccgcctcccgtcggctgtgccggcgaggccgccttcgggcgcgccccgcggctgccatgtggcgcccggccgtcagccgcccgcgccctcgggtgcggctgacgcgtgggacccacggcgccggccggcgtaagccgcgtgcacccggtccaccgtggaccgtgaggctgccgcgtgggccccactcccgtggacccggtccgcgcgcccctcccctcggctgacgcaataaatccgattttaaattaaaatttaaatggagaaattcgcaaatatccatctaaagagcatataaacttcaaatggccataacttggccatttgaactcggaattggaccgttcaagtctctaatttttccttaagaagccaagaaccaatttttgtgctttgtttctgcttgttatatggagtttattagagttaaagccttttcttttccgttggtatcttcggggatgaaaagagaaagataattgtcacgaccggaaataacccaacgggcgttccttacgtgcgtgcattaatccttgtcccaggaggcaaggtacaccaacagttgatacaaatcagagtttaacaagcggaagcgtaaatatatttattacacgggcagcgaaggcccagcacacaaagacaaacgggaaacaacggaagactagggcgacgaccacaggcgcttgacggcaggcacgagctagacaccaaagccttcatctccaaggagctcctcttctggacttgggaaaaattgagcaagactgagtacaaccaccgtactcaacaagacacacccacaaatgcagaataaatgcaagggagtacaagggaatttataataagggttagcgttgcagtaaacagcatttaaagacgtttagttgctcaaagctattttgtaaacacgatcctagaactatacaatgttattaatcaaggccgtgaacccacacgaacctgccttaacccaaggcctatgatgattcagaccgaactggcaacccgaccctgggtcccagctcgtcccaagccaacccaggccaaccattccacattttagttgttaagcaagttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccgcctacggccggaacccccgggacaggcaggcaggactgagcccctagcagcagggcaccaaccctctgccatttgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatacggccgaggtgctaccatcaaaaccatgcacccctagcccagcccaaaaccattttaggggttttgaaaggaaggagcggtgtgaaaccaattccacaatagtccaccattccaaagtatccaggtgatatgaatatttcccaaagtctatagttgtaaaaccacctaatgttacctaattaaattgcgaagcatctacctaaaattaaactagtggtgtcatgagtggagtgtccactagttggggttttgtttgtctagggtgaacaaggtaataataataacaataacaataatgatacggtcataacaaaggtaaataggcatggctaaataaaacagtgataacgcgggaatttaaataaagcgataatgcaataatttaaatcaacataattttataaactgggattcaatatgatcaagatgatgtgtcttgccttgctcgctttcccaaacgtcggcttcaacttccacgaagagcggatcctccgaagctgcagcgtctacacgaccaacggaaaagaaaaggctattactctaataaactccacataacagcagaaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaaattttaattaaaaaatcggattattgcgtcagccgagggagggagcgcgcggaccgggtccacgggagtggggcccacgcgtcagcctctcggtccttggtggaccgggagcacgcggctggaggcggccggcgccgtgggtcccgcgcgtcagccgcacccgcgggcgcgggcggctgacggccgggcccacctggcagccgcggggcgcgcccgaaggcggcctcgccggcacggccgacgggagcggcgcgcccgcgccccgatggtcaccgccggcgaccaccggcgcggcggagcggcgcccgagagagcggagaggagagggaagcgaaagggcggtcctcggctcaccccgggactacaacgacgacggaaacggtggccgaagcggaggaaggcggcggcgcggttcgggacggcgaggacgacggcgttccggcggtcggcgggcgaagcggaggagcggacggggtcggcgacgacgcggcgaagccgatggaggtgacgctgagacgggaggaggtccggggcgacgacggcggcgaaacggagctcggcggcgacggcggagagaaggtgcgacggcgcgggctcgattccgacggggaggagaggcggcgagcggtggaaacggaggggcggagctcggggagggattaaatagcgccgagagggggagagcgcggccggagagggaggaaacggccgcggagatctcggccgccattgatgacgccggcgaggattgcgggcgcgatttcgaaggaatccgagggagagagagagggaaaagacgggggaaacgggagagggaatcacggggagtgatttccccctctttattgcgcgcggagagggcgggatgcggcggattcggcggcggcggcggcgctagggcacgggcggcggcgggcgtggcgcgaggagggagatgacaggtgggtcccacccgtcagcgagagtggcgggcgggcccgcctgtcagcggcgcgcgcgcgcggggcaggccgatgggccgagggggggggaagagagagagagggagagactgggccgagccggcccaagaaggaaaaggggggggaaagaacttcttttagggtttttttctttttacaaaccatttcaactttgtttatttcttttccattattatttgtgctctgaaaattccactaaaatttatttacacattttaggcttttaggaaatatacaaaaatcctccaagcctcatttgacttttatctttgcacattttaattgttggaggctttcacatgaattttaattattctttgcacaatttcgaggatgaattttagagtcgttttgggacgcgacaggtggtatgtggcacgtggctacacgtgaggaagatgtgtcttgtgggtaaagatgtacacctctgatcagagtacaacctattcgaatggccgcgccctcggttatgggcaagccgagcaatgtacccaagttagtgttttaattcttaaaacctgcttaacaactaaaatgttgaatggttggcctgggttggcttgggacgagctgggacccagggtcgggttgccagttcggtctaaatcatcgtcggccttgggttaaggcaggttcgtgtgggttcacggccttgattaataatattgtgtagctctaggaccatatttgcaaaatagctttgagcaactaagtgtcttttaatgctgtttactgcacaccctaaccctttatattgtgactcccttgtactcccttgcattttattctgcacttgtgggtgtgtcttgttgagtacggtggttgtactcagtcttgcttaatttttcccaaacccagaagaggagcctctggaagatgaaggctttggtgtctagctcgtgcctgccgtcaagcgcctgtggtcgtcgccctagtcttccgctgtttcccgtttgtctttgtgtgtgctgggccttcgctgctgtcacatcctgattttcgtttcaggatttataaattatttaataaattattaatataatttatatgaaatgttcattaatttactagtgaagttaaaatgtgggaaataaaatttcctaaatataaagcatggaaggatttaatttttattaaattcttcatggttaattatactctctggaattttctcagatttttcggagctcaattcctaatttttaatcatacaaagaacatttcagtaataatccacatattaaattaatcattaaatggtctgattataattttgttaagtactttgagtgtccaagtattttcaagatttttcttggaattatttgagcattggaagtatttttaacaattcaaagatcatttccgtgattaatttaattggaaaagtatttaaaaatcccttctccttttcgggccgaaataggaaaagttcagcttcagtcctcggcccattctcccttcctttcggctggccttatccctcctccaaagtctgctttgtgtccctctttcaatcgggccaagaagtgaaagcccagccaaaagtctattttgcctccctgctacagtgtcatcttcaatctccagccggctggagacagagcccgagccagccgcacagtacctgtatagccgcggttttcccctccaaatccggccttttatctcgtgtatttccaaaattagttgaggggaaatactcctcttatcctcctctatctttacccccaagaatcggagcaaaccgttgagtattttatccgaatcgaactcgtttttgagtttatctccaaaaccgagtttttgatttcccggatcgatttcttgcgggaggagtccgatctcttcaatccaaggctataaataggaccacctcgtcgccctctttcgtttgcccccttccccgtggtctcccgtgcatcgtagctcgccgtcgacgccgcttagtccgccgccgccgccggccgggttgcagccgcgccgcccctgccgtcgccgccgcttgccgccgccgccaagaggtgcgccgaggagtgaggaagcccggccgcccgtccttcttcgccgccggtcgccgtagctcgccgccgacggtcaacccgaaccgccgcccgttccccgtcgttgccggccgtcgtcggacgtcgtttgtcgttgtggtgagtaccgttgggttcgtctcgtcgtcctctacgtgtacatgccctccaaatccgcagccggccactctatctccggcgaggtcgtcatcgtggttcggccgccatggatgatgtcagcatgacgtcatcatcttctccttttccagttttttctaatagattaaaacttcagaaaatcataactaaatcatcgtaactcggttttgagtggttcaagttgctaaattcatctaaaatcatgatctacatgtttgtttactttatatgtattgtttatttggtttttattagtctttttcttcgttttgcgtgttagcttgtcgtttccgtcgttgcgaagtttcgtgagtgcgccggaagtattcaagaagattaattgaagaccgattattgcaaggcaagtcacacagatcctaaacacaatcctttgagcatgttgatcctatatttaaattctctatttgtttcaactgtgcatttattttcgaatgtcaccgggtggtgtgaacctattcctttgttatggccaatttgcattgaatgccctattccttgataccttgggtaataaattgattggcttgaaccttatgtattggtttggttcagctaaatgttatatatataattgcttagcaatgcttagaaacattagctcactaatgggatgaatcatatatactacattattatttatggttatatttaatggtcgctcacgatggttaatcgtgtgatgttaattaaatgataattaaaacctggttaaggtgggttgtgagcatatggttttgatggttgtgctcatggcaattaaggaccggtttgcgagctactgttgtgaaacatttaccgtaccaaccacaagccagcatgggcaacggctttattctttgtatagcgtgattcattatagtgcgccagactatgaagtggcgagaagtccatgggggtcgctggggagtccatgccttgtttataagggggtgattatgatccagtaacggtgcactgttttgagttgtgttgtgcaaagggtattgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgggttaagcaatgtttttcgtgattagtctcacacctctcacaataattatggatgttatttggtaataatttgtttagctcctggtttggagttagatctgtacagccgggtatggttgttcaggatggttgggcctgtacagcatgggtgtgctgttcggtgttgattaaaattgatgattaattactctactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagataaaggatccagaaggagaagacgtttggcttataccccagttgagctgcctgtgggagtggagctgaagccatcgctagaccgttaattccgctgctgtttctttttcttttcttttgtaagtatgtaacgttattattatgatggatttgtatattaaattgtcagtttgtgtacctcggctgattcctggacgaggattttatgcacaaattagttcggaaattactagtgaatttccgggcgtgacagctgcccatgtaataaattaactatttacgcttccgcttgataaactctgaaatgtatcaactcttggtgtaccttgcctcctgggacaaggaataatacacgcacgtaaggaacgcccgttgggttaattccggtcgtgacaagttggtatcagagccccccttgaccctaggacgagccgtagatcccaagccttagcaatattttcaaaataaaaatcctttgttatttgtgaaaatcctctagtctctctctgtcctgctgcttcatttatcgccaaaatctgacctttaaaatgttgcatttctttttgtttttgtttgtagatggccggcagcatcaaccgtcatggtctggacctgactggcttcgttttggagctgcggggcatgtgcgttgtcctggggtatccgcatggagtggactaccagggcaagcagctcccggagcaggagggtgacgatgcagagccccacgctgcttgggaggttactgcagtgatcctcactggctcacccgagaggacttcgttggcagtcaccgcgggtggagattctttctccgccgcttgccagaacgccgctctcctcgccatcggcactcttcaccagcgctacccggacgagttgcagcactcgccctaccgctaccaccctcgccgtggaggagcccgcgactacgccaccttccgggatgctagctcggaggatgacgctaccatcatgcacctggcgcgcatggtggaggcgtacgacgcggctcgtatcgacttccatcagatggtgcgccgtgggatggtcgagaacaacatgaagatcctggagctgcgtcaggagaatctgcagctgaagaaggacctagacgcagtggaggcgcagttgcatcagctcaagatcgcccagggagaggtctgtcgccccaagcgccgccgtgtctgccgcagccagaagatcaccgcccgcaagagtacatccaggcccgagcttgttcgccagtccttggcatggacctgcttcgtggagacccctcgtgccgagcccgcgcccgtggttcctcaggagggggaagcctccggcgttggtagcacggaggatgcgctgctgctcaccttccgtcctggccagtcgcagcggtagacgagcagttagtaggcttgcgcgtgtgttctttcttgtttgtcttcttgttggagtcgtgtggggcatggttatgccggtgtgtggtataactgtgtcggagcctgtctttattttatttgcctaagcaacttgaactttaatgaaccaatttaatagcagtaataaattcaagaattatggtagtcgtgggtggctagctttaattgtcagctctctctgtttgctggttctgtgtggggttttcagatggtgacgaccaggagaagtgctgctaccggtgaaggcagccaacccgaaggcagcaaccacaacaaccagggcagcccacatccacctcctccgcctccaccaccaccaccagacaccaacgccattctcacccaaatcctcgcccagcaagccaacatgatggctgctttcctccaccacatccaaaatccgccacaacataatgctccaccaccacccccacaacactctaaactcgctgagttcctccgcatccgtccaccaaccttctctagctccaataaccctgtggatgcgttggattggttgcatgccgtggggaaaaagttagacaccgtgcagtgcagcgatgaggagaaagtcgtcttcgccgcccaccagctgcaggggcccgcatctctatggttggaccatttccaggctacgcagctagaggggcagcctattacttgggcccgcttcaccgccgctttccggaggacccatgtgcccgccggagtcatggcccttaagaaaagggaattccgaaagttgaagcaaggcaaccgctccgtgatggagtatttgcatgagttcaacaacctggcccggtacgccccggaggatgtacgggaagatgaggaaaagcaggagaagttcttggctggaatggatcctgagctgtccgtccgtctagtctccggtgactatccggatttccaacatctggtggacaagagcatccgcttggaagccaagcacaaggaactggagtcgcacaagcgtcgcttggcgaatttccgcaatcaacagggagctaaccaaaggatccgctacaccaatccctatccaggaggatcgtcctcgcagcagcaacagcagcagcaacctcgctccgcgccccgacctcaattcgtggtgcgtgtcccacagccgctgtcgcgtcccaaaacgactctaaaattcatcctcgaaattgtgcaaagaataattaaaattcatgtgaaagcctccaacaattaaaatgtgcaaagataaaagtcaaatgaggcttggaggatttttgtatatttcctaaaagcctaaaatgtgtaaataaattttagtggaattttcagagcacaaataataatggaaaagaaataaacaaagttgaaatggttttataaaaagaaaaatcctaaaaagtcttctttccccccctttccttcttgggc

SEQ ID NO: 12262 - DNA, 9811 bp, Oryza sativa
gcccgccccatcggctgatgcaataaatggaatttttaattaaaatttaaatgaagaaattcgcaaatatccatttaaagagcatataaacttcaaatggccatatcttggccatttgaactcggaattggaccgttcaagtctctattttttccttaagaagtcaagaacccatttttgtgctttgtttctgctgttatgtggagttatttagtgtttaagccttttcttttccgttggtcgtgtagacgctgcagcttcggaagatccgctcttcgtcgaagtcgaagccgacgtttgggaagacgagcaaggcaagacacatcatcttgatcatattggatcccagtttataaaattatgttgatttaaattattgcattatcgctttgtttaaattcccgcgttatcactgttttatttagccatgcctatttacctttgttatgaccatatcattattgttattgttattattattaccttgttcaccctagacaaacaaaacctcaactagtgggcactctactcatagtaccactagtataactttaggtagatgcttcgcaatttaattaggtaacattaggtggttttacaactatagacttgggaaatattcatatcacctggatactctggaatggtttggttattgtggaattggcttcacaccgctccctctattcaaaagtccccaaaatggttttgggctgggctaggggtgcatggttttgatggtagcacctcggccgtataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggtctgaatcatcataggccttgggttaaggcaggttcgtgtgggttcacggccttgattaataaaattgtatagttctagaatcgtgtttataaaatggctttgagcaactaaatgtctttaaatgctgtttactgcaaccctaaccctctatattataatccctttgtactcccttgcatttattctgcacttgcgggtgtgtcttgttgagtacggtggttgtactcagtcttgctcaatttttcccaaccccagaagaggagttccttgaagatgaaggctttggtgtctagctcgtgcctgccgtcaagcgcctgtggtcgtcgccctagtcttccgctgtttcctgtttgtctttgtgtgctgggccttcgctgcccgtgtgtcgcgtcccaaatcgactctaaaattcatcctcaaaattgtgcaaaagaataattaaaaatttattgtgaaagcctccaacaattaaaatgtgcaaagataaaagtcaaatgaggcttggaggatttttgtatatttcctaaaagcctaaaatgcttaaataaattttagtggaattttcagagcacaaataataattgaaaagaaataaacaaagttgaaaaggttttataaaaagaaaaatcctaaaagaagttcttttcccccccccctttccttcttgggccggctcggcccaattccctccccctctctctctcctctccccgcggcccatcggcctcccccgcgcgcgcgcgccgctgacaggcgggcccgcccgccactctcgctgacgggtgggacccacctgtcatctccctcctcgcgccgcgcccgccgcccgtgccctagcgccgccgccgccgccgaatccgccgcatcccgccgtccccgcgcgcattaaagagggggaaatcactccccgtgattccctctcccgtttcccccgctttcccctctctctctccctcggattcgtccaaaatcgcgcccgcaatcctcgccggcgtcatcaatggcggccgagatctccgcgcccgtttcctccctctccggccgcgctctccccctcccgacgctatataatcgtcccccgagctccgctcttccgtttccgccgctcgccgctcgctctcgccgtcggattcgtgctcgcgccgtgcacctctctctccgccgtcgccgtcgacctccggttcgccgccgacgtcgctccgggcttcctcccgactcggcgtcacctccatcggcttcgccgcgttgtcgccgaccccgtccgccccttcgcttcgcccgccgaccgccggagctccgtcgtcctcgccgtcccgaaccgcgccgccgccttcctccgcttcggccgccgtttccgtcgtcgttgtagtcccggggtgagccgaggaccgccctttcgcttccctctcctctccgctctctcgggcgccgctccgccgcgccggtggtcgccggcggtgaccatcggggcgcgggcgcgccgctcccgtcggccgtgccggcgaggccgccttcgggcgggccccgcggctgccaggtgggcccggccgtcagccgcccgcgcccgcgggtgcggctgacgcgtgggacccacggcgccgaccgccgccagccgcgtgctcccggtccaccgtggaccgagaggctgacgcgtgggccccactcccgtggacccagtccgcgcgtcctctctcccggctgacgcaataaatgagtttttaattaaaatttaaatgaagaaattcgcaaatatccatttaaagagcatataaacttcaaatggccatatcttggccatttgaactcggaattggaccgttcaagtctctaatttttccttaagatgtaaagaacccattttttgtgctttgtttctgctgttatgtggagttatttagtgttaaagcctttttcttttccgttggtcgtgtagacgctgcagcttcggaagatccgctcttcgtggaagtcgaagccgtcgagtgggaaaacgagcaaggcaagacacatcatcttgatcatattgaatcccagtttataaaattatgttgatttaaattattgcattatcgctttatttaaattcccgcgttatcactgttttatttagccatgcctatttacctttgttatgaccatattattattgttattgttattattattaccttgttcaccctagacaaacaaaatctcaactagtggacactctattcatggttccactagtatgaatttaggtagatgcttcgctgattaattaggcaacattaggtggttttataactttagactttgggaattctcatatcatttggacactatggaatggttggcttatgttggaattggacacacacctctcttcctctttcaaaacccctaaaacctgttttcggtggggtttgggtgcatgccagttgtgggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggggtcgatggacatgctccagggcaaatgaaggctacacgagctgcggcccggtagtcgagatgtcataaagcacagggttggtgccctgctgcgaggggctcagttccgtctgcctgtcccgggggttccggccgtaggcggaattgggtcggtactcttgtctaaggctaggatgggttggaaactatgtcacgtcttccgtccgtataccgtggtggtatgtggcacgtggttacacgtgaggaagatgtgtcttgtgggtaaagatgtacacctctgatcagagtaaatctattcgaatagccgagccctcggatatgggcaagcctagcaatgtacccaagtcagtgttataattcttaaaatttgctcaacaactaaaatatggaatggttggcctgggttggcttgggacgagctggaacccagggtcgggttgccagttcggtccgaatcatcgtaggccttgggttaaggcaggttcgtgtgggttcacggccttgattaataatattgtgtagttctaagatcgtgtttacaaaatagctttgggcaactaaaagtctttaaatgctgtttactgcaactctaaccccttatgttataattcccttgtactcccttgcatttattctgcattcgtgggtgtgtcttgttgagtacggtggttgtactcagtcttgcttaattttcccaagcccagatggggagttccttgaagatgaaggctttggtgtctagctcgtgcctgccgtcaagcgcctgtggtcgtcgccctagtcttccgctgtttttcgttgtctctgagtgtgctgggccttcgtcgcccatgtaataattttatttacgcttccgcttgttaaactctgaattgtatcaacttttggtgtaccttgcctcctgggacaaggaataatacacgcacgtcaggaacgcctgttgggtgatttccggtcgtgacaccgtgtaataaatctatttacgcttccgcttgttaaactctgaattgtatcaacttttggtgtaccttgcctcctgggacaaggattaatgcacgcacgtaaggaatgcccgttgggttatttccggtcgtgacacctattaaagagagatcccgcactgccttcgagttcgatggtaagaatgaccccaaccgtgaagatccagagtctcttgagttcaagattatgaaggagaggatgtacaaaatcttctcaaacggtattgtggttagctattcacaactactgccagtggtgccatataacgctttcaaccctcctccaccggtatgtatcaaatatttcggccttccttatgacatcattttgtcttttgtaatgttggtcaaaaacttcaataataatgcataggaattttctttgatgaaatctgatcctccaagcgctcaacgccgctcgccccgccgacaagctggtcaggccagtggcgggccaaaaatccagtctgctgctcagccaagcatctcaaagccaactaaccaatcgggctcttggaaaaggaaattagttctgagtgacgacaaaggtgacaatgttgggaaagctggcagctgtcacatcctgatttttgtttcaggatttataaattatttaataaattaataatagaatttatattaaatgatctttaatttacaagtgaagttaaatgtgggaaataaaatttcctaaatataaagcatggatggatttaatttttattaaattctccatgattaagtcaactctctgaaattttctcggatttttcagagctcaattcctaaatgatacaaagaacagttcagtaattatttgatcaataatgatctaattataattgttaagagcttttccttgtttaaaaaatccttaaattataaattgttgtttaaaaggaataattagaaatgatcttaaaagcttaaaagagaagatctaattttaatttgctaaatctcaatattaaattgggctagataaaattttgttaaatactttgcttaattctataattcctagatttttctgggatttatttgagctaaggaagtatttttaataaatggaattgcatttcatgaataatttaaattgaaaaaggtttttaaaagtctcttttggctttgggccgaaagtcggcccaaaacctctctctttctctctccctccccggcccagtcggcccaacccgccgtcgcttccttctctctctcggtgccgctgacaggtggggcccacctgtcggacccgtcgacaacctcgcgccgtcgcccggccgaaccctagccgagtcgcgcccgagccaccgccgctgcccttccaaattccgtcgcccctctctatttccggtcaaattgattgagggcaaatgatccttgagatctcctcttctttttctcttttggaaacatcggctaattttctttggaaaccggtggatttgagttggattcggattcatctctctcctctaaccctaacctttccttcgcgtcgctggtcgccgtgggccttcgccgccgcctccttgcccctttaaaaggacccccgagctctcctctatctgccgccacctttgccttagcccgccgtcgcgtctagcgccgcctccgcgtagccctagccgtcgccgttgttgccgtcggttcagccgcgccgcgccgccgttgcagcagccgtcgtcggtcgccgtcgccaccatcgggttcgcgaggtcgtcgccgtccccgtccaccgcttcgccgccgccgaagaccgccggagcaccgccgtcgtcgtcgacccgaagaccgtcgccgtttcttcctcgtcgccggcgccgtccgttgcttttccgccgttgttttggtcaccggtgagttcgccgcgtcgccctctacccgttggtgccctccgttcgcgtcgtcgagccgttgttcgccggcgagcatgcgttgccgagccgccgccggtgctgacgtcatcgctgacgtcgtcgctgacgtcatcgtcgctgtccccgtagacccgtcgtgaaccgatcgatctcggccgtccgttttggatggatcgatctcggccgttcatttccgtgagccgtcgccgtgcacccggttcaccgcaaaccctagccgctgacgcaataaacctcttttccttttcaaaaataattcattattgcgtcataattcaattaaaatccatataagtattttaatccgatttaatctttaaaaattcataactaattcattgtaactcagtttaatgtggttcaagttacaaaaattatataaaataaatatctacatattaaaattatccataaattgaattaaatttatttaattctttttaaatgggctttaattagatttaatcttgtaaaattcataataaattcatatgaaatcggaatgaggccgttcaagtctctaaattcatctaaaatcatgatctacatgtttgtttactttatatgtactgtttatttagtttttattagtctttttccttgttttggcgtgttagcttgtcgtttccgtcgttgcgaaggttcgtgagtgcgtcggaagtaatcaagaagattaattgaagaccgattattgcaaggcaagtcacacagatcttaaacacaatcctttgagcatgttgatcctatatttaaattctctatttatttcaactgtgcatttattttcgaatgtcaccgggtggtgtgaacctattcctttgttatggcctgtttgcattgattactctattccttgataccttgggatattataatttgactagttgagctttatatatattagttcaactagatgttagatataattgcttagccatgcttagaaacattagctcactaatgggatgaatcatatgtactacattattatttatggttatatttaatggtagctcacgatggttaatcgtgttatgataattaattggtaattaaaatatgattaatggtgggttgtgagcacatggttttgagagtcgtgctcatggcaattaaggaccggttcgcgagctactgttgtgaaacattaaccgtgccaaccacaagccagcgtgggcaacggctttaccttttgtatagcatggttcattgcagagcaccagactgagaagtggcggagataagcccacgggggtcgctggggagtccatgccttgttttataagggggtgattatgatccaggaatggtgcactgtggtgagttgtgttgtgcggagggtattgtcacagcctctattcgggtactttccagtatcgcgacgcatggtagacatgatgttgaggctgtgtcttgtgggtacagtggtacacctctggccacagtaaaactattcgaatagccgtgcccgcggttatgggcgggttgagcaatatttttcgtgattagtctcacacctctcacaataattattgatgctataactggtaataatttgtttagctcctggtttggagttagatctgtacagccgggtatggttgttcaggatggttgggcctgtgcagcatgggtgtgctgttcagtgttgattaaaatttctgattaattactctactgttttactactcttaactctttgctaaatgctgcttttgcaaatgagcctatattatgccatcatttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtgaagccggagcttcgctagattttatttttccgctgcagttttcttcttggtgaggactaagtgcctcttaagtaagtatttatcggtttagttaatatgatggatttgtatattaaattgtcagtttgtgtacctcggctgattcctggacgaggattttatgcacaaataagttcgggaattgctagtgaatttccgggcgtgacaagttggtatcagagccatctcgactgtaggataagccaaatggtcaaaccttaaggactaattttccgaaaacatgatttgtgaaaatttctcctttcttccttatctagaattctttgcaaattgtttcattgtctactctcctctctcgttcaacttgagtagttctgaaactagttgttgaaactagaagatgctgatgtggtcaacttatggaggtcagtcaagtggatcgaggaagaaacgaagtgcccagatgtcaagatggaatgaagtttggatcctaccttagaacctatgccgccaaagtgtctttgaagaatagttagtagggtagaacgctgttgattgctttgtgtgtaggtatggttgcattcccgtcattggagtagtccagtgatgagcgtgtacctatactaggttgcttgcttaatcaacttgaacaatataatggtctacacacatcagatcagtgttaaactggttaaggtcttgtctttagtgtaacccctctcctcctatcttttctaatctgcaacagatggtgaacactcgcgccagtggaagtggaaacaataacaatgaagagaacccaacccttgctcaagtgctggctcaacagacccaattgatcaacatgttagtgcaacaaatgcagaaccagcaagggaacaacaatgtcaatcctccgccgccgcagaacaagttagctgattttcttcgtgtgaagccgcctaccttctctagcactaccaacccagtagaagcaggtgattggctgcacactattgagaagaagttggaactgctccagtgcacggatcaggagaaagttgttttcacttcacatcagttgcaaggacctgcatcggaatggtgggatcatttccggatgaacagagcagaaggacaaccaatcacttgggcggagttcactgaagccttcaagaagacacacatacctgcaggtgttgttgctttgaagaagcgtgagttccgggcacttaagcaaaaggatcgtaccgtgacggaatatcttcatgagttcaatcgtctagctcgctatgctccagaagatgtgcgtactgacgaggaaaggcaggagaagtttttggaaggcttaaaggatgagctgacagttatgttgatctctcatgactatgaggattttcaggagctggttgataaagcaattcgactggaagacaagaagaacaggatggacaatcgtaagagaggaaggattgttttcaggaggcacatgatagtagccagaggcagcgtatcaagccact

SEQ ID NO: 12263 - DNA, 2258 bp, Oryza sativa
cagactgagaagtggcgagaagtccatgggggtcgctggggagtccatgccttgtttataagggggtgattatgatccaggaacggtgcactgttttgagttgtgttgtgcaaagggtattgtcacgatttccccctttgcaatgccgtggtggtatttcggggcatggcaacatgtgtggaatcgtgtcttgtgggtacagtggtacacctgtggccagagtaaaactattcgaatagccgtgcccgcggttatgggcgagttgagcaatgtttttcgtgattagtctcacacctttcacaatgattattgatgattaactggtaataatttgcttagctcctggtttggagttagatctgttcagccgggtatggttgttcaggatggttgggcctgtacagcatgggtgtgctgttcagtgttgtttaaaatttcggattaattaatctactgttttactattcttaactctttgctaaatgctgctttcgcaaatgagcctatattatgccatcctttggaatccttgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagccggagcttcgctagattttattttccgctgcagttttcttcatggtgaggactaagtgcctcttaagtaagtatttatcgttttagttaatttgatgaatctgtatattaaattgtcagtttgtgtaccttggctgattcctggacgagaattttatgcacaaataagttcggaaattactagtgaatttccgggcgtgacaaaggtgacaatgttgggaaagctggcagcaaagaggtgattggaaaacagccaagacaggctaacccgaagaagaaaacatccagtcgtccaataccaaaaatcagaaaatcgaccaggtatgaatcagcttgtcatttctcctgtgttgccttgacatgcatcatcaatataacacatctcgaatcctcaggaaaccatcagacatcgatccagctggaaaagaccctgagtcgaccgacaaggagactggttctgcggctgccagggaatccgagccgactgaagaaaaccgctcaactggcagtcagtcggcgaccgttaatgtagaagctgggaacaagcccctgactggaaatcagtcggcagaagctgaaactgacgctcaccaaaagcccccgattggagaccagctggaggttgaaccaaataaagacatcccggaaacagaggaacaaacgagcatccctccctttacaacaccaatgctggtccaaaggtcagtacttttgacaaaatacaagggacagctcgccctcctccgaaggttataacaggtaactgagcctctgaatccatttatattgaaaaagttctcttcaatcgctttatcactcttttcgtaaatgcataggcccaataattggcgacgaagaagaaattcttcggatacgatcagctgaagactcttgcccacccatcttagtcaaatggtgagatgacgaaatgcagccgcaagaaattgtaataaataagcagaaagaagacgaagaagtgtctctactcacaaagacacttaatcaagccactcgtcttgtaaatgtacgtcttctgcttatagcttgactcatcctgttggtcagtcctgtgaactgaataaacttgtaatgctgagaattcatcttaggaatgaagcaaagactgcaacccttgaaaaactggtcccacatcttggaaccctggaagcagggaccagagcccaactccacgaaaccagggagcttgccaggaagactgaacatgatctcagggactggattgccgagcttcaagattccaatttcgagctgagtggttcatctaaaggtaacccctattcctgaataacttattccaaactgtcatccgtgttccaccaaccgctgggatgtattgcagtataagctgccaagatcaccgagctagaaaaagataagggtgaatgtcacacccgaaaataccccaacgggcgttccttagtgcgtgtattattccttgtcccaggaggcaaggtacaccaaaagttgatacatttcagagtttatcaagcggaagcgtaaataattaatttattacatgggcggcaaaggcccagcacacacaaagacaaacgggaaaca

SEQ ID NO: 12264 - DNA, 731 bp, Oryza sativa
tatactctgatcagaggtgtacatctttacccacaagacacatctttctcacgtgtaaccacgtgccacataccaccacggtatacggacggaagacgtgacatagtttccaacccatcatagccatagacaagagtaccgacctaaccccgcctacggccggaacccccgggacaggtaggcaggattgatgtcacgaccggaaatcacccaacaggcgttcctgacgtgcgtgtattattccttgtcccaggaggcaaggtacaccaaaagttgatacaattcagagtttaacaagcggaagcgtaaatataatcattacacgggcagcgaaggcccagcacacaaagacaacgaaaaacagcggaagactagggcgacgaccacaggcgcttgacggcaggcacgagctagacaccaaagccttcatcttcaaggagctcctcttctgtgcttgggaaaaattgagcaagactgagtacaaccaccgtactcaacaagacacacccacaaatgcagaataaatgcaagggagtacaaagggaattataatataaggggttagggttgcagtaaacagcatttaaagacatttagttgctcaaagctatttggtaaacacgaatctagaactatacaacgttattaatcaaggccgtgaacccacacgaacctgcttaacccaaggcctacgatgatccggaccgaactggcaacccgaccctgggtcc

SEQ ID NO: 12265 - DNA, 1676 bp, Oryza sativa
ttagatttgaaggagaaatactggtgggtcacatgaagcgggaaattgcagagtttgtggccctatgtgatgtgtgccagcgtgtcaaggcagaacaccagcgaccggccggacttctccaacctctccaagtgccagaatggaaatgggatgaaattgggatggatttcatcactggacttccaaaaacccaaggtggatatgattctatatgggtaattgtggatcgactaacaaaggtagctcgatttattcctgtgaagaccacctatggagggaacaaactagcggaactctatttcgctaggatcgtgagtctccatggcttcccaagaaaatcgtatctgataggggaagccaattcacctctcacttctggaagaagctccaagaagagctgggcactcgattgaatttcagcaccgcgtatcacccgcagacagatggacagaccgagcgtctaaaccagatcctagaagatatgctccgcgcatgtgtactagatttcgggaagacctgggataagagtctcccctatgccgagttctcctacaataacagctatcaagccagcatacaaatggcaccttatgaagcgttgtacgggcgcaaatgccggacaccgctcttgtgggaccaagttggagaaagccaagtgttcgggactgatatcctgagagaagctgaagctaaagtcagaatcattcgggataatctaaaggtggcacagtcccggcagaaaagttatgcagataaccgtcgccgtgacctggaattcgcagtgggtgattttgtatatcttcgggtcatgccattgcgaggtgtgcacaggtttcagacaaaaggtaagctcgcacctcggtatgtgggtccttaccgtatcatcgctcgacgcggagaagtcgcttaccagctagagttgcccgcctccttgggtaacgtgcatgatgtgttccatgtgtctcaactcaagaaatgtcttcgagtgccatccgagcaggccgactcagagcaaattgaagtccgcgaagatttgacctacgtggagaggccagtgaaaatcctggacaccatggagcgcaggaccaggaaccgggtaatccgtttttgcaaggtccagtggagcaaccacgccgaagaagaagctacctgggagcgtgaagacgagctgaaggcagcccatcccgatctcttcgccagttcttccgaatctcggggtcgagattccgtttaaggggggtaggtttgtcgcgtcccaaaacgactctaaaattcatcctcgaaattgtgcaaagaataattaaaatccatgtgaaagcctccaacaattaaaatgtgcaaagttaaaagtcaaataaggcttggaggatttttgtatatttcctaaaagcctaaaatgtgtaaataaattttagtggaattttcagagcacaaataataattgaagagaaataaacaaagttaaaaggattttataaaaagaaaaaccctaaaaagcctttttcccccccctttccttcttgggccggctcggcccagctctccctctctctctcttccccccccctcggcccatcggcctgccccgcgcgcgcgcgccgctgacaggcgggcccgcccgccactctcgctgacgggtgggacccacctgtatctccctcctcgcgccacgcccg

SEQ ID NO: 12266 - DNA, 784 bp, Oryza sativa
aataatattgtatagctctaggaccgtgtttacaaagtagctttgcgcaactaagtgacttttaatgctgtttactgcaaaccctaaccccctatattatggctcccttgtactcccttgcatttattctgcacttgtgggtgtgtcgtgttgagtacggtggttgtactcagtcttgctcaatttttctcaaacccagaagaggagttccttgaagatgaaggctttggtgtatagctcgtgcctgccgtcaagcgcctgtggtcgtcgccctagtcttccgctgtttcccgtttgtctttgtgtgtgctgggccttcgctgcccgggtaataaatctatttacgcttccgcttgttaaactctgaattggatcaacttttggtgtaccttgcctcctgggacaaggattaatgcacgcacgtaaggaatgcccgttgggttatttccggtcgtgacaccaccacggtatacagacgggagacgtgacatagtttccaacccaccctagccatagacaagagtaccgacccaatcccacctacggccggaacccccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtatacttttgtttatagccagactgagccacaaactaagccttacccactagacatgtgcaagtacggtagtgctttgcaacaga

SEQ ID NO: 12267 - DNA, 717 bp, Oryza sativa
agatattttttattttatatagttattctctaatgtttcaccatagaaaagtttctatttcgctgccaatctgttgacaaagctcaaccaaataaaatatttttgatcctggaagaaatagtagaaattagaagaaaaaacttgatgcttgaaagaacagactcatagggtcactagccaactttcataaagaaaaggcctcactgtatggtttatgtggatgcatgatgctttctcagcgatgacctgtaaaggaattactcaggtccctctcttttgtataaccctcttctagcgatcatgtatcccgacgtaggtacaaacgtgttcgcgaacaaattcgtggagaagggtccaatagccctcgaatggaccggctacactgaaagagggaagcgaatagcctgaagattctttcctttgttgtctcactatcagagcttgcggcacttgaataagccgccgccccccagctgcgtctttacccctatccaatttttgggccaattcccccttcgtactaccaaaaaatgagattcaggaaagtagttgggagtatgtatgccggcaaaaaagtacccacaccttcttaggtggtaaaagatctttttatgaaaaaaaatacatacattcttataggtcaatttatctcaatcgatgatattgtttctgaatagttgacctaaccaatcaaagctcccttgactagctttccag

SEQ ID NO: 12268 - DNA, 1649 bp, Oryza sativa
ttagacaatagtaccgacccaatcccgcctacggccggaacccccgggacaggcagacggaactgagccccttgcagcagggcaccaaccctgtgctttttgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatacggccgaggtgctaccatcaaaaccatgcaccccgagcccagcctaaaaccattttaggggattttgaatagagggggcggtgtgaagccaattccacaataatccaacaattccatagtgtccaggtgatatgaatatttcccaagtctaaagttataaaaccacctaatgttacctaattaaattgcgaagcatctacctaaatttaaactagggataccacgagtagagtgtccactagtcgaggttttgtttgtctagggtgaacaaggtaataataataacaataacaataataatatggtcataacaaaggtaaataggcatggctaaataaaatagtgataacgcgggaatttaaataaagcgataatgcaataatttaaatcaacataattttataaactgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttgcgaatttcttcatttaattttcaattaaaaatcctatttattgcgtcagccgagggagcgggcgcgcggaccgggtccacgggaagtggggcccacgcgtcagccccacggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagtggcgcgcccgcgccccgatggtcaccgccggcgaccaccggcgcggcggagcggcgcccgagagagaggagggaagggggaaggcgaacggcggtactcggctcaccccgggacaacgacgacgacgagaacggcggccggagcggaggaaggcggcggcgcgggtcgggatgacgagggcgacggtgctccggcagtcggcggacgaagcggagcggcggacggggtcggcggcaacacggcgaagcggacggaggtgtcgccgagtcgggaggaggtcctgagcggcggctgctgcggaactgatcttggcggcgacggcggatagagaggaacacggagcgagcactattccgaccgcgagagccatcggtgagcggcggaaacggaa

SEQ ID NO: 12269 - DNA, 2110 bp, Oryza sativa
ggcccaagagggggagggggggaaaaaggctttttagggtttttctttttataaaatccttttaactttgtttatttctccttaattattatttgtgctctgaaaattccactaaaatttatttacacattttaggcttttaggaaatatacaaaaatcctccaagccttatttgacttttaactttgcacattttaattgttggaggctttcacaaggattttacttattctttgcataatttcgaggatgtattttagagtcgttttgggacgcgacaaacctaccccccttaaacggaatctcgaccccgagattcggaagaactggcgaagagatcgggatgggctgccttcagctcgacttcacgctcccaggtagcttcttcttcggcatggttgctccactggaccttgcaaaaacggattacccggttcctggtcctgcgctccatggtgtccaggactttcactggcctctccacgtaagtcaagtcttcgcgaacttcaatttgctctgagtcggcctgctcggatggcactcgaagacatttcttgagttgcgacacatggaacacatcatgcacgttacccaaggaggcgggcaactccagctggtaggcgacttctccgcgtcgagcagtgatacgaaagggacccacataccgaggtgcgagcttcccttttgtccgaaacctgtgcacccctcgcaatggcgtgacccgaaggtacacaaaatcatccactgcgaattccagatcacggcgtcggttatcggcataacttttctgccgggactgtgccacctttaagttatcccgaatgattctgactttagcttcagcttctctcaggatatcagtcccgaacacttggctttctccaacttggtcccacaatagcggtgtccggcatttgcgcccgtacaacgcttcataaggtgccatttgtatgctggcttgatagctgttattgtaggagaactcggcataggggagactcttatcccaagtcttcccgaagtctaggacacatgcgcggagcatatcttctaggatctgatttagacgctcggtctgtccatctgtctgcgggtgatacgcggtgctgaaattcaatcgagtacctagctcttcttggagcttcttccaaaagtgagaggtgaattggcttcccctatcagatacgattttcttgggaataccatggagactcacgatcctagcgaagtagagctccgctagtttgttccctccataggtggtcttcacaggaatgaatcgagctaccttggttaatcgatccacaattacccatatagaatcatatccaccttgggtttttggaagtccggtgatgaaatccatcccaatttcatcccatttccattccggcacttggagaggttggagaagtccagccggtcgctggtgttctgccttgacacgctggcacacatcacatagagccacaaactctgcaatttcccgcttcatgctgacccaccagtatttctccttcaagtctaagtacatcttggtactgcccgggtgaatggaataaggactttcgtgagcttcctgaagtatcagctgtttaagttctctgctatctggaacgcatacccgctttccgttccataaggttccgtgttcatcctctgtgaaacctgcggctttaccctgtttcatattcttgaggagtccatgcatgtccggatcattcttctgagcctcgcggatttgatcgagcaaggtaggcttggcttctaacgcagccaagaatccgcgaccaactatgcttaggttcagggcttccatctgttgattaagttcgggtggaatgccacggacgttaagagtattgcaatagctcttccgacttagagcgtcggcaaccacgttggccttaccgggatgatagtgaattcccacatcataatccttgatgagttctaaccatctcctttgccgaagattcagatctgactgggtgaagatgtatttcaaactcttatgatcagtatatatttcacagcgattcccaatgagatagtgccgccagatttttagagcatgaaccactgcggctaactccaagtcatgtgtagg

SEQ ID NO: 12270 - DNA, 5448 bp, Oryza sativa
aagtatcagctgtttaagttctctgctatctggaacgcatacccgctttccgttccataaggttccgtgttcatcctctgtgaaacctgcggctttaccctgtttcatattcttgaggagtccatgcatgtccggatcattcttctgagcctcgcggatttgatcgagcaaggtaggcttggcttctagcgcagccaaaaatccgcgaccaactatgtttaggttcagggcttccatctgctgattaagctcgggtggaatgcctcggacgttaagagtattgcaatggctcttccgacttagagcgtcggcaaccacgttagccttaccaggatgatagtgaattcccacatcatagtccttgatgagttctaaccatctcctttgccgaagattcagatccgactgggtgaagatgtatttcaagctcttgtgatcagtatatatttcacagcggttcccaatgagatagtgccgccagatttttagagcatgaaccaccgctgctaactccaagtcatgtgtagggtagttgccttcatgaggtcgtagctggcgtgaggcataggctaccacatgaccgtcctgcatgagcacgcaccccaatccttggcgcgaagcatcacaatacaccatgaaatccttgcgagtatccggcaagattaacactggcgaggaaaccagcttttccttgagagtttggaacgccttctcgcattgcgggctccacacaaatttctcttctttcttcaacaactgtgtcatgggtcgagcgattttggagaagttctcgataaatctccggtagtatcctgccaaacctaagaaactgcgaatttgagtgactgtcttgggttgcttccaatcggtgacggcggtcactgtttcggggtccacagcaactcctttagcagatatcacgtgccccaagaatttgacttcggacaaccagaactcacacttgctaagcttggcatacaattgatgttcccgcaactttcccaacaccagacggagatggtgctgatggtcttcttctgactgtgagtatatcagaatgtcatcaatgaaaaccacaacaaacttatccaagtattccatgaacactttgttcattaagttcatgaagaaggcaggtgcattggttaagccgaacgacatcaccgtgaattcatacagcccgtatcgcgtggtgaacgcggtcttagggatatcttcctcacggatacgtaattggtgatatccggaacgaagatcaatcttggagaatatagtggcacctttaagctgatcgaacagatcatcgatccggggaagagggtacttgtttttgatggtgacttcattgagagctctgtagtcaacgcacatcctcttcgttttgtctttcttctccacaaaaatcacaggagcaccccaaggggaagtactcggacgtatgtaccccttttctttcaactcttccaactgtttctttacttcggccagttcatttgctgccatacggtagggtcgcttgtgcagaggagtggttcctggagcaagatctatccggaactcaatctctcgcttgggcggcataccaggtagttcttccggaaacacgtctccgaactctctgactatggggatttctgacagttctatctgatgaagttctgaacttctgacagaggttgggggtgcaaagaaaacaaccggttgttctggtcctcggtacagagtgacagtgcgcctcgcgcaatccactaccccttggaattgggccaaccaattcatcccaaggatcacatccaagttctttgtgtctaacagaatcagatccgagggaaaaggaattccctgaatttctataggaacggcagggctataatactttgctgtcataacccctccaggggtggtgatgagcagagggtttctaagcctttctacccccaactgatttttccccacgaatggcacagatataaacgagtgggaagctccagagtcgaacaaaattgtagcagggatggaatggatgaggaacgtaccaacgatgacgtccggagttgtcagcacgtcctcggccgtcacgtggttcacacgaccccgaatgacgtccttcccaccgttgttggagcggggaggcgcttggccttgctgacgccttggcttcgggcatttatccgcaaagtgcccgggctcgaagcagttgaagcacagacgctgctgaccttgagcgtccctgcggctttgaacgggctgcacagttggcgtaggaggacggggcgcacgagtcccttgttgattctgctgctgctgcggctgtgggacgcgcaccacgaattgaggtcgaggcgcggagcgagattgctgctgctgttgttgctgctgcgaggaggatccccctggatagggattggtgtagcggaccctttggttagcaccctgctgattgcggaagttcgccaagcggcgcttgtgcgactccagctccttgtgcttggcttccaagcggatgctcttgtccaccagacgttggaagtccgggtagtccccagagactagacgaacggacagctcagggtccattcctgccaggaacttctcctgcttctcctcatcttcccgcacatcctccggagcgtaacgggccagattgttgaactcatgcaaatactccatcacggagcggttgccttgcttcaactcccggaactccctcttcttaagagccacgactccggcgggcacatgggttctccggaaagcggcggtaaagcgagcccaagtgataggttgcccctctggctgcgtagcctggaagtggtcccaccagagagatgctggcccttgcagctggtgggcggcgaagatgactttctcttcatcactgcactgcacagtgtccagcttcttccccacggcatgcaaccaatccaacgcatccacagggttgttggagctagagaaggtaggtgggcggatacggaggaactcggcgagtttagagtgttgtggaggtggtggtggagcattctgctgtggcggattttggaggtggtggaggaaagcagtcatcatgttggcctgctgggcgaggatttgggtgagaatggcgttggtgtctggtggtggtggtggaggtggattgccttgggggttggggttgctgccttcgggttggttgccttcaccggtgctaacatttctcctggtcgtcaccatctgaaaaccccacacagaaccagcagacagagaaggagagctgacgattaaaactaaccacccacgactactataaatcttgaatttattactgacattaaattggttcattagagttcaagttgcttaggcaaataaaataagacaggctccgacatagttatgccacaccccggcgtaaccatgccccacacaactcaaaaagacaaacgaggaaaaacacacgcgcaagcctactaactgctcgtctaccgctgcgacgggccaggacggaaggcgagcaacagcgcatcctccgtgctaccaacgccggaggcttccccctcctggggaaccacgggcgcgggctcggcgcgaggggtctcgacgaagcaagtccacgccagggactgacgaacaagctcgggtctggaggtgctcttgcgggcggtgatcttctggctgcggcagacgcggcggcgcttggggcggctgtcctctccttgggcgatcttgagctggtgcagctgcgcctccaacgcgtcgaggtccttcttgagctgcaggttctcctgccgcagctccagaatcttcatgttgttctccaccatgccacgacgcaccatctgatggaagtcgatacgagccgcgtcgtatgcctccaccatgcgtgccagatgcacgacggtagcgtcatcctccgagctagcatctcggaaggtggcgaagtcacgggcttctccgcgacgagggtggtagcgatagggcgagtgctgcaactcgtccgggtagcgctggtgaagggtgccgatggcgaggagagcggcgttctggcaagcggcgggaaaggaatctccacccgcggtgactgccagcgaagtccgctcgggagagccggagaggatcactgcggtgacctcccaaccagcgtgaggctctgcatcctcaccctcctgctccgggagcggcctggcctggtagtccactccatgtggatatcccaagaccacgcacatgccccgcagctccaaaacgaagccagtcatgtccaaaccacgacgggtgacgctgccggccatctacaaacaaaaacaaagagaaaagcaacattttgaaggtcaggttttgatgataaatgaagcagcaagacagagagagactagacaattttcacaaataatcaaagatttttatttttgaaaatattgctaaggcttgggatctacggctcgtcctagggtcaagggaggctctgataccaacttgtcacgaccggaaatcacccaacaggcgttcctgacgtgcgtgtattattccttgtcccaggaggcaaggtacaccaaaagttgatacaattcagagtttaacaagcggaagtgtaaatataatcattacacgggcagcgaaggcccagcacacaaagacaacgaaaaacagcggaagactagggcgacgaccacaggcgcttgacggcaggcacgagctagacaccaaagccttcatcttcaaggagtgtcgcgtcccaaaacgactctaaaatctatcctcgaaattgtgcaaagaataattaaaattcaatgtgaaagcctccaacaattaaaatgtgcaaagataaaagtcaaatgaggcttggaggatttttgtatatttcctaaaagcctaaaatgcgtaaataaattttagtggaattttcagagcacaaataataattgaaaagaaataaacaaagtggaaaaggtttataaaaaaagaaaatcctaaaagaagttctttttcccccccccttccctcttgggccggctcggcccacttctccctccctctctctctctcctcccccgcggcccatcggcctccccgcgcgcgcgcaccgctgacaggcgggcccgcccgccactctcgctgacgggtggggcccacctgtcatcgccctcctcccgccgcgcccgccgccagcgcccggtgccctagcgccgccgccgccgcgaatcccgccgctcccgtccgccccgagtgcaatcaagagggggaaattaatccccgcgttcccctcccccgttcccccctctttcccctctctctctccctcggattcgttcgaatcaagcccgtaatcgtcgccggcgcaatcaatggagccgaatcttccgcgcgcaattcctctctctccggccgctctttccttcccccggcgctatttaaaccctccccgagctccgctctttcgtttccgccgctcgccgctcgctctcgccg

SEQ ID NO: 12271 - DNA, 8872 bp, Oryza sativa
cagcatatcttctaggatctgatttagacgctcggtctgtccatctgtctgcgggtgatacgcggtgctgaaatttaatcgggtaccaagctcttcttggagcttcttccaaaagtgagaggtgaattggcttcccctatcagatacgattttcttgggaacgccatggagactcacgatcctagcgaagtagagctcggctagtttgttccctccatacgtggtcttcaccggaataaatcgagctaccttggttaatcgatccacaactacccatatagaatcatatccgccttgggtttttggaagtccggtgatgaaatccatcccaatctcatcccatttccattctggtacttggagaggttggaggagtccggccggtcgttggtgttctgccttgacacgctggcacacatcacacagagccacgaactctgcaatttcccgcttcatgctaacccaccagtatttctccttcaagtctaagtacatcttcgtactgccagggtggattgaataaggacttttgtgagcttcctgaagtatcagctgtttaagttctctattatctggaacgcatacccgatttccgttccatagggttccgtgttcatcctctgtgaaaccaacagctttaccctgtttcatattcttgaggagtccatgcatatccggatcattcttctgagcctcgcgaatttgatcgagcaaggtgggcttggcttccaacgcagccaaaaatccgcgactaactatgcttaggttcagagcttccatctgttggttaagttcgggtggaatgcctcgggcggtaagagtgttgcaatggcttttccgacttagagcgtcggcaaccacgttggccttaccaggatgatagtgaattcccacatcataatccttgatgagttctaaccatctcctttgccgaagattcagatctgactgagtgaagatgtatttcaaactcttatgatcagtatatatttcacagcggttcccaatgagatagtgccgccagatttttagagcatgaaccaccgctgctaactccaaatcatgtgtagggtagttgccttcatgaggtcgtagctggcgtgaggcataggctaccacatgaccgtcctgcatgagtacgcaccccaatccttggcgcgaagcatcacagtacaccatgaaatccttgcgagtatccggcaagattaacactggcgaggaaaccagcttttccttgagagtttgaaacgccttctcgcattgcgggctccacacaaatttctcttctttcttcaacaactgtgtcatgggtcgagcgattttggagaagttctcgatgaacctccggtagtatcctgccaaacctaagaaactgcgaatctgagtgactgtcttaggttgcttccaatcggtgacggcggtcactgtttcggggtccacagcaactcctttagcagatatcacgtgccccaagaatttgacttcggacaaccagaactcacacttgctaagcttggcatacaattgatgttcccgcaactttcccaacaccagacggagatggtgctgatggtcttcctctgattgtgagtatatcagaatgtcatcgatgaaaaccacaacgaacttatccaagtattccatgaacactttgttcatcaagttcatgaagaaggcaggagcattggttaagccgaacgacatcaccgtgaattcatacagtccatatcgcgtagtgaatgcggtcttcggaatatcttcttcacgaatacgtaattggtgatatccggaacgaagatcaatcttggagaatacagtggcacctttaagctgatcgaacagatcatcgatccggggaagagggtacttgtttttgatggtgacttcattgagagctctgtagtcgacgcacatcctcttcgttttgtctttcttctccacaaaaatcacaggagcaccccatggggaagtactcggacgtatgtaccccttttctttcaactcttccaactgtttctttacttcggccagttcatttgctgccatacggtagggtcgcttgtgcagaggagtggttcctggaacaagatctatccggaactcaatctctcgcttgggcggcataccaggtagttcttccggaaacacgtctccgaactctctgacgatggggatttctgacagttctatctgatgcagttctgaacttctgacagaggttggaggtgcaaagaaaacaaccggctgttccggtcctcagtacagagtgacagtgcgtgtagcccaatccactactccttgaaattgagcccaaccactgattgccaaggatcacatccaagttctttgtgtctagaagaatcaggtcttatggaaaaggaatcccctgaatttctatagggacggcagggctatagtattttgctgtcataacccctccaggggtggtgatgagcagagggtttctaagcctttctacccccaactgatttttccccacgaatggcacagatataaacgagtgggaagctccagagtcgaacaaaatagtagcagggatggaatgaacgaggaacgtaccaacgatgacgtcgggagttgtcagcacgtcctcggccgtcacgtgattcacacgaccacggatgacgtccttgccaccgttgttggagcggggaggcgcttggccttgctgacgccttggctttgggcatttatccgcaaagtgcccgggctcgaaacagttgaagcacagacgctgctgaccttgagcgtccctgcggccttgaacaggcggcacagctggcgtaggaggacggggcgcacgagtcccttgctgattctgctgctgctgcggctgtgggacgcgcaccacgaactgaggtcggggcgctgggcgaggttgctgctgctgttgttgctgctgcgaggaggatccccctgggtagggattggtgtagcgaaccctctggttagcaccctgttgattgcggaaattcgccaagcggcgcttgtgcgattccagctccttgtgcttggcttccaagcggatgctcttgtccaccagtcgttggaagtccgggtagtccccagagactagacgaacggacagctcggggtccattcctgccaggaacttctcttgtttctcctcatcttcccgcacatcctccggagcgtaacgggctagattgttgaactcatgcaaatactccatcacggagcggttgccttgcttcaactcccggaattcccttttcttaagagccacgactccagcgggcacatgggttctccggaaagcggcggtgaagcgggcccaagtaatcggctgcccctctggctgcgcagcctggaaatggtcccaccatagagatgcgggtccctgcaactgatgggcggcgaagacgactttctcctcgtcactgcactgcaccgtgtctagcttcttccccacggcatgcaaccaatccaacgcatctacgggattgttggagctagagaaggtgggtgggcggatgcggagaaactcggcgagtttggagtgttggggaggtggtggtggagcattctgttgtggtggattttggaggtggtggaggaaagcattcatcatgttggcttgctgggcgaggatctgggtgagaatggcgttggtgtctggtggtggtggtggaggtgggttgccttgggggttggggttgctgccttcgggttggttgccttcaccggtgttaacatttctcctggtcgtcaccatctgaaaactccacacggaaccagcaaacagagagagctgacaattaaaactaaccacccacgactaccattatttcttaaatttatcactgctattaaattggttcattaaggttcaagttgcttaggcaaataaaataagacaggctccgacacagttatgccacacaccgacataaccatgccccacacaactcaagaagacaaacgaggaaaaactgtcacgaccggaaataacccaacgggctttcctgacgtgcgtgcattaatccttgtcccaggaggcaaggtacaccaaaagttgatacaaatcagagtttaacaagcggaagcgtatataaaattattacatgggcaacgaaggcccagcacactcaaagacaacgaaaaacagcggaagactagggcgaagaccacaggcgcttgacggcaggcacgagctagacaccgaagccttcatcttcaaggagctcctcttctgggcttgggaaaattaagcaagactgagtacaaccaccgtactcaacaagacacacccacaaatgcagaataaatgcaagggagtacaagggaattataatataaagggttagagttgcagtaaacagcatttaaagacatttagttgctcagggctattttgtaaacacgatcttagtactatacaatgttattaatcaaggccgtgaaccctcacgaacctgccttaacccaaggcctacgatgattcagaccgaactggcaacccgacctgggtcccagctcgtcccaagccaacccaggccaaccattccacattttagttgttgagcaaattttaagaattataacactgacttgggtacattgctaggcttgcccatatccgagggctcggctattcgaatagatttactctgatcagaggtgtacatctttacccacaagacacatcttcctcacgtgttgccacgtgccacataccaccacggtatacggacggaagacgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtgtgtccaattccaacataagccaaccattccatagtgtccaaatgacatgagaattcccaaagtctaaagttgtaaaacctcctaatgttacctaattaaattgcgaagcatctacctagaattaaactagtggtgtcatgagtagagtgtccactagttggggttttgtttgatctagggtgaacaaggtaataataataacaataacaataataatatggtcataaccaaaggtaaataggcatggctaaataaaacaatgataacgcgggaatttaaataaagcgataatgcaataatttaaatcaacataattttataaactgggattcaatatgatcaagatgatgtgtcttgccttgctcgttttcccaatcgacggcttcgacttccacgaagagcggatcttccgaagctgcggcgtctacacgaccaacggaaaagaaaaaggcattaacactaaataactccacataacagcagaaacaaagcacaaaaatgggttctttgcatcttaagggaaaattagagacttgaacggtccaattccgagttcaaatggccaagatatggccatttgaagtttatatgctctttaaatggatatttgcgaatttcttcatttaatttttaattaaaaatcctatttattgcgtcagccgaggggcgggcgcgcggaccgggtccacgggaagtggggcccacgcgtcagccgctcggtccacggtggaccgggcgcacgcggctggcggcggtcggcgccgtgggtcccacgcgtcagccgcacccgcgggcgcgggcggctgacagccgggcccacttggcagccgcgagggcgcgcccgaaggcggcctcgccggcgcggccgacgggagcggtgcgcccgcgccccgatggtcaccgccggcgaccaccggcgcggcggagcggcacacgagagagaggagggaagggggaagcgaacggcggtccacggctcaccccgggacaacgacgacgacgagaacggcggccggaacggaggaaggcggcggcgcggctcgggacgacgaggacgacggtgctccggcggtcggcggacgaagcggagcggcggacggagtcggcggcaacacggcgaagcggatggagatgacgccgagtaaggtggaggtccggagcggcgacggcggcggaacggagttcggcggcgacggcggagagagaggggcacggcgcgagcacaattccgacggcgagagcgagcggtgagcggcggaaacggaggagcggagctcgggcaacgtttttatagcgtcgggagggagagagggcggccggggaggaaggaaaccggccgcggagatctcggccgccattgatgcgccggcgacgattgcgggcacgattcgaacgaatccgagggggagagagaggggaaaacgggggaaacgggagagggaatcacggggagtgattcccctctctttaatgcgcgcggggacggcgggatgcggcgcaatccgcggcggcggcggcgctagggcacgggcgcggcggcgggcgcggcgggaggaaggcgatgacaggtgggccccacccgtcagcgagagtggcgggcgggcccgcctgtcagcggtgcgcgcgcgcggggaggccgatgggccgcgggggaggagagagagagagggagggagaagtgggccgagccggcccaagagggaaggggggggggaaaaagaacttcttttaggattttctttttttataaaccttttccactttgtttatttcttttcaattattatttgtgctctgaaaattcctctaaaatttatttaagcattttaggcttttaggaaatatacaaaaatcctccaagcctcatttgacttttatctttgcacattttaattgttggaggctttcacattgaattttacttattcttttgcacaatttcgaggatagattttagggtcgatttgggacgcgacaaaaacacacgcgcaagcctactaactgctcgtctaccgctgcgacgggccagggcggaaggtgagcaacagcgcaccctccgagctaccaacgccggaggcttccccctcctggggaaccacgggcgcaggctcggcacgaggggtctcgacgaagcaggtccacgccagggactgacgaacaagctcgggcctggaggtgctcttgcgggcggtgatcttctggctgcggcagacgcggcgacgcttggggcggcagatctctccctgggcgaccttgagctgatgcagctgcgcctccaacgcgtcgaggtccttcttgagctgcaggttctcctgacgcagctccaggatcttcaggttgttctccaccatgccacgacgcaccatctggtggaagtcgatacgagccgcgtcgtacgcctccaccatgcgtgccagatgcacgacggtagcgtcatcctccgagctggcgtctcggaaggtggcgtagtcgcaagctcctccgcgacgagggtggtagcggtagggcgagtgctgcaactcgtccgggtagcgctggtgaagggtgccgatggcgaggagagcggcgttctggcaagcggcggggaaggaatccccacccgcggtgactgccagcgaagtccgctcgggagagccggagaggatcactgcagtgacctcccaaccagcgtgaggctctgcatcctcaccctcctgctccgggagcggcctggcctggtaatccactccatgtggataccccaagaccacgcacatgcctcgcagctccaagacgaagccagtcatgtgcaaaccacgacgggtgacgctgccggccatctaaaaacaaagaaaagaaaagcaacattttcaaagatcagattttgacgataaatgaagcagcaagacaaagagagaatagcgggttttcacaaataataaaggatttttatttttgaaaatatagctaaggcttgggatctacggcttgtcctagggtcaagggaggctctgataccaacttgtcacgaccggaaatcacccaacaggcgttcctgacgtgcgtgtattattccttgtcccaggaggcaaggtacaccaaaagttgatacaatacagagtttaacaagcggaagcgtatataaaattattacacgggcaacgaaggcccagcacactcagagacaacgaaaaacagcggaagactagggcgacgaccacaggcgcttgacggcaggcacgagctagacaccaaagccttcatcttcagggaactcctcatctgggcttgggaaaattaagcaagactgagtacaaccaccgtactcaacaagacacacccgcaaatgcagaataaatgcaagggagtacaagggaattataatataaagggttagggttgcagtaaacagcatttaaagacatttagttgctcaaggccattttgcaaacacgaatctagaacaaagttattaatcaaggccgtgaacccacacgaacctgccttaacccaaggcctatgatgattcagaccgaactggcaacccgaccctgggtcccagctcgtcccaagccaacccaggccaaccattccatattttagttgttaagcaagttttaagaattaaaacactaacttgggtacattgctcggcttgcccataaccgagggctcggctattcgaatagattatactctgatcagaggtgtacatcttttacccacaagacacat

SEQ ID NO: 12272 - DNA, 20035 bp, Oryza sativa
cgggcgcgcggaccgggtccacggggtgtggggcccacccgtcagccgctcggtccacggtggaccgggcgcacgcggctggcggcggtcggcgccgtgggtcccgcgcgtcagccgcacccgcgggcgcgggcggctgacggccgggcccacttggcagccgcgagagcgcgcccgagggcggcctcgccggcgcggccgacgggagcggcgcgcacccgcgccccgatggtcgccgccggcgaccaacggcgcggcggagtggcacccgagagagaggagggaagggggaaagcgaacggcggtcttcggctcaccccgggacaacgacgacgacgagaacggcggccggagcggaggaagacggcggcgcggttcgggatgacgatgacgacggtgctccggcggtcggcgggcgaagcggaggcgcggacggagtcggcaaccactcggcgaagcggacggaggggtcgccgagtcggaaggaggaccggagcgacgtcggcggcgaaccgaaggtcgacggcgacggcggagagagaggagcacggcgcgagcacgaatccgacggcgagagcgagcggcgagcggcggaaacggaagagcggagctcggggagcaattatatagcaacgggagggagagagtgtggccggagagagaggaaacgggcgcggagatctcggctccattgaatacgccggcgaggtttgcgggattgattccgagcgaatccaagggagagagagaggggaaagagggggaatcgggagaggggattgcggggaatgattcccctctctttaatgcgcgcggggacggcgggatgcggcgcaatccgcggcggcggcggcgctagggcacggacgcggcggcgggcgcggcgggaggagggagatgacaggtgggccccaccggtcagcgagagtggcgggcgggcccgcctgtcagcggcgcgcgcgcgcgcggggagccgatgggccggggggagagagagagagagagggagggaatgggccgagccggcccaagaagggaggatgagggggaaaagacttcttttagggttttctttttataaaacctttttaactttgtttatttgttttcacttattatttgtgctctgaaaattcctctaaaatttgtttaagcattttaggcttttaggaaatatacaaaaatcctccaagcttcatttgacttttatctttgcacattttaattgttggaggctttcacatgaattttaattattctttgcacaatttcgaggatgaattttagagtcgttttgggacgcgacaataggtgccagccggctcttgataaagtgtcgagtgatttgttccccttgtagaccttgctctttgagtttcaacatgcgttccaacaagataagcgcttgagaagcctcgtctcccattggaagcgaattctaggtgtcttgatatgctggaggaaggcaggagtactcgggaagtgatggttcaggattctgtacatagaaccagtttgcatgccagcccttgtttgatgttttgaaaggcatgtagaaatatttttggctcagggttccccttaagtgaaaatcggctcccccaacaacgcacggcttgctcttgtttggttgaggcttcacgaagaaaatgcggcggaataaagcaaaatgcggcctaattcccagaaaagcctcgcaggcatggataaagttggcaatatgaactatggaattgggatttagatgatgcaagctgattccatagaattccagaatccccctaaagaacttcgaagttggaagagaaaaaccaccatagaagaagtgggagaatacaatgacctcgtgtgtgtcaggggtcgggaatgcttcgccgatgatctctttcgccggaagaacgccgtgcgccaccatttccttcaagttttcttccgtgacatcggaaggagcccattgactctcaaagcattctctctcctccgccatggatgcaagatggatgatgaaatctagcgtgagtgtggtagtgattggagagggatcgatgcggtagttgtgtggaagatcttcgcaaaaacactaggctttgggaaggtggattggtgcggatttgcaaaccctagttttcgccggtgcagttcttgtactgtagcacagaatggggaaagtggcggaggtctcggcagggaagacgaagcgacgctcgttccgtgttttttgttagggtatcgggaggtactaatgggcctaggcctgcacagtgctttcagcccaacttcactattagcatggctggttatgttccctagggatttaagcatatatttttgcccttggtaaaaattgctcacaacaggacagcccaatgctgttaaaatcctttttgatgcagctagataattctttggaattactacaatgcgaaataaaaaggtgcccggcagaaaagtgtaatgctaattttgttgacctttttaggttgcaaagctgcttgggttttatagagatggttaatttcagatggctattctctcaacatgttatatgcttattttgatattgacataagtcacagtttaggctattttgacttgtcatttgtcattctttataaaacagttgatgaatcttttaagagttttttgctcggattcttgtcatatatgttgatttatagatctttggagtgcttttcattggatctctttatgcctttttgggcgtattatggctaaagcagtcggttggatattttatcaagtgctgcatgagcttaagtatataatccctaaagtgatccggttataaaatctctcggatggatgtttaatgtaccttgactatatgtttagtttttattcaactaatcacatagtcggagggctacacctaattaggtgcatctagtcgatgcacctgattttttatttttagcccttcacagtctttgattttagtactcgggagaccaaggcaggagaagttgaagcactcggattatcgttttggattacgagaaaagactatttcgtcgactgtaaaggtctcaggggctactgtggagattatggataccccatacacacggcatgtatatccgactgggtatgggggtaccatgtatagatagaatatctttaaagggtttcgggttaaattcctaaacttgtatatcaagtaagcacccgggattttagtcggttatgattctatcttatctataactgcatattccgttaggaatatgggctgtactttgtaatacggactccttcccctatataaggagaggtccgggtgcctcttggggcacgattttttctcttagatcatacgatcaataatatactccgcagatcaatccccggacaagaagggtattacttcttattaagaaggcctgaacctgtataaaatttcttgtctctaaacacatccactttttcagcttgatagccaccccttttagtattgccgaaatatttgtttcgacaccgagcggcggcgtgaagatgggaaaagtggtggacagcttcagggagagagtttgagaaaggaagaaacgagagagcgagagtgcttatcccgtctgttttttttttctttttcccaccctgtctttcctgtctcttcttttacctgcctgctttgcgtctttttttttttgcctgttttattactacttcctctgttcaaatatttttaaaaatttattatatttgtagttttcatcgttaagttgtataatacttacacgttaatattttttttaattttttaaatacaaatttacgatggtaaaaaaaagttccgcgagacacgatatattagaatatgtgctctatctatcatttatggatcacatgacatgtcccaacacaagtacacatacgattttgaaagcgatatcacacacttgccacacaagagttgagagacactagcgatggagctgtcgtgggcctgtgactcacttcacgcataggataggataattattactgagacgtgcacaagatggactacaaagttcttggcgtcaatcaaaacggtcgcctcaatggtacggcgcgacatccaggtcaggtgcatcatgcatgccatgtcgcatatgacactgagccaccttgcccagttgaggaacctcatagcggtgagcgacacgttagggaaaagtagcgaggtagaccggcaaggtggcaccacggccaaaactggacgggtggagtccacccgaggcacggacaacaaaaaccataattttttagtgtcctataacaaattttgtctttaaatactttttttggttaatcatataaattatcgtctatttcctcttacgtgaaaatgatccagaaattcaccattttgtttcctcccatgctacaatcataacactaacatgtcaggggcatcattcatatcatgctacaatcataacactatcatgtcaggggcatcattcatatcatacacgtcaagagtggaataattgtccaaaataaaaataactattgtgattattatacaagccacatatgcttattgtcacactatgtgttttggaaaaatcgttgagatcaactttatccgcccaaacattacccgtgcaacgcacggccattttactagcaaaattcccgtgctttgctatggtgtattgaactaaaaaatatttgtttttaagcgaagttattttcacactgttttgatacttttgctcgctagaaaaagtctcaaatgatagatcataataaattattattcaatagtgcgttgcaacgggaaaaattaatgttattaacttagtaaagtaataaaaaaagaaacatccgcgttagctcttatagtctaaaaattctcatattaatattatttaattttagtctaaatttaaattctatatcatgacaaataaataattacatttttagtcgaaaaataaatccatatcatgagaaaaatctagccaaatttttagttcattcaatttagttggaattaaattaataagcagtaataaacaattaaaatggtactaatgctatttctgaaaatagaaagatgcttattattgagagagaaaacactaattttatcccggcctaaacttgcaggcccatttggaggcccaatagtgcggcggctcaatgcgagagaagctgaagccatccgatcgaatggacggtccagattgatcccaacctatataaatatctgcagccaaaaccctaaccctaaatttcatttcctccccacccccgataccctctcgattgatcgaaaagcgacggtggcgccccatctcacctccctctccctctcgcagtggcggtgggttggcggcggacgcatgcggacccgaggatggtggcggcgtcgacggcaagtgcgggcggatccggcggcggcggctccctccgccccctctcgcctccctcccgcggcagatccggcggcggtggcagtgtcggcggctagatccgtcggtggtggcggtaaccgcgggcagatctggctactatatttccctctgtcatttgagactttttctagcgagcaaaagtaccaaagtagtgtaaaaataacttcagttaaaaacaaatatttttagttttaatacaccgtacaaaacacgagcattttactagtaagattaagatatatagaagtgatgtgaaagagtcgaaatttcaggactcacttgcaaagattgaggatgaagacttggccctcctctctccatctctctcgactccggcgaggcggcgacacctccccagtccccaacactcgagtattgcggttaataaaaattatcaccccattccggattggtttcatgctcttttgcagatcacattcacaggaacacataatggaaagaagcaagatggtatgcatattgactaattcagcacttgcatatctaaagatccatcttatagaagtaagacggtattacacgcttaataacaagtccactgggcatttcaactaccccggcaagtaagcaccaacaaaataaactcgataataattcaaataacatgatcttacatccatccatgtaattaaagctgaagcagcaacagcatggagtactatgcctcatggcataaaaaatgagtctggcagttaaatcagcacaatatgtgccaagaaatcaaaaggggaaaaagaaatactaacaaggaccccaaggccccaacaaaagacaaacttgccatgaaaataatgagaaaagaatagctgaatatagccgttttctactaccatgtaaagcagaggaaaagagtccaaagcatctgtaaatcaaatctaaaaggacttataaaatcactctatgtgacggtttgcacaatttaaataaacacgaagggtaaagctagtaccaattctaagtaacattcggacgataagcacatcaacataatggcaagcaagcacagctgagaaaagatgcatggggcatgacatatataagacagtatgatttagtaaccgttaagtaacagatgttttcttgagtgaaccaaaatcaacaagcaaccacatataggttgacagctgatgacaaattagaggttgtttcaacatttgtgttcatcatctgatttcataacggtggcggcaacaatataaaacctaaagagtcagcttgcaaaacagcaagacggcacgaagaatacgatccctaccctaccaagtaagcagcagcctggcaaaatgaagtctgctccagcatcacgagccgtccactgttgtcaagcaaaataaactagaagttagaaggatggcaatttcatgctagctgcttttattcctcagagcaatttaaatggcacaactagcagtacaatactaattaacaacaaatcagtaagtataggtcacaccaattgaagctaaattaatcatctcatctacagaagcttattcctcagagtatcttaaatggcacaactagcaatatagttataataattaacaaacaaatgagaaagtatgggtcacaccagttgaagctaaattaatcatctatccttattcttcagagtatcttaaatggcagtgtggcacaactagcagtatatttataacaattaacaacaaatcagtaaagcatggatcacagcagttgaagctaaataaatcatcatctcatcgacagactgcagaagcttatagcggtagaattacctgacctcatcatctcatcgacagactgcagaagcttatagcggtagaattacctgacaaagatgtcactacggtaatgacgacctcctcctcttggttgcaattgggcgtccctgtgtcttggctggaacagactcagcagcaatagggcgaagagacagattctgaaggtctttggaaagatccaaacccaaaggaggaacaatgtcatcagggcaggatgagagggtcaaggacgagaggagcttcttgctgtgcatgttaaggctgaccatgtacagctctgcatcggcatcgttgagcatgaaactaaggacaccatcttcctgagggttcaggacagggctaattggtatggccttgggcaacctcgccttgtcgaagccctccagctcccacagatctgccaccatgagttgtgcatctttcagccactccccggttgcgagggtcagtgtccacatcgttatcgcacgatcgccggtgtgcgcagagctggatccgccgtcactgatgcagacgaacttgatagagtcaccgcagccgtcgacacagctcattgtgcggcatagctggaggtcacccctcatggcgaaactgattttaagatggcactctacaggcagcgggatgtagcggaattgcacggcatcatcattgcggccggagagagcatcgtcgcacctacagaagaggacgccctttgcgaggtcggcccagaacgcgtggcctccgaacgagaacaccttgtcaccgtggaaggaacccggcatctgtgatgggaagatggcgtccttgaattgccatggcgtgatgccccccctggaacttgaggatgatgatggccgcggtgggcacaggcagagaacatcccggtagacgtctcgccccgcttccatgtcaaaccgcatgtccttagccacgatggccagcgagtagctgctgcgcagcgcgtagccaccggcggcggcggtgcgcagggggagaggccgcatgctgcagtaggtgaggcaggactcgggcaggcccgggatcatggagagcgacttgccgacgacgtcgtagacgaggtagcagctgcagccatcccggaagcacgaggtgagggcgatgaggccgtcgcctgccgcctcgacgtaggtgagcggcgggtcgtcgtacggtgacgcgtcgggcaagttggggatgggcgggacggcggcgccgggggggaagctggccggcggcggcctgggcacggcggcggcggcggagaggcggatggagagctcggagagacccgggggctccgcgaggcgcgccaggagcagcatgcccttcaccctagcggcgttcctggggtagcgtttgtcaccggggtggcacccgtacgacttccagtccgcgcactccatggccgcccactccgactcctcctcgacggcttcctcctccgatcgaacgatgcgatccagaagaacataggaaggtagtacagttcttcccatggcagccatggaaggcggaggggatcggagtttaggttaaggattgggggaggaggcggaggggatttttcttttcttttcttttctttttttctctttttgattcgaaggctccggggatatgacttcttctgagcgaacgatactcgcgtgttgtaggtatagatggccaaaacaggcgcggggccgatgacccggcccacagtacggggtttcggctcggctcgactggtgtcaagcctgtgctgatccgtctgaccgttgagttgtgtctgggcctctgcctacgtaaggtgggtcggcccggcacgatacggttcaacgatcaggaggcaaaacagttgaggatacaaagtagacttatttcaaccatataaaatactacaacccaaagaaggagcacgatggactatcttatcttctggtcagcccgagtcttattaggtcgtgcctagaccgttgatgcagcctatgggcaggcacgacccaacacggtgtgtaggttgggccgtgccggcccgactgatcttgggctcaagcctagtcgtgcccgggccgggccaagctaggacaggtgggccatttggccatctatagtttggggcttggaagagaaagataacatagattcgttagttgcatggcgactcggatcgtggcttcatccaacgtctgatgtctagcaccaacaaacacaacgggagaatgaccccgggactcggtgcactatgcttttaatatggactatggcttatttcttaatatcatattttttatgcaacattgtggatgactaatagtttcatgtcaagaagatgggggtgggaatctcctggcctgctgctgctgcatcatgatatacgatcacccgtgaaccagagacgcactgcatctgctcactaaaagaggtgtttcgtcactccatcgtgttttccttgtggagataaagagacgatacgggtgtgggtggagatgggccgaaagcaacattttaagtctaataagcaaaagctagatggataaatgtcatatgaatgaaattgaatggattgggtgaatagacgaaatcaaacgatacaataagtgtaattctcaaaagtataatttatactgtaagaacctaatcttagaaatattataagaactagcaaaaatgcccatgcgttacaacgggtgaaaaaattctaataataatatacgtttttcatgcataatcatgttaatgacaatgtttgtattttgatgagcggcttgtttttttataaacagtgtttttcttcttgcgcgattttctcaaactatttttcagaaatggcgcatttctttctaatagttttttcctagcatgttttttttctttttttaatgacgatgaaaaccatatttttctccccttttttttgcttttattttctcgtgtgttttttgcatgttttttctaacaatcattttctcgcgcgcttttttcttgtctttttgttaaatgttcttttttgctttttttttcaatacatgacaatatgtgacgaaataatagccgtgtagtagatggcaaaaaatcgatggattctatctgactcaagcgtccatcaatttagtgttttttctgacagttttttcagagcgatttgtttttaatagatggtgcttttttttcttgcgcggttttttcaaactatttttttagaaatggcgcgcttttttacagctttttcctcgcatgttttttttaaaaaaaaaattttaccggcgatggaaataattattctcgcgcgtttttttgttttatggaagatgtaaaacctttttagcgtgtttttttgcgcttttttctaacttttttctcacgcgttttttgaacagtttttattttctcatgcattttctatttttagattagattagagatagagaagagatatatactgattagaaatcggactttgtttcgccctttccattttttttctcacgtgcattttttattttatacaaaccagcttcttattttttacgaaccatttttttcgccacttctttaagggaatcggacagacttttttagatgttttttttggatttttttcgcctttaaaggaatcactttttttctcttttttcttttttaaaggaattagatctagcgtttttttttcaccacttttttttgccttttatagtaatcgatttttttccattcggatctacgcttttttttcacttagggaaacagacttttgttgttattgtttttctttttttgtgcggcttttatttttctttttatgcacctttctgcctttgttctctcacttttatcatttttttaacaaaaacaacctcaagaaccttattgcaaagattatagggactcaaatgtaaatataaaaattacagggactcgaatgcaaaagtacaaatccaaaaattaaaattatataaaaatggaatgctctcgacctgtagattccatttttgcaaataaatcttcaatccggcacatcaattttttttaccaagatgtataggatatcatgatatagattgaaacgtgcctgggatctcggactcaaaccgagaggaatagtgcctttttttttctttttaagggggaatcggatatagagtcggacttttttttaatgagaggaatatgagtcaggccagaggaataggagtcggacctttttttattattattttttctctatttttgagtcggactttttttttattttttcgctattttttgatgggcgaaggaagcatctcttattttgggatctcggacttaaaccgagaggaatggtgccttttattttttctttttaagggggaatcggatatagagtcggactttttttttatgagaggaataggagtcggacctttttttattattttttcgctatctttgagtcggaccttttttttaattttttcgttattttttttgacggacgaaggaagcatctcttattttttttaaaagtatatataagtagagatagagattaattcaactaaagtaaaaaaatccccaatttcaaatagaccgaaatgcatgtgtcatgaattgttcgcatcttttgtgttctatctagattcaaatgaacatttgtaaattttccgctggagtagtttttacattttaaacgagtgttattcgaacaacagtttttatggcaattttgcaattgcaatggcgattcaaaaaaaacggcaaattacaattaccccaaatcatatactcctaccgtaattaaccaacatagaaaggggaattaaatcaaaagagccttcgcgctgcagcccgcgacgcctccgcctccgtctccgtcgccaccaccgcctccgcctccaaaaccctaaccctagctcgccgccttcgcgcgagctctcctccatggagaaccccaggccacaggctcctgcggggacccctcccatggctcccctccccgtgcccccgcccatcgcccccatccctgccccgcctccgcgagccccagcacccgccccggccgccgccgccgccgtcgcctcgacctccgcggcgggaggaggcggcgggggcggcggtgaggctgactacgaggtctccgatgaccaccgcgccgcgcgggagcgccacgagcgcgcggtgcaggagctgctccagcgccgccgcgccttcgccatggccgtgcccaccaacgactccgccgtgcgggcgcgcctccgccgcctcggcgagcccgtcacgctcttcggcgagcgcgagatggagcgccgggaccgcctccgcgctctcatggtccgcctcgaggccgacggccacctcgaccgcctcctccgcgcgcaggaggaggagcagggcgccgcgggcgccgaagaggaggaggagcagatccagtaccccttcttcaccgagggcacgcaggagcttctcaaggcgcgcgtcgacatcgcgcagtactcgctgccccgagccaaggccaggatagagcgggccaagcgctgccatgacgaccccgacgaggaccctgaggcagaggccaaccttgtcgttaagcaggcggaggatttcgtgcttgagtgcagcgagattggagatgaccgccccctcaccggctgctccttctctcgagatttttcaatgctcgctacaaggtacggccacttaatcaaacggaatagcgtagggttttatctttgtatgtcttaaaatagtggaatgatttgctcgccgaagtgttgcaatcgtcttattaggtcaattgttaatatgggtttggtaacttgcttaacttgtcccagtttagcatatcaattgagtaaaagctgttctaagtttgggattggcaatgactgaaaacactctgaattgctgctatatatggcagatggccgtgtttcttcacatttacactgctgctgcatagaaccatgctgttctgcttcagcatttctgtcatgattgctttgcgttgaaccaggtgcagctagcactcgttcaaaattgcaatcacaatagttcatcatggcgtgatatcggctggatgaatcaacaaatttttttatggctgtatgatttatagaactagctagcggctcatgtttgggcagctagaatttccttccattgagcagatggaggatggtatcatgcttatcggctagcactattttgagcaggctggtcttcacatttgcaggattgcctgtaacagaactattgcggtgttccaaaatacactaggtgggtggcatggtagcatctggctccttctcgcatacagggtatcttcacaatagtggagtatccctgatgattttcaattgtgatgctaattgaatttcataggagttcatatacacattgtttttggaagggaagttcatgcacgcttaggctgcatttgcttcaacatttcatcagattggccaatttcctaacctgaaaagacactcgattagatcatgattaattaagtattacctattataaacttgaaaatagatttatttgaatttttaaataaacttctatatagaaagtttctttcaaaaatcacaccgtttagcggcttgggaagcgtgcccgcgttaatctggtgctagtagctgaaaagaacatagccttagtaattttggtaaactaattgttgatgtcatgttgttggatacctttttccttaatcttgagcctcaattagcttatgttctcttgttcttggccttaacttatgttttcttgttcttgcttccttgtcagtaaataatgactttatttctgtgttttttagttcatggagtgggatgatcaaagtgtggagtatgccacaagtaactaaaattgcaactctgaaaggtcacacagaacgtgcaactgatgttgcgttttcaccagttgacgactgcttagcaacagcttcagctgataaaactgccaaactatggaagaccgatgggtcactcttattgtcctttgatggtcacctcgatcggcttgctcgccttgcttttcatccatctggtaccttgctacaacaagccagctttgacaaaacctggagattgtgggacgttagcactggaaaggaacttctactccaagaagggcacagcagaagtgtctatggagttagctttcacccagatggttctttagctgcatcttgtggtcttgatgcgtatgctcgagtttgggatttaagatcaggaagattgtggggcacactcatgggacatgtgaagcctgtaagttcatagcatcaattttccaatctttttctaaagtactgtaccattcatttcaagctgttacggctctttattgcttggtttgtggttacatttatttagttgtggacatgctattgcttttttatattgtaacatgattttactttcttttcaggtcttaggagtgagcttctcccctaatggttatctggttgcaactggaagtgaagacaatttctgtcgaatatgggatttgaggactaaaagaatgttatattctataccagcacataagagtcttatctcacatgtcaagtttgaaccccaggaaggctattatttggcaacttcgtcctatgacaccaaagcagcagtatgcctaataataatgcgccatttattttatttcttttattgtctcatttctgatattcttccttccttttgcagctgtggtcagctcgtgattacaaaccaatcaagagtttggtggcccatgagtcaaaggttactagtttggatattagtggaggtaaccacttgcttaagtgccttttatctttgctgtatgtgaaattatatttggatatccttttcttgtgagaattgagatcaatagttttagccctttttatctgtccattcctcatatcaagttggacatccaccatttggttatgctaaaacaaattcccatgtatagtgcacttggattttcttagccaatatcaacactctcatctctgaactaactgcagttgttagagcagtgatgctgctaaaaacggttcaaaccaaacctatttgtctgtattacttttagaaccttatagatctatgctattctatggtgcactttcatcgtataaaattgcatatcatgcatttcccaccatttgtttgtttgtccttaatggcatacccatcttgtttctttaatcctttgttgaaaatggtatctgccagttgtacgttctgattgttctttccatctctattctccctcaacttgtttcttgcaaaatgtatcagcttttgatccttattcctaacagatgccctagtaaactctagggatcggtacattaggtggcgttgttgtctcattcttcattttccttttcaagattgtgccgtattatcatgccatccacttgccacaagattcaaacatgtcatatctgaatttctaattggtggtttgtgtaaatcttgtgcagatggacagcagattgtgactgtgtcacatgatagaacgatcaagatttggtcctgcagaagcagggcacaagataatgccatggagctggactgaggcactgaattaacttgttagaagttgtcagcatctacatgaagccatcttgtagttgtagcacctcatagcccttagcctgtgaaatgtttcatatgtaactcttctacttgacgttgtagaaaatttacgatcgaacggcttaggggcgattacccctgtcctgggtttgcatccctggttttgaagttacaatggcatggatctaattaaccctagttttttttttatgccagtattgcttcacatcaggacgtaggttatacattcccacacttgtggaatcaatccttggaattgcaacaggctagatgcatttacgttctaatcaagataataatctcacaaggtctttacgttaaccactcttaacaattccgactagcaatactcaactagtcatgtatggtcaagcaatataattctgataatatattttggatggatgtgactagatttattatactagttatgtaacatccatccaaaatctcttatattatgggacagagagagtatatcttaatacgaatctaaaatcctttatattatagaatggagggggtatatctttggacgaaatatgaatttatcttttttttagataatggattatattaaacctgacctctacacgaaatatgaatctatctaggtataggtattgtcgtgttggagcaaaatcgtcgcccactgctgggcaaagcttccgtaaaaactgcatcagatgagattaacataagatgacagagccgtggatgtcggtctccaagtcggactcgggacggagtttttttttttttaatacgcaaaaggattgcgtacgggacggggttaattcgaaatcctaatccgactccgatgcgattacccctgcctcaaaccttcccccacccgcctccgcctatattaggttcgcgagtcgtcgtcatcgtcatcatcacctctctaattcacatcaaaagctctggagccatcatggcaaacgtctacgattctcaagcgcttggcccacacaagctggtcttcttctccgagatcgtggcctcgccgccgtcatccgccgcgccggccgtcacgctccggctgcttgtcctgatggcctaccgctcgtcgtacggtgacgacgacgacgacgacggcggcggcgacgtggacacgatggaggacgtttcctgccgcgtgccgctccgcgacctgacgatggcgcgtggcggcgacggcgaccatgttggcgctgtgcgggcggcggcggcggaacgggcgttcggggagctggtggccggcctcgagcacccgacgctgcgcccggaggtcgagaccgaggtccccaaggcggcggcgcgccgtcctgcgcggtgcgagggccgcgcggaggaagaggtcgccgagctcgagatccgcatgcacgtcgtgctcatcgcgcacgacgccccgcgggaggagggtgacggcgaggacgactagagcggcagcgacatggatttcagcgacgtgtgcggcagaaggggcgactggggcgacggcgacgacgccgacgccttcctcagcgacgacgatgacgacgagggggcgcagttcgcggcgcgcccgtacggcggcgccatgctgcgggagggcgggccgagcgacggcacgctgctgctgtcggggttcgcgacgcgctccgacgggccggagctcgacgaccagctcgagctgacgccgcgggacatccgccgcctggtgcgcatggcgctgaagggcaagaacgtggagcgcgacgaggcctaccagcgggcgctcgacggcggcacgcctgtgtcgccggaatcgctcgccgcgatgctcgaccaggcgctgcagtccgtgcgccagcagccgccgcagcagcagcagaactgccagaacacgacgcgagacggcggcgtggttcgccggatgcacacgggattctgacgccgatcgatcgatcgatccaccgcccgggatgaggcgcgagcgatgcgacgccaactagttttggttttgaatgttactgtcccaattttttgggggtcaggctgagtcaatctactattgtattgcgagagctctgatttcgtcagatctactatatttgagttggttgtaggaatttcagttggttgtaagcaaatacgcaagccttgttcaggttcaataattcaaatctatgtcaagcgcttccaaacattgttcattacgaatattgaccatgcttgcaatgcattttcaagaccacaaattcaaatattttgtataatgaagcaagggaaggttatttagtgctaaagattcgatgtgtaaatgtaagccatactcaatcaattgacccaattcatttacacatgcaaaactttgatcaaacttttctttctttaaaaaaatggaaatcgattagacatagcacatcgataatttattgaacatgagaggttggatgtagagcacacagtcaccacactgctgcttttaggaagcagataaaaggaaatcattgcttaaagtagacaagtgaaacaacaatgtagttgataaaaatgatatctgtacctcatcaattacgagtttgcaagctacttatatttcatatgctatggcatgaaaagaggttcaggtccgagatatacaaattacgcagacaaaatggccatgtcgagtgttcgtcgtgaaaaaactttgaaaccaggaaactagcagtttaaatacagtaatctaatacaaagaacaacaaatacaattcacaccagctcctgtgaaacaacgccgcatccaaacctacaatagctcatgaactgatcaatttggaaggaacaatgatccttcaattttgtatcacttgagaagagactccatggcttcgaagaagagagccaccatctccttgtttggagttttgaccgcacacttcacgccaggaacaccgactgcagcagtaagctctatcaggaaggggattccacgcggaatctttgcagacatgtacagaacatccttgtttgagtttttcctcttggcgataaagaacacatttgatgctgcaaggtgctcaacggtcgcatctatgctgctgacgacagaagaggggaactctttcgaaaattcgttgtcatcaggtaaagatttccaggcctgcaagagaatcatgagatttgttcagaaactctaaacaatccggggcaatccaagaaacagaaattcattgagttaattaaattgactactgttgtgaataatgcaatataatacatgttagcgtttttacctcaagaaaacttgttcgttccattttgccatcttcaccaaagaaggcatgcatagggattttgtcattgaagtaccacacaggttgctgattattcttcaccgcaacctgcagcagtgagcttggcgctccaggagagagattctggaatgccaccataggtagcagcgtcctggccgaggtcccaggttgcagtggagagaccttattcatagaataacaccacgttcagtacatgtaattgaatttcaaaaagaatgttttatacttataatatatagctggtacctgaagtgcaccaccggctgcaaggccaaaggtatttttgttaaactgaatcatgaatccatctagcacagtttgagtgccattatcaaaagatatatcatagaatatttggccatcacgccgcactagttgtgcgctgatctgcagtccttggccagtggttgatggcaacaaaacaggtagtggagggctgcaaaagggaagaacaagaaaagatgatatgatcaaaaacctgtcctagtcatacaaaatgattaaatgaatatgccacgagacaccttagcaaaaaccacaaaaatatactaaccctgaaggtgctgttggttcatcaacaggaacaatggagttatccatacccatcaaatcaccaaggaggtctggcattggagcaggagcagctggtgctgctggctgcttcactggaacattagaagaagtgccagcactagaggaaggtgatgccccatcaacaccctgagatggtgactccgaatatcctgtttcagctgtatcagcaaactcctcatcatcagccctaggagctgttttaacgcggctaacaaatgcttctggaggcttgtgataaactgatgaaagggtagaaatattggctagcagatcatctaggagagaagaatcaagctggttggaatcatcgctgtcacaggtttctctgccaaaactacatctttagctgcctgcaggacgccccacatatataaatggtaagagtgctatttaaccaagca

SEQ ID NO: 12273 - DNA, 728 bp, Oryza sativa
ccgaagagggaggaatcggccgcggagatctcggccgccattgatgacgccggcgaggattgcgggcgcgatttcggacgaatccgagggagagagagagggaaaaacgggggaaacgggagagggaatcacggggagtgatttccccctctttattgcgcgcggggacggcgggatgcggcggattcggcggcggcggcggcgctagggcacgggcgggcggcgggcgcggcgcgaggagggagatgacaggtgggtcccacccgtcagcgagagtggcgggcgggcccgcctgtcagcggcgcgcgcgcgcgggggaggccgatgggccgcggggagaggagagagggggagggaattgggccgagccggcccaagaaggaaaaggggggaaagaagacttcttttagggttttttctttttataaaaccatttcaactttgtttatttcttttccattattatttgtgctctgaaaattccactaaaatttatttacacattttaggcttttaggaaatatacaaaaatcctccaagcctcatttgacttttatctttgcacattttaattgttggaggctttcacatgaattttaattattctttgcacaatttcgaggatgaattttagagtcgttttgggacgcgacaataggtgccaccgggttttgataaagtgtcgagtgatttgttccccttgtagaccttgctctttgagtttcaac

SEQ ID NO: 12274 - DNA, 2455 bp, Oryza sativa
  unsure (1)..(2455): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctaagcaattatatatataacatttagctgaaccaaaccaatacataaggttcaagctaatcaatttattacccaaggtatcaaggaataggatattcaatgcaaattggccataacaaaggaattggttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgatcacttccgacgcactcacgaaccttcgcaacgacggaaacgacaagctaacacgcaaaacgaagaaaaagactaataaaaaccaaataaacagtacataaaaagtaaacaaacatgtaaatcataattttagatgaattatgagacttgaacggcctcattctgacttcacatgaatttattatgaattttacaagattaaatctaattaaagcccatttaaaaagaattaaataaatttaattcaatttatggacaattttaatatgtagatctttattttagaaaaatttagcaacttgaaccacctgaaacggatctacggttatttagttatgattttccgaagatttaatctattagaaaaacgggaaaaagaaaaaccgatgacgtcagcatgacgtcatccatggcagccacagcacgggtggcgacctcgccggagctagggtggtcggccgggattttggaggacacctacgcgaagagaacgacgagacgaacccgatggtactcaccacaacggcaaacaacgcacgacgacggccggcgacgaggaggacgacggcggtggctcgggttgcgcggcgacggcgagctccggtggtcggcgacgaaggagaggtggcggccgagcttccccacaccacggcgcacctaaaggcgacggcggcaagcggctgcgacggcggaggcggctgcgcgacgtcgccggagttcggccggcggcggcggcggactaagcggcgtcgacggcgagctacgaggcacgagagaccacgggagagggggcaaacgaaagaggaggactagggggtcctatttatagccttggattgaagagatcggactccaaacgagaggaatcgaagccggaaaatcaaaaactcggttttagagataaactcgaaaacgagtttgattcggataaaatacccaacgatttgctccgattcttgggggaaaagatagaggaggatgagaggatcaaaacccctcaaaaatccggaagaaacggggtcggattggagcggatttggaggcggaaaggcgacgcggcgcgcagctcgggctctgtccagactgcaggctgaaggttagggacgacactgtagcagggaggcaaaacagacttctcctgagcttcctttttttcttgcttgggccgactgagagagagggagataaaacagactttggagagagagaagaggggaggccggctgctgcagctgggccgattgggctgcgcgggagagagagagagatgttgggccggaatcggcccaacgacttagggaaggatttaaaaactttttccaattaaaataatcacttaaatgatctttcaattgttaaaaatacttccaatgctcaaataatttgaagaaaaatcctgaaaatacttggacactaaaagtacttaacaaaattataattagaccatttaatgattaatttaatatttaaataattgctgaactgctctttgtatgattaaaattaggaactgagctccgaaaaatccgagaaaattccagagagtataattaaccatggagaatttaataaaaattaaatccatccatgctttatatttaagaaattttatttcccacatttaacttcacttgtaaattagtgaacatttaatataaattctaataataatttattaaataatttataagtcctgaaacaaaaatcaggatgtgacaaatctaccccccttacaaagaatctcgtcccgagattcggaacggctagaaagaaaaaggcataggtaaactgcagtctatcttattccataactccgataattattctaaggctttaaagaaaactactactgctttgaaactggtggctgagctgtaacacttgaagacacaaccggcactgcatttgctcctgtgaggacaatgttgt

SEQ ID NO: 12275 - DNA, 1946 bp, Oryza sativa
  unsure (1)..(1946): unsure at all n locations
aagagagagtttagagcactcaaccagggatctcgttcggttactgagtaccttcatgatttcaaccgtttagctcgctatgctccagaggatgtccgcaccgatgaggagcgtcaggagaagtttttggagggactgaatgatgagttgtcctatactttgatgtctacggaattccgagatttccagcagttgatggacaaagcgattcgtcaggaagacaagtacaaccgtatggagcagaagaagcgcagggctgcccaatttaaggcacagcagggtagtaaccagaggccgcgtctcgttactggacctcaagttccatcgtaccctcaaggaggatcttcatcagttgtccgtccccaacgccagttctacaacaacaatactggtaatcgtagcaatgacaaccgcaatgtggttgctcgtcctgcagcaacttcagttcagaaccagcctgtcaggaaggagcagggaagtaagccggtgatatgcttcaactgtggtgatccaggacattatgctgataagtgtccgaagcctcggcgtgtgaagaacgttccagccccgaacaactccaatgttccagcaccgaaggcacgtgttaatcatgttgcagcagctgaagctcagaatgcaccagacgttgttttgggtacgtttcctgttaactctatacccgcaactgtgctttttgattccggtgctacacattcctttttgtctaaaagttttgcaagcaaacatgggatggaagttgttagtcttgggagacctttactagttaataccccaggcaatcaagtattttcgacacggtattgtccttctgttaccatagaaatagaagaagtttctttcccatcctctcttatcttgctagaatccaaagatctagatgttatcttagggatggactggttatctcgtcacagaggaattatagattgtgccaaccgtaaggtgattttaaccaatagcaatgggaaaaccgtttctttctttgcgtcctcccctaaatttcatggtgtgatcttaaaccaagttgctctacaagagatccttatagtccaagantcctcacgtgtgttcccggaagatttgtcaggtatgccacttaagagagacatagagtttcggatagatttggtacttgcaaccaacccaatccataagagaccgtgcacgggaaattttcgcgcaagcgtaatccatgttagcgtgagagtgaagaaacaggtggatgattgggctcagaaaggatatattagacccagtacttcgccatggggagcaccagtcatctttgtggagaagaaagatcatactcagagaatgtgcgtggattatcgagcgttgaatgaggttactatcaaaaataagtatcctctacccagaatcgatgacctgtttgatcaattgaaaggtgctacagttttctccaagatagatgtccgttctggatatcatcaacttcgaattcgtgaggaagacataccaaagaccgccttcacaactcggtatggtttgttcgaatgtaccgttatgtcgtttggtctcactaatgccccagcctttttcatgaacctgatgaacaaagtgtttatggaatatctggataagtttgtcgtggtgtttattgatgacattcttatttactccaagacgaaggaagaacatgaagagcatcttcgtctagctttagataaactacgtgagcatcagctttatgccaagttcagtaaatgtgaattttggttgtctgaagtgaagtttcttggtcatgtcatctcgtctggaggagtggcagtagatccaagcaatgtggagtcagtgttaagttggaagcaacccaagacggtttcataagtgcgtagtttccttggacttgcaggatattaccgcaggtttattgaggaacttttcaaagatcgctagaccaatga

SEQ ID NO: 12276 - DNA, 1048 bp, Oryza sativa
aattattccttttcatcaacacacaaccgtgagtctaaccactattttttaggcaaatccacaccaagacaaaaatcattccgcgctcggcaacctctaagcattaccacgtgcacaaacatacaaataaccagatgagaattgcaacctgtatcatctgttgaggcccctcagttggctttttaaggaacaacttaacagttgccgttagtaactgcaattgaactaatgctggttcttctgggaatgtttccaagaagctctcaagaagttcgtcagcattgtcaatcctttcagcatattctccaataatccaaatcattgatgcctggagaaaaataaacatgtaattgcacaaaaatgcaatagattacctagacagttttcatagaataataccttagcctctggttcatctaaggtgtctaggctttcacagagtgttgcgatgatcgactcatacctgcattttggcaagaaaacagttagttttatagatgcaattcttgagcaaaaacaataaaaaaattgaagagttcctttgttacataatatagaacattgatctgtcatgccacagtactcacgtattagggtagcgcctgaagatgtccttaataacaattatagcctcctgcacaacataattaacctttatcttaatcagctcaagcaaaacactgatacacctttcagcagctctctccaacttaattgcacatcttccaatagcacgaacagctttgcggacaaagtcaacatccacctctgtggcatactcttgaatccaatagaacctatagaaggagctctgttagcttcttgaacaaaatttacagaaaagaaaccatctgctccacaaggagtaagacattcaacatggttggcaagttaatccactttttgaaactgatataataattgtgtagcctttcttccaacaatacaaaagcacttctggtagacatgagaccatacaaaagcagaaaaacatttagttaaggaaatctttcactgcaactaacatgcgctgggacacaataataat

SEQ ID NO: 12277 - DNA, 23718 bp, Oryza sativa
atggatgaaggaatataattgccaagggtcatcaaaaccgagaaataattaatttataatttgtgcgcatggatggatgaaagagtatacctaccaaaggtcagtatagtgagttcaaacttcatttaaaatattattatttctttacttatatgatgctagctaatttttttcattacctttacagactagaagcaagttgtttgttgtttggcacaaatctacatagcaagagaatgatgtgaaatcaatattcttaacgatgaacgaaagttacttcgttgtatcactaaatgtgttacaactagttaactggttatttgatatatatgtagaatgtgtctagtttggaccgattaatatccacagcaggttaatgaacccatcaacatatagtttgacatcttaatctgaattataattgtatataaacatttttgttgttatttacatcattataaatagttaatacatcagtacatacacatgcatgcgtcacattaaattcattttcccaaaatcacccacggtttgctaaatccgttaatgcatacttttgctaacaatatacctcatgtcttatacttattggaatatatgacactaaaaagtattaagtaaagtgcacagtcggtctctaaacttatgtgattatatcatctaggtcttcatattatttaaataagatttagattctaaaacttgttaaattgcttcatgctatacgcgtttgatgatagggtgctacgagtggattccacctatccattcgtcacggttaaatccacatgcttgtactatgcaagtgtagaccaagctccagtgcaccatggagtatgtatgggacgggacctgagttgaaagcatatgagccaggataaattttcatcgtgatctcgtataacaaaacaaaactaagagcctcctgttatacatgctctaatgcgtgttgcctctcgtgttatattttgaaacgaacagcacaaagacaatatgatgtttgcatgaaccctgaaagatagtagccagaaaaaaaaaacagaaaaacaaatcatcattgtcgacgggggataaccgtagatcggatatagagggtattggggtacgctggtacgaggatctacgtaatacgacatcgagcaggcagaaaacaaagattatactggttcaggccccttgataggtaataaccctaatccagttgatatgggattatatggtgaaaaccacagattacaaagagaatagtggaactcgatgataccgacgagatcatagtcgagttgattcgactagatctcccggcgacttggctcctgtaagctccggcttcgtaggctgtggtggatgtgttggcggtaagattcgatgccttaggtccttccggggggtcccttttataccgcaggtcaactggtctccaagtaggactcggagacattggacccgacacgatacaatgacgacccagttctatccgagtaggactccttacatctgtggactccataatggaattccttaacttatgccgaaaacgtccgtatacgcgcaagcataccatatctatatgtgacgtatatcgaagggtagagggtataccttacccgtaaccctgacagtagcccccgacttctgcttaaatgaactcgtgagaccgatcgcgacttctgatgtcgaagttgtcgtcgttctcgatgtgaggaccgagagacgaggagtgatcgacaacgtcgggtgaagctcaacggtcatgagtgaatttaaattgaagtctgaaaaactgctgcgcgtaacggacccataaatttccggcagccatctctctcctttccttggaattcgcaccgtcggaagtatccaatttgaagtccgcctgttgaaaaaaaactctccagtttccaagcgttcctcgtcctcttcgctcccgcaaaaaccctagctagctcatctcggtcctttttccggcaatctccggtggcaatggatctcgacaagtctacctccaccaacgcatcactgaagaaactgcaggaggatggcgcccttcccggtcgcgggaccgcggagagggaagtaggaggtactgaaccccagcctgtcctgggtcgcatggttgcgatcgaggactttattctctgcggtttttttcctccgccttctgaatttctccttttggtcttgaatttctatggtctttccttgctccatttgaaccccaactccatcgccttcccgagtatttttacgcatctttgtaaggcctacattttggtagagtcgtttcttgacctcttccacttttactatgagttacgctggatggaacctaaaaaggtgtccgggtgtgttggtttccgacttcgggatggcctgaagtcgcgatacatccccttccagtgcccctcatcacgcagcaaatggcgggggaggtggttctatcttcagatagaggattcggatccagtcttcgttgttcctgaggagcaaccagacaagattccatcttgggccaccaaacccacctagaccccatccctccaatctttcatcgatatcgttgacgacctccgagaacaggggttgtcggggtttgaagtcgctgccgacttcatcggtaggcggatccagccgctttaggctcgagcccatccagcctttgattattctgggccagagaacgcaacccgggtttctcctcggggtattttcctttttagttaaattgactcccttatgcgtgtgtccttcccaacttatcggattctggtctcgatctacaggcttggacagcgccaccgtggagcgccgcgtcagccaactgatgatcagtggcccgacaacggcgagcaacgtccccgtccccctttgcgagaaagaggcagccgagcgcgacgctgccatcaatgtaagtgtactcagcggtcttttcgcatttttcttccaagatcacattatgacttcatgaagcgtaggctctccctttgactgatatcatcgggctgctcgtggaccatcaggtggcggtgtcgctgaaggagaaagtcgccaaggaggcgtctgacactgctgccgccgctgccacaacgagtggcggcaacgctccgaaaaaggggaggaaattctcctctgtggtcggacaccgtcggaagacgcccaccccctcggtaagttctcctgccctttgatcgcgtagtcggaaaacttccacctcacatcatatcggttgtactccaggcctcggacgcgtctcccccacctccacgacggcagaggctagtgacgcttggcgagaagtaagtggatgactttgaggtcttgtctcttcgtcaaactgttgcagcctgtttcagttgcggattttcgcagggcggcatgggcgaaggcggcgcaagacgggtctagagggacctcgacggatttcgtggtcgcgcccaggagccgcgaggcgacacctagcggcccaactagcgatcttgcggctggtcggggtctgccggctgccattctcacctgggaggagctccaggttgagatggggcgcctcctcgaggctagtgctcgcgacattggccgcgagattgcggaggcgaggacggcggcggcgttgtcggcgaatgagcgcgccgaccggctggcgcacgatttggcggaggttcgcgaggacctccagaagatgggggaactggtggccggcaatgagcgacaacggcagggactcgagcaccgtatgtcggagctcgagaacaacttgtcggaaatccgtggctcgttgcgggtcacctatactggactgcaccagctcgccggggagtgcggtatcaagtttaccatcccggcgaatcccgatgagttctcgctgacgtcttctcttgcggagctggcggcggcaatggaggagatcccctccaagcatgcggccaggatcggagaggagacgtccaacgggatctataccggggcgtgccacgtccttgcatgtgtgagactggcgcacccaaaactcgatctgcggaagatcttggatcagggggcggctagcgacgcgtgcaaggatgtgatggaagaagtcggcgatctgggggagtctattctcccacttgttgaagagtaggattttgactctcttgtactctttagtcatgctttgtaaaactttcgttggttccaaccacctgtgtgtgtgcagtcagcgccttagctttctttagcattttgatcttgagtactttgttgtcgtttgtagagatgttgatgtcgaggatgtccagcagcgcgggcagcctgagctgccagtggtcgttccgttacttgcgtctgagccacacatgccggagggcgatgtagctcaaaattcgcctgtgggaatgagcatggcaacgactcccttaggttggttatctttgttttcatctcctttattcttccgtctggatcgacttgatttgctgtattctcgggagagaagagcagtctaacttagtcgtttccgtactgagcagacctcgagagtgcgcttgctgaccaggatcgtcgcatccagtattggaggacgaagtttgaggtcgcggaactcgagaggactatgttggaaatgaggaaggatcaggccgtggagacgctctgtggtcgcgaggtgtggttcaactcgtatctgaagagttgttgtacctccatgttaagagtctgtaaagagctccgagtaccccgtggggatcccgaggaatcggcggctggatacatctcgtggctgaatggggcctgcgcccagctcgagggcatcagccagcgtatcgacgaggccctgaagcaggagtgtcgtcggtcgagccgatatgccggggggcatgtattggcttgtatacgagatcatcgtccgtagctgcacctcgagttcctccacgaagggttttctcgtttttggagaactcctacggagatagatggcctggcgaagtcgatggcgccactggcggaaaaggtcttccaatctatggactggcgttggccttcctggtagtcttcgtgtcctgtgacaaatgtcttaggggaaaagtgtaatataattttggatttttatggaattgtaagaagtacttgtgaaatagaaaagaaatctatctaactaagctttcttactctggatgtagcgtgtatgagtgtcttcccagttcgcgacttcgatcagtcgtttgagttatacactctccctagcccccagccttgtcatcggagaattcttctcggaagataaggctcttggacctttgacctgcctcggttgaacaagcactgatcctagcccccagccatgaagttggaaaatttatttctgattacacggcttggttaatacgcacggcgagaactcttacacgactagatcttacatggtctttcgtctctacaggatccgacaaggccttatcggctctgggcgtccccagccgaagttcccttaggttcctcggaggccttgtcaagacgacgtaaagggacatgaggataggtttcaacactatgtgtcatttgggtaagggatcattgggaaggaacactttgatcgtagtctgtacctgaaaaataggctttattgaggctgtaagatgtcttacaagtatggatactattgacttatacatagaatttacgtaattgatcaatgttccaggaatttgccaactcgcgaccattgccgtctgcgattttgaatgcgcctggccgcagaacttgtgtgatcgtgtacggtccttcccatttgggtgagagcttgttgcgccctgcttggctttgaacccgtcggaggacgtagtcaccgatcgaaagcgtgcatgctcggatgcgcttcttgtggtaacagcgaagggcctgttggtagctggctgctcgaacggcaactcgttcgcgatgttcctcgagtagattcacatcgtcgtatcgttgctcctcctgatcctcatcggaatacttatgtactcgtttactttgatgtcgtagctcggtggggagcatggcctccgagatgtaatagactggtcgttgcaccttctctctctcgacaacaatgacagtgctaacggaatatggcgtggcggaaatatagagaaataattctttattaggttgggggcaacaagtacaggtggatttgataggtagcgcttgagtgcaatgaatgcctcttcgacttcctgtgtccatacgaatttgtcttgcttttttagcagagcgaagaaaggttgtcctcgctctcccatcctagcgacgaacctgcttagtgccgccatgcatccgattagcttctgtacttccttgagtcttgtaggcgacttcatgttctcgattgccttgatcttctcgggatttgcttctattcctctgccagagacgaggaagccgagtagcttgcccgatggtactccgaacgtgcacttctctggattgagcatgaggcgatatcgttggaggttgtcgaacgtttcccgcagatcgtcaatcaatgagtcacttgtcttggtcttgacaacaatgttatcgatgtaggcttcgacattatttccgagctggtcgctaagtgcaccttggaccgtgcgctggaaagtgtttcctgcggttattagtccgaacggcatcttaacgtagcagaataccccgaacggcgtgatgaatgttgtcttctcctcgtcctctttcgccatgctgatttggtagtaaccggagtaagcgtcgagaaagctcaacaactcacaaccggctgttgagtccaccagttggtctattcgaggaagagggaagtgatccttgggacacgccttgttgaggtcggtgaaatcgacacacattctccatttcccgttggccttccgcaccatgactaggttggttagccactctagatagagtacctttctgatgaaaccggctttgagaagtttgtcgagttcttctcgtatggcttgttttcgatctggtgcaaatctctgcagtttttgttttactggcttggcatcgggtcgcaccatgagtttgtgctcaatcactccctgggtaccccgggcatgtcggacggctgccaagcgaacacgtcagcattgtcgcggaggaaggtgatgagcgcgagttcctatttctcgcctagtgatgccccgatcttgacggtcttgttggggttggcactggagagtggaacgatcttgattgcgccgtccatttcggcgtcttgtttgttttgctcactttcttgggtggctcagctgtggcgagtgggctgggtgtgtgctcgagcatgtcaaggctccgcttgtcgcattgcactgccagcttagcattcccttaaatagtgaatgttcccttcggtcccggtatcttgagcacttgatacgcgtagtgagatgcggccatgaacttcgcgagtgcagttctcccaatgatggcattttatgctgtatcgaattcagcgacatcaaaggtgatctgttccgttcggaagttatttgcttggccgaaagtcacaggcaacgtaattttgcccaatggtttagacgatgactgaggagtgattccatggaagggttgattggtgggtgtcaactctcttcgtgggatccccatcgcgtccaaagcgctggcgaagaaaaggttgattgagctgccgtcgtcgatcagaactcgcgtgaccttgatattccgaatagtgggttcgaccacgatcagatattgccctaggatgatggcagtattggggtgttcctcttctgagaatactatcttctgttcggatcacttcatcttgggcgcagccccctgccacatcgaacaaacttcacgtttcaccttcttgtattctcgctctgaggagtatgtcgtggaacctccgaagatgtgcgagacatggagatcggagtctggatatgctgagtctgattcctgagtaaccgcctcagcgtccttctcgaccacacgtattcgcttgcctttttcaaataccatatgttttacgagcgacttattgaagacgaggcaatcttctagagagtgtctatctgacttgtgtatagggcaccatattttcttcgcgtcgctgccttgtgggtctgggcgcttgggagggtccgcgtattctgctgcgagaacttccgcttgagctttccttttcccactcttgcgatttttcttcttgcttgactcgggtgcgtcctttgctggtttcttctctcctccggtcttcggtttgtcgttcttgcgtctcagtgcgtcgtccgcatgagcgcatcgatcgacaatttcgaataatctccgagtagtcatgacgcgcctcgttgccaactcctaagtagtatagcgatctctgacaccggacttgaaagcgcgaattacagaagcgtcggtgatttcagggattgtatttctgcactcgttaaagcgccaaacataatccctcaaggattcacccgggttctgtgtcaacgcatgtaggtcgtcttcgatcgcgtggcgcttgtacgttccttggaagttggcaacgaactgctgccacaggtctgcccacaaagaaatcgagtaagggggagatgcatcagccatgaacgtgcagagcctttcaatgcagttggcaagtaattcgccaatgcgttgtcgtccgctccggcagcgtagagtaccgtggagtagacctgaaggaattcttctaggtcggtgctcccatcgtatttctctattgctcctggttggaacctttcaggccatcggacatcttgaagtgaacgaccgaaagctctacacccagcgctgggggcggtgggttgtcggcgatcgtacgtccttcgcggatgtctatctgatgatgaggatgaggaagatgacgacaatgacgatggatcgcttggttccggcgtgcgattacgaggacgtcggccaggttctcgagaactctgtcgtcgtctctcgttgttgtctcggcgctgatctccatcatcgtcgtcattatggcaacgtcctcgaccagaatcgcccagcacccgccgctcgcgatcgtcgtgatcgcggcggttgtggcggttatctcagtctcggtcttcgctcgaacggcctcctcgttcttcgttatcgtgacgccgtgaagagacgcgatgtcaggaacggttctcgtcgactcgtgtgcgtcgcgcctctcggcggccattcaggtgatcgcggagatcaccggtgccgcgaggtggaggggtggctcgatgaggcgattcccgctgttcagggttttcaccattagcatcgccagttggtggctgtttcgggtgcgctgcagtggcggcctcttcgaacgcgttgctgaggttggtcactgattcccataaccgctttgtccatcgtgcgagatcgtcgttcagaacggggtcgtagggagtttccctcagtattgcgttgacggctctaatgtgctgggccggtgtaatcacttgattctccgcttccgcattggtgcatgctgacgtgccgacatcgtcgatagccaatacctcacgcggcatactcgttgtcgatgaaccatagtcttcgagcaggtgcaagactgatggttcgtggggatcgatgtcgattactccaacaaatcgatctgaaatcggcgtcgctccttgttccttgtcctcatccctgaagggaacgcgtgactgctggaccttaggaggtggcgtcttcatggcgctgagaaagaccttgcagctcgagaggttgtgattctttgtcttgtgaataggacaatagacatcacgagttggagaggtacgctgaattccatgctctttgcaggcacgaatttcagcatggacgttgaggaaaacccagcaggcttgcaaggtgtgttttctggttttgtggataggacaccaggaccttgtcacctcggaagtaatcctcgtcggctcatgattcctgtcgaaaagacaaggcttagccgcactaggatctcgaactcggatgttgtcgatgttccgatctccgcttctgcaggaggatccttcgacatggagtcgccccgggttgtagccactgcgttctcgtttccggtcattggcggactagctgagatcggcactgtggtgtaaaccggaaagacgatttcgccgacttgagtccacaccagtattgttgaagtaggaactctttggttgaggttggtattgacgctattgtcgacgaagctggatgtcatagtagtagaaccttgagcactaagtccccctacctggcgcaccactgtcgacgggggatacccgtagaccggatatagagggtattggggtacgctggtacgaggatctacgtaatacgacatcgagcaggcagaaaacaaagattatactggttcaggccccttgataggtaatagccctaatccagttgatatgggattatatggtgaaaaccacagattacaaagagaatagtggaactcgatgataccgacgagatcgtagtcgagttgatttgactagatctcccggcgacttggctcctgtaagctccggcttcgtaggctgtggtggatgtgttggtggtaagattcgatgccttaggtcctcccggagggtcccttttataccgcaggtcaactggtctccaagtaggactcggagacatcggacccgacacgatacaatgacgacccagttctatccgagtaggactccttacatctgtggactccataatggaattccttaacttatgccgaaaacgtccgtatacgcgcaagcataccatatcgatatgtgacgtatatcgaagggtagagagtataccttacccgtaaccctgacaaccaccaccacacatcgacaacatctacataaaatcaagaaaagagttagcaccagaccagccgttgctagacaaaaaaggagctacagccaaaccgttcaaaatcaaaccctaatagacgagcccctagccttctagatgttgtccggacgaaaaggatatagaaggagagggcaagagagaagaaagatccctctccctcggatagacccaccgatcggctgccatccagcggcttcgcatagactgtctaggaccagttttggcaaaagggggcctcctagatgacgtctccatagagaagagcgacactattgtccctcgtggtctctgtcagggttatgaataaggcataccttctatacttggagtcgagagatatacggatacggtataccttcaagtatacgaaaaggttacttttgggttaaggaagtcggtgggcttctcaggaaataatctctacaaattgaaggggtcagagtcctattcggagaacataaggattttttcatactgtgtgaggtctgttgtctccgagttctacttggatattaaggtgatctgtggtataaatgtaggccccccgagggtacagatcatcacatcttagtgcaatacacccaccatagtaggagcaatccagaggacttgaagccaactcgccgatagatctcatctagttgttctcgatagggatctcgtcagtaatctcaggattctattgttctctattgtactctatggttttttttcataatcccatataaaatggattaaggctattaccttacgagggggcctaaaccagtataatctttgtttcctgtgagcttgatgtcgtatcaacatacctcaatacccttagaatacggtccgcgggtatccccccgtcgatagtttcaaggagatctaagataaggttttcactaggaaagaagatggacatctcgacaactcccccaagagtgaatacgacgcctaaaccgtgtcgttgctgacccgacaagactgggctaggctttcacccacctcctgtcccctgtcgatctactgctaccgctccattgcaccaccaccagtcacccatcataagcgccaccgacacctcccgtcgaccatcctccgcatgcctccacatgctaacatgacacacatgccatcactagcctctcgccgctagtcatgcatgcatcctcgccgttgcccgtgtcaacctcccgtgttgctggtcttcctatcatcgttagagtcaacctccagcattcgtcagcctccctgttgtcacctgcattggccacacatgacctcccgctgttgccacgcgagtggtgtcggtagtgctgtagccactcccagcagcaacctccgggaagaggagcaaccactgccacacctagtaacagctgctcctccacacacaccgtcactagaggccatcaccatgtgcttctccctcaccaccgtcatttgtcatcaccgagagctacctcgtcgggggaagctagagggagctatgctggaggccgctggatttggcagctcccgctgccacctccgagtccacttctcgccaccctctgccatgccgcctagtacccccacccttctccaccatgccgtgcgctaaccttcacctcgccagatccgtgaaaagggctagatatggacagtgccacctccttcttcccggttgcttcagagcccatattaacgcgacgttctcgaggaggaaaagagttcggcatcatcttccttgcaaccacgtggcttgctgacgggttgctccggtggtggcaaggggcagaggtgcgggggtggctgcgtcgctcaattggttgtctcctgtgtcatcccggattatgatcacacgggtcctctacttagtgagccatatgccacttagagggtggtaagtgggctgcgagctagagcgtatattctggtcccgttcatttcttcaagagttggatgaagataaaaatttttgtgacacgtttttcaaaccgctaaatggtacgtttcgtacgaaaattttctatatgaaagttgctttaaaatatcatattaatatatttttaaagtttgtaataattaaaactcaatcaataatacgttaatactatatcattttacgttaataccatatagtagtagtttggcacgagaaaattgttccccgatcgtgcttattcaaatctacggtgagagctaacactacgtggaagaagaaccggacgtcggatgcggcgtcattgcaggatcggcggcgacgccgggggcggcgtgctgtggctgagccgcgccgcagttcgcggaccacacgcccccccaccccccgcctgccgcctggcccggctgccgccaagtgtccgccgccgcgtcgtgtcgcgtcgcgtcgctcggcccgcctcgcctcgcctcgccaccaatatctccccccaacctcgccgcgcaacgcgcaccccccgcgtcgaacacccgaggaccgggagcccgcgatggcgatggcgatggcctgcctcaaccctctcgcgctctccccgcgcctggcctacggcggtagagcggccccgcggcgctgctgctcggtggtggtgcccacatcctccgcgcgcgccgcggcgggtcgctgcagatggcggctcgcggcggtggcggaggagccgcaggccgtgcggcagcaggagcagcagcagcggacggaggggtcgggtgaggccggcgcggaggcggcggccgacgcctcgtccaagctagttctcgtcgtcggcgggaccggcggcgtaggtaaggagacccacatctctagcccttctctccatagcttcagtgtcaccttctctccattggagtgtcactactgtgtgagtatattttttttttcacaaaatatttcgtagcattttactatgccattatctgattatgtcaagctcatcatgctggtaattcttttagttaagcgtacatttgctctgcattttaagtgataaatatatgttctgcagttgtctagatattgattgagcagatctgtcgaaactagatttcggcaataataaaagggggtggctatcaagctcggaaagtgtatgggtttggagacaaaggatttatacaggttcaggccttcttataaaagaagtaataccctactcctgtccggggatgaatccgccgagtgtattattgattgtatgattcgggaaaaatcagcatatgcccctagaggcgcccggaccccccttatatactggaaggagtccggattacaaaagataatctatattcctaacggaatatgaagatagaggtaaaatacagtcgtaaccgactaagtctcagggtgtttccttgatacacaagttaagaaacaaacccgagatacagataagatattctatctacattaagtatccggtacccagttcgaataccatcgccgtgtagatatgggatacccataatctccacaagatccttgcagggcagttggtggtggcatctttactgagcaggaacatcaagacaaggttgttgctaagagatcctgcaaaggcagtgaccctattcggcgagcaagatgagagcgtatttcaggtgatcttacatccagagagcttgaacattctatttccttctgtgtaaattttgctcatgtaaattgttacttcatggaaggcttacaaggctgacacgagaaatgctgcagaattggatccagaaatatttgaggttcattttcttgtgttttattgttttgaagctgaaatggtagagcgttatgggctttctatttatgcatgattgaataaagcaaaatatagggatctcttttcacagggagttacgcatgtcatctgcactactggaactacagcattcccttcaaagcgctgggatggggataacactcctgaacgtgttggtacgtactgagtaaagttcttcagttcttgttgaaaccatctatttgtttgttctacgtacgtaaatggaacagtgatggttgatcttgggggatggatgatccttgggtaaagtctttcaatcccctatggacaaactaagaattcaactgtggcagtcgcggagtgctaataagctgcttatgatatttccagatcttggcattcccattgacagagtttaatatgtaccttttgttgatcatgatcatgcacactacagttaaattcattccctgtgcattgatgttaatgatatttcttataagttataactgatataacctggtctatctttgtcacgcataatgagctagcaacatcagctatgtgcctatgtcttgttgtgtttttttttttctgaacacacaccattttccctttctagattgggatggcacccgtaatctggtgagcgccatgccacggacaatcaagagactggttctggtgtcatccatcggcgttacaaaatacaatgaactaccatggaggtatactgcagaatttcaacgaaaaactttggtatcttacagttgaacttcctgtcagtcatactagtctccaaagtctaaagttgcatgcattccatgagctatcctgaaattttactagagtttaatgaagaatttatatcctcaatatacttatgagtttaatttagcaatggtttactgtgagacaatgtacttgctgtataagatttgcatgcttatgcttccaaaacccatcttaatcttgaattttagttcattaagtctagtgtctgcttcctcaacttctattgcgtcacaattttaaccttcactcatgctatgcatttttcagtatcatgaatctgtttggtgtgcttaagtacaagaagatggcagaggactttgtccagaactcaggcatacctttcaccatcataaggtattgtgcacataaatccttttcatggctcacaacggatacatttttatgacccaatactagctgcattgcaggcctgggagattaaccgatggaccctacacttcttatgaccttaacacacttcttcaagctactgctggagaaagacgggcagttgtcatgggcgaaggtaacttatactagttgttattaatggatttctgttaagctatcttattcttgcaactcttcatcactacccctattaggtgacaagcttgtgggagaagcaagcagactggtggtggcagaagcctgtatccaagctttggatattgaattcacagaaggacaaatatacgagatcaactcggtgaaggtatttatgcctggtgtttgatatttcctcgtgcgtgtgtgtgtgtgtgttctttttgaaaaatggcctttggttacgttgaaaactaaatatacaaaagctgtctagttacgttcaaactaaattatttatcttttgactgaagtgtcaattatcacttcagggcgaaggacctgggagcgacccagagaaatggaaggagctgttcagagctgttcaatgaaattaatggcattagctcaccctcatcgtgatgtattttgttcatgtatagtgtactttagtggaattccattgaggtagtttagtccattgtagttaactagtagtgtacaattcatatcatcatgtaatgagattttagcaattctaatcccaagaccgcattggtggtaattagatttggtactaccactgtcccaaaaggatttcatttctagccatgcatttgggcaagtattaggtgtatattgggcaggtattaggtgcatagtcaaaagtaaaatcttttacgggcaaaggtaggtagtaaaatgaagtaataactttttggctatgtatcggatatattcttttccagacatatagctaaaagttgcagatggagagaggtgtaattggcattcacttctaaagggtcaagcaaatactccctccatcccataaaaatagctatgatttagatttatttttttatgggacggatggagtacatcattttgttcttagagttgtattttttttcaatttttgggtaacttctggtcggttctaacgggaggatttatgggaaaaaaaaactgaactaaatattataaagctaacaagtaggcataggttaaaagaaaagttatcttagcgatcctaatgttgaaaaataattttcttatagaaattatactttttaatgtaaaactattacaacgttagatttttattcctttcattctaacatgttaatttctaagccttaattaacatctaaagctggaggttccacgaagatggaccagtttggcacaacttcaagtctagctccactttttcgtaatctggagtacagccaaatggcttcagctccaccaaaataaatggtaagagtgaagcatgttgaaatattcttataaaataaactagagaaattaaattgggctttgcgaaattcagagtaaatttttaaagttaaatccttaaaaaacatgccctcaccactacggtctacgggagagggaagagacagaaaccccgaaaccccccaaaggttcccacttcctcccacccgcccaaacccatcctccgccgccaacgcgccgagagcaaaaaaagagaagcaccgggatgctgtacatcgtggggctcggcctcggcgacgagcgcgacatcaccgtgcgggggctcgacgccgtccgccgctgcgccaaggtctacatggaggcctacacctccctcctttccctcggcctcgacccctccgcgctctccaacctcgtgcgttcccccccccccctccccctccccctcaccctccatgcccgccacctgttcgaccaaatgcctgttcccgctcacgcgccatcgccccactgttttcttgcgcaggagaagatgtatgggaaggagatcacggtggcggaccgcgagatggtggaggagcgcgccgaccagatgctccgcgaggccgccgacgcggacgtcgccttcctcgtcgtcggcgaccccttcgggtaatggtttgctctctgagagccttctgggtactgtaaacctttgctcttgtgcgacagcttttcggtttatgtcctgtttgaatgacaaattgcagcgcaactacacacactgatctggtggttcgcgccaagaacatgggggtggaagtgaaggtgatccacaatgcgtccgtcatgaatgcagttggagtttgcggattgcaactttaccgctacggggagaccatctctatacctttcttcacggagacatggaggccggacagtttctatgagaagattcagaacaatcgacggcttggactgcacacactttgcttactaggtttgtcatgcttgcttgatcatttatttcagtgtagtcaaagctcggcattcttaaggagagaggcaattgaacttgaatggctgctagtggctgacttcttttacggttaacacttccttacaaattacaatcatggttatggatcttggttcttatattggcaaatacaattgatattcaaaatgtaataaccaaagtaaacttttaatttatatgacagaccctggattgacaggtaaccactatttcctgtaatttattgatatcaacagctgatcctgaactgtcaaatgaacttgtcaggtgtaattttgtacatgcaacacttcatacgtctagcctaaatttattgacgcttgataatctttatggtttagtactttcttttcaagattaatcttgtgctactttcactttttccctgttactgcaagcgggcttgcttgactgttccttattaaagaaaaactgtggtttgattatccaatgcagatattcgtgttaaggaaccaacgcttgagtctttatgcaggtaaattgcatgatttcctgtctagtgtcagtagtgtgcagtgcagaactacaatttcttcttagaattagctatgtgctagagatgcttcattgctatgttctttcttcaaagaattgatcaatattctgtgcggcacaagcagattcatctgttgaatttttatgttgccatttaggatatatctatcttttgccattatattttatttttatttctttcaggggaaagaaagtgtatgaaccaccaaggttcatgtctgtaaacaccgcaataagtcagcttttggaggtggaggaactgcgtgggggatctggtattctcatggaatctctgaattaatttcccaagttaaaatgctcttgaaaaacagctgttagtctgcctatctaagtttaatgtaccaatctaaaaagggatttcattatgccctgcagggtaactatagctagatttttggacgttgcttacatgttctacttttcataggccagtaggttttacttctagattagcacttaaaaatcacttgtttccagcatatggcgcagattcactatgcataggtgttgctcgccttggaagtgatgatcagaagatcgtcgctggacctatgaagaaactactagatgtcgatttcggcccaccccttcactgccttatcatagtgggagagacgcatcctgtggaagaagagatgatagaattccacatgatcaagtcatgatgaatgaaagtgcttttatgtgagtttcactcctttcttgcaatgaaaaaaaaaaagcaatacttgtatgctttcattcgttacaaagcaatttctacaccttatatcctgtggctaatgttgagtcaatactcatttgcctccacaattttgaatcagggccttgtagctggatacatgatcccaggcttatagctcccttgaaacgatacttcgatgcttccgcccgccgtgaaaggtccaccagtagtagtttactgctccaattgttgctcatttttaagttaaactgggatcagctgttgttctttttttggcctgataccgaatactctcaaaccagtattgaaccttgtttacattgtgtgagctcatatttgaatgtgttcgtgcataaatcaccttgagatcaatgttactcatcaagaaacggttaccggaacattagctacaattgtggagtataaactcgtatgaatgaattgtggtaacccgtagtacgatttcgtgtcgtccgatcttctgtgccgtgtttcagatccatcttttgttgtctcacagctcagtctgagtctgggaagccttccagagttccagttgaagaggatgaacagtcacagaaaaaaaaagcaggatttttttttttttgctttatcgttcgttgcaaattacatgcttgatgatgctaattctcttcaccggataggggtgtactgctccatctgcagctggtgcagcgcggcctcggagccgaagctgtggcgtcccggcgacctccgggaccgggacctcgtcggcgtcatgggccccttcacccgcggcgaccgctgcgccgccgccggccggctggacctcgcgaagacgatgtcgctggcgatggacgggatcggcgacatggaggggatcggcgacaggaggcggtcggcgaacgggaagcactgctccgagtaggcgtccgccgcgccggcgccggagcgctccttgggcgtgctcatggaccggaacttggccttggccgacgccgtcgacgccatgtaccccgggaacgccgccgcgccgccgccgtcgtcgtccctcgccggcgtgcgcctcccggcgcgggtgaatgaccgcctcgccgagtacccgagctgcctgtcggcgtcgtcgtcgtcgccgccgacgcaggcgagcctgtcggccctggacctggaccggagcaccggcggcggcggcgggcgttcgtcgtcgttcatggcggcgccggcggcgtccctgcttggagattggtgcgcgacggggatgtccttatcgaacggcggctgcgacccgacccattcctccagccagctccaccgctggttcagcgtctccatctcctcccggctcatcggctgcctcctgaccccgaccttctcctgcgccaaaaattaacagctctcgatcagtcaccgacgagtgggcccagacagccggatcgcgggggccccgcgctgtcagtggctgggggacgtgacgtcatgggggaggtgaggtgacgtacgctctggtggagcgaggcgtactggagcgcgcggacgcgcttgagggcggcctcctccctgctccggctcatggcgctcatctcctccttcgacagtgtgctgctgtcccaccccttgctcagctgctgttcctgcacaacaacaacaaccaccaatcgcccttcagattcttcagtaaaatgaaatccattcactggctcgcccaccgaaatatgccaagctctctctctctctctctctctctctcttttccctcttctttttactgttactatgagcattggcacttgcaggcatggatcgatggacagacaagtataggaaaagaagagccagattacagcagaaacagcagctgatggtgcaaagcaaaatgttgtgagtagtactactactacagtgctacactggacagtgctacattgggcgcaagaacagaagcaacgaaagaatcggggcatatgcatgtgcatgtgtcctggcgatggccgcgcacgacaccgacgtgacgcggccgggtcgccgtctgccgtgccgccaccccgcaccacatgccgcgcatgtgcccagcaaatcattcgcacgttcctactacctagctatagcagctagctggtgagagtgttcttttactactagtgttacttacgtggacggcggcggcggcggcgtagtacagctcccggcctcgccggagcagcgcgtccatgccgtcgggcgccggcgaattagcggcgttgtggtcgccgccggcggcggcggcggatgaggccctggcgcgctgccgcgcctggatcttcatgagcgactcgaggccgcgcagcgtcgccgccgtctgccgccgcaccgcctgcccccggatcagcgcctgcagccgcaccaaccccttcaacgctcgcaacgccctcctcgcctgtaaaaaaacaaaaagaaaaaaaaaaggattaaagcaacagaaaatgtattgatacgaagacatttttggtgagcgacatcaaattcactgaaaattggacgaattatcaaatcgctacgaaatccattgaaaatgggggctataaattttgaaggtttgaagcaaaaaattttagttgtttgttttacttacgaggtatccacggtagacggattggatcataagggcggcgtgttcgtggccgtacggcgtcggcgtcgtcgtcgtcgccggcgccggagccaatgcggccgtcttcccggtgaggcggaccacctcggcggcggcgtgcgcggcggcgacggcggcctctgcggccgccgcggtggcgagcgcgaccgccatcgcgtgcttgctctgctcgtcctccgcctgcctgatctgctcctcctccaccgccggcgccggcgccggcagcgcgaacgagtgctgcgtcttgagcttgcccgcgaacatccacctcttgctcttcaccttctgatcaataaatcaatcaacaacaccacctcctcgtcagctcaactcatcaatcaatcaaacgaattctcgcaaaaatttcggcaaaatttgtggcaagaatgaatcggtgcaaaccttgtccggcttgggcttctgcttcggctcggagacgaagagcctcttgatgcgctcgagccatcccctcctcttcctctccatgtcgcagctaagcttcgtgcaagcttagctactaactagccttactacacctcgtcagtgtctgaaccgagcaaaatctgaagcaagaaacgcatcgtcattaccagaaatgcagatgaaataatagaaatgaaaaacaagaattgggagtagtagctggcatgtctcaatcgtaagatccaaggaaatgttgactaaagcttcggcaggacgagggcactttgctgccagcacaagctactgttcgtcagtggtgacggtcacagtgtccgagcaaaacgaagaaatcaagaagcggaaaaaataaaattcagagcaggactgctgctgcattggattcggttgatgatttgccgttgcatttgtcagtaatctgaagttttaacagtttttaatcacgcagtgggagccatttagaggctaaagccaagtgagtgattagctgggtgctttcttgtgtcacctgctaaaattccaaatagtagtacaaatcaagcgaaaaacaccaaccggaatgcctagttttgatgcgacaaaccgcagctataagctgtaatgttcagagtgtgacgggtttctatctgaatcatctcatggcaactgaacaaagaaccaaccataacactactagacagctacatgcgtcgcatctgaatttactctgaaatgactgcaccaacgaaagaaggaagaagactgaagaggaaagtgaaaacaatatcgaatgaatcaaccacgagacccaaaagatgaactgaaaatcaagtgatccaagatgagagtaccttgcagagtaatggtagggatgctagctctgagtgatccaagaactctctcactttcagcagctgcttgtggaggaggtggtgatgacacagacaggaggctcatgtaaggcagatcatgctctgcctgccatatgagggaggaagaaccaatttccagtggaaagccagcaggtcatgcctcaccatctcagagagaaccccacatgatgacatgaatcaagagcgctctctctctctctctcaatttatacggagtacaagatgtacatttgcaaagagaccttcagatttggcaaggtgtgaaacgccctgcttcctctgccatgtctgattaccctcaagacccctctcaacttaagtactcctacttaacatgtgagcttgccggtaaactg

SEQ ID NO: 12278 - DNA, 346 bp, Oryza sativa
ttttggctttggtgtggcgatcctgtggagtgtggtttggtttgggaggagttcggttttttcagaatggagatggcctgtttgccggtaaattgagtttgatctttccgtttcttttcttggcgagatcgtttttgaatgaactttgtttttcggattaaatgatgttactgggaactgaccgtgtgctgttttttcccctctttttgtggccgttctgtgctattcagggaaacgccatggcaaccgacgaaaacggtgccgacgatcgcgccggcggcgagagcaccgtggatcatctcaggagccatatgaactacggcgacatggatttgtcaggggaaga

SEQ ID NO: 12279 - DNA, 629 bp, Oryza sativa
  unsure (1)..(629): unsure at all n locations
agcacaacttgccagacagcccgtttgcttcctctaccaagtcgaccgcattctttaccgcaaccgctgccactgccattggtagcgagggagatttcaccaccggtagtagctgcaatattggtggcagtgcggcggcagcgccaaccctctccggcctcccacattggacataccttcgccaaggacctgcttcttccccatgcccaggtttggccatgccactactttgagcagttgattactacttgattgtactggtcatttcgtgatcacttgcgattggaatgattcgatcaaatgcaatgagcaggctgtccgagcacggggcgatcgggatgtaaagtagtccacaatggaagtggctgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12280 - DNA, 746 bp, Oryza sativa
  unsure (1)..(746): unsure at all n locations
aaaccggtcgggctcctttcgcccaaacctggaaaagtaccgataaatcccaagtgatgttggtgtccccttgattgaacaagcagaagtgatggccgtggaaattgtgaacaaaaccaggcatcgatcctgaggaggagatgtgatccagtctttaacctatatatcccttcaaaagaacgaccacatatctcataggccatgcataggtataactccaaatagatagggcgagataatggttactagcaggctatccacttaatatgcctaatggtatgttggacattcgatcggtaagggtaaacatctcattgggatatatggctgggcacactggcgaccttgaagctcctatcgtggggtgcacggcaggtgatcaaactgtttaggcgatcatgaatgcactgctctctgtcttcctagccgtgcaagggttgataggggaatgcttcaccttctactttggtgtgcatgattatcactgcttgaaaatgctcatggcggaccggaattctgttatgtctatcgttctcgatgcgagggaccaggtcagtggcattaacatggtcaccgtccactctggcactgcgggtgacatggngaaaagatatcagatctgcttaacgtttcctgacaggatggactggtcagcgttcacctaaccactgtgaatgcaagaggtgattccagaatgcattgtttgcaatacacccggtaacaatttaggatctactggtgtttgg

SEQ ID NO: 12281 - DNA, 758 bp, Oryza sativa
ctccttaagcgccgaggccctgctacacatcatcatggcgcaggcgcgcaaggagctccccctcctgccgccgcctcaagcggcgtcctcgtcgcccaccgtgccagcagcccactccccattcctgctgtccaggcaaaactccagcgctgccccgcgccgtcgtcgtcgtcgtgggcacaagctcactcgttctcgcaggagtaacagcatgggcaatggcggcgccgcgaatgagatgatcagccctggggaggagctaatgagccccttgaacggcgggggaagctcctccgcgaacgcctctgccttattttctcagggcggggactctctcctagacgactgctagctgcaggagcagctctcgttcctgcacgacagagccgagggcgtaaaccgcgggcatgctctacaagcgatctacggaccgtattgccatagcccctgacctggccagagcagtgggatgcattactaccgtctacaccgggccaatgggatggataggcacagctcgccatcagttgcccacctgacattgttcagtggatattgctaagtgaagagaccttgactgatcgacgtccacagaacgagtacgatcagtgctatctatgcgtactacaactacgcggtgactcaacaattgtggtggcacccggtctggccggaagtgaaggcattggtgatctgagtgggcaaatacattgttgtcgtctccgccgcatggacagtggcagaagacttgatgtcta

SEQ ID NO: 12282 - DNA, 760 bp, Oryza sativa
aggaactggtgccatcattgacttttgccatacctgacaaacaacaaaatgaggatactggtcctcactgtcggtgatccgctggttgttattgaacacatgcatcgtgcatgattaattatcatagtaactcttgctacacatacaagtgtgaatgactcatatcattctcgtctccacacttaatatctagtgcactttcaccacctttcatcttgtagcccatgacgtgaagtctactcatatgacaacatgatgaacatgaactaatgcagcattccattatttgtgtgtacatacataccataaacccaatgaacagcctaaggcacaacgtggcgaacgcatgtgtctaacctatatctggtgaatgcaaaagcggatgaccgccctccccttcttttagtgtctctctttagaacacagaacgcgggacaatacaattcagccttgacaaccctaaccacttgcttgttagctactcgctgcagagtcgaacacttgaatgtggacatactcagtagacagacacaaaatcacctctcgcaagcgaacttggactagaaatataattaggcacatctgtaatcacctgcactatatccagcacgaagcccacgtggccctttgaatacgcggggagagccattacctactgcctggcagtgcacagtattgtcattgaccaccttacatgccgctgacaatgactcatccgtatcagccgcaatatctgaactaacctggcccttatccagag

SEQ ID NO: 12283 - DNA, 452 bp, Oryza sativa
tggatcacgcggtggttcggatcggacgggtcggaaacaccggacgcgtagccccttagtcggggcggacgcgacacggacatcctacggcgcgcataaatcgtacgcgcacacgaccctaccactctatggttttccttttgggtcccactgtcattggaccacaggcaagaacgctcctctccctccccctctgccgcggcggtcaaaaccagcacgcgccgaaatcccgtacttcccactgacacgtaggccccactgtcattgaccgttacaactcaggaaaaaaaaggggaaccccacccaccagaaacgcagcccccagcaatgataagtgggcccagaggaaatgtggggcccacgggtcagtgggacgtggccgtgccgtgcggggggcgaaaggtacggtcgctgaggagaggctggcgtgggcggtggagcgcttcccacag

SEQ ID NO: 12284 - DNA, 587 bp, Oryza sativa
aaaaatacgcccccttatatattccataattatacgtggggtggaggtgtatgttgtaattgctgtatccatttgttatttcattcacttgttatccctagctctactatctccctcgttcattttctcttctgaatttgctgcaacttgtcatccgatttcctatattgctctggctactggttcaccggaagtggaagtgtggaacacacataaggaaaattatggtcctaaatcctaatccatatttatcgttactctaattttcctatggaaccttgaacaccatagcgctctctctctctctctctggtaattgtgccttgtagtttgaagactcgttatcaatgcagtgaaaattgtggatgcgatttatacacttctactcctagcaatccgaagccaaggctaaatgacaataacaatagaaaagactcaaaattatttataaaatgaagttctcaaattataagccgtgtcacaaagaagcaggcctgacatcctgtgtagtacactataatccacttttcagccatgcagcttgtgaagtacagaaatggacaaatcaaacttgcgattcttcggtc

SEQ ID NO: 12285 - DNA, 332 bp, Oryza sativa
catcctcctgggagggcaccatgagcgcgcccgcgtgagcgtgcgcgtgcgcgcgctcgagcgagacactttgttcagcctcgtcggcggccttctggatcgtgtcgctcgcggcggccagggagacgtcgatggatcggagaagctccagtagctccacgtcgggctggcggcgatgccgtccacctgcgccgccgccatggccaactcgccgccgccgccgccgggtccttgctttgcggcggcttggttctcgcagtaggaggcgttgtccacggagtgcttccgccgatccttctccggcagcgatttgtaccgagtggggatcgccc

SEQ ID NO: 12286 - DNA, 82 bp, Oryza sativa
gtttgataggggattctggatgatctgggccgccggcggccagatgccccagctccggcagccggccgacgacggggtgacc

SEQ ID NO: 12287 - DNA, 600 bp, Oryza sativa
ctgtatcgaattcagcaacatcaaaggtgatctgttctgtttggaagttgttggcttggccgaaagtcacgggcaacgtaatcttgcccaaaggtctggacgatgattggggagtaattccatggaagggttgatcagttggtgtcaactcgttttgtggaattcccatcgcgtccaaagtgctggcgaaaagaagattgattgagctgccaccgtcaatgagaactcgcgctaccttgatgttccgaatagtaggttcgaccacgatcggatatcgtcctgggataacggcggtcttggggtggtcttcttccgagaactctatcttctgctcagaccacttcatcttgggtgtagccccctgtcatgtcgaacagacttcatgttccactttcttgtattctcgcttggaggagtacgttgtggaaccgctgaagatgtgtgagacgtggaggtcggagtctggatacgctaagtccggttcgtgaggagccgtctcttgattcgtctcaacaacgcgtactcgcttgcctttttcaaatgccatgtgcttcttcagcgactttttgaaaacaaggcaatcttccacagaatgtctgt

SEQ ID NO: 12288 - DNA, 571 bp, Oryza sativa
caactatatatagcttattggcactcaaaatcacatccaactgagttgagttaaagagtactcgaaagaagtgggaagggcaatgatggatgaacattacatatttgcctgacttgatatcggagtagatcacaatgaaatcaccctcctgcagctcgtttgaacgaacaaaatcacctgaaaaaacatatgacaacgattaatcaacaatacttgagagccacaaattaaggatggaagttattggcatggcttgtgactgtaaaatttgaataattcaaaagtttgctattcacctgtgttttcgagaagatacatcctgcttttgttgttgggccaaaacctgtgttcatgaaaatcaatatccattaatgtcagtgaatcaaaatctaagccatcatgtattcgaataacttgggcatatataatattgccaatggaaataattaaattaattaatcaaaaacatgagctcagcagaaccagcaaaaatcatatgcataatgttagtactgaaaacagcaggaaaagatcacttttatttttttgttgtatgcacttgagcatcaac

SEQ ID NO: 12289 - DNA, 497 bp, Oryza sativa
aggtggtgtcgtggcaacctccattttgatcgggaagattggtcagcgattgttgaaatcggtttagaagatccatctttgattttttttatggtagcagttaatttcttgtccatggtgcactcgctttaactagaaggtggtacagagtgcaagcaacaatgactccagggtgaaaaccttgagatgaatctaaattcagcagtgtcagctcttgtttgtcatctcatcgttgaaggtgtcgtttgaagtgttggataaaaatccagccctatttttggatgacaatgtggtagacaggggccaagtcgttctcgaaggtgcttggatccgagtaggtgcataataccgaggtttgttttcgttacggaattgctaaaaaatcgtgcgatagtttttttcaaagaaatttgtcaacgcgctttaactagaaggtggtacagagtgcaagcaacaatgactccagggtgaaaaccttgagatgtgatctaaattca

SEQ ID NO: 12290 - DNA, 853 bp, Oryza sativa
gtacgcatagtgcgaacatattctcctttctgctcgccatgaagaggaaaatctctgcagacatgcagcctgtctcctcggcggagtgtagtctgagatgacgtgagctttcggtcgccatcgacgtatcatgggtggcatcgttgtggtgcagttggacgcttccgaaacaatcagagaaaacctcgagaagaaagaaagggagacatgcagagactctgtctgtgctgtccaggtttgccttcccttttcttcctttcatcagtctccaacctgcatgcatggatgatgatttggagagaaaaggggaaatggatgaatgatttgattgcacaagagcgaggtaaagctgtcatcatgtaccacgacctggatgcacctgtaacaagtttgtagccgtcacctacatcgggaaatattcagcctgtttttttttggcttaattatctgctgttccagcctgtatgattttcagaactactcggctgtttcagcgtatgagcagctatgattggctggctgagacagtaccactgatcactcatcattcgtgcttgcttagatcttaatggcgagtgattagcaccgagttagttaagggtttggtgaaagctactactagtgctgccggattaagatttaacggcgatggcaaggacggggacgtaccgggccgggtgtgtgcgcgggcaatgatcgtgtcgcgccgaggcggagcccagatggcgcgaatgattcgggcggcgaaaaacaaaccactgcacatgacctactacagtaccactccgtcctaaaaaaaaatactgctagctacgaatctgaacacacatatatatcaagttcgtatgtagga

SEQ ID NO: 12291 - DNA, 666 bp, Oryza sativa
aactgctgatattcaacatgctgagacaacaatactccctccgtaatcatattatgagttgtctgactttattaaagtcaaatctcttgaaatttgaccacgcttattgaaaaatataggaatatttatatctctaaattagttattttagatccaacatttttttgtgcaaactattagatccaacgattgaatatgaagtagacaggagctttaatctatgttaaaaacattgttatatcgctctatgacatgtggttaaagttaaacacgcttgatggataaaatagtcaagcacgactaataatatgacacggataaaatacctcataacgggccatctcgacatacatgctgcgaccacgaaatgcaattcttgcatccacactcttatcccgtaatttagcaaggccattctcaatcaattccacaaacttgacactgctaccgtccaacacagcacggccatctgtaagtatatgaacccgtatccttttcgctccatgctcactggctccttttagaagcagttgcaagagccgaccaaaagaaccattacaagagaaactgatatagtgtgctactactgacctcgactgatcgacggatgaagttagaaattgaattatatcaacctcgcactgatcaatccttgaatggactcct

SEQ ID NO: 12292 - DNA, 12484 bp, Oryza sativa
  unsure (1)..(12484): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttggatccggtcgatgttagggaaactggtgctaatgtaaagtgcatagcgtgagcctgaggtgctcacagccgattgcgatgcccgaacttgatctgacgtcgtgtaactgttcaatgagcctgtgtgcaaatgcaatgttgcaacgacaccagcttttagggggaaaatatagcgtggaaatctgaaaaccactttgggataacaaaaactagacgtataagatttgttctttgcataagatcacatggatagaatagtcgtttactagctatttgtaggacatcatcgcctcaccagctgttaaacataaacatagggtgtgtttagatccaggataaaaagttgtggcttgtcatatcggatgtatgtatatttaaagtattaaacataaactaataacaaaacgcatttaaaatattaaacatagactaataataaaacacatttaaagtattaaacataaactaataactaaacaaattacagatttcaactgtgagatgaatttattaagcttaattaattcatcattagtaaatgttttattgtagcactacattgttagatcatagagcaattaggcttaaaaaaatcgtctcgtaatttacacgtaacctgtgtaattagtttttttttcctatatttaatactctatgcatgtatccaacattcaatgtgacaagttgaaaaattttaccggggcccatagaccatcatcaaagactttgcccagtactaaagtgcaagtcctgagaggaacagattgtcaaaaaatacagcatagtagcagcgtttatttaccacacgcatagcatttatttgctgccaggaatcatcctgctacgcaacgcaaccaccagcaaaactggaaagcgaattcattggtttgtctgcagcccttccagaaacggagaagctgtgcatctttctccaagtctcaaaacacgtgggaactacagagagaaacaatctcgtcgtggcgaagaggagcagatatcagtatatcaccagtcactactattcactagtactccgtagtcaaattagtcatcatttgtcgacaacttcgatcagcgtaggctcatagtgatctggggcctcgaagccatgaagattcatgactgttgccgcaacgttggcaaggccggcactggggagatctgaccgaaatcttacccctggttgaagcccagggcctccaatggcgatgggaacctgcagatggtttcagaaagtgaggtcctaaacagcaactgcatcctaatattgttaacacggtgtattgcaaagcaaagcagatctggaagtgagcctactggattcaaagtgtgtgaggtgaggggctggacatttccatccttgtcgcgaagcggtttgccagatttatctcttttcaccatgtcctccgcattgccatggtctgcggtgaccacgaaaatgccacctacttgttctatcgcatcgagaacaatctgaataagagaattccggtccaccatgagtattttcaaacagtgaaaatcatgcatacaagactgaatggtgaattggtggcctatcaattgttaaaagactgaaaagagagagagcactgcagacatgatcaccttaacagcttcatcagctgccttgcacccaacgatagtagcttcaatgtcgcctgtgtgaccaaccatatctccatttgcgatgtttacccttacctaacaaatgaccaaaataacattaggcctattaagtggattagctgctagtaacaattatcacgccctatctatctgaagtctacccgatgcatggcctatgagctctttgttcgttcttctgaaggaatttatttgttaaatacctgatcaaatttgcgactcaggatggcatcccttgtcttcttcgcaatttccacggccttcatttttggctgttcattgaaggggataccaatgtcacttggaatttcttcgtatttttccaggtttgggtggaagtagccagaccggtttccattccagaaaaaagtgacgtgaccaaatttgactgtctcactgaaaattagaatgacaagatatgaagctgcatgctcaagtaccaacactcagagcaaacactttcgacaagataatgaacagtattgtacctgcaagcatatgtgcgtatgccattgcgcgctaagtattcgccagacgttctctctatctctgggggagcaacaagaaaatggctcggaagttttagctcaccgtcgtactgaagcataccggcatagcgaatcttggggaacctgacacgatcaaatttgtcaaaactctcgtattctagtgcctttgcaagcatgaccatccggtctgctctgaaattaaatgtcacaacagcatccccatccattatagggccaatcggtcttcctctttcgtcaactataacaaatggcggtaaatactggtcattggcctttggatcctccctgagcttcttcacagcttcaagggcgttttgaaacttatgtggcgcttcaccgagaacctgtgcatcccaaccacgcttcacaacttgccagtcattctgcagaaccagtgaaaatttcaatcatatttttggcgcagagaaaattgtgccatgacattacaaaaggcaagtattgagcagctagcttcggacaacctcttatgttaagaaatgcagctagcatatgcaacataagtggtaagatataatgagttcccggagtagtaactgaactctgaattcaaatgcttgacacatactccctccgttatcatattataagttgttttgacttttttaaagtcaaatctcttgaaatttgaccaagcttatagaaaaatatagtaatatttatagcactaaattagttattttagatccaacatttttttgtgtaaactattagatccaacattgaatatattttgatagtttctttattttatgttaaaaatattgttatatttctctataaatttggttaaagttaaagaagtttgatttataaaatagtcaaaacgatttataatatgaaacggagaaaatacctcataacggtccatcgtgacatacatcctgccaccaccagatgcaattcttgcatccacacccttatcccgtaatttagcaaggtcattctcaatcaattccacaaacttgacactgctaccgtccaacacatcacggccatctgtaagtatatgaacccgtatccttttcgctccatgctcactggctccttttagaagcagctgcaagagcccaccaaaagaacattaacaagagaaactgagatagttgtactactactcaactacaactgatcgacggatgaagtttgaaatttaattatatcaacctgcagctgatcaatccttgaatgtactcctccatcgctgagcaagccaatgaggtgcaaagtaccgttctcgaaggactgttggatgtacttaaaaccttccccctcgtatatctttccagaggctagcgccatatctaccagttttgcactgcgcattgtcagcaactgatcagtaacttggcatttgagatgtgcatgcaacactcatccatgctaccgtagtttttggaacaatcaggttaaggtgattaaagctggtcatactcacgcatgatagtactcctctgttctaaaatataagactccttgtgattcggaaattcaacattgaaaattttgacattagattcatatttcaaatatttccatctgatattaatttcatagttattgataacaaattatgaaagaaatcaatggtcaaaatatacatatttttacataaacggtcaaagtataatattggagaccctgtaaaagtctaatacatcttatattttaaaacagagagacttgtccaggaagaagagtagtgagataaaattattcataataaaagagttaagattcagcattcaacagctaggtccctgtgcaactgggctgcattactacatactgtcactggagggtgtgaatgtgcacctagagaattagagacattaaccatcttaaatgaacaagccttacttcagaagatatttacagcaggttgaaaagtaaattacgttctacttcatccgtctttcatttttcatctatcgcacatatatcaataaaaaaacaaaaataaactataatactcttactttatcaaatctcaatgcaattattttctacttcatctactcctaatatatttatcccctaattttataaactccgtgatcgctaaataatgaacttattattttagtacaaacggaaagcacgaaaaatgaaattattataggatagagggagtatctagttagcctgaacaacccaacatgcatttttctggtgtatatactactccctccgttccaaatataaggtattttttatggatgcatggaacatatcctaatactatgaatctgaacggactctactatctagattcataatattagaatatgttctatttatctaaaatcgcttatattttagcatcgagggagtaatatgcagagtaacagaattgcaggtacatgcagaaaaccagaaatcaagcagagattgctgctatgctactatactagtacagtaaagggcccctttgaatcgcaggattgaaaaaaaacgtaggaataggaaaaacgtaggattttgatagaaatgtaagtggaaaacagaggattgcaaaacgcaggaaaaacacaggaatgaccgtttgattgaaccgcaggaaaaacgcaggaattggatgagagagatagactcaaaggaaagttaccaaaagattgaagctcttgctaaattttctccaaaatctctataagattgtccattccataggaatttcaaaggattggatatgattcaatcctttgtttcaaagggcttcataggaaattctatatttcctatagaattaaaatcctctaaaatttttatatgtttttcctccaattcaaaggggccctaaaactagtattacccctgggcatatatctggcctgctccaagcgcgttgtggccaacctcactgttgcccatgtcgtcgtccgtaggcagccccaccgccgtcccgtgagccttgatcaccctccacctctccggaccaccctgcacgcgccagaaaacacacacacaagtctcgctctcagctgatcatcatgggaagcatcaaacaaacgtcttgttagcgttgttactaccttcttgagggcgtcgagggttggggtgtcggcgacgtggatgcagttgaaggtatccggcgccgcctcgccccagccgtccagcaccaccacgcccaccaccttccccttctccagcctccggtgagccgccagctcccaccgcctcgtctccgccatcgagaagaaaaaaaaaacgttgttcgtctgcctcgacgttgttcctcttctctggtggcgtcccgccgcgagccaagctgaagttaggaagaggaggatgtctggcttctttttatgctgcaactggaagtgtccgggcgcgacgaggcagctggagagatgtccaagtgttaagaggcacttctcgttgtttagttctttcttgtgagcttacgtgacagtgtgacgcggacacatgtcgtgtgaccccgataatcatccatgtatacgttcgtgaacctgcctctataaattttcatcttaagaaagaaagaatcccgccgattggaggcctataatccgtcctatcgggctgagttttcacaacacgaggccgcgtcatgtgcgagagaggcccaaagggcataaagaacccgggccgacgaacccgctgatctgccgacacaaagtgagtcgttcgccgagatggcccacccgtttccatcaagagagccgggccgacacaccgcgccggtcgtagtcgtataggttgtttagttggcatactcacattatcaaaacttgctatactttatttagctaacatgtctaacatgtggccaacaaaattaaagccacactttagccatagtagagtaaacttgccacacttttatgtgccaatgatatgtgggacccacatcacggtgaaggaatcttatcaaaagtgtggcaccaaacaaacgaatgtctaactaagttaaactttggctaatttgagttgtggcatgatgaggcaaattttggtagtgcggggctgcgggcgcacactgagctctcggcgagccgcgcggggagcgccgccaccgaccgctcgggttgccggattcccagccgacaccgacacggctgatctgatcaatcaatctgtggctcgcggatctctcatgaaaccaagggtggcgttccaaaaacaggtggaatcaggacggtgccgtctctccatcctgtttgccaagttccgtgccagccatttgcgttttctgccatgccaccctgacgccacactgcagaactccacatgcaaactgtgtattgggggggggggggggggggtggtctgcgacttgtgtgcatatcgagtgtagtcccggtgtgtgccgctttccgtagttcccacggtatatcgagtgtagtctgcaggcgcactcgccactatagaatatcatcggcatttcgttttctgctctttgcacgttctttacccttccctcgctaacatcaaaagttggacgagccgctttgcgtgctgggcttccaaaagcaacgctcaaactgaacgtgatataaaaaccaactcttcctcctctgacaaagttacgatcataccggtggtctttaaactacatgacgggctgaactaccgtagaactgacaaaggccgtgtttagttccacagctatttttttaaaagtatatgaacacacatttaaaatattaaacgtaaactaataataaaataaattacagattcttataaattgcgagatgaatttattaagcctaattaatccgtcattagcaaatggttactgtagcaccacattatcaaatcataatgtaattaggctcaaaagatacatctcgtaatttacatgtgaactgtgtaattatttttttcatttatatttaatgctctatataggtgtctaaatatttaatgtgacagatttttttaaagtttaaaggagactaaacacaatcaaaagtgacgagagcatgggggtgttccttttttttttataccctccctgtctcgtctcgttggatgttgctggataagccggcctgtagtaacagtcgtgtatctagggaaggatggcttctctcgtcgtctctttccgttcattttccagagcctgacactgccgattctcgcttagaataaacgacctggcacctggcacagtgccatgagttattttcctacaaccggcccaatccaatgaatccatggtctcggtttactcaggcctctagtatgatattagtatctgccatcccatttacgtgtcagcaccgggcaaattagccgatagattaacaagacaactagtagcatgtatcatgagtaagcacgcgctgcggagttgttaatagcagcgcatctcggacttaacagcttaattacggtgagttcacatgcggagcacacgtacaccaagaatggccatcccaggcggccgtttgctgatgataatgtctccccgtcgtatgctgctaataaagtgatcacctaccaccgtacacttcctgacacatgggggagttagttcgtcctttctttgagaggagcagatgaaggagtagctgtttattggccttgttagggggtgtttgggagcccctctcacaaaacaataagtcttattgtgagagcctctctctcccaaacattcccttatttccataactttgattttcaagtctcatgttaaataattatattgcctacttttggtgacatcgttgagtagattgtgcacatgattgtcactattttttcaacaatatatttttaggactatagaaactatacaatgctatggatgcatgttgcaaaacaaatctaacgatatgaattttaacattcaaacttcaaagagagtgatatccctatcagaaaatagagtgatatctcgcaaaaaaaggggagaaaaacagagcaatataggcatgtttactttgatgtcatttttaaccttaccgaattttggtaaagttactaaataagtggctacatttagtttgctgttaaattgtcgaaatttggtaagttttttttggcatcaaaagtgaacagaccctaagtttaccatttagtactattggttaatgtagtgttttcgtcgagccggaaatcccgaagcggttgtggttgccggcctgccgctgctgtccgggccttcggcgtcgtcgaaacggcggggcgcacgtcggttttcgccgtggtgaacgggggaatggggtggggatacgcacgcgggtttgcttggtcccgttcacgcggcgcggtatgggtgtagccgtgtagggggtcagcggtttcgcgtcttttgtatcgtcccctcctcgtcgcgccgagccgaaatcatcagagacaacggctacggtgggatgctgccgcggatcggaggagaaaggcagaaaagctgtggtacgaagggcgcaggtttccgcagaccgcaggcgaaatgaccggtagcatttggagtccactcctaccgaggcgacatggctggctcgtgacatgtttgctccgttggcatggtgtatattccggtttttcattgcttgggatgtttttctttggatgggtggcttatgtttatggcaagtactgtacgcagtactatgaacagtaaactgttttaattaagggccagcttggagctaataaatccataaaatgattaggaaacacggtgccaaaatggggaagaaaacaaatatggttttcaactattaatacatggtgcacagcaatataatcttatactccctccgtttcaaaatgtttaacatcgttgactttttagcacatgtttaaccgttcgtcttattaaaaaaatttgtgaaatatgtaaaactatatgtgtacatgaaagtatgtttaacaatgaatcaaatgatatgaaaagaataattaattacttaaattttttgaataagacgaataagacgaatggtcaaacacgtactaaaaagtcaatggtgtcaaacattttgaaacggagggagtataacctaatgatataaggaaagagatcgactttttaaagacatgtgactttgagtcactaacatatggattcaatttgctatagatttacaaaaatattaattactcaaaattacgtgatgaaatggtggaggatcggtcttaatgctggaaaccattcaagttccatggaattccttagaaatataggaattcctaaccccgcataagtatttctatgccgcattttttcctttgtttaaatgataaattaaataaaaaattgtggccatgtgcaagcactaaatggatacaaacaatctgttcaggttctaaacctttcttgcacaatccgacttccgtcgggaccggcggtagctaatgaagaaagcgacgcaaaacgaaacagaaagcctactccaatcgttgctccgtttcttgtctttctttggatataatctccggtgttaggtccacacacaacaaataaaaaagagcaatgaagccttcaatttgaaggatgtgtgcccaataaggtttgtcctactatatcaatatatatcatccatgcaccattcctattgattcttaacacacgattgggcgcgaaaatgggaatgccaatattatttaaaagcaccgacaaacctaaacttgaaaaaggcctatgaaaaaaacagagatggggaaataacgcaagagggttctttccttgacaagtatgtgggctatatattgtaagtgtactttagaaccttctattcacttcgcatcgatgcatgttgcttggcccttgtttagtttctaattttttcttcaaacttttaactttttcatcacattaaaattttcctacacacataaacttttaaattttttctttaaacttctaattctagtcaaacttttaattttgatatggaactaaacacacccttagtaagggaaaggcatggaattgtctgcagtagttagatctagggagaggggctaaagtttaggtagagaggcctctctccaaacacccccctagttgaagcatttaaaggtgctactaaatcagtactcctgcatgttctagggctgtttggttggtggcctcagtttgccacaccagatcttaggcgtgccacaatttttcaggctagtgtttggttgcgtgccgcagttgagtcaagccacactttactagcacattggcccacgcgtcatactattcatttgctagccaaagtttgccatagttgtggccaacaaattgttggccacactttgtgtggcttaccccacttatagcaaatcgagctatggtaaagttagcctctattcaaatagccccctagacttgtagtgagtctagccagaatttgttttctctcttcaacagaaaagagagtaaagttagaaaatgaacaggaaagcgggagatccatcatcatcatcatcattcatcacctttccatattttcctgaccactctttcagttttcaggcattcgtgtagccaggaaaaagtagccataaggtcaagattagtgtaatacggagtagtagtattactactagcagggagtaaatattatttcggtagaaaaatgcacatgcgcgtcattgtcattaaatttaaatgagttggtgatactatctactggtagtaatcggaagcggttgatcttttgtggatatgccgttgtgtggtgtgtttgttgtcactttgcacgccctacatttagaatgggaccaaacaaggtttttatcgaggggatcaaataagttagaccaatttaaaaactactccgtaacatgcatcatctggtgatatatcacatttaaagtcaaatatcatcacatttttttaaatataatttgtattttatatttttatttgatcaattcgttttgctttagttattttttctacgtaatgtttttttcttagagataattctgcttgctactttttataattttgcgagtaaatatataattctaaaattatatcattatgaaagcatcccaacaaaatctagacagcttcagatatagtgatcaaactttacaaaggttgacaaaaacatattatagagaatcaagtaaacaaaatgtgtttattaataataagtgttaattggatccatgccatgataaatttatcaatttggtaaaataacattactattcgtgaaacatactaggtgtcactcaatttttctaaaattcaaattgtgccatcaccaccaagttttatatcactttctccccaaccacattccatctggatctgagactaagtaggaatgagcttggcaactaaatggggtgctgattgaagctaacgatgaccttccccagccaagtaaaagttcaacaaatttctgttgctgaaagagaatcaaagttttcctacaaagagttgccatttgttcttctgtcgtaggtggggttgatcacatccactgtgggcttcagctcgctgctcgtcaggtgatggcggtggctgagactgcgcgagaactatgcaaggcggtggctacccttgatgccgacctcatacgccactaggactcgctctctctgtttgcgtgccgtccttgccgtgtcgtacctcttcgtcatcgacctttcttgctctgggggcttaggcgctgctggccttgttgcgcttgtcttacaccgaaatgtgttgggtaagaagacaacaaacttgatggctgtggcacgattcaaattttagaaaatttaagtggcatttagcaggtatcacaaagagtgatggtattttttaaaaaaggaattgataaatttgtaatgacacagatacaataaatcctaataaaaaataattatttgacatatattgagttgtgttaatcttcgattatgaatagtaccgaaatttcattctttatgaccaatgatgatttggttatcgtttcttttattattttgctggcagtaaagatatctatatgtattagcacaatagtatgatcataaaccatgaatcatacctagacattattttaggtacatggaaaatagaaaaataaacaagtatatatatagcatttcctagagaggttactatgctcacaaacgcaaaattaatagagacatcgagcacgagcatactccaggttgttgggggaaaac

SEQ ID NO: 12293 - DNA, 6875 bp, Oryza sativa
ctgtttattcgtctccgctccccttgcttctcgcgcacactaaccaatccgagcatctcgcctcgccccgccccgccccgatcgatcgactcgagcgccaccccacgccgccgcccccgcgccattggccccagccgccgggaggcattcgtctgcgctgccccgcggcggtggcggtgacggtggaggtggaggcggtgtggcatgatcgatagaggagtcgggagaggcggcggaggaggagggggaggaagaggcggtggagatcgctaggagtggtggtggtggtgggaggaggaggcgatgaaggcgacgcccccgccggcgaagaggcggaggggcccgcggctggcggtgctggcgctcgtcttctgctcgctgctcgtgccgatcgccttcctcttcaaccgcttccctgccggtgagttctccgcggccgacacgttcgcccccacccctcgcgacgcgacgcggctcgagcccccccggattcgggggaatgcgggtgccgccgcggcctcccccccgatcggatcggcgccgttcccggcggatctgttccgggggctcgctggttccttccttgtcgtttagtgtgcgggatattgggttgttttggtggtattcctgttctcttattggggattgtgttttttgggggtcagttttctgattggtttggatgtttctgatgcagtgtatgtgacggatgagcgcccccaacaggtaacttgttgtttctagaaatgtgcatattgaactagtttttgatagtcttgtgtggatgttttcttacgaaaatgctgtttgtttgggacaatatgtgtcactcattgctattttggtgatttgtgtttggtacaggagattgatttgccttcattcggacgcatggggttggaaaggagcggtggagtaaccgtagtgaagccggaagatggcagtggtgctaacgcagagacaaaggttagtgattttctgtgatctttttgttacgtagtgatagtgattaatccgtacggcattgtgccttgtgctagcttggtggattttgacatagtcatgcaatgtaaaactctgacatgatcatgttgacgaaggttagtagcttggcctttgtattgcattttcacctctatggagaaggacaaaacatgaataaccattaaactaataacattagcattttatttttcataggctggacatgtcgttgtatccctcattcctcctaacgtggtttagattcttggttggttactgggttttaataaaaactacctggtttaggtgcatttgcattcaaatgtatttttgttcttttaaaatttgtatggcatggtagataaaacaactggccataacacaactgagtttacgactggagagcatatcaagacagaccatgtcaaattgaacttatccagtgaaacgggttttttgtcagcttttggagaatttggcgaactagtcataatgccgtagactgcactgcttctatactatttctcttggactgagtatgacaactgagatatggcatgctaacacgatttgagccacaaaatccaactgctacgaactacccccgacatagccaatgagcaaagcaatattgcatatcaatagtacctccctctattctagtctctttgttcatgattatgaactgcgaaggatctggaagatctatgcctgcagaaatatagaattagtaattaatttgcttcttttgttcttaataaatactgcattccataacagctccatatgtattgtaaaatcccttattcctcacacccttttctcttcctttttcaggatacacctgagatgattcacaggggcggtataaactcacatcaccatagtgataatgtcccttccaaagttagtgctaacccaaaaggtattggttataagattagaaatattataaattagactcagttgtatatatgtcaaaactattaaaaaaatacaggaagtgccatttgggcaatttaatgtacaactttgaagaaaagaagcatagattgtttttcaattttgtaggaaaatgtttatttggataatattaaaaaacaatgcagttatacatcattttggggctattgaggatgaagaccagttactattcaatatcccaacacctgcagtttactagttttaatatttacattcatgtatagtgtggcaagatggtgacttctattcataaatggtgttttgtgtgctcaagctgtgtatgagtagtccatctattctattctattttttttgttcccttagtaaactcatattttatttgactgtcttattgactcaataattggcacctgtctgcagtcccccctccaccaaaaattgaaccactgaagccaaaggcaaagtcagtaccagttccagttcaacgtacagaagtatggctcttggctagttgcagttacatctatgaccttaggctaggttgtaatttggttgtcgtttttaatgagaaatgtgctgatacattttgtttgaataaacatttactggtttcaggttattagtggcaataacatgaaacctgccaaagttcaaaatgcggacgatgtggaaaaggctaaggcttgtcagcttgaatttgggagttactgcctctggtccatagagcacaaagaagttatgaaagacaccattgtgaaaagactaaaagatcagctatttgtagctcgctcgtactacccaagcattgccaaactaaaaggaaaggaggcactgactcgtgggttgaagcaaaatattcaagaacatgagagggttctcagtgagtccattgttgatgctgatctaccatcgttgtaagtacctagcatgcatattgtgattgcccccttcaatgctttcagggtccatcttttgagttaaaactgtgaaaactaaaacatcctcttttgtgtgggggtggtaactagatcatctatgtactgcatagattcttctgcaagcaaaagaattgaaaatccatgtcttttatatcttaatccagcactcatgtgtcaaaattttcttttaacatttctatgttttctgagttgtaaatgttgaacttgcaccttggtagcttgacagaaatttcagtctggttctcttagtaattaacacttaaattgtgctttcagtatcaaaagcaagatagagaagatggaccaaacaataggaagagctaaagcatgcactgttgattgtagcaacgtcgacagaaagcttcgccaaatacttcatatgacagaggatgaagctcattttcatatgaagcagagtgcatatctgtacaatcttggtgttcacacgatgcccaaaagtcatcattgccttaacatgaggttgacggtagaatattttaagtccgctccattggattcagatgactctgctgtgcataagtttaatgttccagaccataggcactatgtcatattatctaaaaatgtacttgcagcttctgttgtcatcaactcaactgttagtaattctgaggtatgcaaccaaattttaacacattcaagttggtagaatctgctctacacttgccatttctgattttctttttgtgattttgcaggagaccgaaaatgtagtatttcatatattaactgacgctcaaaatttctatgccatgaagcactggtttggaaggaactcctacagggagtcagctgttcatgtcataaactatgagcatattattttggagaatttgcccgagttcagctcccagcaattatatttacccgaagaatttcgtgttttcatcagtaatcttgaacgacctagtgagaaaaccagaatggaatatttatcagtgttcagtcactcacatttcttcatcccagaaatattaaaagatttaaagaaggtgattgtgttggatgatgatgtggttgttcaacgtgatctctctttcttgtggaatattgatatgggagataaggtcaatggtgctgtcaagttttgtggtctgagaatgggacaactaagaaaccttctgggtaaagcaacatatgatccgcagtcgtgtgcttggatgtctggggtgaatgtgattgatttggagaaatggagggagcataatgtcacagagaattaccttcaactactgaaaaaggtcagtcctctgtttaaaattcaaaaacataatagtgtgcttagtaattctgttccatggggccacaaatttgctaattatatgggatcatgacttgctatggtcgttgaaatgaactgctcaaacttttctctgagaatgtattgttagcttatttagtaatcttattttgttacagttccaacacaatgatgatgaagcttcagtgcgagctgcagctttgccaataagcttgcttgcctttgaacatcttatatatcctctcgatgaaagattgactatatctgggcttggatatgactatgccatcaaagaggaacttgtccggaattctgtatcattgcattataacggtaatatgaagccttggcttgagttaggtataccggactacaggaagtactggaagaggtttcttacacgagatgaacgattcatggatgagtgcaatgtaagtccataatgcacttaaacctgggaaacaaaatatctgacggtagattgctacgtctgctgctgtattatatacctagaggggacgagcacttccattgaggaaaaatggggccaggaaagcagttattagccatcaattttgacagagtagatccagcaccatctgttcattgaattagtgagcttgatggatggtttttctacagttagagaaattagtcttaagctgaaggataatgcagtagacaatgatgatgagtgttagtgaggcttcaggtaaagggagcatcactctcaccttctagagtacgggacagaacgatcgatcggtggtgggctgtggcacctttattcaaattggtaccttgcgcctcatcgatgcaggttaattcttttctttgttgaatttttttgacccccttgttttgtcctgtcaataagggcatacacaggctaaattcaaattctttgttcttagttgcacattgattgttcatcatttttgtgtcggtggaaagtatattttgttgtcagaaaaccatcagttacacaacgagattgacagctgtttggatatcttttgagtgctcaagtccaattctcattctccagtaaattttccaatcttgtattcctttgtattgcattgaaatgggtgtgttatcttgcaaccatcaccgtttcaagttcagctctagaagagagtcatccataaaatcttatctcatcctaatttcaacaaccaatctaattttcggctcaccgaactcgtttgatctacaatatcataaatgtagccgaataaatacgcctgattcagcctctgtagtctgcactgcagttaccactattgtcaaaagcaataccagtgctaccgcggaatcaggcatattcgacagcccactcggactcggccactgcctccgcccacgctggacttacatgccaaaacttttcaccccgaaactaaacagggccttatgttcacgacatgccgcgagttcacggtcattttttttccttttctttgttttcttgagatgacaggaggtccggagctcacaatcttcactggttacttgaggggataagtgcaactactataagcttctacacacttgcctctaaatgtcatgtaagctcatatgatgagctggatgagagatatgaaagaagagagaatgagccatctctcatgtaagaggtaatctctatacaaactataagagagatgataacaaagagaccaatgaattgataggaaacagataaaataaaattaatactccatccgtttcagaatataaacatttttagagttagacattattattaagaaaatagatacaattaaatagggaagggttgtgattggatgagaagtgaaggtatgtaggaacattgaatggtggggagttgtgattggttgaaaagagaatgttggtgtagaagttgttatatttgggacaaattctagagactagaaattgttatattttaggacggagggagtatgatgtggggcaagtgtgctagaggtaatttgttgtatctatattgcctcttaattaatgagttgatgatgtgtactaaattaagggtgactatcacctccactataaaacttgccctaaagaacaccaggatcagggtgcctcgaacactaggagggaatgctatcactatgcagcagcgcgggactccgcggtagcggatggccatggaaccagcaataatcgttgtcaactgtcaggttctttttcacctacttcgagcaccaccgctgcatcttctcatgatgccactgttaccgttctagaccagtggtttagcccctctgctaccaacgttgtttacgccgttcaattcttgttcgcgcgtattggcaacattagtgcacgcatttgttttgagttgttcctagggttggtaaagccggtatgatgtctaatccttcacggtttgacaatttcggttattcgacgtcatcttccacgactgtctcgattaagttaccgttttcgtcttcagtgcgtccctatgaaccttagtccagggtgtcgttccatgtgcccacaaccactcgttggcaccccttgtgccctgtgacttggctaaattgtccatggtaccccgatttcgattacatcatctaaaggctactctaatcacgaccctttttgaaattagctctgtcgcagtccacatttcagctacaccgctatcattgttaagtcatcctactgatgtcttctctagcctaaacgtt

SEQ ID NO: 12294 - DNA, 5281 bp, Oryza sativa
agagaattcatttgtggattccattactgctatatatacccgcccctgatcaatatccatcatgctcatgcaacgtacgcaccaccccctccggccctccccatccgagggcatcctcatcaatggccgtgctgactgctggactcgaaccactggccgtggacacatcaacgagcgccatggcgggtgggtgccattgcacgctcgttggggccgtgccgacagccgacacatgcacggagatctcacgccttgttggaagcagctgaatcatacagccggctaggctattgcagttttagtttggattcctcgaggagaaatcaccataagactatttgacttgaaagcttcaaacaggtttagttcaaccttaccaccattggttcatgtacttccaaaaaaaaaaaaaaaccattggttcacattcaagagataccagtaactcgggacatttcagtacctagctcaatatcttctgagctgcaaggaggaagagggagttccgtagccttttacaactgactccctgaaataaaaattgtacccaggaagatggctagatctcaaattctccttatttcatagtaccggagataaatttgagttattgctactgaattataatacaagcggacaccaaacagttccccttctctattaggcttttttatgttccttttaaatagttcagctcaatagacttggatcagcactagaatttcagccaatatagatggaaccatttttcttttaccaagtacatgggcagaacagctataatctgaatgcactctacattcagatgagttaactgtcaagattcatgcactctacgacgcttctcttgggggagctccgatccatcagttgcaattactggggaatcaggggactcggttgctgcagttttcaggttggcacctacattggtagaatttttagggtggttgtctcctattctgtttgggtccaaggcagcctcactgtccttgtctacagaattgcttggctcagatggagttgctgtatctccagacgatggatcctgcacactctgtgtgctggatttacattgcttttcaaacatcttctgcagatatttcccttgttcttcaattcgaagctgcaatttcctctgaatctgcaatagagcaatcaaatgtgcttcaggtcatgggaatttaatttgaagtatatgagcatgtcctacccctatattattaagaccagtgcaattgtagcatgccacattcctgcagtcacaattttgttcattgccacaaactagtgtcgaaaggaacatttctgagtctcatatttgtatccccaaaagggtagcaattgttgcatgcctcttttagtttattaaggtgccatttgcccatttggcatgagcctatttcaaccaaatttagagtcagtgcacatgcttttgaattagtacctcgagttgttcatgaaggcgcttctgaacttccatctgaaggcgcagtgcttcagtaagatccatgctcctacataagcaaaacaacataatgcaagggtatctagtactggtgactgggaagaacatggtgcacttactgatccaacagaaaaatgaacatgaaataccaccattccctcaataatgcataatggtaactcctaaacataatttgaagtaaaatggatatatcttctattgtgctatatgagcaaactgtagatttgaaccatactagtaggcgaatccctactcttattttgaaaccatgctagcaagtgaatcacaaatatatatgtgcgaccaactttttctcaaggcaattatttactttagtcggtaatgcaatctgccatccagtcatgcctacgctcttgatctgaactttgatgcatgttgatttgtaaaccacacagtaccctacttattagttagcgccatgtgaagtgtaccaaaagtacaatgaaacaggagaagagacgatggaataataatatccactcacgctttcaggtccaaagacaactcatcggtagttttcccttcttgtgttttacctgcatgatgagttaagaaaaggtcagagttgtcttaacaactcacataaactagaatatggttgcatgcgtgctattttgcaacaagggatcttacactaagtatttaatatttcatcatgaaaatatgcttttacaaataaattcacagcccttgccattatcatgaaaattgtacttaagttattgccatgaagttctaaaaaaaaagttattgccatgaaaaatgagttcccgtatgtaagaatatgtataaataaaatgcaagtcagagaggaacccaattgatataaaccttctgataggtctggcttgtagcgagctgtgcggtacttctgcagtaaaaataagtgcagataaagaaagtcaaaactgaagtctcctttcagcaaatatgacatttagaaagattaaaaaaagaacctgcagatgactcttaacatgatagattgtcaaaccatcaactttcataagcttgagcacaccttttggagtagcttctgaaggttttttttttttaaaaaaaaaaaactattagactatgccagaataggattcgtatatataagagaaaaccacttgagtggtatttacgacacggaggacatactttcactaccaccaagcttatttacagcatggacaaaagattcatgcaattccggggtccatctcatccgttgtttacttgcagaggcattgctgttgttgggaggaggacttgtgacaggacaaatatcgccactatgggatgaagttgactgattgaaagcaggctgtgatgcagcagaattggaaggttgggccatggactgtaacaaaagagatccataaatatttagcattctgaccagggtagaaacataaggagcgctatctatagcatcagggacaaaaaaaatgcgttaaaggtaagatgcagtatacattgcttagaatttccaggagcagcctatgtcaagaacatgaacaattcgttacaggatttttaacacattgaatcaaatatttaatctaccaacagccacaatctcttcaagccaaggaacaagtaatcattgctcttgtacaggtaatcactttaacaaatgacatctcacacaagtttcgagcattcaataaatgaatagataaactaacaaaatgcccttgtgtaataagggaaaaaaataccgccatggttacagaagtatgttgctggaaaggcaaaatttctctaaaattaatcacgatcatataaattagtaaccgggttagagtgtaggcagatggtaccactattaccagtaggatgatgtcaaaatactctcaatagattatagtgttagaaactttcgtcaacatgttaaaataaataggtgtatttctaaacttccagaacacaagaaagggatacaactttactctttatggtattgcagttacatacctttgactgagaatcagtagctgttgcatctagaatatctttccagtcatcattcattatatctgcccaccattcattttgtttagcagcatcagatgtaacagtagaggagccgctctgggtgtgattatcagggacagttatagtatccatgtaatctggcgcgccacaggcaggagctgggaaaaaggttggcacagtgtgtcccccatgggtattattattacataaatactggagcatttcagcattcgacgactgagaaataaagggagcagccataaaatgcccctcatggctagacacagaatcaattgggttagcagcatatcctaacattgctgaatatgatgatctgacaacactggctcttgggtgcgaaatagaagattgagttgcactctggtgcaaaggcatagaatcatttggcagttgccctggcatcagaatattctgggtattatgggatcttgggatatctttcaaagatttcggtagaataggcaaggaggatgacatctctccagaaatacttgttttgcaactgcctcagatcaaacttccctcactgcaattctgcaaatagtgcataagatttgcttctttcccataaaatagtttgaatgcctttctacagatcaaactcgcccaaaatgttagtccatcactctgtacatgattaagaaatgaagagttaaaggggtgagcttattttgaggtcatggaaataatagtataattgtaaggaacatatatagactgtaaataatatttcacacatttaagcatgctggaactaatcatgaataagcagcagtgttgctagtgtcaagcagatgacacaagcagaaaacaaaaacggctaagccatgaaatgtacatctaggtgtaaaccttttgtacactgatgcacaacaacaaattttacacccccaatattttgaccactccaatggtagattacattgcataaacctcatttattagcattacaaaccggatactttcggaaaagttaaaatgtaatacctgcgatgcaggttcgacttctagctacattgcaaaaatgccgcaaattccagttccaaggtattattcagttaacatttttcttgaagctataaagtgatatttttcctgcatagcaaacccacatgcagaactctgtggaacagggcgccataatgatggcctgaatagtggtggcacaactggccccaaccatcttttcctactatcaagcaaataactctttacctaagacttttttgccacacacacacatgaaatgtgtacttctctatcacgcctgcaccgattaactcacagtacggcaaccaatggttaagcactagaatatcctgtttctagggcggaagcaaaccatcacagcactacaccactccacagtactacctaataattctgccgtgaagctcccccggttcgtaccctcacagaatcaaccccccataattccctgtaccaacaccatcatgtccgctcacgagcatgcggtacagcagctcccccccaccaaactcccacgccctacatgtcgcgatcaaaaccctaaaccaaaaaccccctacccccagcttctccccggcgggcacgcgctcgtccgctcctgttccataggctccaaccggggccgatcgatggagacggcgtggactgagactagattggatgggaggagaggaggcgtacctggggctgcggcggcgcgatcggcgcggcggggagcggcttggcttttcggaggcgacgagggaagtggggaggaggggggggggggaatct

SEQ ID NO: 12295 - DNA, 55349 bp, Oryza sativa
ttttcttgttcggccgtgtggcggccaacttggacggctgggatggtggtccatggggactggggaggggagagagtggcaacgtgtgcgccagaactttgaagaaagaaaaccggaataatgatgcaaattgcgaccaccggattaaaaacatggctgaagaaacttaaacaccccctacttattattaggttaagaacactttaacaactacccaatataaatatattttagagtaaattatattgttagtacacaaacttgttaggtgggtgtaatttagtatataaacttgtaaaatactcgttccagtacacgaacttatctagctagttcgtgcgaacgaggaccaaaataacttggcaatattaattttacgaagttgatattgattaggatgtgacgtgcatacgtgtagtgagtatgcataagacatgtaatatttataaatttagtctctatttcatccttcatcattgaaatgatgaatttcatatgtttttaacccttatatcagtgctcgttttttaatatttttctactatcactaaatcctattctatattttattgaatatgatgtctaatggtaactttctctcatgtatgtgtttacatagtatcctaatcagcccctaaatcaataagattagtcatatagtgtcctttttaacttccaccgcacgcaccatacaagtttgtgcactaaaacaagcattttataagtttgtccactagattgcacccacctgataagttcgtgtaccgacaatgcaaagagtaaattgcatcggcggtacacgaacttgttaggtgggtgcaatctagtacatgaacttgtaaaatgcggtacacgaacttatcttgcgcgtgcgaactaaggtcaaaaggatattacatgactaattttgttgatttaggtgctgatcaggatactacgtaaacatatagataagaaggttgctacttagacatacacctgttcaataaaaagatagaatgagatatagtgattatagagaaagagataaaataccgagcaatgatacattggttagaaacatacggaatttaagataaagtagagaacatatttataaatatagcatgttttatgcatactcactatacgtatgcacgccacatcttaatcaacattagctaggtaaaattaaccttgccaagccattttggacctagttcgcacggattagataagttcatgtaccgaaacaaacattttacaagttcatgtactaaattgcacacatctaacaagtttgtgtaccaccaatgcaatttactccattttatacatattgaatgggtcaccaactactcctagctatcagtacaagtagaatggtttgctaatttctagagagatggatgtgcaaggtgccactgttggaaaacagagtaagatatatgaatgctcaattaccaatcctataagtgaactacaatctattatactataatcttgcgtaattcgagacatagttttaggttcttgcaaatatgctatatgttgcagattagcctttactttccaccggctttttttgacatcttttggggaaatgtatcaagcgaaagtatccaattgttgtagtcatcaaagaggtactctttcctctttgatgcattgataatgtacatttgcttttcccaattcgtcattttaacattgtacaccaataggtaggaagaaggatctatgatccaaaattttgaaagctaatggtacgaacgacagtcactataccattgtaacatcgtgtgtgttctctttaataaaattgattcatttttaatggaaaggatgaatgtgtttgcacatggaggatacaaatgatagtaattgctgcgtgatttaccacatgatcaggagaaaccataattcaggtcatgttgaccagggaaatcaattcccgttcggaaatgaaaatttaataaaatcagggtgaatttgttcaaaggtttgaacatgattccgaatttagggtaaattactatctgaatgaaatttgaccctaagcctctcctgatcagccatggtgttggacggttatgtgtccatcggagtggtgggagtgacgaggaggctggagatgcctggaatgatggaacgaacccttaaagcctagtatttttctgattctgacatcttttttgttgggaaattttgataaaagcactatgactttgtggttttagctgtagggcaccgcactagtgacttttggagggaaaacacccccaaaagttagatgtttactgatgaacaccgcacgtattaaagtaataattttcagttaaaaatgagagagaaatcgtgtgaaatgtcagaaatgcccttgggcacacatgtcagctctcctatctctctctatcccctccttcacttctttctctatcccacatgtcagcgatgtcggcgcgcaggtgaggtccggcggcagcggtgacgggagggcgatggctccggccgctgacaacgcccctccctcctcactccgcgtgggcgacggctccggccaatggcgcgcccggacagcgatgccgatcgccgacggtgcccctccctcttcactctgcgcgctgcagccgtcgtcgtcgtccagccgcgccgcctctcctccacacgttgttgccaccgccgaacctcgcctgctgtctggccaacaccacttgccggcgccggcgctactccgcacgccggtggtcgcgtacgctctgccctcaccctcgccctcgcctgtccaccgttgtggttaacatgtgggatagagagagaagagattagagggagaagtgtagtagaggatagagagagaagagagataggagagtgggcccaaggacatttctaacatttcacacgatttctcctccttttcaactggaaattattactttaatgcgtgcggtgtctatcaacaaatattcaacttttgatagtgttttcctccaaaagtcacttcgtgcgatgttctatagttaaaaccgcgaaatcacggtgtgctgtagcaaaatttgctcttttttttttctgatgacctactctcatgtcatctctctctgtgaaaaaactagaattgattgcccttttgatctttcgccactttggtagcatccaatatccattgatacagctaatctaatacaagtaagtagtaacagccagcagggaccagaggagaatatgttctttcgtggtgcttctaacaatatattagaaaaatcaccatacaaaatcactcttaaagagtgtaaatgtaccaatcacataacataaaatttcttcgcatctctacatattcgataatccacttgctgaagaggaagaaaaagatcgaccaaaacagaatcccaatccggttatcttctacttcggttcgatcttggattggaaggaataccctccgctgtagtcgaacgagtcggtgctcatgtccttgtccttcttcgggagaggatcgttgtaaggatggcgtggggcacccttggtgacgtcgaactccgtcgcggacgtcgacgccgacgtggaggcgctgctcagcccctcgctctgcagcatcatctcgatctccttgacgacgtcgctcatcgacggccgcgcgccggccacctcctcgacgcaccggagcgccagctggacgaacttgctgaatgcggccaggtggttggtgttcatgatcctggcgtctatcatgtccttgatcccgcagaactcggcgtcgccggcgtcgaacgcccgcttcacctcccggacgatgtacttccctttctcgatcggctgcttggcgatgatcagctcgagcatcaccaccccgaagctgtacacgtcgctcttctcggtcagctgctgggacatgtagtactcgggatccaggtagccctgcaagtatggaagaaggagaacaacaaatcagacgagccgacggcgaagggtgcagcatatcggtcggcgtggtgcgcgcgtttaccagtgttcctttgacttgggtgctgacgtggcccctctcggtgtcggacactagcttggagaggccgaagtcggcgaccttggccgtgaggtgctcgtccatgaggatgttgctggacttgacgtccctgtggatgatgggcgggtcggcgagctcgtggaggtaggccagcccacgcgccgcgccgagcgctacccgcagccgcttcttccagtcaaggtgcagcccgctcttccctgcaaagaaaaaaatccaacaagttcagggcgcgtgccgtgcaagaacgcgcggcgcgtcaggaacgcacggacaaatgtggtttgtggttttaccggagaggctgtcgcggagggtgccggcggacatgaactcgtagacgagcatctgctcgccctgctcgaagcagaatccgacgaggccgacgaggttcttgtggtggacgcgggagagcagctcgatctccgtcttgaactcgtgcccgccctgcatcgacccctgctgcgccctcttgatggcgatgaacgtccccgtcggcagcatccccctgtacaccttgccgtaccctccgtacccgagctcgttcgcctccgcgaagttgttggtgctccgcttcagctcctcgtacgagaaccacctcgcccccttcagccgcggcgccccgcccctctcctcgctccgtttccacgacgcgaacggcccgcccagctcctccctcgccttctgcgcgcgccgccgctgcacgagcgcgtacaccgccgcgcccacgagcgccaccaccagcacgccgcatccggccgcgatcccgatgatggcacccttgctcctcgacgacgaccgctcctctgcacaccaacaggtcagtttgaatggtaacgagctgaacaatgtctgaatcaaattgatccatgggagtcatggactgacctgggaaggggtagggcgaggcgatgaagtagtaagggccaaactccttgggcggcttgaaggtctggttgctgaggtcgaagccgatgcgcatgacctcggagcggttgaagtaggcggagccggaggggaaaagcttgacctggacctgcatgtaggcgtcggcgttgaagaaggggtcctggaggaagacggagcccggggtgaggtccagcttggtccacagccggctctccagctcctggaacgccgtgccgttggtcacgtccccgaagaacggcgccctgaagtacatcaccccctggtacgggtacgcgcacgcgcagctctgcgggctcatgctctcccccaccgcgttgcacgtccccgagaagcacttgacaaggctcgtcgagtacggcgccgccgcggcgcgctgcgtcacgttgcagtactgcgtgttcggcagccggtcgcacaccgggttcccggccagcctgatcgatgtacagggagttaggcaaggagaggcagcagcgaaggccacggcatcattcggagatggttggttcaatggactcacgaaagggtgccgttgtagctggcggtgaccgtgacggaggagagctggttgtccttgaggctgacgatgctcagctcgctgctgatgtacttgcccatgtcgagggtgccgttgaacgcgttgccgtcgaggatcctgcagcgaatggtgagcgtcacaagttgttgaggccattttgtcaggcggattactgcacagtgaggctggtttgttcagtgagcttacacttgctgcaactgtgggccgctgaacagcctcatcggcaccgtgccgtaaagcctcccggattgtatgatccttgatgaacagcatcacagagatgatcaggtcaggttttttggttatgccacatgtgagagcatgttctgaagctggaggcactggagaaggagaacacttacagagctgagagctgtggcagcctccaaaaccattgtgggctaggagaagggtcgaacgtgttgttgctcagatccctgtggtaaaattggaggagatttcaagtcaaacatgattgatggtatgtttaagttagaagaagaaattttgtggaggagtgccagtatcttacacataattgagttgggtcatctgagatagatcaggcaatgggccggtaagctggttgttggctaaattgctgaaatatgacaatagcttgtttagtgtgaatattccatctcacatatacaggtgcactggaactgtcaatggtatctatgcaattcttgaacaacttacagctcatttactttagtgaggttattcagattctctggaactggccctgagagcgaattcctatcaagccggctgttcaaacaacaaacagagcagatgaatgttttatgtaatccgacataacaaaaactgtttacgtagtttcatgtgaagcttttgtttgtggatggacacttacacaacttcaagtgtagtaacaagcccaagagagtctgggatattaccagtgaatttgtttccatcaaaaagcctgcatcaaaactcctaacgtgttagttcacctttttagctgaattgccaactgaatcaaagaagcaggaggtcaggaacttacaaatggatcagtgtcatctcaggactgaagagggcatctgggattggaccggacaattggttcttgttgaagtggctgcagagagaaccagaaacatatggtcagtgctacatttcatttagtatggcctcttgaggaataggaatgaacaaacttcttaggacctacaagtgtttggttttgaaaagcttgtctaaacccattccaccatttgtcgagattggtaagggacctgacaattgattgtcggcgatgtcgaaccaatagaggttggaaagattgcccatagaagctggtatttttccagagaactgatttgagttcaatgccctgaaagacagattatgtcagtcttcttctccagacactaagttgcagaagtctcccaattgtatgtctactaattcaccagtgagtaattctcacatgtaagacaattttggcagactccctagctcatccgggatgttgccatggaaactgcaaccggccagaatcctacaaaataggcagcacatgagcatactaacttcttagatggcagaaacctgaaagagaaatactttcagaacttacaaggtggtaagctgcttcaagtttccgatgtttggagtgagcacgccgccaagatccttattaaatgacatgtccctgcatacatgcagttctctcatgattcaccgttgcaggtcggaacaacatgaggtttcagaaaaaaagatcaatcttgaacagtgtgctctgctgctacatacagggattgaagctcggtcagttgccctatgtcagcagctagaactcccttgatgcccatggtagaaattttactgaaacagtcgggtagcagtgggtaaacgtaaaccttgtagttggaaacatgcagagttatagaacagagcagtagagcacttacatggagatcactctgttgttgctgcataccactccatcccatggcgaatcgctgcatgggtcgtcagactgcccccacgttggcggcgcgttctgccactgatccatcaacgcgcggagaacagatgctacaaccaaatccacggttcatttcattcttcaagatatcacacaataagatcataaatacagagcagcacgagcttcataaacaaggttatcccactccttcaagattggacaatcatggagacacgcctctggtgttcccttccaatcatcgaagaatatacagaacatttgttctttccctcctcaaaatcaataaatccaatcgttcaagactgagaaaacaaaacgatcttaacactagctgattaaatggttgggtcatatggtactcactgtcctggctatccgtcacggcatggcttgctcggacgcacaccgagagcagcagcacgacgccgagaaccacccgtctcatcctcgcacagcctccgggcaccggtgccgccatgcatgcagacgacacgatgagctgcgtgcgagctgctgctgctaccagaggtgcggttttaggtcgccccggccactcaggaaaaggctatagctgtagctatagctcgggagagagagacagagacaaagaacgcgcaaggcaactaccagcaccacaaccgcatcagcatgatgcgcctcatgatgggatgtgcattcaagaagccaacatgacatgataagcttggaggttagagatacacacagtggaacagagtgtggtgtgtgtgtgagagagaaagacgacgacgacgacttggcttgaaagcaatgcaagctcctggcccggccgcctgggtggtgtcgtggtgagctcgcgcgcgcggtgtccgcggaagccaccgcgcgaggggtcaaaaaaaggaggaagaagacgctcgcgcgggcgccctcgtctcatcaacatatccctcgttccacggcaagtcctcactcagattccctgtaccgtggcagcgacgtacgtagacgtggtgctagtgctagccagattgagatcatctgacgtaaagttagaggacgtggttactgatacatgatcctatcggatccatatattagtgatcatgtcacggagaaattcacgtcggagaagctgcttccatgctaattttggtggtggactggtggttcccggtgtctaaagaaaaaaaagagaggaagaaatggtttgttccatagagggttcttaaaggtgatgatggggagcttagtgatgatgaggggtgtgatctaaggtacgtcgacgggtggacaatttggtggggattaaacaaaattatgtccatgatcaagtgctgggactttggcatgcactgggagaaaaaagtgtggacagattgacagaaggaatgttgttaggatgttttgtaggcttagggtgagtttgggagggggattgggaagatacgcaaaacgaggtgagccattagtacatgattaattgagtattaactattttaaattttaaaaattgattaatatgattttttaaagcaacttttctatagaaaatttttgtaaaaaatacatcgtttagtagtttgggaagcgtgcgcgtttaatacgatgtccttttctcacccaatcctccagaactcatcacaacgaacgcatccttagtttcagggagaagtgaagaaccgattgttgcaggcaatacatgttcgatgatgctgatttgatgcaagaaaactactatcccttccatttcataacatagtaattcgtaattttttttaagtcaaatatttctaggtttgataaaatttatagaaaaatatagtaacattttcaacacacgctacatttaataaaactaatttagtgtggtagattttgctagattttctataaacttagtcaaaactagaaaagtttgactagaaaaaaaatcccaaaagtgagttatgatataaaacagaactacgatatagagatacacagagacgtcagtgtcagcatggtgtcacggcctaactaggaacaataagcaagactttgtcaaatggacttcactgatgttggtccgtgtgacaacagtgaaatgagtgagactgtgagagtgatgcctgctgcaagggaaaaggacagccagttatacataaaaacagagctttgatctgatatgcttttttttcccatcagaatatatactcagttggaaacgagacgattaacgatggcttgctacatggttttgaaaacatatgcttttttttttttgaacattgaaaacatatgctctctcttgttttttaccctcggtgctgtgaaaattcagaagtgaagctcttctttttaccggctggttcatgcgttttagttcatgatggtggttgatgatgatggctggctggtcctgaatcacgttagcgggataattgtttcgaagcagattaatttcatatcatgattgggctacttttacagcaattttacattgtaaaattataatttatgaaaaatacatcaagcaacatggtttcaagtcttctggaatatgctccacgcagttgccaacctgcggtgagagctgccaagtagaaccccatcacgaggtctttacacggcaaactcgtgcctttggctgcgatgataccggtgttgaagacaacattaaagatctactagtagaattagctagaaaaaaaactaaacgaaattaggtcacaatcacgagtgtgactgtcctgtctaggaactttttgcccaaaggtgggaggaaacgcatcgaacaagttatgcaacaggttccatgaaagaaacctcgacatcaagaagtgcacatagatgttaccttgccatattttacagaacgacaaatgattcataaatgtctctccaaataagatcgagtaatatatatgactcgtgggaacttttgtcataggttgatgaatttcaagtagtggatagaaaatgttgtaaggaacaaagtactgacaaatgattaatcaatatagtgacttaatcaaatctatattgcacgtatattagtatacaccgaataagtggtatggtttctcaaatcccatgggaagagaaaacccaagaaaacttcaaaaaaagttgtttgcatgtacacataagccacagaaaattaatagacaaatgacggtctttatttaatgaaattggcaacgaacttgtaccggttcttcaaaaagaaagaaagaaattacctcagagaaattttttttccaaaatatctatagagttgctattccatatacattttaaaggaaaatgtaggattcgacaattaaacttgaagagtgaccaattaatcgagatagtggctgattaatccttcgagactacctaatgctcttcacatacactacacgtgaatcttgatggctttacctcaaaccgaaccctttttttgtacaacttcactaataaaagggtagataaatgaaaagagattaatatggaaataaacacaaagatatgatgcataatcccacacattcccacccttggcaggcccttaattagagaaaacattaaggtagttgtagtggagttattagttagtaataatccactgcatctatgtactccctccggtttcattttaattgatgctttggacaatgacacgctttataagatataactttgaccttatttttctattataatatatacaataaataaatgcatgtttacttttattatagtgttttgaaagacaaatttatatatgtttttctagtttctttaaactaaatatttttaaagttattgatggttaaggtaataaaagtttaccctcaaccttgttcaaaacgtcaattaatatagaaccagagggagtagcttggtgcgctcaataaatagcaactagcacctaccataatctcaagtggagcataaagctccatgtatcatgccacaggggaatggactgggctagtgctacttcacaccacgggatcctacatattttcctttttttttccgcagtgaataaaaacaccattgctatctttacaaaagtttgccttttgtttatgtctgtgatgggttttttgactacgaggtgctgtattgatgtgaacaagctctcatggaatgaattcattgcacctatgttcgggtctacattttcgtttcagttcgcagaacgaaagagagttgaattcaatattgatgctcatgttcttcatctcattgaagtcgaatttaatgtgggatggatatgtaggaaaaatcttacagtcaacacaaagaaagtatagaccgatatacatgtaaaggctaaataatgtggaaattaggatttttttttcctgattaagatatagattctacatcagtttttgttaacacgattttcaagcaactaaacagtatgttttgtgtaaaaacttcctacacagaagttaatctaaaatatcaaataaatatatttttaaaatttgtaataattaaaactgaattattactccatcctttccattttaagcgcagccataagtttatgtgtccaatattaatcattcgttttatttgaattttatttttgaaaaaaaataaaaaatataagtcacgcataaagtacaattcatgttttatcatctaataacaatagaaatactaatcataaaaaaatttcaaatataacggactatcaagattggacacgaaaactcataactgcgcttataattggacagagatagtagtacatattaacatgattttcaagctactaaatggtactttttatgtgaaaactttctacatttgatctaaaatataaaataaatctattttttaattttttataatgatctattttattattaaaacagctttgaaaagagtcatcacgttcgctgtgggggctagaaatttccatattaatcggataaaaaggaaaaaaagaaaagaagagtccaagtagaaatacaatttaaaaatagctgaaattcgaaattaaaaataagcaatattgaaagaagtttccatataaaaacccaatatgagattaatcaaaattcaaaataaaaataaaataaaatccaaaattagaaaagagaaggataatccaagtaggaatacaatttaaaaatagctgaaattagaaattaaaaataaagaatattaaaagaagagtccatataagaatccaatacgagattaattaaaattcggaataaaaataaaataaaatccaaaattagaaaaataaaataaaataaaagaagagagctcaagtaggaatacaatttaaaattagctaaaattcggaattaaaaataagcaatattgaaagaagagtccatataagaacccaatacgagattaattagaattcagaataaaaaataaaataatatctaaaattagaaaaattaaaagagagttcaaataggaatacaattttgaaacaattgtaattgaaaatgaaaaattgaagtattaacagaacacaatacgataataattgaaattcgaaaaaaataaaatttgaaattagaaaaagaaaaataatatttcaattagaaatgcaatttataaatgactaaaatttgtgataaaaataatgactattgaaagaaaagacgatctaaaacacatgacgagataaattaagtaacatgcctcggttgatatgataaataaaaactgttagtaaaacaccaaatagaatcctaatgacgattaaaaggagggacgacagtcatgccgtgaaggaaacaagcaaggcggttgccgggacttctagaaagtaaaaaaaataaaccccattgataatcatattcaatttttaaaatctcaatgacaataaaaaatagaagcagcgggtgggggtgtataggagtatagttgcggagccaccgaaggttgacggaacttctagaaaataaaaaatgaatcccaaaaacagttatgtttgatttttagaatcacaatgataataaagagtaggtggcggacgggccgtagaatagcatagtagcatcgtttgaaggtacttctaaaaattataaaaaataaaacccaacaagacaataaactctaaaaactacaaggtccaatttttaaaggttcggaactttaaaaaataaaaaaaaacaatgataatcatgttcgattttaaaatctcaatgacaataaagaagggaggcagcgggcgagccgtagaggagtacaatagcaaaaccgctgacggtttggccggtcttctagaaaataaaaatgaatccaaacgataattatgttcgatttttaaaattttaatgacaataaagagaagagacagtggatgggccatagaggagtataacggcaacgtttgacgggacatctagaaattataaaaagaaacccaatgtgacaataaactctaaaaactataaaatccaatttttaaaggttccaagaagaatgaatagaaatattggtagatcgagcaagcaaataaagaagtagatgacataaggggtagcaactggtgtgacttttaaaaactatataattagaaacacgaggatgataaggtttgatctttcaaaatcttaagacaatgagatagctatttaataaattttaagtaaaatcatacttaaaaaatatatgattttgtttgggtactagccgcgtaattgcgcgggccatccagctagttaaaacttaattaatcatgtgctaatgattttctcgttttgcatcccttaatcccatcttcctcatcggctgcgaacaccaaatgctttctgttaaaaaaaacacgaaacttatgttcttcaaaaacaggctagttcaatgagccatggtaccaaatatccctaagttaaaagaaaatccctaggatattttttaaacaactagcaacggtcagtaactgacgtatcataaaatttgtgttaaccgtatatctcgactactataaatacatataaaagaacagtttcgtttgtccatcctccttacacattgtttgttcgaggaaaagaaaagaagaacgaatgagcaatgggcaatggtcgtctattgcctagcacagtgaagttgtactaagaagagggtggcacttgccatatccatgttagcatgataaggatgggcttgggtatgttgaagtttggtggagtccctgggctgcctaagaaaaatacccactcgcaccaagtcttctttttgggcatggaataaattctttatctcatcaactcatgctactattgaatcccatccctcaaccgtaaaatcaggtataacccgtcccctaactttcaaaaccatagcaaatcgactccccatatggttccagaggtggtttcgtcctacacaccacttatgtggcaggttcacttggtgtttatctcacgtgacgttgacatgatgcttacgtagcactaaaataaaaacaaacctaaatgggatccacatgtcagtgagtaaaagaataaaaataaatttcgggcccacgtgtcgccaccctttctcctccctctttaccatttctctcgcaggtgatggcagagaccggtggtggatggcggcaacagcgagatggagcacgacggagggcgaggactatggcgtttggctgccgggccgctgagttcgacggctaggtcagcaagagcagtctgctcgccctcgctagtagatgagctctccgttgcaggcggtgcgcgagcgcggcagcgttgatctcggcgaaggggacgagctgtaggggcacacgacaaccatggcgcgcacaaccccagcggtgacggaggcaagggagaatccgggcgaggtttgcggtaggtggagcacacctggtcagggaggacgcggcggtggtggggctttagggcggcggggctcttggtgggagtgaggggacgaggcccatatgcgtctccctgtggaagttgatggccttttccaggctccggcactgctcctgtatggctacaaggtcatcgccgctggcgtccgtctacacctccattgctgttgtgcggcgaggaggtcacaagggcggtcgaggaaggagatgaggttggtacggggcgctagagcaaggcaacgaggcccatctgcatctcccgatggaaaccaatggcctcctccaagcctggcgctgctccctcatggcggcgacgttcgcctgcgcctccattgctgttgcggcggagagatcgggggacgtcaggggcggggcgcggagaggggcggcggcgttgctcccatgcgctgaaatccacctgagatgtcgtgagactgactgggagagatgagagagaggagaataactgacatctagggcccatttaggtttgttttttattttagtgcgatgtaagtgtcacgtcgatgtcacatggatgaagaccaagtcaaccgtgccacataggacgaaaccgtctggggagtcaatttgctacagttttggaaattgggggacgggttgtacccggttttacagttgagggatgcgattcaaccaaggggcatgagttgagggacgcgaaatagacttatccccttgcaatagccatccattttttccagcccaattcattcagcatcctctcgtgcataggccttctcttttttgttagggaaccgtccagtttcatccttatcgacacgacctaacgcttggtcaaccaacacgaaaatattggacgacaagccgacggcccacacggaatcctatctcgtggacggacattaatcctagcaggcagccttggtccgaggccggacacgtgaagccaaccatgacaaaccctcacgcgctcctgttaactccggtggacccttgccacgccaccagtccaaagcatttcgccgctggggaccccccgtcgcgacgcgccgtttcctggctggcacacgctcaccatttcggcgcaatatccagctgcatgcacgcatttcccccgggcgccccggcacacagccacacgccgcctacgagcagcacgagatcgatgcgtatgcgttttcctgcgggcatgcacaccgcggacacggcgaaaccggctcatcgatccgttgatgcgttcacgtcgagacagctggatcatcggcgtccggtccgtcgtcgcgtgtcgtgtggcaatgaaggtggccatgctttgtacgtagcgtggcccccgttgcacttgcacccaaggaccaagctggaaatttttccggaaaccgtggcttcagaatttgtagaaattgtgtctctccatttcagtcttgtacacggagttgcttgtagaaggtcggtcgggttacacgcagagagataataggtaatgtattgaacatactttcgtgccagtaagagttaaggacggtacgtagagagtagtgaactgttatgtttgagctacaaaaggaaatctagagcttttgctccagcaaaaaggagcccatacatacatgatcgtcaagagatgacttgtcttggttagcttgagcctgaaggttaattgcttcactgttcagcataccagttgcatgctaccagctagtgcccacaaagtagaatctagaaagcgctaagctttcggactctcaacaactaacaaagtcgcatcggcttacacccgtaccttgccttgtaagagaatccttatattgctaatcctcctgctccatctcgatccacataacgatccactgttaattcgtccttcgacatatggaagggtctgtgcgttgtccctgtcgcctttattagctgcgtgcaattcctttccagcacagtaagtgacctaatcaattgtagttaaatccagatgcttccagattatgcacttaactgagatcaatccgagaggccagtttgatgcgggttgatgagcgaggtgtcctgcaggtgctttggtgaagcacacctgctccatgactccatcccctcaaatgttaaactcacatgcatgtactatacagttttttaaaacagcgtttttcagaactcccaggtcatgtttaaaactgaaaaaaactatttctaaataaacatactacggagaataaaaataatctgaagataatctatcctagtacgagagtaacagtcgtatactaaagtaaagtaaactctgtacaaaacagtggttgataaacacagtgactgactacgaatattaaactctgtacaaaacagctgaaactaaagatccgcacggcacaactgaaactgcccttcctaaacccagacgaccaaagatcaaaacaaaaacaaacaaaaatccacatataagattgtctcgtaggcgtccatcgctatccccacccaacaccacactacaacggcaacagtagtagtagtacctgattatccatccctaacaaatcccacttccccacacacgccaaaagcctctcctctcctttcctcctcctccagtcctcctcactgtccgtcccaagaaccactcggtgcagccgccgccgccgccgcagccagtgccattgcaagaatcgcgagggggtattgaggttgggcggcgagatgagcatgtacgggagggacccgtggggcgggccgctggagatatgccacgactcggcgacggacgacgaccggagccggaacctggacctggacaggggggcgctgtcgcggacgctggacgagacgcagcagagctggctgctggccgggccgggggaccagggccggaagaagaagaagtacgtcgacctcggctgcctcgtcgtcagccgcaagctcttcgtgtggacggtcggggtgctcctcgccgccgccgtcttcgccgggctcgtcgccggcatcgccaaggccatccccaggcaccaccgcccgccgccgccgccggacgacttcaccgtcgcgctgcgcaaggcgctcatgttcttcaatgcccagaaatgtgagtgtgcttccctccctgccgcctcgcgcgtcggagtatcagatcatttttttcctttttttgtgagttctcagttgtgctggattagaaatggtgggttttttttggcgatctgggcgatttatgttcgggagcttttaggatttgattattgtgcgtttgagctttgccaagttctgaagattcgatttttttttcatgcttctcttggtagaataggaaagaccggattttcccgttgtttctcccggtgatcttgtggacaggaagtttcaagtctttagcttggtttccggtttcttccgagagttacgatggcttgagagttgagacgccggcttcagagatgggatttttattttattagcttggatttatttttccggtgcttgaaatgggaataactaggcaccaaaccggtctgtccatcagatccatccgtaaagattacaggagtttatctagaagaataatatgtccaacttaaagatcacattttgatggtacttcccatttgtgtatttgctgcagctggaaagcttccgaagaacaacaatgtgcattggcgtggtaactcgtgcatgaaggacggactctcggatccggcagtcgggcgcagcctcgtcggagggtactacgacgccggcgacgccgtcaagttcaactttccagctgccttctccatgaccctcctcagctggagcgtcatcgagtacagtgctaaatacgaggcagttggggaacttggccatatccgtgataccatcaagtggggggccgattacttcttgaagaccttcaactcaacggcggataccattgatcgtgtcgttatgcaggtaaaacaaagatgcaaacatggatatgtgcagagggattgtagttcttgccatcagagccattgctaattcgagattttatggtgggtgcaggtggggagcggtgcaacatcacccggttcgactcaaccgaacgatcactattgttggatgagaccagaggacattgactaccctcgcccagtagttgagtgccatgcttgttcagatcttgcggctgagatggctgcatcattggcagcagcatcaattgtgttcaaggacaataaggcgtactcgcagaagctggtacatggtgctaccaccctcttcaagtttgcaaggcaaaaccgtggaagatatagtgcaggtggttccgatgctgcaaaattctataactcaaccagctactgggatgagtttgtatggggtggttcatggatgtatctcgcaaccggcaattcatcgtacctgcagttggcaacacaccccaagcttgcaaagcatgctggtgcttactggggtggtccagactacggtgtattcagctgggacaataagcttactggtgcacaggtaattgcatttgttctcttctgtttaagtaatgatatagacattccccaggttgacccattggcatttaatttggtacttggttgatgcttgacatgaatattccgtatctaacatgctgatcattataatataggactatctgttgaatcaccaattttgtatataatatgtgaggtggtttagttgcagtagctatcttgtgtggagtcaacttgttatgtggtatatcaagacctgaaatgtagagcattagtaacaattatagagaaagaggtacacaacttgtatgatatattaaggtttggaacaccgtcagtgttgtcctgtctcccttttttgttctttggaatttcctaaaaatgtgacccatgataacaattgttttcagcatgcaacctgcatttgggctcatcttttaaataaccagttctggtaggtttcaactatgtgtgtcaaaagaattggtcacacttctctctagtttaacccgttgaatcatagaacctggtaacttttgtgtatatgctatttcttaaccttcaagagctaaaattctttgctactccctccttccctaaatgtttgacgccgttgatttttttaaacatgtttgaccattcgtcttatttaaaaacttttgtgaaatatgtaaaactatatgtatacacaaaaatatatttaacaatgaatcaaatgatataaaaagaattaataattacttaatttttttaaataagacgaacggtcaaatatgtttaaaaaagtcaacgacatcaaacatttagggatggagggagtacatagcagtagctagtaaaaaaaatccagatgaacaaataaacggatttaacatatcaattggtacttattttatggtctgtcattacaggttcttttgagccggttaaggctcttcttaagtcctggttatccatatgaagagatcctcaggacattccacaatcaaacaagcattattatgtgctcttatcttccaattttcaagtctttcaacaggacaaaaggtttgaccttgaactcactgaatcacacagtcacacattggtttgtgaacagttagttacttaggccctgtttagttctccaaaaacttttcgcaaaaacatcacatcgaatctttagacacatgtatggagcattaaatatagataaaaagaaaaactaattgcacagtttgcatgtaaatcgcaagacgaatcgtttgaccctaattagttcatgattagccataagtgccacagtaacctacatgtgctaatgacggcttaattaggctcaaaagattcgtctcgtggtttccaggcgagttatgaaattatttttttcattcgtgtccgaaaagcacttccgacatccggtcaaacgtccgatgtgacacccaaaaattttcatttcaccaactaaacaggccctattattattgtatttcaggtggtttgatccagttgaatcacgggaggccacaacctcttcagtatgtggtgaacgctgcattccttgcttctttgtacggtgactatcttgaggctgcagatacccctggctggtattgtgggccccatttctacccaattgaaactctgcgcaattttgcaagaactcaagtaggtttgcagagtttaaaatgttggaatcttgtaattccagcagtttttaactcctgatactaattcactacttatttcagatcgaatacatcttaggaaaaaatcctttgaagatgagctatgtggttggttacggaaaccgttaccctaaacgtgttcatcatcggggtgcctcgatcccaaagaatggtgtccactacggttgcaaaggaggttggaagtggagagaaaccaagaaaccaaaccctaacatcatcgtcggagcgatggtagctggccctgatcgccacgacggcttcaaggatgttcgcaagaattacaactacacggaagcaactctagctggcaatgccggtctagttgcagcattagtagcattgtcaggtgaaggccatggcgtggataagaacactatgttttctgccgtgccgccgatgttcccttcgcccccaccgcctccggcaccatggaaaccatgattggctgccactatctgattctgattcattttgtatacggcttatttagattagtgtttttctcccttgttctggaaatgctgggggaaacctaacagaaaagaaggcgtcaggtttttatctttgtttctcccattgttgtatacttgtataatccccatgttatgtaacactattgctgttctggtatgaacctagtaattaatactatctttcctcgtggatttgtgggagttagatttttaagactctgctttcttgaatcagtctatgaaacggcaacgctcatattaacattcacgtcctaacccattcgatttgtactctactgagatgaaactgagtaccacacttgggccaaaggtcatgaataatgatgattcttgcaacccattttcattaggaaaaagtccaccttcactccctaaactaatgaccaaatttgattcgtatccttgaatcgcaataccagatatatcgaccccccaaagccccaactattaaaaccggtgtaatttgactcccttacgtttttagagggttgtttcgctggcgtggcgcatacgtggcggtattgacctggtcttcgtccaacgtggcattgatatggtatgctattataatacatggacccatttatcattcaaaaaaattatgggccactgacatgtgggcccacatgtcatcctctctccttcccttcttcctcttccctctctcccttgttcggctgtgtgcactgtgtgcagggagtgggtgctggagcggcagcagcgacgacgacgtcgtcacataggcgctccgtctcgaggcagcgcccgccctcccgccatcattattgcagaaatgcagagccaattttactactaattccacaatacgaattcaagcacaagtagaaatgcagagaccgcaatggttctactcctagatagcactcgtcgccgccggagctcagaccttggttgcctctaccgcccccgtcacccgaggggcaaggacagggggagcgggaggcgtcgtggcattggccttcaccacgcgccaccatacccagacgacaacgagaccggtgatgagcaagcgcggccaagacgatcacggcggcggcgatgaccattgcccaagcattcgtcgcgtgagtgacacccctacgccgacctctaatcttccaacacttataatccatcgtgatcgtggtgggggttgtcagaggctgtaaggccaatgaggttcactgccaccgctcgtcgccattgaggagacaaagaagaaagcctcacacagcggtaggagtacttagtagttcgtagtctctcatggagggtttgcaattttgcccttgggtttggttatccgtggatacccggtccgataggtatggctctacgtatgatttttttatgtaccatttaatttttaggaaaacatgagcgaaaaataaagaactagaagttgaaaatcgtactaccgaacacacccttaatatatttttgtttagcttctctctataatccataaaccaaaaccatatgagccatcaaaacacattactcttatccagtggcggatccagtataggggcggcggggtctcgagcccccactactggggtgaagactatgagagacgccacgaagaccccactaaattttttttaccatatgtagatgggaggggggactgtaactctatctagtttattcagacccactgctcttatcttctaaattcatatcgatttaatagcacgtacccttcctatactagcagtagcagtttaatttttttgtgacacgtgatacaagataagtcattagcatatcaattatcataaacttaaaataaatttatttaatttttcaagaaacatttcaggctcattcggaacacaggattttaaaaacgcaggaacataaaaaatgcactattgcagtgtcctaacacctcaaatcctatggattaggaaaaaacccccaaaaaatagccattttaataagcacatgaaaagtacgggaataagaaaagagatagacacaaaggacttttttccctaagaaattaaagctcatgttagaattcccctagaacttctaggttttgagccaatccaaaggaaatccgtaggatttttatagctattcctataacccaaatgtccatatagaaattattttcacatgattgaatttctctaaaattccttaaaaagaatcctttgttccaaaaaaacctttatataaaaaacttttacataaatgcatagtttagcaatttgaaaactatattattgaaaataagataattatagtttgaagttgatgtaaagaacgcacctaagtgtaatattttttatttgggaatggaatgagcacaaacaaaacaaaaggagtgcttgtctgatcgtatcaagcctgattattagaccggatacggttgccattgatttatttcctccgtcacaaaatatttttatgttccaagcaattattatatcaaagttgataaaatagaaacaaatatattgtgaccagataaagcgtgggataattacattagtattcgaaaagagtaaacggtattttagtgattttactttttattactccctccgtctcataatataagagattttgagtttttgcttgcactgtttgaccactcgttttattaaaaataattgtgcaaatataaaagacggaaagttgtgcttaaaggacttttgataataaaatatgtcacaaaaaataaataataatttcaaacatttttaaataaaacgagtgatcaaacagtgtaaacaaaaacacaaaatcccttgtattaggatccgtcccaaaaaaggcaaaccgtgggtttccgtgccaacgtttgactgtccatcttatatgaaaattttttataattagtattttcattgttgttagatgataaaatatgattaatattttatatatgacttatatttttaattttttttataatttttttaaataagacggatggtaaaagattgaacaactttttttttttttttacggagggagtacgtggggagagataagaaatgaacaacggatggagtatgcgcgaccggagcgcatcgatgcgcgcatgaacgcaagccttcctgcgcactacactgcgcatacgcaacgcgcagtcgcggagcagagaaaccgcgcggtctcccacgcgcgatttgaatcccgcatcgggacccgcggcctgcctacagaccaaaacaagctagcggccacacaaggcagaacaaatcgattgacagtagagggaagcagggttggtgacttgtgggtgtgcgcctgggcggattttaattgcaccgctccgatttcttttggatttgacgaccgatcggccccgccggtggcgccccagcatactactactactactaccactaccccgcgggcctaatccagcccaaccgagttcgctgctagtatacttttggataatggccattcgaacttggtcggcgccagcaaggggtgtcttctgttgtcgccgcatatgggtccggcaaaaaacttcgctttttctgtggcgagttcaaattgcgggtaaatggattgaactccgaatacggaagaaaataataccatagaacaaaatagtagtagtactactgcagactgtagattttgatttggaggaaaaacacagtaattttgaaggatttcaatcctataagaaaaaattcacatcaataccattgaatcaaagaattaaatcatatccaatcttttgaaatttctatggaattggacgatctcgtagagatttaggaggaaacttagcaagaacttaaagtcttggaaaatttcctttgagtctctctcttccaattcatgtgtattttcctacggctcagtcaaacaactatttcttgtttttcatgtgttttttaatcttctattttaccctacaatttatgttagaatcctgtgttttttctattcttttattttttttcattccagcgattcaaagagaccctgaaggcccaacccagaccatccaaaaatgtttgcagtgaattccctcggtggtcgttgcaagttctagagctgtcaaaaatgttcgaggctcgtaaactgcttgagctccaaacgagttgagcctgagcctctcctaaaactcgcgagctttgttaagtcgagctcgagcttccatcgagtttattatttgtttcctcttctattaatatgattaactagatattaattattttttaagatatcatcctcaaaatatatattcttttacttaaaaattaagcttgatagtcgaactcgagcttgatcgaactcgaaccaagctgtttgaaagatcaaatattttataagctcggttcgaggttgtatcgagcttatagcttaggcgagagctcgctcgagatcagctcgttcacagccctacttgcaactacttctcgcggctcgctcggcgcaagactgcgggccacgcagctgccaggttccagccttggctggcgactcgtcggggtgtggccgtgtgggctgtgtggcaagtgaccatatgtgtgtatccaccgcgcgcgcgcgaggcgcagccgtagacaacagcatgctcgtcgggcactcgggcggctgtgcacgcacgaccgtgtgcacgcagagaaggttcgccgcagttcgctcggcgcgacaaggccgaggaggcagatcggcggacgatccaatcctgatctttaacccacatgaaaactgggcgagccgccgtagcagtactgatccacactaggacaagatggtgtgcacatggcgcggcacatgcgacccgctgcgcacgcccagtcagcccagaggccacgggccaagttgggagtcttggggagagacagcaccatgataccgtatcacaccctgcttatcctcggccctaccacgctttgcccacacctgtgcgcagcagcagcagcagcagcagccgtggcccgtggccggcgtgcatatgcggcagcgctatctgcaatgcaagtttgcatcttggactgcactgccccggctaggaaacaaaacccagcagggctttgcccctgtgggcccaggttcgggaccgggagcgggttgacagactgatgtgtgggtccgacgggcttgtgccgggccccgtgtcctgtttgccccagactagcaaaggatcattaggatattaattagcttaggcacaacagcacaagctaatgcaaacgacgtaactagaggagtagtagtacgtgttagtgagatcctagtatatagattagcggcggagatgtgggccgtgggcctgggctccaagatctggtcttttgctttatttaggtttgactgcaacgctgtccaaaagaatactgccccactactgcattgagggagaaatttcatcgagccccttgagttttgcacttttgctactcctggtagagtacccagtacctttgcccgtgaccgagaggctctctgtttatttattccttctcggaattcgagctctgctttccaatgtcgtgtcttgccaattgtttgttcattgggtaaagatttgcctgtgcatgttcagggtccagcaaactttacaggcttttttgttgccagtctacagtgtaaagcattgaaaaaagacttgtggctggactctcgctttttaaaagtcctctttgcgaaaattttcggcgagtacaaaagtttcataagctgtttcccaatacgtcctggctccagattaggaacgatgtataggaagtaaataatattttgatatcaatatgtgtataaaagaaaggattataaaatataggaaaaatatatatataaagtttaaataggccataggtaaaacattgcaatctgatgagaatgataaactcaaagaaaaaatttcataaagattgaagctattgctaactttcatttgaaatatacatagtacattaaaaaccactccttacaaattctatagtaatagaaaaaatgctcgtgcgttgcaatgagtgaagattattttaatcttattattgttatatggtttagttaagctgaaattcactttgttaaatttgcttgcatatatatttgttagaaaatcatgagctgcaattaggagtccgaccgtctcaaattagcatgcgagtttttagaagaaatttcttatatgattcattctgtatttccaaaaacgaacgaatttaaaaaccgactcaaatacggatttatatttccaaaagcgcacgaatttaaaaaccgatccatacccagatgacatagtaaagtaccgacaaaaatatcttcaatatatatatatatatatataaagtagttaggagtcggtattttttatgtataagttttttctcttttttctccaccggagagtcggaattaagtcagacatattttttaacgatataagtttttatttttggttttttctctctctcttttttccacatgaggagtggtacttttttttcttttattttatggtagaagttgtttttctctttttttttctcgcctttttttccactagacgatggaaacgcctcttatttttaaagtagtagtagatttagaaaactccaatgcattatttcaaaggataaataagaacttttctacacattgtgtacactcataaactctagccaaatgtatcgagaaaaatcagaataattttactcgaacttggaaaaaaatgaaacaaacatgactggcaggatgaagagaattcctcctacgtaacatcccacctaacgtagtcaatgaatgtaaatgatcatatcctctgactttacattagaggatctcaatccacatatcctaactcatatctgaaagatatatgcactagagttgcccttgtaaggggggattggaagatctataatcctaagagtgtggtgattgttttggtgattaataataacccattgttggaactaactatttccatgagttggtgagattaggttaagttccggcatcgagtaagatgggcatcttaccttgatgaggagcaagtgaatacagtgatgatgcggggtatgaagtggctatctatggcaaaacggtgaagggaaaacaaggctcggctacaatggaccatgcgggggtgaagggcaagcaagaggctagcgccgacgaaccaaatccggtggtgaagggcgagtgaaagctttgtcattatggaccgtgcgaggccatttgaagctatgagtaatccgtatcaattataagaagaccgcaagatagaatgccgaaaatcaagaggaagctgttctccgatgaacatcaagtcaaaagccaaagtaggcattgatcaaggcaaaggtataattgatttgggactaatgtgcttaactagttgtagataagaatagtcccaatggagaaatggcgttgacgttggcacccctgaaggcgaagcaagaagatggcaagaaggcattccttgcatttgagtataggaataccatactattaagagggatgcaacattgatatgtttgtttatgtctcggtgataaaagtgacctatgcaagtgctaccttgagagaaaccaaagccttaacctaacatatgagtggttttagagcttgtttctagttgggttgggtagccctctcaaaaagctttccatagagcccaagtttaccgaaaactgactctggagcaaggagttatgaccgtttttgtgaagtgctgtcagggtagctcggaagttccgggccctgggccaggaagttccgacccgatatctctgttcgggcgaggagggtgccaggaagttctaggtctcggggcaggaagttccgggtcctgttatgtgagtaacggctagttttttgggggcttgggtttttaatccccttcaccctcttctttgttggctgctaattttgggcaagaatagacctatccaaaaccaaatagcccctccgaaacctcctaccttagtggtagatctttgtgagtgagatttggcaagagatttgagagattgagaggtggcaaggttgggattgcatctatattgctctctctagttctacttggacaaggggacatctatgtgtataaatataagacccccctagggagagggaacaacaacatatcaatatagatcaatacaaaccaacatgcgccaagacaagccgccgaatattgacatcagagataagcctagacaaacccaatatggttctgcggaagccagcaggagggatctagcgctatctttgatctcgccgagtgcggattcgaggaagaagactaccctgtcatcgactatgtattggttatccatgccgctaagtcgacgacagctagataggttatcccaattattgtactggtgtgattatagtgaataagagcaataccggcttcggccaataggagtagggctattacctgtcagataaggggcccgaacctatataaaaatccttgtctccatctcttttacctcaatctcgcatataccctggtaccaatgatccctataccatccaaatattgtagtcgtgatctcaagcgttgacaaaattcaatgcatccccccctctccctctacattatcttttccactagtaatttcctccaaacttcatgtatttctatctatagtgttcctctattttgaaatcatgtactgcatagcatgcaacaatctattattacatttttcttattcttgtatttaagcaacgtgtggtagagactcttgtaaaacaactctactctaaagaatatatggaaattttcaaaatgatttgaatcctccaatgtttgtatgaaaatcatctgttcaaaatttgtatgaaacagaagggggttttccaatcctacaaaaatctcagcagcaattctaccatccaaatgactaaaattccactttgaaacaatggattgagaatatggaatgaaatttcctttagagattttgaaggaaaataatcatgaggtttcacctcaagtttttcctataactttaaattcctatgtatcaaccaaacgatagttttaggaccttgtttttagaaaaaaatttaatgagaacgtcattctattttacaatcattcatttagggccccctttgattcaaagtaaagttagaggaattttggaggatttcattgctatggatttttttttcataaatggccctttgaatcaaaggaatggacaaaattgaatgctataaaattcctatggaatgcttcatgccatgcaattttcgaggaaatctaacatgaggtagaacctcatggaaacgttcctttgagtttttatctctcttataatttctgagtttttcttgagatccaatcaaacgattattccggtgttttttctgtgtttgacaatcctttgttttccacttacattcctgtcaaaatcatacgttttctcaatcctgcgattcaaagtggcctaaaattttcggagctcacaaaatgaggcaagggttgtgagcgtcctaggactaaggaatattttcctatagtacagtaaagttctttgccttgttcaaattcaggaactagggcctctttgaattggagaaaaaaatacagaagaagcaaaggaattggaatcctttagaaaaggttaatgttcattcctttggttcttaagaatgagcaaaagaaaaacacatgaaactcgcatttcctaatgattctgaaggcactactatagaaagtgtcataggtgtcagttaagaagcctctatacgtgtggattttctagccagcaccacagagacggcatagatgaccccgagtcattggtgtcatttccacaactaacacctttgaggcactcgctaagcgaaaaaagattggctcgatgcatcggctcgaatcgaggttctcccattgccccaaatccaaattcaaatccccgaatcaaaattagatcgctaccaagattgattgacatcacaaaatcatgaacatatatagaatcaacaaaagaaaaaacatccaaatcagcaaaacccgtcggtatgcacttgacgacattgagataaggccgacgccaccacggatatggtgtagggcaacgacgcccccggggggggggagcagatccggaggccctcaaggttgggcccgttggatctgtcatcggtgccaccaccctcgccgtcgctgatgaatccactggctggggagaggccggccgttacctgctagggaaaggtgccagcgaagagggagagctggaatgagaggaaacggtgctcgcaagagaaaagaaagagggaggcgtgggcgagagagagaacaggctaagggataaggacgggagagagagggtggctaaaaaaatttctcgtcctgatggtggctcggctcagtttttctaatagatgttggttgttttagaaccgactcctatactacatgtgttggtttttatctagaaccgacacctataatataagtatatatgctattttttttaaaaaaaccaacacctatactatgtgtgtcggtttttatctagatttttgcctgatagaagtgataaatggaaaataggtgttagttttaataaaccgtcacttagagccgtaacctataaggtattttgtagtagtgagggaaacatagggcatttaacatcgactataagctcatgtttttttttctagctcacgtaagatcgaggcaaatctagggcctgtttgggatagttttacattctgagaaacagccaggggcggatccaacgtgggtgcaggggggactcaaaacccatggatacctcaggagcacccccttcgattttttcaccataaatgataaactaaaggtctttaaatagctagaggttgaagaaactgtgtaattgagcctccccaattttttgttcctggatccgcccctggaaacagcgagaggggatttagcttgtgagagtatgaagaatttgggaaaattagcttttgggtgtgtttagttccacggccaaaattagaagtttgactaaaattgaaagtttgaagaaaaaagttggaagtttgtgtgtaggaaagttttgatgtgatggaaaagttggaagtttgaagaaaaagttgggaactaaacaaagactttgtcttctagtttatttgctgaattcaacaactacttgttctcaaaacctaaggccttgttcggttactagggatttaatccccaaggggaatcaatccagggagggattgagtgaatccctctcatgtcactcaatccctgttggggatgaatccctccctacccactaatccccctctcaaatccatgtgttcggtttggtcaagatcaacaatagcaggattggtgctttcctgcttcaacgctgctattgagttgatgttcagcttggcagtttatatgcatcaacttcagagcatcaaatggaggaagcatcaaacatagcaacggaatttgataatatcttatcgtacaaacaaaatatactcagtggagtaattactgtaatctccaatgaacatcaaatgtcacttttgcttttcgtcgaaacatagcattatctaatataagttagaatatcgatcagtcctagcttctacagtctatgcttgacggagcgtggggctcctcaccgggagaccgcgcaggcccccctttgccggttcggccggggaccctaggtgagactctaagctcccaatctgtatgtggaaggttcgcgagaccggaagcacagaagacgccggcgatgtatacaggttcgggccgcttagaagcgtaataccctactcctgtgttttggtggattcgtgtgtgaaggagctacaaagtatgagccagcctctcccttgttctgggttcctaatctggaaaagtccagtccaaaaaaaaaaacctcccttctctcagtgggcaaggtcctccttttatatcttaaggggataccacatgcaccatccccccctctctgtggggacttaccctaccttttcataaatggacggagatttgcatggttgccgttcgagtcaccttctgatgggacggcccgcacctacctccactttcgccgggagcaggcgcgacgcggaatcatggctgtctgctgacgacatgacctgtgtcagactggtcacaaatcggtcattcttgtccaccacgcgtcagcttagcaatctgcacgttggtccttcttcacacaacattttgcctgtaatggttaggatgaagcctggcatatatctgaccaggactaacgtgccatctctgggaggtaacacgctagctccagctggggacgagtgcctagaagccctcgtcctgacgggatggggcgaggcgtgcgtcagatcgcctgtcgccacctaacccgcgatctgaccggtctgtgactggtcacagaccggataaatgagtgcactgcaccgcgttacatgcggcgtgacacgctcagccaaaccgcaataaatgtggttaggtgagccccactgtgcccacctaacccatacacgcggagcgaaaacccacgaggggtcggggcgcctcggccctcggggccgaggcgggtgcggctcgaccccctcggggggactaagaggagggcgaacacatcaccctcgggcccgacgtcccccgagggtgccaggccacgtgggcgattgtgtctgcctcaaacctctagtcatgatactcccgatcccatgtcaccgacaatgcttaataaatattttagacatagtgaaagaagtgcagtgcagatgcataattaatccttcagcgcccctgcaacaaaaagatccttacagccttccagttccataatttacaccatcatcaacatcttctccaactgtcatcacaggagaattacgaaaaattatgtaagaccataatagagctgattgaggatatgtatatggtaatttaaaattccagcaattgacaactacttgtgggtaaccccaaagaaaggtagattataacaactaaaaattaagcattatctaatatagttttgtatggaagaccatacaaactacttgcaattttctgaagtttaaccatgttcagaacaatgatccagaaattaagcaacattctcctattcccccatgcatccatatggtgacattggtatacacaaataccattaactttaatctacagtacttcgaggaacttatgcaagcattgccttttgccatgccacacaaacaaaaaaatgattttttttcttctaaaaatagcatataagctagttgtaaatgatcatcttcatcatgcatgattaatattcataataacactttagacagaaacaaattgatagaggaattattatattcacatcacaaaaattaatatcttgtcaactttcagcattcttaaacatgttgcacatgacatgaagtataatcttatgaaaacatgttgaactgaactaatgcaacattccatttcttgttgtacatacataaaataaaaccagtgaacattataatgcacaaagtttcagactcaagtgtataacaaatatatggtgaatgtagaaaaggatgaccacctcaaccttcttctagtttctctctctagaaattagaacgtgtggaagtacaattcagccttgaaaacactaaacacttgcttgctagctactggtaatagagtgtgactctgaaatctgaacttactttgtagacagatccaaaaccaccttttccaagcaaactttcacttgagaaattattagttgcatcttttatgtcatagaaatcatacagtttaaagcccaagttgccctcttctaacctccagagagttattacattctgcattgccatggacagccttcgcagctccgatcttactcaccacgagtaagaactcatcgggaaatgcagcaatcaagaactcaccatgcccaaatcaagaactaatgatatggtttaggacgtgcggcagcggcggtggcgaatcaagaactcatccccacccaaccaagaaaaaaagctcattccccatctgatcaagaactcactaatcctcacccaaatcaagaactcactagatcgagcagaatacgaggaggaggacgacgaatcgcgatgacgacgggaaagggagaaaagaagaaaaccctaaccctagctttggaagaggaggggagaggggaaaatgctgcgtgctcaccggagagaagatggcggccggaggagagcgccgtgccgtcgccatcgccgtcgcctccgcgtcgcgccgcccccgccgttgcgccacctcgaatcgcctccgcgtcgtgctgccgctgcgcgtgttgcgcgtcgcctcccgctcccgtcatgaggaatttttccacgccacacgagaagctgattttttcccgggcctgggtgagggggaaaggccgggataggccggggtaaaacccagactgggcttaaccgaacacacaatttcagatgggccgggattgtttcctcgccggggtgatccacggggattgggccccgatcccagccggaaacggcccaaccgaacaaggcctaaatgaaaaactaagactatttgggggttttcgattctgaaagcagctacagctttcacaagcttcccagacagcaatagtagctcttggtcacttgtctattcaattagggtgggttatatggatataagtagataagtaacccaatttattcaataatcatttatcattacaaaatttatgtgtttttcaatcatctatgttgcacgtatgctcgtattttattcctttgttttttcctattttttaatatttttttcaatcaaacgttttaagaaggggcccatagtttaatttcggagaaaaatcctgtaaaatttgaccatctataagactataatataaacgaggcagcaaagcgaagcactgtgtgatagtactgcagttcctagtgctaccgctaccccattatctaattacccgtcattggtgattgacattcaatagcattgtgcgttttgttatcagaaaagaaaagataaagcaaatagtagtaaaagtaaaaaaaaaaaaaaaaaaagagtacagacaacagactgtacagtgccatgcatgtggtagtataagcaatcgctatggtttgctaggacgtaaagtcaccatgacatggtcactgacaggtgggcccgagagcggtggggcccacatatcagccaccatgctagctgtgtggtaatagtatagtacccatgtataaaatcttggggacgcactgcaaagggccacatgggcatggcgagccgtgagacccacacaggtactggctttttcaaaccggggaaagctacacgtacgctgtaccaacagccgtaaagccaagcagaagcttttgctgtgcgtgcgagaaacatgtatacggacgacggaaacaccggtcaactcctgtgcgcatatgcaaggcaaacgcagcatcacacagacagcttcacgctagtacctttcccagtacagagtggataagcaaaatggattaattgggtagaatggtttatgagtcaaggaggtgagaaagagaaattgctagtgcctagtggtagagcattgttgacccctagaagctagaaccggctcataaaatcggatactcccttttccctgttagatcctctattttcaaagataccatatctttatcattgatatataagtccaaggtttatcgggtccacatatcagtatatcagtgacaaagccaaatgcttttgaaggtggaggagcttgatccaaattgtatggtccggttttggatattcaaaggaaaactttatggtatgagaaacattttatctctttatttctttgccttttacatttccaaaccctaattaatattctaccttcgtctctatagcaattgaagacactctaggtgccctgccgattctagagcaagcctaggtgcacctaccctaacggggttcctcctgagcgggggttcgtaggtcttcaagacgattatgtgagaacaggtactctggtttccaaaacagggtaatccgtaatcggttttctcaagaagcgttacgagttgatctaattgcaatccacacgttgtagtgctttggtgttttgtctatctcaatgtcaacaagcatcacaatgcccatttaccttcttggttacaggcaaagaaaatatgattacatggcatgtactcgatcttctctgaagattcagacccgatatctcaatcttcataatttcggtcaataagatttcttgaaccgacaattggttaaccgatatgacggtgtatccagtcttagctaacttgaccgaacactcccgcgtaggcagactctagtgtaggggatggcaattttacccgtgggtgcgggcattcgctggtaccacacccgatgggtatgggcatgtgtacccaaatatttctattcatacatgatttttttttaaagtgtcaatactaactaaaacatactagctgtgtaagtgcaacaaagtcatatatcactctagcttagtcatttgtctttttttttcttggtgatgaaataatttgtaattgtagaatttatggattttggtccgtatttaatactttgtgattatacttattgagtaaacatagatgtctaattgtgatagtttagatatatatgtatcaattgatatatcacatcatgttgttgaaaaatccatggatacccgatacatgacgggtattgacatggattttattttacgatgaaagcattgggcatgggtgggcgagaactttgtcgtcttgggttgggtatattcttactccacccgaaccaaacttgatctattgccatccctacttagggcccctttcattcgcaggataggaaaaacataggaattgaagtagtatgattcttcaatcccgtgggaataaaaaacataggaaaaaatgaaatgtgccctttgatagtgctataggaaaaaacacaggatttcttttccaaagaggtcagacctctttctttttttcctgtgaaaatgaactaaagggatgcaatccttaggaatgttttctttcatttcctatgaatcaaaggcctccataagaaataatccataggattgtgaatcctaaaagatcctataccaatcctttgaataaaggagcccttaatgggaacttgagtctgctggactctcctgtgacctgtcgtagcgaaggtggacttaagtttggccgtaataatcggtttgctcaggtacctgaggaacacgaccgaaataacgaaaaatagatcggatactttggtctggctcctgtttttttttccttggttctttctgcacaccccaaaagacatgcctatctttgatccaagtcagcttgctttcaagatttcaccaaacctcagcatgatgaagaataactgtagttctctgcagctcagtaaagagtagggacttcagacaaaaaaaaaagaaaggtatagcgttcaattttgcagaaagaaactttcattgcctaaaattttgcacaaaaaaacatttattttcgaaaattatcaccaaactatatattcatcgtaaaatttattattcccccgtccacaacaaatataaatattcttagcactgctattcttgtactagtaacaaaaagctcttcttgagttctgagctcattccaacaaaatggatacaaataaagcataatattaagaaccaaagtactactccattgtagtaatactctctccatcccatctcattttaaatacagtcgtgagtcatgagtttccatgtttaacatttgatcgtctgtcttatttaaaaaaattttaaaaaattttaaaaataaatgtattattcatgttttatcatctaatatcaataaaaatactaattatataaaaatttaaataagacggacagtaaaatattgtacacagaatcccatgtctttacttaaaatgagaaggacactacagcagaaacaggatgtagagacggttttcttctcttgtagagacggttttgcccgtctctaggtgtactagagacggccctgtgtagagacggttttcttctcttgtagagacggttttgcccgtctctaggtgtactagagacggccctgtgaaccgtctctgaggcgttgccattgctcccgtctcaataaacaagagacggttttgctagccatgtctactaggtagagacggtccatagagacggaaaaaccgtctctacatatattttccatattttgtagaaatatcataataaatacactagacacggcttcggaccgtctctacatataaatttcttagatacagaaacaaacctcctcaattctggcatccacaattttatttggagaacatcagactgcatcacactttagcattataaataaaaaaacagggagggacttgtcgaaaaatcacacatttcactcactgaatggtaatttacatcttacatgaaaaggtgaacttctggaaaaaaaatgtacaatttcagttacaatatcataaacaaatacataacttggacttctccatctaattgaagtatactctctattgctccagattgattgaactgttatttcgttaatcatcatcttcatgcacccgttaatcatcatcttcacacaagaacctgctatacaatgtaactttacaatgtgaaaaaaaaataaatagtgaaagtggactagagtagagattgtgaaggaagctattgataaaatattctgtcaacaaaataatgacaagacttaccgcgcaaaacaacacgggatggactatgaatcatgtgaataatagatcaagttaactccatggtttatctgaacatctgaaactgaaagtagatcactcgatcagagtttgtgagagaatctatgaaaaaaaaattatgtcatacaagaagcaccatggatgcaaaggaatatgcctttcaatcatcaagtatatcacggagtttccaggttcagcttgtagtgaagtctacaaaagaaatcgtcttttgatctgctaaggaaaagcaaaagaatagtgaaacatgattaataatgtcctgcattggatatacagtgaaacaaaatatatattgacaacaagtgcagagttgatatcatttctcatgataaggcaacatgtaagttagcaatcatatatgcataatattttattgggaattaatcaacctcaccttgctagtagtaacatggaggtgcttcagcagtaactgaagttcctgagaattgataatcgcatatgtgtcaaatagcagcaaaagccatccctctagctagtctgctaacagaaaccctgcattaaggtaggaagcatatgaaagcaatcaaagtcaatatatatatgtgtatatctgttgtgccctttttgaacttaagaaattaagggattcagttcattttcccgaaactagatttacattgaatgcagtaatgttgacaaccttgaacaacatacctaacttttcaggaaagaaagatcattaagaacaatggcctctaaccacagtcccaatgaatgcaaattaaaactaccaaagcacaccaaaccagatgttcatcacgaatcgtcctaaaccaatgtatacctatgtggattctcaatagaaagggagaacaatgaaattaccttttctttgatgaagctgtgcaactcgatctgattcctcacggtaggtcaatccgtcgtgctagcactttcaatcagccaatcaggggatcatactctgaatcagccaaaaatcagagtctcatccctccacaaatctgctccccacgtgttcatctacctagcgactcgcaagatctgaaccgcgccgtggtggctgcaatggagtggcagcgcagtggcgataggcagcaacggccagaaaggagaagcgagagtgtaggaccggagcggcggtggtcagcggtggcgcgcgatggtggtggaggaggcacaccggcgatctggagcgggcgcgcggcggcgtgcgactccgtcgagggtttcgatagaccaacgattgtaccgagcagttccaaaaataaatagtgattatccgattaattaataattttaaaggatattatgatggtgggtgcagttaagtggggaggtagccacggtttatctctccgtctcttttatccgactctaggtgaggggggatttctcgcacgtacgttgggatagtttagtagcaacggtttgatgacccgtagtattttagtcgtctctagttgcctgttttgctgtagtgggaatagcatctattcacagtaatgtcgtaatgtcgtactataacaatcacaggttgagtttaacaaccacatgttgagtttaagcaaaacagtggggggtaagtgggagacactgatctgttatctcaccataatcacctgatgtaaccgcacggccaagtaggaccttgcggccagtaaaaagcttcagagaccactgcaatggccatgtgcccttcgtcagtttctgggctacccctgtcctgctgtccacatatgacactcttacagcttgcaggtagtactgttgctaaacatgtgaacgtgtggcaggcacttgcctccaggattaaccacagaatcagtataatatacgagtagttgttatacatggaagaactgggtaacaacatcaattgtctgatggcagtagtaaacaaaataactgctaactgccacatagtactatattctctagtataattaggcgcaccactaaattatttatatatatatagagtagtattatatatagtagtatatcacaatacttcatatgctgccactttttcttccataagggctaatggcatcttcttcttctcgtgttgtttaatggagctatccactaaaaggtgagagaagcttaaaaacgaaaagaaaggggagctaaacatcctaaaaactacgctgacactccactccttttttcccctatattccgataacactttctttgcttcatgtattcctgcacagaaataaacaccaaaagaaagaacgcaaaaatggcagcataattagatgggtagaagcctaataattgggaaacgtagtgggaataaagcagtgcttactatgatttctggagagggtttcagccacttccattgtggactactttacatcccgatcgccccgtgctcggacagcctgctcattgcatttgatcgaatcattccaatcgcaagtgatcacgaaatgaccagtacaatcaagtagtaatcaactgctcaaagtagtggcatggccaaacctgggcatggggaagaagcaggtccttggcgaaggtatgtccaatgtgggaggccggagagggttggcgctgccgaccgcactgccaccaatattgcagctactaccggtggtgaaatctccctcgctaccaatggcagtggcagcggttgcggtaaagaatgcggtcgacttggtagaggaagcaaacgggctgtctggcaagttgtgctcaccactgctcaaaatacatgcacaaacaatggtgaagcaaactttcagccacggaataattgcagatttgtaggcttgttgttcatgagttaatgacattagtctgagaatcatgagcaagcagaatgccaataatggtaaaaatctacctttggtcactatcggcattgcgggtaacctcaccggcagaatccgccttattaccaccattgacaactttcccctccgatggagagccgcagctcgccatcagttgcccagctgacaatgtacagtggatattggcaagttaagagaacttgattgattgacgtctaaagaacgagttcgatcaatgctatctatgcttactagagctaggcggtgactcgacgattgtggtggcaccgggttggccggaggtgaaggcattggtgatcggagtgggcagagacattgttgtcgtctccgccgcatggacagcggcagaagacttgaggtcgagcagctggaggccaatgaggcggcggctatggagatcaatagcctgctgcagctccgccgcctgttgctgctcctcgagcttccgccgcagcattagctcgttcgcgctgttggagtgctgcagcatccttgcacctgacgaacaccaaaccaacatccatcaaaacttacagctctagcaagcaacattgaacatcaggcaaacagggcgtccaaatggtaggagcaggtaaaggttgaatctttttataccgagctggtgaaaatcaaaggggtccctggcgtctaaccccgtgggcgacatgcagcagaaatcgccttgctgctgcttcctgaggagcgacgaacaacaaattcacatgcatgcaggttggtggctagcagtcgtgacaagcaacgtagtagtatactactactactaatttggagcgcttaacataatcgcgcatgcatttcttcattcaagccgcgtttcgaacgtacctgtacttgtcggggaccttgcccttctccttgtagggcttgacgagcacgcgggcgtcgcagatgaagtgcgggttgcccttggccaagatcagcttcaccgtctccgggtaaacgaaggtgacgaacccgaacatgcgcttctgctggtacgggatgcgcacgtcgtgcaccggcccgtagatgctgcagcgcggcgcgttgccaagaacagcaatgcaaaaatgccaatcagatcgcgtcctaccgagcccgccatgaaagaaggaagaagcatcattgcaacatcgcattatatacctgaagtagttggagacgtcctcctcgcggaacgtgctgtcggccgggaaggtgaggtaaatctggcgcgacccggggttcatcatgctggcgaaatcgacgcggtccaggcgcggccgccccatgaacttgtgcgcctcgtcgccgccggcgagcatcagcgcggccgcggcggctcttcacacgcgcaagcaagaaacgttttggaactttgaaatgccttctggcttggagaacgcatggaggttgcgaaggcggtagtacctttggttgtcgttgtgctgctgctgctgctgcaggaggaggctgaggcacttgctggtggcggatggcgaggcagggagagagcctgtgggggtgaacgggaaggcggcggggccgaggcgctggctcttggagcggaggaggaaatcctggcactgctgctgttcggcggtggttgcgtccatggcggcgtcgtcggagaggccgccatggacgaacctgcaggtgctgccgttcttgcagaacccgcgcgcgtagtacaggcaaggtttccacccgaagccgtcgccgccgaggcagagctcgttcaccgacgcgctgcggcggtgcccagggccgccgttggcccaggcgaggccgtaggggagcatcccgccgctctcgccggggccggggctccggcactccgctccgtcgaacgcctggagagcatgcccggggttcacgcccccggctccgtcgtgcaggaacgcgagctgctcctgcagctcgaagtcgtccaggagcgcgtccccaccccgaggaaagaagggcggggcgttcgccgcggcgcctcccccgccgttcaaggggctcattagctcctccccagcgccgaccatctcatccgcggcgccgccattgcccatgctgttactcctcgagaacggctgcgcctgcgcccacgacgacggcgacggcgcggggcagcggccggagttctgcctcgacagcaggaacggcgagtgggctgccggcacggtgggcgacgacgacgccgcctgaggcggcggcaggagggcgagctccttgcgcgcctgcgccatgacgctgtggagcagcgcctcggggccgaaggcgaggcgtatcatctccttgtcgccgtggtcctggatgagcaggaggcccatgatcttggcggcgtggtcagggtccagcgcctggatccgggagaacaccaccttggtcgcctcgtatgcatccatggcggcgcccaaagcttctcttctcctactcctaccttctcagtcacagcctcacaggcgcctttgcctcttggtcttcagttcacccttttaccacactactactagtatctgtgttggactattggtgctgtgtttacacttattacggccttaaatatacaggagctagcgaagcaagctcgatgctagtggtagatagagcaagatcgaggaggcagtacactagctagtgcttcttggcgtggtccggttgctctcggtagcctccgcttcccggagctgcggccactgagccactgagcagctccatttcccaaaggattgagagtgagtagtcgcgagctcgctgcgcgcccctttcttgagcacactggcctgagcatggctttcttgggccgggagtggactggtggagtgggcggtgcgcaaattttctgagggttttggggtgatgtgcacatacgaccagtttcgtttgagatggcccacttgtttcgaaacgtactccataattgtaaaaggaaatacaggaatattccctctgtactcataaaatcgttttgcacagcgacgtggtctccaaaacataattttgacttttggtttctataaaaatatttattgaaaaatgatatatgtatattaatataatttttacattttcaaattcaagaactcgagagttattcatgatatatatttctaaggtttgacttaaacattgttctaaacgacttctaatacgagtatggagggagtactcgtactaaaaagcatatattaaggtttttttaaaggaaggtcttcttcgatttatagaaaaatcggaggattttaattttattagaaaaattcctattaaggtcttcaaaataaatgactgaaacatgttgttccctttggaatgcgcatttttaaagaatttattgaaaagtgagcctaaccattctcttagaaaatttcttcaagtctatctcattttatttctatgtttttttttctacagtctaatcaaactatcatttctatgtgatttgtcaggttttgaaactcattgttttgctcttgtagtagcggttaaaatcctatatttttcctctttttttcaatagccctaaacgaacatcattctctttagaatacacaggattttaaaacataagaaaaattgaggtaatgtctttggacgattccaagcaaatcaaagcacatgactggaagttactcgaggaaaacaaaggaagtagagaggggatgaaagagtggattagacttctcaaaggggaaactcctatgttttaattattttccttttagaatccaggtgcataaataatactaccattttataggatctcaccaatcatgtcacatgctccttaaaaacttgagattgagaaaataaaggaatagaaatgcccatttgattatatcgcagtaaaaacacagaaatttaagagcgatgaaactcagaggaaattttcggttagtacatgattaattaagtatttgctataaaaacacaaaaaagattaatataaattttaaagcattttttctatggaaaattttggtataaaacacacaatttaacaacttgggaagtatgcacgtaaaaaatgtgagagtaaaagttgggaacctgtacttccgcgatggggctcctctaaagtacgttagagcatgtacaacaggtcaacagcatattttaagcagataaaagatgggagataagagcaacgagctacatatttgtagccagcttcagcacagactgcaagatacatgtgtgtatgacaggtgcgaccatacattaattttgtagtacatgtttataggtaactattatatgaattggctattaaattgattatagataattttgagctaataattggctatactattaaacttgctcttagatggatgtgcctctcttacttgtggatccataggagtggaccccacctgtcaaggattcacgttactttctctaacctcgcttcaaaggagctgcttcatgtatttatgggtgtgttccgacttgaaatgaggctcgtatttgtgactaattattatttcaatgataactgacaattatcgacaacgatgtgtccaaaatgacttcgttaattttaaaatatgccaactcgtcttttagaagtgcttttttttaagaaaatggattaaaatccagtctctatatccacaatgaatatacacaacccaattcagaagtgctattggaaataaaaagtgtgtatatgtgtttgaactgtgttttagaaaaattatcgtaacaaattaaatattaactatattatactaaatagtaacaaattaaatatcaagtatatatattatagtaaaagtataatcaaatatcgtttttgagggtttgttcggcatccccttttcccaacacatctctctcgtttttcacacgcacgcttttcaaactattaaacggtgcgtttttttcaaaaacttttgtatgtttctatacaaaagttgcttaaaaaatcaaattaatttattttttaaaagaaattagctaacacttaattaatcacgtgctaatagaccgctctgtttttttgcactctgttccggttgggaacatccgctagcgcgcacagcccgagtaaagcctggagcattcacaggtaagatgtactactcacgttgtactagcagttattttcagttgacttgttccacctacggaaagattgcgcattaatgaacaagcaagtgagcgctgctccggaagagaatgagaaagaagccaacagtcgcaaatattttagagtgcactacaaaatactcgaacgtagtacatatttttatatatatttcaaccattaatatgtccttacatttcaccatgtcatatttaaaccatttccatccaaagtttttattttcacttgcgcgaaggagaccgggagactccctctctttcaaaatgatcatcttataacatttttgaggttatttctaaataatcatcatatttattttatggtcattcattaaggctctgtttagttcctccaaaagagcaaaagttttgctgtttttgagcactttttgccaaaatggatcaaaacctagtagcaaaagttggcaatttagcatttatcatttaggagtctagagtagcaaattttgccaaaaagtacgttgggagccgtgctctctctatctttactagtaaaatggcaaaactttaccatgtatctaaacaccaactaacaaaacttcaatgccaaatcttttgccaccaaaacttttgccaaaaaaaattgccacaacaaattgatctaaacaggccctaagtctattcgttatttgtgcattaaatggacattgatgcatgtattcatgcacacaagtatttataaccaacatgcaataccttgatttactatttgctagaaaatggtggggatggtgcatgcatcaggtttgttgtgggagtaaatatactacgagaaagttattagagcaggtacaataatagactataagccagctataaacacatatcgagaagataaaagaagatagagataagcagtgggctatagatttgtagccagctacaacacaaactccaagacgcaacgttagtatgacaggtgggaccagatattaatagtttaatatatatttatagataactattgtacgaatttgctactaaattgactataaatgatttgaagctagtaattggctatactattaaacttgctcttagcttttcttaccaatacacccccacatgtctcttaaattgacatcaattaacatacaacaccgattgttgtctctcgcacatgcatcaagggcaatttacaccaacagtattgcttgcatgcaccaaaattgcatttggttgaatagtacaatattgaacaatgcatacaaatgataatttagtagtgcacagaaaaacgaaaaagtcacacataggaagtaccgaatatgccaatcatttctgaataacattgaaaaaattatatgattatcatttgtgaatggaaggagtagattctagcttggttttgttagcactcttttcaaaccgctaaacggtacattttgtgaaaaaaaattttatatagattttctctaaaatatcaaataaatttattttcaagtttataataattatttttatagaacttaattaatcatgtgctaatggtttctcattttacttgcttgtacttaatctttatccgccattacgtcgaacggggccttagggaacctttgtatcgtacgattaagaaaagagaggaataaaaattataggattttcaccagaatataagtgcgaaacacacgaatgattatttgaatagaccatagaaaaaatgcagggattgaatgagagagatagacccatagaaaattttcaaaaaggttggtgctaacttttctccaaaatctatatgcatgagtcaatccttaaagcaggtacaatagcaggctataagccagctataaacatattttaaagagataaaggaagagagagaagagcagcgggctacaggtctgtagccagctgcagcacggactccaagatgtaatgtgtgtatgacatgtgggaccaagtattaatagtatagtaagcaactattatatgaattagttattacattggctatagatgatttggagctagtagtgggctatactattaaacttgctcttaataatttcataggatttgaagaactgcaatcctttgtttcaaaagatcaaatatgaaaaattcctatataatttaaatcctagaaaattcctctaaggaactcctctataattcctttgcttcaaaggaaacctaattatattatggggacaaggaaacatgagtagaatttcttatattaaagagcagaggtagtaacaacgctcttgactatttgtcaaccactatttacggtttcgtagaaaaatggatgaggcattaaaactattgtatagataaaaaaacgtttatacttagtgcagtatattgttagcagtttcaaaactaaggctgaaaaatagaatataacaaaaagaactaaattaaagcatacgagagtgtttaaaagtaaggtttagtataattcgaattgtaaacaagcccgcgcgacgagagtgtttgcaagttagctggaaaaaaaaacatttgcactgcgattattatcggctgtgatatcgctggcgttcaatgaggtctccaatacagttctagcttcgatcataagcttagataattattcccctgtatgcactgtgattgtaagtgttgtgtcaagtgtgggtatgcatgtccttgaagatcaatcacgtaagacaagaagtgatctcgcttcaaggggccacgacgatttgagtaagcctacttcctatatatatatatctgccatcactatcagcagatagtgtcttcctgttttcttttggaggtggaggattcatcctgcaatgctgatataatatactcccatcgcctttaaaaaatgtatttttaactgtaaacctgtactccctcggtcctaaagtgtatgcagatttatatctagaattgaattctttttaggatggagaaagtacttccctccggttcgaacgattttggtagctagacgattttggcagctaggcatgaaaacggtcgaaaaacatctcaactattttcataaccataattttcttaaaaccagaatcaaaatggtgaagttgaaaataaaaagtatcgaaaattggagatggactatgcacggaaatatatcggtaacaatcgtaaaccgatcataaatatcaaaaagacattaaggctcatttggagtgaaggaatttcaaaggaagtttgaaggatttcaatctttaggattttttttcctattaaaccgaatggcattcatagaatttaatccttaggaatccaaatcctttaaattttcttcaaaacgaataggtccttagcctcattcagtttggaggaaataagaagggaaaatgtagcaacatgattcttgtaggaactatcactattcatccattcggttcgtacgatttgagcaaaggaaaatgataggaaaatttcctttgactatgattcctgaagaatttgctattagagctcttttatctatttccaagcgtaggatgaggcaaagcactcattggtctatgtttttgctctccagttgtatagattaaagcattcaaatcttggccatgttaatttaatactaagcattttgttttttttctatcatccatttaaaggatcaattctataccttttctattctctattttacacatacattcctatacaatttgtatgtttcgttttcctatttctatggttagaaatccgaaactcctgatgggcgattgatcgccaggggcgatcggatctggtctccccctctcctccacgtggttttcttttttggcaccgcattatttttctattttagtaaatttattcaagtaaagtttgtacacctcaagtttacacatctaaagtttagagacccaaagtttacaagtcaaaagtttatatatccgattcaaatttgaatttgaattcaaatatttttttatatatagtatttatatacatctaaagtttatacacttaaagtttatagacccaaagtttataagtcaaaagtttatatacccgattcaaatttgaatttgaattcaaatattttttatatatagcatttctatacatctaaagtttatacacctaaagtttatagaccgaaagtttataaatcaaaagtttacatacccgattcaaatttgaatttgaatttaaatattagtttatagacctaaagtttataagtcaaaagtttacatacccatttcaaatttgaatttgaattcaaatattttttatatatagtatttctatacataaatttttccaactttgtttttttgttttttttaagtttatagtgtagtatgaagagaaaaagaggaggaagaagggaggagaaggtgtgtacaggcccgcccattagccacacccttagaaatcatgtaaaccgaacaatctcttagctcctttgctcctttggaataaaggaatatgattgaaaatatggatttgctttctatgcccctatcccaaatgaaaacaaacatgacctcctacatcatgttttcattttcctttgagaagtcctacgaacttctccctttctctctagtttctctcttccacaaaattatttccatcatgtttcctacaaagccattcagatgagtaaagtctaaaattcctatattttgaaaccatgcgggaatatgaagtgtgtgatattctattcctgcattttcgaaatcctgtgttccaaggagccctgaaatgtaaaagtcaaacatttagctttacataactatatgattatataacgaaataagttcaggttgtactatataaattacaaattgtatccctagctttcaactaagcactcaacttaggatttggttgattagttgaagggcttctaaactatggtcaaataaagaaatggataggtttagaaataccataaatccataatgtaaaaaggtaattttagtaagaatacggtataaattcagaaacgatgagtataactatgaaatagtttatgtttccatttccttttttttaccgttccattttcattttcattttcttgttggtaaccattttgatatgttcggtaaaaataaaaaacgagcatcagacactcggaaattcccgtgactgttttcaccccattgacggctatcttggaatacatttcaactttatttaacttttgccggtttagataaacgtggtatacaagaaaaatcttactcctacaaacaatcgagaaaattgtttcgttcgtttagttccaactttaatcaaccaatttgatgcgagaaatggagcaaagtgagttaagatttagtaatgactagcactgctcacagtaaattttaaatattaaacttaatctagaaccaatttaggggtataattctcattgcatcagtcacacatcttcggcataatgcttgtggcaatcagattattctcacgagacgttaaacgcaagagttaagccagccaaatttaaatttcagaattaatttagatgattttccatcattttggtcactcgcccttggtttttagactgtgaagagtaagcctcgtaatcagatttttagactgtgcacagacagaattttaattttaaaacttaaattttgaattgattttgagaatttatttaccgtaatatattttcaacattggcggttaaataaaaaataataatatttactcatgaattattttttgtcacttcatttttcatggcttattagggtataagtagaaggcctcctttaattccttcgtataggaatttttcataaatatccattccaaacaagtaattggaaatgaatcttatgtaatctccgaaattcaatagaaagtttctttgagtctttccctctcatcaaattatgtgtttttctgtggtctaaataaatggttattcttttttttcaattttctattttacacgtccatcccaatcaaaatcatgtgtttcttctattattaagttttttaacctactttccaaggagcctaggtgagttcgtttgagcaacttcaaacgacaacttcatcatgttccattagtacacttcccaaaatgcaaagggatatgttctatggaaaaaattatacatgaaagtttattaaaaaaatcatattaatatattttaaagtttataataattaacacttgattaattatatactaatggtttatcttattttacatgccgccaatttaccgagattcctaatgggcgatcgatcgccccgagcaatcagccctcctccacgtggttttctttttttgcaccgcattactttcctattttagtaaatttatgcatctaattttgtacacctcaagtttacacatctaaagtttagagacccaaagtttataagtcaaaagtttatatatccgattcaaatttgaatttgaattcaaatattttttatatatagtattttctatacatctaaagtttatacacctcaagtttataagtcaaaagtttatatacccaattcagatttgaatttgaattcaaatattttttatatatagtattttctatacattaaagtttatacacctcaaatttatagacccaaagtttataagtcaaaaaattatatacccgattcaaatttgaatttgaattcaaactatttttatatatagtatttctatacataaacttttttctaactttgtttttttattttttttaaaatttatggtgttgtaggaagagaagaaggggaggaggaagggggg

SEQ ID NO: 12296 - DNA, 7651 bp, Oryza sativa
agagcagtgccctgagcacgagttgccttagtcctattgggacactgatgccctccgtaaggcatcgggagtctccatggagacacgacgagacatggttgagttagagccacggctccaacgtggcgagccaaagcggcgcgctgtaaagggcctaatccctatcacgggaacatgtatatgtagtacactctccataaggactaaatgtaagtttagaatgatctcagaatattttttttaaccaagagctccaagtttgagaaccctatgtcaagaacattgtgcttttgagtgttaccaacggtgtggcacaatccagcgtccgctattggtgtaccatcgtaaccatcatatactttgcccatcggcacctccccacaactccgtctctccattctccaattctggaagaactgtctctttttctcgtagaggaggaacggagctccaaagcaccgggacatccttataaaatttgacgacaacgactctacctcgcgtgtccgagtgtagcaaatgttgtttccctcacaaatcaagggacaacaaagccccacaactttactatagaagtaggggacatatctgtcatggttatggataccgcatacccaatagtaatcaattaagctcgatgaggcctaccatatgccaagtcttatacggaatcatacctcgtatatagaaagagtttcagataaggtaggacaagtagagttctatatggaaacgacaaggactactcggattgtatccatattggtttccctagttttactttgataaggagacatctatgggtataaatacaagcccccctaggaggagagggacagaagacacagatcgacacacaaaccgagacaagttagacatcgacattagatattagcctagacaaacccaatcagttgcttgcggaggccgataacaaggatctagggctatttctgatctcaatgagttcatattcgagtagtaagactaccctctcgtcgactacgtgttggtgttcatgccgccacgtcaacgacgattagataggttatcccaaatattgtacttgtgtcattcaaaagaataaagagcaataccggcttcagccaataggagtagagctattacctatcagataaggggcccgaacttgtataaaaatccttgtctccatctcttttaccacaatctcgcatataccctggtaccaacgatctccataccatgcaaataccatagtcgtaacctcaaacgtcgacaatatctagtgaaaatcaaataagtgaaaattcatgaaagccagagctaaaagttttataaatttatgaaaatttctagagatagttataaaaatgaaatacatattcactaaatgttaagttgaaaaccaactttatttgcgagtaaaaaatgataaatttcgggtgaatagtaattaaacgctattcacctgaatctttgtctcttttttcctctcaaatgaagttgagttcagatttgtaatttggtatgaatatattttatgcttatatgtaatttttttcataaatttagagaacttttatgtataatttttacgggtttttactagacattttcttatagacgtattggtaagtgctgctacctcttctaaactgactataaacaataatcgcttgtataggtgaaaagtcaacattattattattattattattattattattattattattattattattattattattattattattattattattattattattattattattattattattattattaagcggagatactagctctgttccaaaaataacttcatttttacgctccatttgatttcgctgtaggggtaagcaactttatcattttttgttagcacatttcccgaactactaaacgatatattttttaaaaaaatatatatatacattgaagtttcttaaaaaaaacaaatgaatcattttccaagttttaataattagtaatatggagtactagccctaatggtttgcttcgttttgcatgccgctcaattttttttcaaacaacttagtcgaacggagcctacaaagtttaaaagactaaaacatcctttgctttatcaaattactccttgattttatccttaactctatcaagcctaaattaaatatatgtgtccttgatttttttcaagtgttaacatatttcacctaattttatcgaatcacaatgcattgccttcaaagttttttgggacgatgagtgaggtaaaagatagtaatagttatcatggaaaggagggagcgttaacttgaagctagctgatgaagtgagtatagctcgattggttatgttacttatgataaaatcagcttagtggattcaagttctagacatgacattattactcacatatatgactatttgttcttctagtattagtcaacatctcgccacaccctcgccacacccatgatgacttcataaatatatgttgacatgtcttcttattagtattattagtattatgtttcttttttttgaaaaaaacttgaagcgagctgtgatacacaatactacccgcttgcgacgcacgcgcacatccattatgatccttgactatctcgcgggacatgaaaatgttcgtgtgaggcttgttgggggtgtcaacctcatggtttacaaaactgacgataaccgtgtggttatcgtgtttactgccggttacgataaaccatggtaagctcattaaactgaaataaattttaaaagtaatttaaatttttaaaaaatattatacaattactgcgagtaaccatgcagtgtgcggtaaacccacgccgatggtaaggaaaccctggtgaacccaacacaagcaatgcgattagagcgtatcaacgagaacacacgcgggagccacacgaggcggagtactacacaccaatccctccatctcataaaaaatctaggaccggatactactataaatctgaacacatatatatccaaattcgtagttttagaatatgtcacatttagtactagattgattttttaatggaacggagggagtacacaggagcacgagcagcagtggcatctttgttcttccgttccgtgtcgtgtgcaaaactaaaacaacacaaggagggggaggcaggaggcgcacgaagaaaccggccgcggctcgaggaaaatataaaaggaaccatcaccgtgcaggggaggggaagggaatccggcgcgtccgccgtggctgcgcggaaacaaacacgcagcgcacggtcacccacgtccggttctggaatcctgcctcggaagcggcgaggctactccagaggccaggttggtggataaattcaccgggctgtttggatacgagcagcaagttttccaaacatttttctctctgattaatttttttaataatgttctctctgcttaatttgttgtggataaggaaattgacaatttaatcatgtttggtaacttttggaccgtgtcagaacactacggctcacacaagtcggtggaaacaggtcaaacttatgggcaagtttcggccgactttggcagtttggtcttcaggaagcaggcctatttcgtttactgactgactgaccggagggtactgcttttggatctgttgaatttggttggcgccgaggtcatttgtttttttagtaagcacataatcgaaacacgctatattcgcactaccgcattttctatacttcattgaaatattgtaagggcactgaaatccacgtaaacatgaagtatatactttctccgtctcaaaataatttaatctagaatgatatgagatccatcatagtataacgaatctagctaatctaggatgtgatatgattctaatatggataaagttatgtgcagatttattgtattatgatgggtctcgtcgtatcctagctcgtattattttggaacagaaggagtattcccttcatcccataaaggacttgagggatagtgaaaaaaaaaagaaaataaaaaaaatcttgagttaaccatttatatgttcacctctctctcattataatcatgtaatactagaagtacaagtcacctatatataagaaatgttcaaccaagcgagagtcggctacaaaacaaatattcaaactttaaaattcacatttcaaacctttgtgtaaaccgtgcggtacatttcctaaaagattagtggacactatcctcccctatcgttttcctttcatttcgctcaaaatcctgcctcgcgaatacttcacacaacttatgatttctttggaacgcatgaatcgaaaaatatagaaataacaaaaacaaagtattaagtgtcgtgacttgatgaatacatcaggaactaaaaccacaataattctacataataattacaggaaaaacacatgaaatttaatatttatataattgatttactagatagaaagaagagatacacagaaagtgcttgggcttctcaaataaattctgttaacacgaggtgagatcacatattagaattcctctaaaatttggaagattttttactatcctgtaatattactctgaacaatttcaccatctaacactactgaaaaactgatcttcgatgggtcaagcaaaatccacattagtcccggttcaagtaggaaccgggactaaaaaatatatttagtcccggtttaattttacgatctttagtcccggttcaaaataggtcatacgtcccactatctttattcccggttgataacaacaagcacttattctcatctcctccccccccccaaacaaactcctcctcatatctgtatctgcatttcctctctctctctctctcatcctcatcctctctttttttccaacatcctcagcgggcggtggccgaggccagcgtggcgccaggcggcggcggccgaggcccacgccaggggcagcgtgctagcgccggtcagcggcctgcccgcgcggggtggcggcgggctgtgcggagagcagtggcggactgtgatgtaaatttgtgaatttgttcatactgtagatctatgaatttatgatgtcaatttgagtattttcattcgatctgtgaatttgtagatgattttgtgatgttttgtgaatgggaatgattttgttgtagagatcagtttgaaatcaatataagtagtaaaaaaactgaagatgagaagaactttggccacgtggcgttccgatccttagtcgtggttcgtaacacgaaccggaactaaagatacccatctttagtctcggattcaaggtcccagttacataaacgggactaaggggcttacgaaccgtgagtgaagacactttctccagcagtgtaagagctcctttaattcataggatgggtaaagaattttcgtaggatttagattgttgttgattttttcctacatatccctctaattcataaaaaggaagaaaaatttgtataccaaccaagaggtgcgacctgtttgtaaactttcctttgtttttcctattgcgctcctattatattatcctgtatttattttattcttgtaggatttgaaaatcatactaaagtttcttctatcctacgaatctaatgagacctcttatagaaagttttgttcccttcgcactagatatctctaattttctacaaatttcctccattctaaagagccctacacacacgtcattattcatccccacaccgaaattgaagttgatgaaatggctatgatagcgatagcgctcgccaaacaaccccaaccggtggacccctcgtcgagatatgtagtgactcactccgtcccaaaataagtagttttgtactattcacgttcaacgtttaaccgttcgttttatttgaaattttttatgattagtatttttattgctattagatgataaaacataaatagtactttatatgtgactaaatattttcacaatttttttaaataagatgaatggtcaatcgttaggcacggatatctacggctgcacttattttgggacggggtagtagtacatattgtactatgtgtcttaaggacacccacaatgtatgaaaaagatagccttaaaatattgattgtacttataaaataatccataatagtttattatttatgagctcactcttaaggttgcactacatcttaaacaatgatcttgccctaacacaatgtctaatgtatctcatgcatgtgtagccgcccggacgtagcgctagcccgatcggttccgagttccgactacgactttgcgagacggctgcgtctgcgttgtactttcacgccacacccgcgcgcaccacagaaaactcacgctctcagcctccaagcctccggcggcgcgtcggcttgacggactgaacatgaacagagaggcaagcgggggcgcagccgcgcaggcagcgcacatccgcaggcgcagggggcgcgcattgaagcgttccgctgccgcggaggcaatctacggggcccaaacggggcgcggtggcgggggcgcacatgcatccgctgggcgcggcgcgcgcacagccacaacaaaacaaagggggaagggaaggacgtaacaaaagctgcacagtgcgcgcgtccggcccggcgtccgctgtaggcggcatgcattgcctgatggatgaacaagggggtggggtgtggtggactggtggggtggccggccggcgtccatgattccgtaggtcggtaggttattgttgccgggcggtgcgtctctgttcaagtgttggtcctttggggtttcaggtttgactccgtataggtgacgtcgttaccgattgcaccaaaccttggattacatgtgcatgcgagagattgtgtgagcctactactagtaacgaaaacaaccgtgcagttctatttcattgttttagaaatcaagagcatgcactgttgtgacttgtgcgcccttttgctcacgaagctagtacagcgttttctcaaacaaggaaaagagaaactgtactcctacactctacagctacgtaggagtagcaaagtactagcacggctagtttagcaggtctacgacaagaggaattgcgctacatcgtggctgctgctgcaaccattccgtacactctccgtagcacagagacacagtcacgcagacaggttggcctgcgaacgggccaaagccacgtactgtcgccgttggactcgataaaagcctgggggcgcacagcctgcgtcgcccacatgggcgtgacgaggcctgctactgtgggcccttaccttggggcccaccacctctcgctctctgtcaaacgccctttttaccccctcgcgtatctgggcctgcggcccacccttgatctaccgcacgtagtagtagtacaactagtagtaacgctgttctctctcgcggtgcaacggacgatagagacttgatgagtgagaggcatcatggtcatcaggtatccgtcgatgtgcacgcccaaaacgacaaggcaggttgcagcgtttacttataggcaaagtcaagacaaatcgagcgatcatcaagttgatcaccatacctaccttgttatagggtgtccatgcctagcttattgcatggagtatttgcatgtcggcttgattggaagattttgcggcgctccagtttgggccacaagttggcatcacagtaa

SEQ ID NO: 12297 - DNA, 1333 bp, Oryza sativa
ctggcttgatgatataggccgagttacagtgaagaacaggtgagtaacttacaaacactgcatatgaattcacgtcatgtgcatagaattttttgtcaaaattaactaaacctgtgatcaacataggttaaatttgcgagaatgcccgttatgaaggaaagaacacccagaaccatagccattatatatcactccagatgaacacaactgtccactcgaatagttactgctatatagcttgctattagtctacaaaccgcataaacaaggtaatagagatacaacacactaaggattacacaagctttacacccccaaaatcgtggcacggcattgcaaacagaacagaattgaaaagcctagttagttttccagaactatacaaccaaactaacggaattatggacaaggtggggagccccaactgaaagaatgaaccattcaaatgctacctacttgccagcttgctagaatacagtatagctctgaaagaattgcaggaatatagtgtgaaagctcagctgtgaacgactgaaagccattgactagttgagtgtggaattcctggtcttcttcccctatcattctaaaatgcacacggattgcgcgcttgcagactgccatgaattccagcaatgcagcgatgagctgctgcagttcttgagatcggagcctagttgcgggctcaccagataagaatgcagtgcacacacttaatacaccactatttacctgcatcgtcaggtttttgtaaaagtagcaaaagaaagaaaatagaggagcatatactcaaggcattcttaaaaaatggttcaaattctgcacaagagttacaggcttacagcttacctgaacagccacacttccttggagtatcctctgcaggctttggagtcttgggagttggtcaccttccgaactgcgtggttcttctagttcatttcgcaaggcagctgtccttgtctcgatcattccaatcgcattctcaacaggagaaaactctagagattctgatttgatcactaacagacgattcaccaaagcaggaaaggaaccctctgtctggagtactgtgcgcctcttccactgatcttcaaggccaccttgtgtttttccattctttgtgaatggtgtatcaaaaagaaaacggtcgaacacacgggcccggacagtaccagtagataaagagaaaatcctttcccttctactccctaggtcctcatcctccattacaggatcaacagcagttatctgcagatagcagacaccaggttgcaactcatcagcgttgacttgtctcgaatccggaatgatgtgtaaggtgtgattgcca

SEQ ID NO: 12298 - DNA, 13777 bp, Oryza sativa
aatacagaatcagcaagtattaacgaccaatgatgctcttcaagttctctgtttctggatgacataagccactccacgtaccacgtggatcttcagaagaatgtttgcttcgatttgcgtcagaacgatcagctttcgaaggcagacaagtgctactacttattcacactaactggggtgtggctcagcaaaaatatgagccttgacagttaaatgaggaagtttgttttgcatttcctgaaatcagctgatcagactattagaatgacattgaattgatactgctttaccgcaattcactttggtctcctatgtacctgcagcctaccaggcagctttcatatctcagtatgttttagcttctcccttcgctttctcgcagctccaagacattcatgtggattagcatagaagtagtcctcttcctttggctgcccggcaatagctttccttctggtgggttcgctcattcggccctcgtgtagctccttcacagcagtagagaattcgtcccaggacagctcctgatcttcaagaagatctataagctcaactagctttttcctatcaagctgtatggttttgtgaaagcccataaacctgcatttccaacataaacatttgcagttaacctagtggtggtgttcttctaaactagtctttctcactattgtgatgattcttaaaagcaaacatataccatttctcggacaaaaaaaggaacacctataaccttgtgacaggacacagtgcagatgtaagtgtgcacgccaataaacattttgttccactccttactatacttaacatattgcagtaatacacacacaatggcaagtcaaacaagaacaaacagaaggaatatcgaagtggcagacctgcgatgtccttctacaaccttagccatgtttccgtcattactggggataaaaacatcactagcaatagacacaagatagtccagggctgccatttgagtcgaatgcttctggaaggggcgtaactcatcagcagataaaagcatctccttccgaatctaaaattgcaatagtggataagcatctttctagcattagtatatgttttcatgggcgttaaattatgatgtgcttacaatgttagggaattctgtcttcagttcagttaatcttttttcaccaccatagatttcacccgaggcaatatatatccgagtgtccctggggaaaccaagagctttgagtagtaatgttgtttctccgggtgttagggggcataatccttcgagccttttcttttcagaatctatttctttttctttccaccaagggtacgcatacctgatgtccaaatagcagataacagtagagattgattagagtctgggagaagtaagtgcagacagttatgaagttcaatatcgaatgaaacctcattctcgtgagctctgctgtttcttcgtcagaacatccatgtgtacaaccagagaatgcaagcatatccatctcgtatctcagatgaagcacaataaaagatccagttttcctaagagctgatatcatctttttgccaagagcctcaattgatggtgcaaattgtagtgcattgtagttaacacggcaacgaagcttttggagctttaaaggaaggccattatttgcaaggcgagaatctgtcctgctaaaacgtaccaccttatgcttccgtactagaggcaagatctgaaagcaagagcactaaaaaagtcaaaagaagcagtggatagcatagaaatgtaaggccccctttgaatcataggaatgaaaaaacggaagaataggaaaaacataggattctcacaagaatacaagtgtaaaacagaggattacaaaacacaggaaaaacattgaatgaccgtttgattgagccgtaggaaaaacacaggaatttgaggagagataaagactaaggattcttaacatgaggttctacctcatgctaaatttcctctaaaacttgcatgggaagaggcattccataggaatttcataggattccataggattcatttctttgattcaaagggctatataagaaaaattcctataggaatgaaatcctttaaaattcctatgaatttcctttgaataaaagggggcctaaacctatgccttggaggaagattagtatcaacctgtctcaaatagtacttctcgctagaccagctgattggctgcattgagaatggaactttcctgctgaatttctgtggcagttccctgatgatctttacttcatcttgtaaagaattgatgaagtggtttacatcaaaaatatctccaaaatcactggaaaatataactacattgaatcaataatagtgcattctaactgtaaaatcaatcatgaaggaagtgagaatgtgggactggtgggaaaaccacacacctaggatcagcccagaaggactgcttatcaagttcaggtaccaccatagtcaggttcatatagcgtgctacagttaccatgtcacatatctgcagaaaacaaacatttctgcaacattagtaaaacataattacacaggttttattgtagacagaagcattgtgagatactaccgcagctcgcatttggttcagaccaccattgcatgaaataagaagataaccattactcttataaacccctgcatgagagattgtactttatcagactgaacctatcattaaaaccaagacatgctttgtattgttctgttgatattgctaccagaatgctgtatatgccaagggtgaagctagatggggtaaattcaagtaaaatcgagcaaacttcattcttgaggcatcaggtcctctcgcttacatataatggtaaaaaggaagctagaaattatttctttttgaagcctatcacccacatggtgattggaattttactttgcaagggaaaccacctcctaatttctattttccagcttcatgtgaaaataaccaaaacagctatcctggaaaaaaaaattccaaagtgtatccaggtatacaactatttatcgaatcttttttcaggaaacacatttatcattttgttctatgaaggatgcaaatccctgtgtcacatgatttaacaaggaataattaatgaagagagcaatctttatatactactactgctaaaagtgaagcacattccaggttttgctaatcagttacggcttacagcttccaggttccaagttccaacatgtgaagatctcaaattctgacataacgttaacgtatcactagcttcagagaaccaaaatccatagcacaaaatccatcacaacaaaccgtggaactccgttttcgataaacaaactaaaatcggtagcacaaactaaacggtaaatcaagaactcaaacacccagaaccaagaacaggcgctgcgagcaaaaataattcagtcgcaagtctgtcaagacccaaatccccgaacaacaccagtttaacgatccacaagaccacaaccaatgactcagtttagctaagcttattcagttacttcctggaacagttcgatccaactcatgaatgctcgagagcttccacattccactccatccattcagatagtgggaagcgccttacccaagaaccccaaccaagacccgagcaaggaggtcatgattccaagaaccaagaaccgcccagccgcccacagcagcgagatcaacaagacaagaaccactcactcctgcgaggcacagccgggggcgcgaggcgcccgacctcgtcggcggcagcgacggttacagcagaggaggcgctggagttgctgccgccgccgccgcctaggcaggagggccgggcggcgaggagcggcgggcgggggaggccgaggaggctggataaatggaggagggccgtccagagcacgatgctcgaggcgacgcgcaccgcccaccggagcatgccgaccccgcggcggcggatcgccggcggcgagctcttgtgcctggccatggcgccttcttcctactgctactggtataagctacgctttgcagtgctccccactactagtggtggaagggcaaagacggtaagagcagtgtccgttattttgacttgtgcgtgacgtgacggaaagaacagttgggatttggatcggtgttagggtgattattaactgcaaccggaaagtttggtggcctttctcattgcaaggggactagtgtgccgtgcactagtctcgtcctaattcaaatatggcgtgtatattaaccattttgaaggacgtggacacgaggggcagctagggctcggagagagggataggagaatttcactgttttatgtcaataaaatatcatctaaattcacaccacttccaaatttttttatcggagatacaaatttctatccctccgtaccactccctctgcacagtttttggattttgggaaacatgcagaaagttttggcaagaagttttgggtcctgacagaattcctgaattgctcatatttaatgccatgcatgcatggctgactttcaaacttgcttcataggcgatgttgctacaaacaaataataaatttggcatacatgcatggtacagcaaacacagctgccatgcgacgtcacacacatactgacatacaacataaatctcttggcttacatcctccataacagtagcacattacaaatgcagtcaacaattatgcaagcaatagaaatccacaaataagttgtcaaacatacacatcagccgcatacatgacagtccatacgcatgttccaaatgacaaacaaaattcaagaaccgtgtaccaaagcaagtgcaatggaatcacgaaatgcattcatcagatcacaatcatcaaacacttcttcggtctcaggttgatcgtcactagcttgtggcggcacatagttctcatcacagtcacaacgatcgaagtgcttgtcacgtatgccacttttcctaatgaagttatgtagcgcacaacatgcaactataatttgtgcctgtttacgaggatcataactagggatcttctccaacatcctccacttcattttcaaaactccaatgacctttcaatgacattcctaagagatgagtgtgcatagttgaagttctcttccttaccttgtggttcaggggcatcgcgatactcctaaagatgatacttggttcccttgtaaggagcaaggcaacctggccggttagggtacccagagtcgacaaggtaatatttccctacagcatcaaacatgagttagtatgacatatttcaaataacaaagaaggaacaagtaccattcaagcatatacctgtaggtggatgtagaaacacatgggtgtatgttgtgtgggcatcatcaaatactctcatgtcatgtaccgaacctggccatccagctagtacaaatgtaaacctcatgtcaaagtcacagacagccatcacattttgtgttgtcatgcccttgcggcacaagtgctgcacaaacttgttacttggcaccacgcaaggtacatgagtcccatctatagcccctatgcaatccttgaagtagggaaagaacctacggttcctcagtcttggatgcattgttgtgaattgtgggtcagccggctttatgacatcaacggcaagcttgatgacagactgcaaaactttgttaaacagcctacttacagtccccattgacctctcaaatctgtcctcagcttgtctaacagattgtggggcaccaaccatccaaagaaacatcgtaagtgcctcaaccgaggttgacttgctactagatttaagctcatacgactgtaccaatagatcatgcaggcgaaggaacatagttggactcattctaaacatgttataacaggcctttctatccccaagttttttatgtacccattccaaaccagtcatggcaggttgcctatactcagctctagtcaaatgcttgtcaatgtgcatggcatacttgtacataccgtacacataaccgtcgtcatcatcatccatcaatgcaatgatcaactcgtctatctcatcctcccaacgcttaagccgacggcgcgactcctcataacctgattggtcatcatcctctacataacctgattggtcatcatcctgtcaaaacaagcaatgcaaaatattagcaatgaaaaatatatagacatgattaatatgcatttctttctcagccatgcattacatagttcaaatcagcagcatacatagaattcatcaatagtagtaccatgctgatgtttaaataacacacatcgggaacatagtccaaacacacaaatacatgcaccatacatccgagtgaacatacggccattagtacataaagtaggaaatatagccatgacaaaacattagctggactagttgtcgacccctgcatatttcttgatgatgagcatccttccttcaggctcggtgacaatgaacaagtccatcacactttgatacttgatgatttcgaggacacccatgaacaatgttggggtctcagagggagttaccccacactcctttcccagctcgttaacctttgccaccttccgctcaatagctttgcgttcttcttgcatagcatcctgctttacttgcatcatggtctgcaggacactgagtttgttccttgaaatttcgttgtactcactcatgtttctgtccattaccctcactgctggactcctagacttcttacttggactcgaggctgtggtgctcgtgctgcttgtccttttgttgtcgacactaagaggagtcagctcatcgtcgtcctcatcatcatccgcttcatcagagctgtcacactctacaggctggtcggcagtcgcaacaaaggatgtagaaccatccactgcaacaccctcaaacattctgtccatttcaggcaaatattcaggcaagcctttcctgaacttcttccaatcgggatgtccctgtccaacgaaagcacatgtcatgacctgctgaacttaacatgtgttcacaacattagagagacatgaccaatttaccttggtgttggcagcccaccaatcatcttcggcgacaacagtcccatcagggttcctccctaagccagagctggagcgaagcttattacagaatgcccattgcttcctaagctgcctgtgtctccccatgaattgctccctgttgtgaactaaaccagtggcttggaagtacctcttaatgatgtccctccagccatttttttgcataataccgcgaacacagtttcctatgtccatttgatggcaccagatggaacagaaggtgcgagtatttctcgctgaccaatttgccttatctttcctaacctaaatgcatcaatagtcatggaaaacaacatcgaacatgtgaactaagtttgcatttaacaaaattttaaactagtcggaagcaggcaatcaattgtaattggaattgttgtacgtaccggaataccgtcgttagcatcggagtgctcggccgcaaggtccgagacattgtggcacactgatgcgcgtgatgcaggccgtgcgctcacggccacgcctcctcctccgacgactgcgcctgcgactcctcctccagcgcttgcggcccctgctcgtcctcctccagcggccgcgccttgtactcctcctccccccgcactgcgagtgggccggattccgagggtgcgagatattcgccggggaggaacttgaacgggcggtggaggaatttcgatgttgtcgtcgtcggcctgcagcatgcccgcgtacgtagccatttctggccacccgtcgctgtcgttgaggtcgagcgactcgaaccgcacccgggaggtgttgccgctagaggaatcaggcgggggatgcgccgcgtcagcgccgaccgcgccccctcggcgtgcgcaccaaggcccggacgcaaggaagtccttggtgcagccgtcgtggccgtacacgtcgtcatcgtggcctttgccgccttcgttgccattgtagccgcccccgtagctggccatcacgggaatgaaggcggatctgggcaccgacggtgaatcggaagggtgggcggcggcggttggagggatgacgtgtgtcggcgggggagggacgaccacacaagcggtggaagaattggagttgggcggcggcggtgtgagagacgacgggcggctccgctatgagcaacgaatgccggagcagcagaacctgctggatctgggcggcgggggtctcacggacagcgagcggcggctggctattttagggagggcgagaggcggctgagagaaggagggcgagcgtaggggaggagggggtcgatctgggagggggcggtgtcagggatggcatgcagcagcggtgggacgaacgaaggggcgagcggctgtgttggggattttggtggagcgacgaggagcagggtgaggggtactactcgtccatgggtgaacagtaattgcacatctgccaaaaaattttgccccccgtttagttcacaaaacgcaaaaagtggccccatgccaaaattttttggcccatcctaaaagatttcaccatctaaaccgggcactatccgtgcataaccgttcgacgccaacgagtcatcatacctgagcttaagcttagccactgcatgtgtcgtaccccgctcgcgtcttccctgagcttgtgccattcccaagcttggtcaatagctgccgcttgccccataacccgcttgcgtcgtccgcgagcttggccgccactaatccgggataccaccattgttctcgagctgttggttcaacctctacccgccatccccaagtcagtcttcgcctgagctatcccaggctcaacctcgagtagtgcttgcagtcggtccattgcctactacctagcagcaggaggagacagcggatatgttgccattgcagttgcgtcagcctacaacaacagacaaagagtttgaattggcggctcgcacatggtgatggcatcctgaagtggcgatgggcatcagacgaatggtgcggaagggcagaaggagtggcacgaaatcgagaaattcacatcttcgatgtatagatggctaaaaggcccggcccaggcacggctaggcacagcccaccagccatcaggctggcacggcccggtcggcacatcgtgccagaccgtgctggcccatggattgcacctctggcctaggcacggcccaccagtagtcgggccgtgccgggccagcccaacgtgccagtggaggggcccaggcacgacccggtggtcgggccggaccagcatgggtccaacccccgtcgggccgtgccgtgcttgggccggaccaaaatgccatgccgtgggccaggttgtcgggccttgggccttttagccatttatacttcggtgacacgttttaaaagaagggtgaatttgaggtaatttctaaaaaaaaaacccgatgaattgaatggcaactagtaaaatttatggggagagaagattaggaaggagccgaaaactagtttggtctctggtggtattctaacatgtagacatgggttaagggtaacatttacgaagtgccatttgggtgaagcctaatataatttgataatctcatcttttactctacaatgtatcaaccgctgacaaaatttaaatttaaagttatttttaggatattttcaaagataatatttaattattttttttagcattgacattttagggctctgtttggctatagttatagcgcagccagcacgaaaagcgctgcaaacatataaacaccaagccagcagctgcatcatcaattttccaaacagatctttagtcgctaagtatcttatatataagttctaccccctccgtcccagaatatattggatacggttattaagaaaatatgtagaattaaataggaatgggttatgattggctgagaaatggaggtaggtgagaaaagtgaatgacagaagattatgattgattgtgaagggaatgttggtgaataagttgttatattgtgcaacaaatcctaagtgctcaaagttgttatattttgggactgagggatcagtatttataaattattatttgatcgctaatgagccatttgacatgcaatcaatcaacttttattcgtgaagtaagcgtagcacaactggttaggtttcttatagtggaaccagttcacccacaatcaaatcctaaatttaacatgagtgctctcatttatagctaattattattttaatggtaggcgacgtatccgtcgacaagtccgtagtgacttcgtcaatctaaaaaaatgtcgacaacgagatgtccgtagtgacttcgtcaatttaaaaaatggccagtcttttgaaggtgtttagaggagtagggtgtgtacgtttatagggatgtacatgtgttatgagtatatacatttttattatgttccaaaaaaaatgtaagcttttcttctactctctctatcctaagtgtaattgtaggtttctttgcccaacgtttaaccaaaagttttattttaaaaaaatatgataaaatttaaaaataagttattatttgtgttttatcatctaataatattaaaaattatcaaatgttcaagaaagaaaaccgcaattacacctaaaatgacacgaagggatgataggtctgcagcctgcagttacagctatcccgccctcccatgcttcgagcgttccttccagtgacttccatgaccggcagctagatctcatctcgcaagtggaatgaccgcctcgaggtctctcctcgccgtcatcctcctggccgcgaccgccgccgacgtcgacgccctggtgttcgacgtgccatcgggcggctccaagtgcctgaccgaggagctccgccgcggcgcgctctcccacgcgtcgtaccgcgtggccgaggccacgtcggcggcgtcctccgcggtctcggcgcgcgtggcggggccccgcggcgaggagctgcacctgacggagggcgtggaggccggggagttcaggttcgaggcggcggaggacggcaggtacaccgcctgcttctggacgccacgctacttgcgcggcgccattgtctccatcgacgtgcagtggaccaccgaagtccgcgaccacgccggtggtgccggctccccgccagccgtcgcagccgccaaggaaggccacatcgatgtatgctctctctctctctctctctctctctctctccactactactacttgcagattagttgtcactagatcagatagtgtaaagatcagatttaatttaagctacaaaatttgtgtcgatatagtgctggacaaagctataagtaattaatgggtttaatgtattttagatttcgtccagcggtttgtttagaaatttgtccgcgtgttccgtttatgaaacggaaataagacaactacaaatctcatttagatggtcaatgaaaatggaagtgattgatccgtgtggtgcgtgaaggtgattctggtgccaaatgcagtgtgtacaggtgattttgatgtttcacttcattgtaattcacacaagcataatggggattaggaatgtagatgcacacgcttctgtaagttgaaagtcaaaattaggtgaacaatggtagcatgtagtgcctctgtctcaaaatataacagcatagaataagataggatatatccgtactacgaatatgtactggctttatcgagatttgtagtagaggtgtctaatctgattttaggttactataatttagtctgttttttaatagctgacgttcaaagattagaaatgtgcctattcattgtgttgagctcagtaggatgtaatttaatctcaagggagaattaaatttgaaaatatactattcattcgattttttctcacgaatattcgggatgcaaaattttttacagaaataaaccgtcggtctcgcacaaccgttgcacgaaaacaacgtgggaatgacgtcgcagccggtatcgtgcccagaaagctctatccgcgcgggcatcagcttgactccgcgcgatctcgtggattagaatatcaatactgagcagattgtaagggatgtctctcggtctctctcattgcatgagcgatagcggttcaatgccgatgtaattagcggttaattctaattagtgattaattatcctaattagtgatttgattaatcactgattaggataattaaccgctaattattattagctaattgtatattaaataattaatccctaatcaaatcgagccgttggatactatagttgtttgattttgcgagaccgtttggtctcgctcttccattccacgagaccgtgcggtctcgcgctttccctgcgcgataccgtccgcgatgtcattttcgcgcaatggttgagcgagaccgacggtatatttttataaaaaaaatttgcatgtcgaataatactgagaaaaaattgtatgaacagtgtatttttaaatttaattctctcatgggaggtctaaaagcagtattataagaattttcattttcgaatcagtcctgtacgatatttttttttcattttcgaatgtcctttcctagtcgatgattggagagttgaagaaattggaggtttctactcggctcatacatgaagagatgatttctctccgacggaggtacggtactcgaagactattccaagttctctttccaatgtaacattgttgcttattgatctcttttttttttctctgccagcgagggtgagatgcaaaagctcaacgaagacacgaccatgaaaatacactcgttcaccctgctatcgctggcagtttgcgttggagttgcagggctgcagctgtggcatctaaagactttcttccaaaaaagacacatactttagggactagatggaacaaggagggccatgccttactgattttttttttcaaaaaaaaaatcatgtacaaatataatgaactcggagggtcttgcctctctccgagttcatcactgtacatttattcttcagaaaggaaattagtgcaagtccatctcatacgtttgcttgttttctgcagcattttgttggctgtttcacttatcggtaatgtgctccaagagttccagaccttgaaagtgcctggtgtcatttggcggtttacggaagagcgctcaccaagctatacacatgtttagtctttgggatgttcgatgctttctgtaaattataccaagctaacaaaagggtcacaatgccggcatattttcatgaaactaaagcccgcataagtacataacagaaatgggactgaaggagacacatctatgcatcagattataagtccaaaagaatgaaaaaaaggctctgatatggctttgcattaatacaaaaaaaaaatccttacaatggtcagtacttaacatctgcaagctatattcctcatgtgtacgtcaaggtgtaggcggccaaacaaatagaatcgaaaatggacaacaaatggtgaatcaagtaaaaaaagaatctaacctcaaacataggatctacactccctactaagtcggtgaactaagccaaaactatatgctgagaccttcctttctttcataagttatagccaagctatttctgctatgatgaagatgcaacctcaatggcactaccaaggggccatgctgcttcaacaaatgaattgctataaggcaccttctttaccaatgtaatatcctggtagggatccacacctgaaagaacagcaaacagaatgaatttaaaaatgtctaaatcttacaaaaagtatcgtgttttttttcactttgcattaagatataccaaatccatccacaag

SEQ ID NO: 12299 - DNA, 6127 bp, Oryza sativa
gcacttggaataacttgcaccagatgacaaacctgatgcttcgaatatatcgtcaccatatctgtattgtcctgtgtacaatttacaaggacaattagaatccggtaccatctttccaagaaaacgtaaattgatacaactgaacaaaaaaaaaaggagagaatttcagaaagctacaactattttgttaaaattatcagtatgttacaaatttaaccaagcatttcagataactccaactatagcatatatgattttatcaaaaagctgcaaattttatctgtttgacaagtttgggcccacctgtcatatacacatgaaatactcatgctgttgtaaattggacccagatgtgacacgcacagagtgaataaaattgcagtttctgatgaaattatttgttgttattgcagctttgtgaaatacctagttaacgttatagcataatgatagttttgaacaaacaattgcagtttgtgaaatttactcagaaaacaattatggggtaaatggtgcgtgtgtgtatacatattttctaaatttatacattgcgaccataatttgccaatagaatagtcattcttttaccaaggccttcagaatatcgaaaatgatcttaactaatattcgatgattgcagaatttctcaaggaaatccaaatgacattctgtatcttggtttctgtttcaataatgagcttttgctctttcatgttgacatagtttcaatgaagttcacaggaaatctatttaaatttccaagcaggcagatgaagataatatcatgttggctttgtggattaaagaagatgcgggcaaccataccatgatgtccttccaacatacagttgcggtaatcattgccttcacctgcttttaagatctctgctctagccgccagcaatccataacgcaaataactgtagaaagcaatgtttcttgttattccatgatcttttacttgtgatgttggttccaacatttgttcatcaaaatgtggtaaaaagaaaatgttccatttccatgtcagatttagagtaacaaaaagaagtgatagattggaatcgcagtgtaaataacagtgcagaaatcactttgcagtcatatgtacaatcttcactgatttcatagatggaatagattttgcgatgccagtgccaacaacagttcatcagaatattgtcaacaacattgttcatgtcccattgaaagtaacagcaagaagtaataaaatcaattgaaggacatatgtactgacatctgcattgcaaggaaacaatatccttaagttactagttcaacttctcaactttcttttagcccaggtgtgctttattctatttctgtaatgatcagcttctagttgcagcttcctaaataatgtcagggttcctctctttacagttctaaaacacctaaggattgagattaaaaaaaaattacaagatactgcaaggcaatcctactagaaataaagactagtcaaaaattagtttcgccaatatttcaatacttatgacagattttagacatcattagtacgatatcttggtacaaataataacgatgtaaaatatctgtaaaaaactggaatgcaacaaaccatttgacgtgtacctgtgaacataaagataatatgttgttcccttaagtagaagctccttcacatatgaatcttcaccttctgcaactggaggagcctttcctgcatccttctctgagatggcataagccatttggacagaaccaccacctagatcaaccactccaaccgtgtgtgagtaaggctttcccaaatttcccaacagataattgatggtaacctaaaaaacagcaaagaagcactcatgtaatcatgttgatttttttttttttttgtatggagtacaaaaagagcagcatatggagtacggacaactttgtacttccatataagaaggggcaagcaggcaagtggtggcaatgaacattgctaaatccaaaggaacaccaatcatagaacctttttatatttgctaaaatagactaaataagataatgatctggggcatagaaacaaattaactttccatacccactggaatgcaccttcctgagatccatctagaacggtaacccattctggttgggatctgaaagagctcttgtcttgaagaagatcccttacctaaagaattcaatgaccaagtaacaaaaattacaagagagtacaaagcataataaatcttacaatctcaagtgagattataataaaaaaaggcagtccaatcttgacaggaataagatatgctacagctagcttatcacaaggacaatttaccgcttgcaaaatttcttcagacttttcagtccctaatgctctcaggcctgcagtagcctgcataagggtgaacatcacttcacagaaaaaagatgttatggaaagtcaaaaaaatgtgtttttcagcttccattccatagagtgaaatagaatggcctccacccaccccaaccctgacaggagtttgctcacgtaattccacaggaattactttttcagcttcctctagaagagaaacaagtgacttagcagcttcttgtgggtccatggcataggcactgaggcctggttttttctggcaagaggcaagagaaaaggatgaaggttcagataaaattgtacattcccccagttctatccttcttcatttatatttagaagttaggagtctccgcaacaactgtatgcatgaaatttttcgagaagtagaacatcttaatcaaggaagtaaactagtggtgcatacttctctgaacaggatgtagctcttggcaattttacaatgtatctacctagaaatctataatcgacacatactttaaagcttcagataagctttacccggcatatatagcccaaggcccagtgcctgtcagcaatttatacaaatttcagagaacagttatctacagtatataagaatgttcatacactctcagattttaattcaacgtccatcttcaaataatataaaggggtaaactgatcaataacactagaaagatcgcatgttgtaaaatcacattgatatgtcaatgacatatcgaccttggtcccaattctcacctgaatgctgttttccaatctatacatgtttgcaaattgcattgttcctagaaaattttcccaaatattaatgcacttgcaaaaatattggagcatctggatggcatccacatatatgtgtatttgcttgccactagtttcagctagtttggaaatacaacccagttcagtactaagtagtcttaaatttgaagttaaaaaaattcacaaagattattttctacaccgtatcttttgtctcaatactcttacaaaagaccagctaattatgtgtcacacttacaacgttgcctggctgaatatgaagcaatgcatctgatcacaggcattctaaacttaagcagtgcgcctaattgcagcaagccaggcataataacaaagacaggttaaattgttaaatagctgtgaacatcaataggtggtttcatggttttaacggcttgctgtcaccaactagcaatgtcagcaccaaatgctacagttcagcatttcatagtatgttactcacatgtgcttgctttgcagaaacgaaatgatcccatttcaaattctaaccaggatcaattatccctataagcatgctaatataagatcataacaagacctatcccgatcggatccacctgatagcaccccatatttcacaactaaagataatcaaccaaaaatgaaacgcggccaattcacctgcttgaacagctcgatttcctttccaataggcagcagatccaggttcccatcgaagcagtacacgtgcacgcggctcccggagctcccggcatcaaatatcacagcgtacctggtggatccgtccccaagtccgctgacggcccgggggccccacctccgtccggcagcggcgacgagctcaccggcagagccctctacggtagcggaggcgggcgcgcgaggcatgagaaggagcacgagcgagatgaggagcaccggcgcgagcaccacgacgaggaccccgcggaagcggaggacgcggtcggacacggcctccccctgctgctgctgctgccgcgccccggcggcggccgagaagcggcgcatcctcgcggcatccgcggcggaggggccggcggcggcggcgaggtcatcggccgggagtaggtcggccgccgagggcgagcggtagcggatgcggccgttggtcggggacggcttcaccgcctcctgctgcggcggctccagggcggcgggtcgggtgcggccgcggcgcgcggcctcggcctcgtgggggcgcgtggctggaggtgcggctgcgcgagatctcccccgtcgcggctcacggcgaccggcggtgcgctcggcgccggggcggcattgcgtgcggtgcgagcgatcggagcggcgaggtaggcggatcggtggtggttcgatcagggaggacggattcgtggtggagtcgcgcgcgccgctcggggagagcgagaccgggacggatcggacggtgcggttcggctcgggagtcgggacgaggtggtttgtctcgctcgctcgcgtcgcgtctccggggacgggaatgggaacgggaggtgcgccttgggccgcggccgccacttggctgcacgctgcagcctttggctctctccgcctccggtggtttttacgtacctttctgggttgaaactgcgtgtcacgccaataatcgtgctctcatcttcttcttctttttgtctttttgtcataattgtgtgcatatttatatgagcgtttacgtttgtactgtgttttgtaagtgaatagaagaagtaacttatgttttgaaaatatgtaaaaaaaagggggtaaaatgatctcatttggcgtccgataacacggctcaaccggttagatttttaatggtgcaaccaacccattctggttcacatactagatttgacgcacgtgcttctattttcgactaattgtttatttcagtggcaggcaacatacccggacagcgcggcgcacgttgtgattttgtcaatcttaagatatatcagcaaagcgtctgtgatgattttgtcaatctcaaaatacaccggttcagtctttcggatatgctcatagggatagggtgtgcgcgtgttcataaaggagattatgtgtgtgttacgggtacatgcttttttattatgcttctaaaaaataaaaattttaaatttgaatacacatctaccaggggaaaagcattactaggaaaaagaacccggtctattgaaggatatcgagcttaaactgaagggccgttagtttggcgcattattttgttgggcctttgttggaaattaagagagatgatgggtgggaggcgatcagagtaaatgggccagaacattactctaccggggaaaaagtgcaccgaaagtccctcaacttgtcatcggggtacagaaacatcctcaaaccacaaaaccagatacgcgggaaccgatcatccgaggtccttcggtggttttgactccggttttgtctacatggcagctgagtcagtgtgggacccacgtgtcagcgtgccacgtcatctctctctttcccttttctttttttctcttctttttttacttctctttgcggcaggggagtagcaagaacgggcggcggcgggcggcgaaggcggtgtgcgagcgcgcggcggccggtgagcatggtggtcgtcggcgttgccatggtggttgtcggcgtcctcctcgtctcctcctcctcgcgtccgggtccagccgcggcgcggtggccccgccgcatcgacggtgtgccccgtttctccctccctcgccagccgtcgggacgacccgcagcgcttgccgcgacctccacggccacctcctgcgcggccgcgagctccgcgtcggcctcgccgaccggccccagcaggaggcccctggaggacggggtggcggaaggggcggcactggaggagccggagccgatggagacgacgaggaggtcgtcgacgccggcagtgaggcggaactcctgcttgttgtggaggacttgggtgatggcggcggcggtggggttgcccatggtagc

SEQ ID NO: 12300 - DNA, 11190 bp, Oryza sativa
ctctcatctccgcacgcgtacgcttgcacggtcagggacccggagcacccgtcgctggcgtccccgacggagaactccagcctgtacgaccgcccgggcacggtgctcacctcctgcaccatcgccgtctccatgccggacaccagctcaaccgcgcgggcgccgcccggcaccgcgtcgatgtacttgacggacttggtggtcgacaggatcgtccacggggacagcggcgtgtggtcgtcctcgtccatgggcggcaccagcacgccccaggacgtgttggggaagatgtacgggccctcctcaaagcccccattcttcagcatgttacctggttcagtttgttcgattatttcactgtgagcacatcctaattgtattcaattttgtagagatgcacactgatagcagctttgtggagaggttagcacccggctcaattagttaattacctttcgttctttgaggaggttgcggggtcttaatggcgaacgagtcgatgagggggccgcgagcttcgtcatcagagacaccggggttgtggacgatgaacaacacgacgctgtgcttggccttgaaggcccaggagtaggagtcccagccgctcggacccgttgttgccgaccgtggccagctcctccttggcgagcatagcacgcagcacgacgcccaggtcgtcggcaagcttggcgaggaacgcctagatggagtaaaaaaaaggaagagaaaaaagaaaggggaaagagagatgacgtgtatcatgctgacatgtggggcccacgtgagacccatgctgactcagccgccacgtaagccaaaaccggggtcaaaaccaccgaaagacctcgggtgaccggttttgtatagttaagggaccccgcgtatctgattttgcggttcaaggatgtttttctatcccgatgacaagttgagggaccttcggtgcactttttccctctaccggacattagaggtatgggctttttgcataggatccgataacaacgtgtccaacaccggtccgtctaaaataaacacgagtaacaggattatactaccctctcgatcatattatgtttaccaaacatgatgagtaaccgggtactacttcgtaaccaaaatcaaccctagtaatatttcgtgaggcgaaaatttgatgtaaccaaaagtggtaagataaaagatgtggaggtaatatttattcgaaaccactttggtgtagttgttaaatgtataaattttcagagctaccaaaatttagtagcataatgatagctgaaatatattcgatttatcatgttagggttggtttggacaacaaatcaaacacgctgttaagtttacacgttgtattaggggccgaaatggaccagacatgcacatacagacccgctattatattgttttatttagtacagtatatattttttcaagatatccaggtggttcttctttcatctatactagccacgtaatcatgcttcgtgcaacttttaatcccgtataataacttttgtatacggtatattagttaattgaaggttttagcatgagttattttttttcaaagtatcaattggcctacctaactatatatatatttagttactatataagaaatcactataagtctcctaagtttttctctttgttttctttgccccctctcttttttatcacgtgtctaagaggaaagcaatagaatcctcgaaaattcccatacgtttatccatttgttgtttctgttaggaaatgataggcgaacaaatgataaaaaaataatagatcaatcacagaatacatgagatttaacgtggaaaaccctctcaaagcagtagagacaaaaccacgggcgccagccagcaaaattcttcactatatctgaggtaaggttacattgtcgcacgacggcttacaagaggtatatatatatggtggaaccctaaaagggatgacgatccggcccaagcctcccggcgacaagcctccgctccactacgacagaagctggcctttattaagtgcaaataaatttggatcataactcaacattttccaatgcatgtgtacctttttatccactctttatcccttgactaatatgtcttgatgagatgtggcgtatcctcgtagtaaaaatgttttatgctttcactggataagataggataagatattccatataattttaacctagctactactatactacatatttaagtttaacatgtaaaaatggcactcacttctttttctacgcatgacaatattagtccaattttaaaccaactaacgtcatatattagataacgaaggcagtacattaatattatccgtgagcaattattaattagatcttaaatttgacataagcatgctccgttatgtatgatttattatattttaagctcaatataaaaacatatgaaatcatcgtgccattgtcattttcataatattttaacatatacagtatatgtttattatctttataatatttaacatatatttataattcttaattactccctctgtttcaggttgtaagacgttttgactttgatcaagtcaaacttctttaaatttaaccaagtttgtagaaaaagtggtaacattttcaatcaagataaatttatcatgaaaatatattcaattattaatttgatgaaactaatttagtattataaatattactatatttgtatataacttagttaaacttgaaacggtcttataacctgaaatagatgaaatagatggagtattaatttttctcagatagtcaaatctcaaggaattagcctctcacgcaggtgattcaatgggtaagctcctaattattccactttatatttaaaagatatgctacctttccctgtttgtgcacagctgcatatccacttgcagtggcatctcataaaaggagccttggaccttgctaaagggccacagaaacacatacccaaacggaactaaactaaggtcaagtggatgcaatgtcatatgcaatccattaagcttgccatttgtcatttcgtgtattttaaggctgccgtacaatgacaaggtcggattggcattattgtgaaacacgtaggcccgtatgatctgatggctctcacatgatacactaattaatcttactactgtacttgaattatttgtttttcaaaagcaaagctagcgcatatatccggattatgcagacgaagccatgcattaggatcgcttgaatatggacagagacaaataacactagtcccataaactaatgggagacaaatgcaacgaggcgttgtcacatctacctgaaagcctccatggccgtgatgcatgcaaggacttgtctgtctgccttaggaaagggctttgttaaagactgttgaacctgagtagtaccagtattattattcgtgaaaacagagaagaaaaatggaagcgacgcattgcagccttcgcatggttcatgaaacgcgcgcgaattaaagatgctcgatcgctcgtgacaacacagttcacgaccccgcggcatcaagaagccgcacgcatgcaagcatgcaattatgtactcgtatcgtgttcaaaattctagttgtactcttacttttcttgatttctcaaaaccccgtgccttgattagttctcaaatttttttcctaaaaatgtcacataaaatctttggattcatacatgaagcattaaatatagataaaataaaaaactaattgcacagtttgcatgaaaatcgcgagacgaatcttttgagcataattagtccatgattagtcataagtgctatagtaacccacatgtgctaatgatggattagttaggctcaaaagtttcgtctcgtggttttcagacgagttatgaaattatttttttattcgtgtccgaaaaccccattcaatatccggtcaaacgtccgacgtgacactaaaaattttccttttcacgaactgaacgaggacttagctcttccttccatgatacagggcaccgcgcgtggatgtgaacaggatgccgagataattttttaccatgtcaagtttttttttaaaaaaaataaaattttatacttttaaatttttaatttttaatacaaacattttcaggacttgattttaagatctaatttttttaaccacatcagtcgagccagcgtgaccaacaatactgtcacaccgatctaaataacgtggcagagttatttagcgcgtaggtttgtgtcagggtcatggataccacatacccaatagtaatcgactaagctcggcagggcccatcacataccatgtcttatacggaaacaaacctcgtatatagaaggagttctggataaggaatgacgagtagagttctatatgtaaacgacaaggactactcggatcatatctatatttatctccctagtcttacttggataagaaggattctatgggtataaatacaagcccccctaggaaaagaggggacacacccaccacaatctatgaagcaaatacaagccaatatgctgccagatctcgacatcagagatgagcctagccataccccatctggcacctacaggggccggcaagagggatctagcgccatctcttatctcaccgagtacggattcgaggaggagattaccctgtcgtcgactacgagttggttatctagccgccaagtcgacgacagttagatatgttatcctaattattgtacttgtgtgattcagatgaataaagaacaacaccagcttcggccaacaggatgtagggctattacctgtaagataggggtccgaacctgtataaaattatatgtctccatctcttttacctcaatctcgcatataccctgataccaacgatccccatacatccaaataccctagtcgtgtcgacaatttgctggtgtggtagtgttcttctcctaatgtattaggataaaactatatatgacacccgctgcatgttgtatgataatgttattttgggacgttggggtgattggcttgatggaaaggttcatatttttaaaataaacttgaaagttcatttttgaaattgtgtgtttatttcacactagaattgaaaatttggttgaaattggaacgatgtgatggaaaagttgaaagtttgtgtgtgtagaaaaattttgatgtggtggaaaaattgaaagtttgaaaaaaaaattagaactaaactcagcctaaattaaaaggtaaaaaaaaaatcgatcgtcgatcggctatgcccgctagacgagaggattgctcggcgcctgagccgtgaaggtaggggatattctattgcaccgtgatcttgtgctgcctcctctcctctcgtgctggtccttgcggtaccacatattttggcccgtgcctctgttggatcgctcgcgcgggcgcgacagtctgcggctgccaggagcgcagctttgactagcagataacaacggcgcgggaattgaaggagcaaggccggtgggtgggagtcactgatcaccatgtgcctcttgctccctcttcagatgcctaatcgggagtactccgtaattcaaaactttgaaagctcgagtactaggacagttgttgttgttgttgccctggactgtagattaaaagaaaagtaagagcgccctcatgcgccataaaagatgctgatcgcctgatccaacagaagcccgacacgcacgggcgcacccttttgtggctatctaatcctgatgttaattacttgatggtcataggcatatgatcatcgaattctacagttgttaaaccctgcatacttcttatgggttagtataaagattttgcctccatgcagctgcggcagaattatttttcaggttttgccacctttagacatgggcatcaagttatcaatgatcagtctcggcgacacagtagtgccaggaacgggataatgagcacccatgcttgggtacataattgctcgggatgaaggaaggctgggttaaacggcgagagtaacgatgtaaaaaaaaaacgacgaaccagatcgctgtagctccacgactcgtcgtcatcatccagtctttcgcctccatgcctgcgcgctgcgctgagctgcatgcacgcgattctggccttggtggcctagctacctctgaccctccttggattctgaccctttttcgtgcactcacatgccatgctttccccggtttcccccctccgaaaaaccaaaagcgcccagccaaaagtgccggatggacgcatacgtaaaaatggccgccccgtggatggatggatgcaattttcacttttatgattaccgcgcggatgcgcgaggacacgcgctgcactggcacgggcacatcagcacatggctgtgaacagcggaacccggtcatggctgacgacgggacgaggcggccaggtcacaggccatgctgcgcgcggcggaagaggcaagggcccctctccctcggcccagcatttgcacgcgctccgcgtacgcccggcgtcccgactcccgcgcgtgccgtgcgttttgccgccacaccacccaccaccagtccaccaggttgacgtgatgttaaaggcgtgagaaagcaacggaggatttcggatttcgatctcacgcgcacggagagaacgagccgcagccgcccgtccgtgccgccggccgtcgtcgagctcggtgagacggtgtgggcatgtggagagaaacacctgtatctccccccgaagcctgaccgagacgtgtcacaagagtggcaaatagttaaattagccaaagtgacaaataaacggatcctgtcatctggttgggagccatcgagaaactttgttttcccgtctggtcactctagctaactgctggaaaagctagcgaacgtgcatggagtcctcgtgcggtcctaagagaaaaaaatcattgtcttgtggtgagattgaatcccatgattcccattcgctgcggcattagtggacgatgtactaccggagtagtatacgtgcaacgagagaatgtttcactgtcagcaaaagcggggaactttgacgcgaataattgcgcctattaatgagagaggatataacaaatgatggatcctggatgatcgagtgcgagaggtaggtgtgttggttgcagcagttatttttactctaagaggaactcttgtacgttgatctaatagctcaggctcccttcaaagaaaattcataaaaatttttatggatttcattcatataggaattttttctatatagccatttgaattaaatgaatgaattctatgaaattccaatggaatgcctctttacatataaattttgcaagaaatttaacatgaggtagaacctcatgttaagtctttatctctcctcaaattcctgtgttttttctacggctcaatcaaatggttatttctatgtttttcctgtgttttgtaatcctctgtttacacttgtattcctatcagaacctatatttttcatattcctttttttttccattcctgttattcaaagggacccctcaaaagttaaattttctggaacagagatagtatagcgagataatattgcaaaaaagtggagatagaaattttgtcaaacaaataatactattagaaagtatggttataaaggagataaatatttttatactgtagacaaataaaacattttttatagcgagataatactgcaaaaaagtggagatagaaattttgtcaaacaaataatactattacaaagtatggttgtaaaggagataaatatttttataccgcagacaaataaaggagataaatatttttacaaagtatggttttggaacaaaaataatacccgagataatatttttattattttcaagcagaaaagtggagatagaaatttcaaaaagacataattgcacttagccttatcgaaccatcgccctcagtccaactggcccgtcaactccttccgatccccatccaaaactctaaccctaggcgatgggtggcacgaccgatggtggcggcgccgctaggagggagtgatgatgaaaccgtgaagttgatagtgccgagggtaattttgtctttttaaattgctctatcatctttttgcccataaatgataaaatattgtctcagggtatcatacatccaagcacacagattttgaagtgtctatcagaggcatcagtagcgatacgattttgcggtttctcttagctaatcacataaaatatagatgttcctatagcaaattttaccatgtttgttgctaaaaccgcatatgcaaaacaagtgttactattgtcaatattagctagagatgtgatcccacttagattattatgtaagcatcctattcatgtatcctcttctcgtgatttttgtactcatattgtaactattaaaaaaacatggttaagtaagaattactttctcgtcccaaaatataaaaacttataatcggatgggacattttttagtagtacagatctgaaccggaaggagtaatcactggaattttgcaatggatacgaacaaaactatcatctctcaacatgatctacccttggaaaagcatccttggcaaagtgacgaggtgcgttcgttctgggggattgggtgagaaagggacatcgttttccacgcgcacgcttcccaaactactaaacggtgcgttttttgcaaaaattttctatggaaaagttgctttaaaaaatcatattaatctatttttaaagtttaaaatagttaatactcaattaattatgcgctaatggcgcacctcgttttgcgtatctttctaattttttttatctcctcctcaaacacagccgaagaggacacacttacagtgggtctagggatagagatacaacgcctgaacaggattgggagaaagagaaagacggattgctcaatggatgaggttggtggttacggatatggtattaagggaagctaaacacccgatggcccatcgccggcagcaattagccatttgaatcgcaatgatagatatcaaccgtaccatgcgatctttccagctagacagatcacatagctcagtgtctgagttgtagttaagtaagatttaaaacctgatattgtgccagattagtccaagtatgccaggacataagtatcacaagaaccattgatcgctcaatggacttttggcattggatgagcttctcgttgttaaggaaaaaagaattaacatcgggtcagttggtcaatctcccatagtcggcgaggccgccgtacagaatggatatcacttggcgttttgcggggcccggcctgcagtgacagcctcgtagcgggccccgtgcgagagggcccatgcataggtgcacgtttggctctggtccacatggatcatgcgcgctgcaggcaaacaaacgtgagtcgcggcgcggaaaaggagcgcgacctcgctgttgaacctgtagtaggcgtacacgtctgacgtggaaagaaactacatttaacttttccgaaaattagttctaaaacgtgtctcgtaaaacggatcccgtcttttcacaaaagcgaaaaaaaaattacacattaatatattagagaaaaaagagtgtttgatacaaacgcaatcagttatactggcttatgttaggggaaggaagaaaagacaaaaaaaaaaaaagaaaaagaaaaggaaggactactacgatggctatagaaatttcgattggcgggatagaacggatcccttcgtaaaattcaatttgaattaccgctatagtcagtagtcacaataataatacgtacaatagatgcatttaaactgattatcaatagtattactctttggatttaggctcttatttggttgactcatgccagataagttttagcaaaatgaataggcaaataaaagaatttataggtaaaaatatttttatctgtgttattagcagcctaaaagtatgtgcttaaaaatagactaaaagacccaaaaaatcaattttaaaattaagttttaagatttaaattttagatgtgattgataaaccaacaaatgatattagcttttgaagatagtacatgtcatcagtggtggatctacaatttaagatataggtggttcaacctaaatttttttctaaacacagtaaatctaacaacactaatatatgcaatgcatgtatagattaatataatataccaaatcaccaaaagtttaccatcatatattaataaatcatataaaattagtaaccaagtaaaattttgatttaaagaagtttaaagcagaaaacctaaaattgttagtgtgggctgggcgtcaacggctgcgcactgcagcaaggaggcaagtctccgtgagtccgtgattccgtcttccagttttacctggttgatcggctcgacgtcggctcctcgcagtagtggcacactatagcacaacagatcagtagtgtgagtgcggcgcagcggcggcggactcgtgtgcggcgtgcgtgggccgccggcggcgcggcgctcgctctgccgtgtgatcagatgagatcgcgttgacgcgtcgtgttcgtgtcgctaggggctagggtgaggaggagagagccacgcggaattctgaattctgatcacgcgtgtggggcctgtgggcggcgggcgctaggaatcgggaaggaatagattcgctattttttttaataaccgctattttctttttttttaatattggagccggtcgctgtatttttgggtggtccagggacaactcggaccaccctctgaatttgccagtgcatgtcatgattttaatatgtttacactactaattaaactgaactggtgttttaaaagctactccctccatctcataatatagcaacctcgtattggatgggacatctcataatacaacgaatctgaacaatcattctatctagattcgttgtactattagatgtcacatccggtactaggttgcaatattatgggacggagggagtatgtgactgtccaaaacgtagttggttttctgactagggctgtgttcttaccttcaagttcccaacccatctccctcgttttccgctcacacgcttttcaaactactaaacggtttttttttacaaaaagtttctatacgaaagtttcttaaaaaaatcaaattaatctatttttttaaaagctaatacttaattaatcctgcaataatacatgcctcgttttgcgtgccggggagga

SEQ ID NO: 12301 - DNA, 3021 bp, Oryza sativa
ttgctccgggcgtttcttgggcgcggccatggacgcctacgaggcgaccaaggtggtgttctcccggatccaggcgctggaccctgaccacgccgccaagatcatgggcctcctgctcatccaggaccacggcgacaaggagatgatacgcctcgccttcggccccgaggcgctgctccacagcgtcatggcgcaggctcgcaaggagctcgccctcctcccgccgccgccgccgccgtcgtcgtcgtcgcccaccgtgccggcggcccactcgccgttcctgctgtcgcggcagaactccggccgcggccccgcgccgtcgccgtcgccgctgtccgcgtcctcgccgtcctcgtgggcgcaggcgcagccgttctcgaggagcaatgggtccgtggatgaggtggtgggcgctggggaggagctaatcagcccggcgaacagcgggggaggcgccgcggcgaacgcgccgcccttctttcctcggggtggggacgtgctcctggacgacttccagctgcaggagcagctcgcgttcctcaacgaggggggcgtcaaccccagccaccctctccaggggttcgatggagcggagtgccggagccccggtcccggcgagggcggcgggatgttcccgtacggtctcggctgggcaaacggtggccctgggcaccgccggagcgcgtcggtcaacgagctctgcctcggcggcggcagcagcgacggcttcgggtggaagccttgcctgtactacgcgcgcgggttctgcaagaacggcagcagctgcaggttcgtccacggcgacgacgccgccgctctgacgggcgccgccatggacgcggccaccgccgagcagcagcagtgccaggatttcctcctccgttccaagagccagcgcctcggccctgctgccttcccctattcacccacagggtcgctccccggctcgccatccgccgccaccaagtgcctcagcctcttgctgcagcagcagcacaacgacaaccaaaggtaccgaccgccttttacaacctccatattccaagctcgaagctttcaaagttccaacctttgttgtttggttgcgcgtgtgcagagccgcggcggcggcggcgctgatgctcggcggcagcgacgaggcgcacaagttcatggggcggccgcgcctggaccgcgtcgactttgccagcatgatgaaccccggatcgcgccagatttacctcaccttcccggccgacagcacgttccgcgaggaggacgtctccaactacttcaggtataatgcgatgttgcaatgatgtttcttctttcatggcggactcggtagaacgcgatctgattggcatgtttgctgttcttggcaatgcgcccgcgctgcagcatctacggtccggtgcacgacgtgcgcatcccgtaccagcagaagcgcatgttcgggttcgtcaccttcgtgtaccctgagacggtgaagctgatcttggccaagggcaatccgcatttcatctgcgacgcccgcgtgctcgtcaagccttacaaggagaagggcaaggtccccgacaagtacaggcacgcttggaacacgctccggcgttttaattccgcatctttaaactgcaactgtatccgtgcatgcagttttcctggttgcttataattttttttccactcatcttgcaggaaacatcaaggtgacttctccggctgcacgacccccactggcctggacggcagagacccattcgatctgcatcagctcggtaaaaatatcctagctcgctccgatcgtttgtgctagctgtggcagcacagctgtagttcattgtttcatagtggatactgttgctgcagctgtaacgcagctgcaagtcgcacaaacgaacagcctcaatgccttcctgcttgatctttggtatggtgtattagagcgatctgctgatgtgaagtttggtgcctggcaggtgcgaggatgctgcagcactccaatagcacaaacgagatgatgcttcgtaggaaactggaggagcagcagcaggctgccgagctgcaacaggccatcgaactccacagtcgccgtctcatggacctccagctgctcgacctcaagaatagagccgcagctgctgtcacaacagcaatggcgatgacaattcccaccgccaatgccttcggttccagtcagcctcttgccaccaccatggtcgagtcaccgcctgattctggtatgtgttacttcggtcggtctgcctgtcaagcattgtaagacgagttcatccactcattcgacactactgatccttgtaatttcttggtcgtttataggcgagcagctcaagggaacaggttacttcacagaagagaggaaaatggtcaacggaggaggtgataaggaagaatctgctggtgaggcgagcctgaatgctgatagcgaccaaaggtggatcttactaaactacactagacagaccatcatcatcattctgtttgcttattattcttgcagttagctttcatgatttgatgcacatagaagctgaaaaggttgggctgcttcagtggctcatggctttcatttgatatggatattctgcagcttggagcacaatttgccggacagcccgtttgcttcgccgactaagtcctctgtctcagctcaccaaagtttcaccaccactgataccggtgtcgtcgcgacaagtagctgcagtgcatctcatgtaggcatcagcgcgggcactaatgctggaggtggaatcaaccatctgcggccctctactttggatataccttcgccaagagacttcttctcggtttccaggtatggcatgtactgtgattatattgatggatccgatatcttgtgatcgatgcttgaaatgatttggtgaacgcaataagcaggctggcctctgatcacggagcgattgggatgtaaagttctctgcaatggatgagtgaatcccccagcctaatcatagtaagcacttaatccttcctttattccactatgcttccaaaaaaata

SEQ ID NO: 12302 - DNA, 11243 bp, Oryza sativa
ggtatccccttaagatataaaagaaggacgttgcccattgagagaagggaggtttttttttttggactggacttttccagattaggaacccagaacaagggagaggctggctcatactttgtagctccttcacacacgaatccaccaaaacacaggagtagggtattacgcttctaagcggcccgaacctgtatacatcgccggcgtcttctgtgcttccggtctcgcgaaccttccacatacagattgggagcttagagtctcacctagggtccccggccgaaccggcaaaggggggcctgcgcggtctcccggtgaggagccccacgctccgtcatctggcgcgccaggtaggggactctgcgagtgatcttctgagctctcgcactccttcgtgtgcaccaagcttttcctgttcagcccaatggccgagccagcaaaggcgcgcgacctctccccaagtatgagcggtgacgatggggagccaaacccacgccgtcgagctcgtactccaccgccccctccacgccaaagtcctaggcgggaaaaggcgctcgagagggctgaaggatccacgacttcgacatccacaggaggtggagaagggcggcgagatggggagcgtcgtctcctcgtctacggcgacggcagcacgccccagggcgcgctccaagctgcaggcgcgctcctacgtcacccgcccgtcgcccatgacccggagtctccagcccaacgttggctggacgatgtggccaaattggtcatgactgcacggcagcgcctagatgctggtgggcggtcctccgccaccaaggcctctggtgctgctaccaccggctccgcgtcgtcaagacggagggcacgacgagcggcaggcgctgttcgccattcggcagccactccttcgtcgactccttcgacccggaagatctgcgtggggggccggacgcccgcaccagcatcgagcgccggcgtaatgaccgacgtgctgcccacgcaacagggggcgcttcctcgtccagagtgtcacctcaacacggacgcggggaccagccctccgtgcccccggttggtggtgtcggttgtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaggcgcggggttggctaatgaacttgccacccgcgtctgtccactcttgggaggatttgtgccaacagttcaccatgaacttccaaggcacatatccgcgccccggtgaggaagcggacttgcacgcagtacagcgaagggacgatgagtcacttcgatcgtacattcagcggttctgtcaagtccgcaacaccataccatgcatccctgcacacgcggtgatttacgcgttcaggggggtgtgcggcacaaccgtatgctcgaaaagatcgcctccaaagagccccagactaccgcggagctttttcagctcgcggaccgagtggctcgtaaggaggaggcatggacctggaacccctccggttccggtgtggcagcttcagccgcccccggatccgctgctcagacagggcggcgtgacaggaggaggaagaagaggtcagcccataccgacgacgagggtcatgtcctcgccgtcgagggcgctccgcgggccacccgaaaggggaggcctgcgggagacaaaaagaaggaggccggcgctcccagcagggagcgcccgaccggcaagtggtgcaccgtccacaacacttcccttcacgacctcgcggactgccgtgcagtcaaaagtttggctgagcggacgaggaagtgggaggaggagaggaggcaggagcgccgagagggcaagtccccggcggttccttccggcaatcggcgaagtgaggccaagcagaaggcccccgctgaggacatcgatgacggcgatgatgacctaggtttccaagagcctggggccatcgttgccactgtcgatgggggagcgtgtgctcacgtttctcgccggagcctcaaggccatgaagcgagagcttctggccgcggcccctactcatgaggcgacgcgccgggcgcggtggtcggaggttgccctcaccttcgaccagaccgaccacccaccgtgcgttgcccggggaggacagatcgcaatggtggtttcccccactgtttgcaacgtgaagctggggcgtgtcctcattgatggaggagcagccctcaacatcctttcccccgcagcctttgacgccatcaaggccccggggatgatgctccggccgtcccagccgatcatcggtgtgacgccggggcacacttggccgctaggtcatatcgacctcccggtcaccttcggtggacccgccaacttccgcacggagcgggtgaactttgatgtcgcggacctcagtctgccctacaacgcggtcttggggaggcccgcgttggtaaagttcatggcggcggtccactacgcctacctccagatgaagatgccgggccccgatggccccatctctgtccatggcgacctcaaagtcgcgctcgcttgtatggagcagcgcgcggaccgcctcgccgtcgtgtccaagcccgagggtggcgacgagaggcttggcacatccgcccccgccgccccgaggcagcggatagtcacgtgcgatgaggtcccggtcaaggaggttgccctgggcgacggcccgtccaagaccacacggatcggtggtcttctggacggcaaataggaagacacgctcgtctctttcctgcgggcaaacgctgacgtcttcgcatggagaccggcggatatgcccggggtccccagggaggtgattgagcaccgtctcgccgtacggccgggcgcaaggccggtccggcagaaagtgcggcgccaggccccggaacgtcaagccttcatccgcgaggaggtggcgcgacttctggaggccggattcatccgcgaggtcatccatccggagtggctggcgaacccggtggtcattcccaaggcgaacggcaagcttcggatgtgcatcgactacaccgaccttaacaaggcatgtcctaaggatccttaccccctgcctcgcatagatcagattgtcgactccacagcggggtgcgaccttttgtgttttctagatgcatactctggttaccatcagattcgcatggctagggaggatgaggaaaaaactgcgttcattaccccataggaacttattgttatacaacaatgcccttcgggttaaaaaatgcaggtcctagttttcaacgtactactcgaatttctttgggtagccaaataggacgtaatgttgaggcttatgtcgatgacttggttgtaaagacgcgcaaccaagagaccttactctcggatctagcggaaacttttgagagtctccgctccgcccgcataaaactgaaccccgataagtgcgtgttcggtatacctgcgggcaagcttctcgggttcttggtctctgcccgaagcatcgaggccaaccccgagaagatacgagctatagagcggatgcgcccccccagcaagcttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgccccggagccaaatgaacccttgctactctacttagcggcgaccccgcaagtggttagtgcggcgttggttgtggagtgcgatgaggacaatcctcattccgcgcacccccaccctgtgctggcttggcccgggagagagcagggaggagaggcccccgagccggacggtggcccaaggcccccgacgaccggagcaggccctctgcccgcttgtcagacggtgccaggtgcccccgacccccaggacggccccgaagccactgcgggaaggccgcacctatcgccctctgaccccgaggctaaccctgtgccgattcgacccgggagagagcagggagaagaggcccccgagccgaacggtggcctaaggcccctgacgaccggagttggccctttgcccgcttgtccgacgacgccaggagcccccgacccccaggacggccccgaggccactgtgggaaggccgcccctgtcgtcctccgatcccgaggtcgtcggcacagaagacgagtgcgccccgcgaggccgcttgggtgaagagcgccccagggatgcggcccctagcgaagaggatcggccccaccgaaaggtgcagcggcccgtctactttgttagtaaggccctccgggatgccaagacccgataccctcaggcccagaaaatgctttacgttattctgatggcctcgaggaaactgcgccattatttccaggcgcatcgggttacagtggttacgtcttaccccctcggccaaatcttgcataatcgagagggtactggacgggtggtgaaatgggcaatcgaactttctgagtttgatttgcactttgaaccacgccacgctatcaagagccaggccctcgccgactttgtggcagaatggaccccggctcccgagctcgtctcggtccccgaagccagctcgggcccctcgcagctgcctcacaccgcccactgggtgatgcagttcgacggctccctgtctcttcagggcgccggtgcgggggtcacgttgacctctccgagtggagacgtcctcagatacttggtccgcctcgactttcgagcgaccaataatatggcagagtacgagggactccttgccggactcagagtggcagctggactggggatccgccgcctcctggtgttaggcgactcccagctggtcgttaaccaagtctgtaaggagtaccggtgctctgacccgcagatggacgcctacgtgcgccaagtacggcgtatggagcaccattttgacgggattgagcttcggcacgtgcccagacgggataacatgatggccgacgagctctcacggctcgcgtcctcgcgagcccagaccccaccgggcgcctttgaagaaaggcttgcccagccgtcggcgcgacccgaccccttaggggagacggatgcgcctgaccggcccccgaggcccgtcggagtccaggcctcgggacccgaggggagtgctcccagctcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagagcattcctcgggaacaaagcgttgtgcttcttgccgatatccatgaaggcgaatgcggagcccactccgcctcgcgcaccttggttggtaaagcttttcgccaaggtttctattggccgacagctctcaatgatgcgctcgacctggtccggcgatgtagagcgtgtcaattccacgccaagcaaatccatcagccggcccaggccctgcagaccataccactttcgtggccatttgctgtctggggactcgatatcctgggaccgtttaggcgggccccaggcgggtttgagtatctgtatgtcgcgatcgacaagttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctctacttcgcctcacctgcccaccccagaagcaatggccaagtggagcgcgctaatgcggaaatcctcaaaggccttaaaaccaagaccttcaacatactcaagaagcatggcgattcatggatcgaggagttgccagcggtgctctgggcaaaccgaactacaccaagccaagtaaccggggaaacgcctttcttcctcgtctacggcgcggaagcagttctcccatccgagctcaccctgaggtctcctcgagccaccatgtactgcgaggctgatcaagatcagcttcgcagagatgacctcgactacttggaagagcgaaggcggcgcgcggccctccgagccgcgcgctaccagcagagcctgcggcgctaccatcagcgtcacgtccgggcccgatcactctgcatcgacgacctcgtcctacgccgcgtccaaacgcgtgctggattgagcaagctttcaccaatgtgggagggtccgtatcgagtggtcggcgtcccctggccgggctccatacggctggccacgggcgacggcactgagctccctaacccgtggaacatcgaacaccttcgtcgcttctacccctgagggggggtcgggtgtcaggtttcgggctcgggccaaccccgcaccccctcgggcgtgcagggttggccgggggctgccacacatgcacattcttatttcttttttttttcagtatttcaataaaagcagtttcaatttcctaaaggctgtgtctgtgctgttttttccttttgaagaatcttgacttgaaataggtcactcgtgctcaatcctgccctcgggggctcgggtcggctaaattcgccaaacggggcccagaaccgagccgtgccctggggcgtggtgaactccgggggggaatcggcaaaaacccacaatcgggtcatccataaccctcggtcaccacgttcccggcctggccagtctcgacatgtggatctcccaggcactagccccgacccgcgccttttgaggactgggacctgggcacgaacccttaatcaagctaagacacaaaaggaccacggcacagatcatcctcatctcatatacacagcaagataaaattgacacaaaaatttcttcatttttgattacagattaagttgatctatacaaaaaagaggcccgaaggccttagaagaaagaaaagaagaaaaaactgaagaatggcgggggtctgggggctcaatccgatgcgcccgggtcgccggcctcgtcgtcactgttgtctgcaccaccggcattgccctcctcgtcggagttggggccgaacgcgagccgaggggccgagccctcgaagctgtcgacgatatggtcggcggcatcccggacttgcacgcgcgcggtcctcggtcccaggagggaactcttccagcgccatccatggagagaaattggggtccctggcctggtaactcgccaggacgagctccaccgctccttgggcgaggtccctcgaggatgacttaattgtcttctcgagctcctcggggagccgttggagagccccggccatcttcgagaggcgctgggcgagacctccctggttggcggcgtactttacgatccgccctctccagaggcccacttgccgaccggcgcaatctaggcgggagacggcgtcccaaagcatgccgggcccaacctcgcctgccaagcggagggcttcgacctccccggcggacgagtccagcgcgccctgcagatcggcgatggtgtgttctgcagctgcgaggcgggcggctaagtcgctttcgcccgcggccgccccgccgatgagcgcccttgcgtccagctccttctcccgcgcctcgagctcagcgggccgttggttcagtgcagccctgtctgcgcgggcaccttacagattacggcgcgcctgctcctcctgcgctgactcgcggagggacaggctgtccgctagctgttgcgccgcggcctcggccccctcgagagctcgctcccgctcggtgagcgcgtcctcgcggaggcggagcgcgagctcttcttcggcgcaggcagcctcgtgcgccgccagcgttgcttcccggatggtgacggcggcctcgcggtccgccagatccctctccacgacgcagacgcgctcttccagcgccatggcgcgcgcctcaagggcctcttcgcgccaccgggacgccgcttcggtctccgccgcccgctgttctcgggcagcggcagcgtcaagcaccccctgggcggcgtcgagcttcttccctagctccgcctcccagctcccgtattgaaggcggagggtgtcctgcgcctcgttcatcacggtggtggcaatgagggcagccccccgctcctccttggcgatctccgctagcaccttcttacgggtttcaagctccgagacgtgccggcggtgagccttacggcccacctccaccatggcctccaccgagcgtcgcccctcttcgacgcgcgcccacgcggcgtcgagctccgcccgctctgcctgcagggcctccacctgggcacttaacccatccaacaccgtggtgtttgcggcggccaaggcttgcagaaggggctctgcgctcagtagggcagcagaaggcgtggggaaaagccgcctcggagaagatgccacgcggctcggcccgccgatggacgtgccagacgcggggatgtcctccggacctggttgggcctgagcgttgcccgagggagtgggcccaagcgacgcgcccgcggcctcgtcgcgagctgcctcggaagttgccatcgcctcgtcctggcgaaatccggcttcctcccgagcggcttcctcggccttgtgggctcggacagcctcctcccgagcggcttcctcggcctggtgggctcgggcggcctcctcccaagcagcttcctcggcctggcaggcccgggcggctccctcccgagcggtttcctcggcctggcgagcccgggcggcctcctggacggcctcctcggctacccgtaggcgatccgcggcctctcgccggtcagattcccgcctccgggcctctgcggccgccggatcctcggcctcaggctggccggacttggaatggcgggagggacgcgacgggatctcgctgaaacaaaagaaaagaccagaagacgaacgagatgggtgagtgaaaactcgcgttgagagaatgaatacagccacgatgggtgagagacgaacctgcgagggggtcggttaaacgaccactttggaggggaaatgaggtttccccgagatggttctgtctcccccatcttgcggggccgcttcttcttgcgctccccctcgggctgcgatgttggcgcggccccctccgggcgcctgctgctggcacgcgccgccccgccccctcggggaggagatgggggaggtgttcctccctgcttcctcttcccccgggcgtcggcagggcggctgctccccgggcccctgtcgcgggacccagaagcacgaccccctctcggggtagattgttccccccggcggctcccgcctgcgccgtcgtggccctttggagctcgctcctctgaggccccgaccgccatcataatggtcaggatggaggcgcggtctggatcgctgcagagggggaggattccttggggaatgagggccgcctccacggagttgagattcagcacccgttggaccaatatcttgaagtcctcaggagcccagtcccatctcactccctggtgagtcctcatgaagtcttcggacccggtgtactcccaggcgcctcgagcgcgccgctggagcggcgcaatccgacgacggaggtagtcgccgtacaccatggcccctgtgagcccctgggatcgcaggcccgccaggcggtcgaggacggcgtcatagccatcccccagatctaccggcgcccgccagctggaggcctgagccgggggctggctcggaagtcggaggcgcacttcgtcggcaaggggggtgtagaaccagtcgctcttccagtcgtcccacttcttgcggagggcgcaggggatgtagcggttcggcaccggcccccgtggctggaagtagcagccaccaactaccgatggcggcgacaccgactgcacggtgaagaaccaccggaacagccgaagagatgggcgcaccccaatgaacatctcgcacagatgcgcgaagatggccaatgtcatcatcgcgttgggggtgaggtgcgccatctggagatcgtagaactccagaacatccatgaaggaagaagaaaatggcggaaccagccctgccattgcaaaggggagaaagaagacggaccgccccgggtagtctggcgccgggcgtccctcgcccagcgtgactatctcccggccggtggcagattccggcatgaagcggcgcggcagcccagcctgcctctcgctcacgatgcgggagggcggcagcacgctaccatcgagcagagcggagccccgtgccatggcgccggaaggaagagaagattaagagcgagcgcgtgtggcgaaggtagggcacaggaaagaaggagttagggcgcaagcggcgaagacaaggggaataatggcgaaaggaaggaaacaaatcccttcctcagtgcctttatactcttgccaacgctgtgcccggctcctcgcttctcgcgcccactatttcgccccctcgtttctcgcgcccacgcttccactaatcccattcgcccgcttgcggtgcatgaggtcgagatagatcatatcgtgcgcgcgttaattacgctcgccgaccgaagcgacgttaccatatctccagatgaaacgaatcgccatgtccagattcgtgtgctactcgagtaatgtggcagtcttgaagagaccgctcattattgacagccgagttaccattgccgatgtgcgtgatttttgaccgttgggtttctgcccaattgtggagaccggtcccacatgtcaccaggccttaggagtggcgtcacgcccgaccgcttcccttaaggagggcgatcgccctggcataacgccgggggctactgtcggtgacatgggatcgggagtatcatgactagaggtttgaggcagacacaatcgcccacgtggcctggcaccctcgggggacgtcgggcccgagggtggtgttcgccctcctcttagtccccccgagggggtcgagccgcacccgccttcggccccgagggccgaggcgccccgacccctcgtgggttttcgctccgcgtgtatgggttaggtgggc

SEQ ID NO: 12303 - DNA, 519 bp, Oryza sativa
ctcaaaatataagcagcctacactctgataggatatatccgtactacgaatatgtactggctttatcgagattcgcactagaggtgtctaatctgattttaggttactataatttagtctgttttttaatagctgacgttcaaagattaaaatgtgcctattcattgtgttgagctcagtaagatgtaatttaatctcaagggagaattaaatttgaaaatatactattcattcgattttttctcacgaatattcgggatgcaaaattttttacagaaataaaccgtcggactctttctaccgtcagcgtcagacactacgaccggatattgaatggggttttctgacacgaataaaaaactaatcccataactcgtctgaaaaccacgagacgaaacttttgagcctaactaatccactcgttaacacatgtggggttactatagcacttatgactaatcattggactaattgtgctcaaaagatttcgtctcgcgattttcatgcaaactgtgcgat

SEQ ID NO: 12304 - DNA, 621 bp, Oryza sativa
tcgctgtacggacaagggtacctggcgtctgagtggccagaaggaaggcgtggaagctgccggaaggcggagcccccgagacggtggctgtagtcgtgggccaggcgacgaagcgcagtccaggagaggtcctggtacgcgatctggagagtgggcctggccaaagtgaagtggtgtgggcaaggccagctccgtgtatacctccacgggggtagaggtacacagagagctcacagtgagggggaacacggcccacggagtaccccgtgtactcgggacacgagaagccaaggaaacgggcgaggtcacgaagctgagcgacgtggtgaccctcaccaaaaccatgggaactgaagctggcgttcactgccatctacaattttgaaagagggagaaagatcagtaaccattttagaaacaaactattgaaaataaggaaaccaaaagaagccttagcttttcgcaagtagttttgaacttagtatccttagggtcgtcctaaacatcgggtttcgccctagggccaagcctgtgctctgataccatctcttgtcaccccccgaactagtcccgactggaactagcccgtgacgctccaaattaacctgttaatcgatacca

SEQ ID NO: 12305 - DNA, 16069 bp, Oryza sativa
  unsure (1)..(16069): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggaagagagaaaaaatcaaatggcgcatggataccaaggatcgaaccagcgatcgacgtgcaaaacgctagagcatgtgttcactaccaagatttgtaaatttttctattttacaataataattacatctttcttgtactgcagttatatacgagttacgaatgtaattacactgctattatactataattacatttgccagaaattttagggggattttctatcgaatgttagatagacagtctctattttttaatctaaatgacaacgatatgccgttagaaatatatgcaatgcctttttatcattagaaatatacacaatgcctttctgccaaatgtcccaccacccctctcctcacctcgtctcatatcccctttactccttatttttaagtagttgagatattatttttaatttatcataataaatctcaaaaaagcaacttttaggtacccaaacaattattattcgctcacaccgttatatttcttacaattaaatgccgtaggctctctggaccttccattatatttgagagatgaagtgaataattaaagtcatcaaacaaatataatgaaatatctgacgccttgagagaagaatattggagacattgctaggcctttagcctgtcagtcaactttgattaaatttatggtgtgagaaaaatctacttcgtaagtattcttgaaaacgaaatattttgtgttggttcatgttctaaaattttaccggtcgctcaaataatcataaatatgtaaaataaaaataggaaagaaattagtcctgctactatgaaatcatgctatgttaaaataattttactatatgatttaactaagtatatttatatttatgaagtaatatattttgtctttatttcgtaaaaagtcatactatgaatgcacacacacacatacctacgactatttccgaaagactgggccggcatattttgagattaaagaaatcaccacggatgcctcactattgatgggtacgtcacctacaactgaatgcacacacacatacctacgactatttccgaaagactgggcctgcatattttgagattaaagaaatcaccacggatgcctcactattgatgggtacgtcacctacaactgaaagaacaattaatcgtaaatgcaagcacccatatcaagtataggacttgaacccaggtggcaagttccagaacaagaaacctaaccagttgagctacgcttgctttgcaataatgttggatactaaaacaactataattttttagatctatcttattaaaaaaacaagtgtgtattcatggtacatcacatttcaaaaatgttactgcgcaattatatttcatcgttatcgtattcatgttaagctgcgtggaggttctgacccactctacatgaaatgttcatagatggatcacctctcaaactacatcaattataagagtctatataaacctatacatttagtggagtttcatgtctaacacaattcatcctctaataaaccatgataatatatgcaactaagaaaagaaaaacaccttaattttactttacacttacttttactttcgttaacatgttttcttaagaaaagaagtctaccttcttttcaattgcttatagatgttacttaattatgatataatataaagctaataggttagaaaattataaaagcaattaatgccgacgtaaacaatttatggagaaatcgtggcagatgttatccgtttaatatttcactcttataagtgtcttgaactaagcgtaagacacatgtccgcgtgaaagcgtgggctaccttcctagtttcttttaaaggcagatcgagttggtgcaggtatgacgtattgtacgcggtagcttgcagaggtaaatttggactagaaaacttagttaaccgagatcgatcgatcgagctgagtcgctagctagctagggaactcatctatatattacactaccaactaaatatcaccatatataatactccctccgtattttaatgtatgacgccgttgactattcgaccaacgtttgaccatttgttttattcaaaatttttatgcaaatatgaaaatatttatgttatgcttaaagaacatttgatgacgaatcaagttataataaaataaatgataattacataaattttttgaataagacgaatggtcaaacattgaacaaaaagtcaacagcgtcatagattaaaatatggaggtttctttctgtggagattatgggtgccccatacccacacggcgtggttatccgactggttatagcggataacttatatctatggaatatgtaacggatcatgacttgggtattacgtttcctttatattatggaatagcctaaagttctggtttgattatgttgtaaagtagatttaggaaaccgataccgtattggttaaggtttctatcttgtaatcctgccccccatcctatataaggtgggcaggaggccctctagggggcatgagcacatatgatcgtcatatctataatacactcggcggattcaaatcttcaaacatgagtagcgtattacatctcattgagagggcctgaacctgtctaaatccttgtctccgcatccatccacttttaggtctcgtgccctaccccttttattattgccgaattcatgtttcgacagttggcgcgccaggtaggggtgcgccgagttatctatcaagaagtgagatggaaccaattagaagtccccgaatcagattcaatctagcaaggaaaatcaacctcagcaagttagatcgctccaatctccgacgtcaccaatggtggtgaatccttaagattcaactcgccaagatgccggctggagctgctatacagtccgtagccaaaagaatcgtttgtatccaagagatcatcggccacgtctccaactaccagcctgcacaaccctgctcgatcgtgctgctctgcatggaggtcggccacgggaggcaccactgctatctggacaggtgccgatccagttgtcgtcgtcgtcgccgttttctgttatgctcggtgagattgattccgctgagaacagattggacgcttcgagttagacgcggactcggcgcctcgccggaggcgtgtagcagcgcgtcatccaccgcagccatctatcagccgtgtgaagacagctactcgccgggataacaatcacccgtcagcacatgcacttggacatgcaaggatcggctttgcatctacacgcataaacacatgcatgcatggataaaaactgctttccggcatcggcagatttatcgttccaatctattattatgattatgatattatttttaatcatagattgatctgccttttgattcttctttttctctcgcgtgcatatactggcgtttgatggatccatgattacctccgatgacggcatcatgctgaaggactgtcggttacaggggcagatacacgcacagtggcatgcaatactttcagacgcatggacatgcaaattagcatgcgtatatgctgcatgcatacatcaatatatatagcatataatatctatacgttattgctaattgctattcctaatcagtctgattaatatattgggtattttttgcatgtgagatcatcgttggcctatccatccggctgacgtcgccctgatctggctggagcgagctgctcacacgcataatttgcactctgccgtatgcacatatatacacgcgtgcgagcagattgggagcaaacatgtgtgaggaaatatcctagcgttttccaaccatcactgggcctcttcatcttcaccgactagccgcctcgtcagccgccgactagtgtttccgcctgcacagctggcctattatgccgccgtttgttgggcttatatgtctccactgccggcttgccttcgccaccgccaactgatgtctctgcctgcacggctggcctattatgccgccgttgttgggggtctacatcttcaccgccggctcgcctccgtcgccgccgactagtgtttccgcctacacggtcacaccatagttgttgggcgtctacgtcttcacagccggcttgccttcgccgccgctgactggtgcctccgcctacatggctagtctattatgccgccgttgatgggcgtctacgttgtcaccgaccggccgtctcgtccgctgccgactggtgtttccgcctacacggctgacctattataccgctgttgttgggcgtccacatcttcaccaaccggcttgccttcgctgccgccgattggtgtctctgcctacacggctggcctattatgtcaccgttattgggcgtctacgacttcatcgctggcttgcctctgtcgccaccgactgatgtttccgcctatacggatggtggactccgtcaccgttgatgggcctagtcatctacaccaccggcttgcttccgccgccgccgactggtgttttcattgccattgatggacgactttgttcccacatcagccacctctgccatcatcaagaggaatattacaaagctaagtcattattttttcttatatgatattttccttttcctctgcctcactacatcaactggttaaccgttgactagtgagtcgggagctacagatattatatcatatttttcaacaattttcataatatttatcttgattgcttgcgaaataatacgagtaacaataaagtgcctatcgagttatggagttgtatcttcctatgctttccgtttggtttgtcaatggatagtttgcctttgggctgattcctagcacccgggggctcgttggatggaccaagtaacgcaaggtgctaagtattactcggaagaaatcaaaagcatagagataagataatttattttctactcttaataattgcaaaagtacctgagtagtaaacgccaatccgtgaaactttgtcccattaatggcgaactcatgtcacttatatgcatctttgggaagtgcctaggttgactcccgatgcttggggtctatgactagtcgggcagagtgtttaaacgtacggagtcatctgctcagggaaatcaaaattgacaagaggagaaatacatatttataaatattttaaaatacttgaatttttctcgagtattatatttacaccagatactacttatcctatatgtttgttctgtaggatccagatccagatatgcataaaagggattcatggctttaagcttatctcttacgctccaggaatggatcagtcagaacatcaccaacggcttgccttcgccgcggccgactagtgtcaccgcctgcatggctggcctattgtgccgccgttgttgggcgtttacgtcttcaccgccggcttgccttcgccgcacgcgactggtgtcactgcctgcacggctggcctattctgccgccgttgtcgggcgtctacgtcttcaccgaccggcttgccttcgccgccgccgactggtgtcttcgcctacacggctggcctattatgccgccgttgttgggcgtctacgtcttcaccgccggcttgccttcgccgcacgcgactggtgtcactgcctgcacggctggcctattctgccgccgttgtcgggcgtctacatcttcaccgaccggcttgcctttgccgccgccgactggtgtctttgcctacacggctggcctattatgccgccgttgttgggcatctacgtcttcaccgccgccgactggtgtcgccgactgcacggctagcctattatgccgccgttgttgggcgtctacgtcttcaccgaccggcttgccttcgccgccgccgactggtgtcttcgcctacacggctggcctattatgccgccgttgttgggcgtctacgtcttcaccgccggcttgccttcgccgccgccgaatggtgtcttcgcctacacggctggcctattatgccgccgttgttgggtgtctatgtcttcaccgactggccgcctcgtatgacgccaactggagttatcgtcttcacggttggccacctcgtcgtcatcattctacttcttccatcgccgactggttatgccgccgcaggttggtgtttttatcttcacaactacgcgtcttcgctaccgatttgcttctgttgctgcagactcatcttcacttcatcacggctatgcaactttatcaccattatggggtgacttcatcttcattatcttcggcacaggcaaattctattgcctctactttgcaagatttgctacttcaccaaccaagacgtctacaagagctccgacatctcggcatgcatcaccaaatatgatgccatgttattttactacaacaagtggtgttccaatattcaatatttctactcggacatcttcaacacgtatcttcactcaagcaatgactactcgacgacaagaagctacagttctcgactgtatatttagttgttttccaactaaccaaagagtcgggggctacacaaatacaagacgaatacaagactcaaaattcgacaagttttttttgtcaagctgaagcaatcaattaatcagcctacgagtcaactccagaagtcattatcttcatctttgcttcggagcagacattctacttcagcaactcttattatttcactggcaattttggcttctggatgacgacagatctgccagggtagtgtgtgtttttcacgtcaatacttagcctacttgggtagattacaacttgataggtagattccaaggatgaagcaggaggcaaggagtgttcaaactttcaagatgaagaaggcggaccaaaacggaaaagtcactcttcctaaaagctcgaggaagtacaccattcgagtgggggaagatgccaagaaaagattccgtggggaccaccttcaaccactcttgctagctggcgcccaaaagagtataatgacctccaaaatataccaaaatgcccctatgtttgcaaatgtggcaaaggcattatagtaaactcacaaaggcccgtaggggcatagatgtaatctcacatgtatgaccgtggattacaaaagctggtcaaaatcccgtagcagataagacatttttaatacaaaagtaatcagcaaaaagttgtgtgtactgttcgagctcatttctaagtataggcgggagagttcacttttcccgcctatccccaaacttgtccgtaacccaaggtcacgacaaaattctttcctagtgaccatcttattaggtcattacttgactttggtttttggttcatcctttattttactcgatcggatgtcaggtaagattcttaaggtgctatcaaacatatttctcgcatggtacatgacatcggtagcctaacgaatcttgaagtctttttcagtaagtacttattgagtagttcttgaacggcacatttggcacgttcgtatttttcttcctctttctttccttcttctttcaaaaagaaaactttgcatttgcaagaccaattatatgagtcttggcttatcgactaatgttaattgtttaacttttagctaggctgtgttcatttgtgtgtgttggaaacaaatctccgatgcacgacgaaaaatagagtggtccattagcgcgtgattattcaagtatttgctatttttttggatcaatataatttttaagcaacttttgaatagaaactttttgtaaaaaaaccatcatttagcagtttgaaaagcgtacgcgtggaacacgagagagagagagagttgaaaacacaggctgcctaacataaccttaatgttatattctagagtaaattgcgtctacggtacataaacatgataggtgggtgtgatctagtgcaaaaacttgaaaaatgagcatataggtgcaacaacttgactagcgcgttcattactttttattccatataaaaaaagccaccactcagactatctcgaaaaggatctacatgtattacatattgctttcaattagttagttataataataaaataatatgtcaatttaaaaccgaaagatatatggttatcaaaaataagtgcatgactaatcaacatatttattatctcaggttatgaacatggtgaaacacggaaatgaatcatgagccaacgatctagcaaagcgtataattccaggattaatcaacgtatgcattagtgttttggcataaaatatacatgattgtaaagtttactagagcgggagcgcgctttgcgcgctgcaccagcttatctggatcaaaatgcgtttgttcttttttgggaaattatctgtgtttttccttttttggaaaattggttgtgttttttttcctgttttaggtggtgaaaaagaatgaattagtttgaagcattgaattgtgagcatttgtgaaaagggtatcaagatggatagcttattactgtaacggcaggcattttactcgaactacttagatagtataaaggcatgtcattcagctagactgcatgcatatacatactatattctacagcattggtagtagatgcagtagcatcttagatcatacaatgctaaggaaggtagataaggcaacacttatatacaatgataatcatgacaaaaagccatgaacaaaagatcttggttccttagtcctgggtaatttcacaactgccatctgtcttctagctgggacatagctttgtacatatatataagaaaaagtcttgagatggattgcacgtcgacaactcattcactgtgtagatgaattaagagctgagattaggaatgcctttaaattgctaatttgttatgtgtagataggtgagtttgtgtttgaggagtaacctgtcattgcctttttgctgggcatcatccttgaacaatttcttagcaaccggaggtgttgctgtaggtgtaggccttcctctgtttattgaaatgatgtgttagttacaatggaagaaatctttattattggaatgcacctaggagtgatcaaagcacctttttttggctagggtatctgtagggaaggatggggttgcttgtttggcttcttcagcagtttctggtagtccctttcccttgtaaaagaagtggcggttaggtcttaatgaatgagatgaaaggaaagagatgtagtagtaccttattttcagcagtatcaggcagtacaacaattgaagatttatcatgtgaggtgttttctttagcttttgtgtcagttttgggcttgcaaaattaggaaagaagtgagagtggatgtaattcagtatgagtgacaacaagtttaagggtggctataaagtggttaccttatcatcagttttaggtttggtcttgctagactgcatgtgagacactgagacaacaatgcttttcttggtaggtgctgaagaacttgatttgctagttggggtgtcctgtgttccctgagcgatgatgaacttggttggtgttgagatggtttgtcttggttaaatgggctgctgtgattcattgcttgtttcatttggtgttggtgctgtttggacagagctgcttgagcttgctgagacaatagctgatgtcacttgtgaagcatctggggacataaggagtagtggctggtttgaagcaccagcggatataatgctattaacttgtaggcactcttgacttctcataacagtatcccgcgtaaagctaacattccatgcaaaattgctaccaataagtgacgtgatttcacttggaatgtattcactgtttggtggtttttcttcaatgagagattctacgggcctgcgtagtagccgttgtgcgatccttccgaaaaggataaatgtagcattagcatcatcatcgctggcaattaatactactttgtacctgcatgaaaaatggatatggctatagcaatgtgtggatgataattgctaaagatgtaagaggacagagcgtgttctgttatgaaccttggatctgttattccgatgctagaacagctggagtatctgtagctagagccatatggttttgaagttttgtagcatattcgacatgaattgtaccaccaagaatattcattacatatccttctgacagtcacatttactataaaacgtgttccctgcataagaagacaatgaaaatatcatattggtaattatatcatcaaaaagtggatagatgtagttaagatgtgttctagagatagtgtcaaccttgtgtttgtgagggttgatattaaggatttctgcaatactcttttcttctggtacatcctggttgtatcctgtagcaggctcatcaacccacttgattggttgaaagtttgtgctaaagctacatagaagaattgtatcttagattaatggatactgtgaaaaccttgaagaatacagtgatgcacatagattgtaagaataacgttaaataaattaaattacctctcatttagttctgctacttcaggaatatttagatggtaagcttccagttagtgtaaggcctatatatgtggaggaaattattagatattattagttgcatgtagtcaatactacagtaattgaaagtttagaaagaaatgtacctaatcctctataatctttcacaagtgttccaacaaacacagcaacttgagcttgagtttgaccagcattgtatatgtcatcagcatcaaaagaggttgctctttctccccagagtgtgacaggaagagttgaattgctagttttgtagatttggaggggaaaaagtgatttaattttaattggaagagatgacttagtgttaagaatatgtgagatagtttgtgtgaatgctagcgaaaaagattaagtaaataataaatatgtaaatatttagttgtactaaactagccttgcatcgcggatctgtaatgtcctttttaagctcttagcgtttctggacttaggacgtatagtagtgactgcaccaacttcagtgatcacacccataatgtctgtttgcattgcatataaatttaataaaatgatatggcattgcaaaagatgtatataacaataattgcaacacaataaaagtatgttattaccaacgtagaatgattttttctcgacaagggaaggaacatcttcgaatggtgtcagtgaaaatgtaataccagggaaatgaggagggacattaatgtgttcttcaagtgttgtccatttactgaagaggatcattaggttgtttgcaactagcctgtatgttctgtttgcagccctaacagtgaatgagtcaatgtagtaaaccttttcttccttaaggagaggtttcatcttttctgttataggggggtaaatttgggcatgtatgctagtcccctgcagattataaatacaaatcatgttatcaagagaattatcggtatagaaaggaaaatatagaaaatggatttggcacgtaaattattaccatttcatcgagtaagacaagatcagtgtggaaaatttttgtatcatcgttgagatcagtaaagttccatagcctggagacccttgcaaggattcttttgtttgaatctccaaacgatagctgtgaaatcagtacatgcgccatatggaatctgcaataagcacaaaatacttttagtatagacaaaacaacactactatatatgtacaaggaaatgttactaagaagaacagtacatataactgcagcggacaaatcatatactatgtatatagtatatggtacatgtgaaggaggtatatttattccaaaatatatgtacaaaattgcttcttttttagggtaaaagaggttaagcatggagcggcaaagcctgcaacagaaaggtatttcaattattattgataatttaagagaacacataaacatgatatatggaacagtgtgttgaaaagcaccgctggcaatgtagcgctaagcacttcggtgtaaacaatatttcttgtttgtgtaccacatgatccatcgtcattctcaattaatatttttaaacctgatcggcttgttgctcttgaaatagcaacgtataattgcccatgtgtgaaaacaggttttctaagatatacacctactcgttgaagtgtttgaccttggtttttattgatagtcattgaataacaaacacgaacagggaattgtcttctttgtaatgtaaaaggccatttcattttggtagtactcagtgttatccgaggtatgtaaacagtttcaccgatgtttgatccagttaatatgatacattgaagaattctttcacccaaacctgtaactaataatcttgttccattacatagcccaattgattgattcagatttcgaagtagcatgaccacagcagcttctttaagaataagtctatatgtagggaagttagtggcgtctattgagttaagaaactcaggtggatatagcaagtcaaaatctggtatttgttcagagcattttgatattgtatcacaacttgagtatatttttgcatctccaggaagcaaaccaataatatagtcatttatttcatcaactgttgtattattagggcaaacaattgcacgtgaagctaggtattcaggatttttgtatgatgcaaggaaatcagggtatacttcgctgacaatggcatttattttatcaccatcagttataatgagtaaatcatcaggaattgtgatccatgtaggatagctttcaccttcctttgctatcattggtaaagtgccatcaccaacagccaaaacccactggctaaaatcatccatgtcctttttttcatttttaggtagcattgtattaagtaatctcatttttatattcatagttaatattgtcacatgtttccataagtctgagtttgtgaccgatgcattgattatagcacgacgggagcctttaggaacaactggcaatatttgtctgaagtcaccacctaggacaacaggttttcctccaaaaggtataatagaattcaaagggcatgtctcagaaagtatatcacataatgtgcggtctagtgcttcaaagcatcgcctatgtgtcattggagcttcatcccatatgattaatgcagtctcaattaaaagctcagcaagcatagttcctcgttttacattgcaaatacctatttcatcaatgtcaattggtattttaaatcgagaatgagctgttctgcctctaggtaatagcagtgacgctacgcccgatgaagcgacggcaagaacaattttattatgtgatctaagttttgcaataatagcattccacaggaatatttttccagttccaccatggccacacacaaagaaaaaaccaggttgattcgcagcaatacgagaagttatgatgtcgaaaatgttttttttgatcattgttcaattggtgtatcaaagaatttgcatgcatgcttaacataagtggatcaagtgcaagttcttcaatcaatctattattaccaggaatatgcggtacagacgatggatgtggcaggttaaaatcctttatattaccaccactattcgcaaacacattagcaagttcgtggagaagaagattaagcaaatggtcaggtggaatgatacaattcgggttatccaatgctttttttagtttgctatgtatatcatctatcatatataaccaatacttgttaaacaatgatcgcacatcactaacagagcagtaaagaagtatagtcacaaaaagttgtctaaggtgctgtgaagatgcagagactattgcttcatcgaaaagtagataccattcattgtccccctcaaggagccctcgtgcctcacatgcttctctaaatgtggcatagacaatattattaaatgtacgcacatcaacataactttgagcacctttaacaatcattaacaacatgcgtaggtagtaaagttcactagcagttggatgcacataatatattctaccaatttttgcagcaggtgttcgctggcaccatactctagatgacgactcccatgaccactctttcggaaattcacagtatgttaatgaacgggctttagaatattttttgttagcttcaaaccattcagttaacattgaacgcttcgtagcaggactttcaagcactgctcgtaagtccgatcctttctcatatctaacatagtttttcccaggtaagtggacaaccaatcgttcaacaggaggtactctatagtgtatatcaaattcaaacaatcgatgaagtgcctcacaggtcgaaacaaatcttgcatccatgtattctaatatttcatcacgtggagcaaggtcatgattcggtgatgcatttgttgtcttagctattgtttcgaagtagattttagctcggtcttggcctttcatgatatatttaaataaatatttatcaaatttgatttgttacaccactcaacatttatgtgtgcctcgtattttttaagtaatttcatgttataggggacaacagatctattatccaagggaattccattttttataatacatcgtccatcatttcttcgtctataaattgtaaaaccagcttcatcaataatggtttcatcttgaaaatctttagggtagtttttttttagcatttatcgttttttatgcaaggacaacttttgtttgcatcaccacagggaccatgcatcatgaactcgctaaccaattcatatcctagtcgatcagtgtcataatcgggtatttcagcacatatgaagccatctatgatagatgctgacacgtcagcagtgggagctgcgagccaaaccaagcaatgtatgtgcggaagcccacgtttctggaactcaacagtgtagaggactgtaataacttaagagagaatactatgagtgtgctatccttaattcaatatattctatggaccaagagggtataagaatacctgcaagaactttaccaaaagttctgccctctctaatatcagctatgaattcattaaccttcatattaaatacacgaacaatgatatcggctctatcagatggttgttgactaggctcaaatcgaatcgcttcagcaatttcttgccattttgaattacatgtatatgtcacaaagaggtcaagtgatccataaacacggcatattgtcattgcatcttgatagttcatcaccatataccttctccctccagtgaaactggcaggaagtatgacacgctttccaattgaatcaccatcagtgacacctttatcaatcgcatctacgatcccatctacagactcaccacgtaactctttttgatggttgtcacgtcccaaaacgaccctaaaatatatcctctaaattatgcctagaataattaaaatccgtgtgaaagcctccaacaattaaaatgtgcaaagttaaaagtcaaataatgcttagaggatttttgtatatttcctaaaagcctaaaatacgtaaataaattttagtggaattttcagagcacaaataataattgttaagaaataaacaaagttaaaaaagttttataaaaagaaaaaccctaaaaagtcccccttccctcccttgggccggcccggtccatctctccccccctctccctctctcctctccccgcggcccatccggcctctccccgcgcgcgcgccgctgacgggcgggcccgcccgccaccctcgctgacgggtggggcccacccgtcatccccttaatcccgccgctcccgccgcctcccccgcgccctagcgccgccgccgccgcgaatcccgccgcctcccgccgtcc

SEQ ID NO: 12306 - DNA, 8252 bp, Oryza sativa
aaaccctccccgcacctcctccgtccgtttccgcctctcgccgcccttcctcctcgctagattcgagcccgcgacgtcgctctctctctccgccgtcgccgccgagctccggtccgccgccgtcgtcgccccggaccgcctcctacctcggcgccgcctccttcggcttcgccgcatcctcgccgacctcgtccacctctccgtttcagtcgccgaccgccggaacgccgtcgaccccgtcgacccgagccgcgccgccgcctccctctgctccgaccgccccctccgtcgccgtcgtcgccccggggtgagccgtggaccgtcgcctcctttcccccttccctcccctctctcggccgccgttccgctgcgccggtggtcgccggcggcgaccatcggggcgcgggcgcgccgcctcccaccgaccgcgccggcgtggccgccctcgtgcgcgccgagtggctgccgcgtggggcccagccgtcagcagcccgcgccctcgggtgcggctaacgtgtggggcccacggcgccggccggtgcgagccgggtgcgcccggtccaccgtgaaccgtgaggctgccgcgtgggccccactcccgtggacccggtccgcgcgcccctccccctcggctgacgcaataaaccctttttaaattacaatttaaatgaagaaattcgcgaatattcatttaaagagcatataaacttcagatggccataacttggccatttgaactcgaaattggaccgttcaagtctctaatttttccttaagaagtcaagaacccatttttgtactttgttcctgcttgttatatggagtttattagagtaaaagccttttcttttccattggttgtgtagacgctgcagcttcggaagatccactcttcgtggaggttgaagccgacgtttgggaaagcgagcaaggcaagtcacatcatccttgagcatattgaatcccagtttataaaattattttgatttaaattattgcattatcactttacttaaattcccgcgttatcactgttttatttagccatacctatttacctttgttatgaccttattattattgttattgatattattaccttgttcaccctagattaaacaaaaccccaactagtggacactctactcatggtaccactagtatgatgttaggtagatgcttcgctggttaattaggcaacattaggtggttttacaactctagactttgggaatattctcatcacctggacactatgaaatggatggattattgtggaattggattcacacctccccctctattcaaaaccctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtggggttgggttggtactcttgtctatggctaggatgggttggaaactatgtcacgtcttccgtccgtataccgtggtggtatgtggcacgtggttacatgttaggaagatgtgtcttgtgggtaaagatgtacacctctgatcagagtataatctattcgaatacccgcgcccttggttatggccaagccgagcaatgtacccaagttagtgtttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagctctaggactgtatttacaaaatagctttgagcaactaagtgtcttttaatgctgtttactgcaaaccctaaccctttatattttaacccccttgtactcccttgcattgattctgcacttatgggtgtgtcttgttgagtacggtggttgtactcagtcttgctcaattttgcccaaacccaaaagaggagcccctggaagatgaaggctttggtgtctagctcatgcctgccgtcaagcgcctgtggtcgtcgccctagtcttccgctgtttttcgtttgtcttcttgtgtgctgggtcttcgctgcccatgtaataaattaattaattacgcttccgcttgttaaactctgaattgtatcaacttttggtgtaccttgcctcttgggacaaggaataatgcacgcacgtaaggaacgcccgttgggttatttccggtcgtgacaatggtcaatgaaaaattgtagtctattagcttcaattgtagaaaatatatcaacatcaatttgatcacttaatcgaccataacatgtcaaaggatttggttcatttagtctatagtgcatcatatatctataatattctggcattgtgacgtattttcttccaactccgtcataattattatatttaatgccaagatggaatccgcgttcaccatatgggaataataaagggtactgcaaggccatataagatgggtgcaatggagaaatctggtgcagtccatggtttttatcatacacaagcatatcaaatttgtattcttttgcagaaaattcacctactattattccacgatttcaccacttgttggtaggttatactgaacatcgtcttttgcgttgcaacctaaacggcgaagggttatttgctgatcaccatgttcagaaagacgttctttagcatatctgaagttttggacaagggcattctcagcatcaaacatcaatgacagggcagcaagtatttcagaatctgctttatctacattatcaccatcattttcaaatatatttagcctgttttgtatttcattttctgaatcatagatgtataattgagcgaatttcggaggtgaaccacgagatcgcacaagagtaccaattcggtggtgcacaactccattgatcttgaaaacataaggtgcattcccagtattaatcgatttgtcaacagtagcacccattgaagtgaaaacaaacattgagttatataatcgtatttgtctcaaaaatctttttgatcgtgcatcaccattaaagtttaataatgttgcaagtggttcaggaggaggacgtaacttaggtaattgtatttgaccacctttgcaacatagattgtaaactatttttcttttcgtgatagcagaagtgcttttgactctttcttggtaccaaaacatggcaccacaatatgggcattcatatgttggaggaccgtagtatgatctgtctgggtacaatgctgcaatgcgtgtattgaagaatgtcagaaagttttttttcggaacaaaaatagtatagtttgtatttagtatagtgtgcaaaccctttagtgatagaatatattctttatcggcccgtgatgaactaccgatgctcttagtgttgatagctgcagtgtacaaatataggggaaatgatgaacccagatacgaagaataacacgatccacatctaagaaaattgaaatagcataccatgtctacggccttcagtcggcgacgaaggtatttttgaacgcaagaagcaacgcctttgtctatttaatttagtcaattcaggtgtaaaatccatgagtgatctcttacggtcactttgttcactcgcttgatttggtatgattatagcatgttctatatgcatcgcaggttgccgagaaagaatatttgcaactcgtctttgccggctagcacgaactctgcgtactctattggtactttcttcattcatttgtgaaaacatttcacacatacagattgaaggaattgagggaaaaaaatacaggccccaacttaaatcaagagataaaataacacatggtccgttgttccatattacattatagatgttcatgatattaagttaagcatagctgcagtcttgcaaaagggcctatatggatttaaagtacgtacacataggaacaataaaaaaactacaatgatatgaatccgagcttactattgtcaataaaataactaaactatattgaacaacatgcgcaagtgatatcgttagaaagtgattgtctgtatgatcggcatgatttaaaccgtcaaatacaacctagaagcagattaaagggcagatcatcctaactttctgtgcactaccattgactgaaaactataatcgtgcactacaaaatcatatagtcagtagctacaggctcgtgcgtagtttcaatgagatctgtcgtttcaccaaaaaaaataatggctacaactcaactgggacaacaatggatggaacaagtagttctatggctacaagcaacctatcatcataatgaaattcccaaagaaaagaaggggtcagaagcatgagctgtcgtacagcaatattcagtagggaaacatgagagacatctatggctaactacaaaggaagaaagatggccatggaaagttggaaacataagctttgaccatatatctaatgacgaaataccgaggagaaggtaagaagtatgtatatataagaaggcgacatactatcatcgcaagataaagttgagaagaaagctatgcacacccatcgacttaacagatagtaaaaggaacaaattggtcgttataacaattgtgacaattgtaacttgtagcgtctctcttttgctactaatacccaaaactatagggggaagaagggatcactttcaatatatgcacacagcacagaaccatctaattatataaaaaaatgacaaagctagggaggaactgcagttgcacacacataaacttactggggcacacatataccatataatatcatgcaaagaattaaacaaccagagaaatatagtaatgtataacaataaagaagaagaaaataccttcagcacaaaggcagaccgaactgacaggaaggggaaaaggcagggaaacaagagcaatatcaacccctaattaaacaatagactgaaacagcaagcttcgcagcaaggaaagttaaccaacactatcttgagcgaataaacaaccagagctgcatggtacaaacatcatggttagacactagcaagtttaaatctaacgcgtaacagtagaagaactcctcagagaaatgccagactgaacagaaggatgaactgaaattacctgccaagtattttgtcacatcctgattttcgtcttaggatttataaattatttaataaatcattattagaatttatattaaatgttcattaatttacaagtgaagttaaatgtgagaaataaaatttcctaaatataaagcatggctggatttaatttttattaaattctccatggttaattatactctctggaattttctcggatttttcggagctcaattcctaattttaatcatacaaagaacatttcagtaattatccacatattaaattaatcattaaatggtctgattataatttttttaaatactttgagggtccaagtattttcaagatttttcttgaaattatttgaggaatagaagtatttttaacaattcaaagatcatttcagtgattaatttaattagaaaagtaattaaaattcaccttttccttttcgggccgaattaggaaaagtcctctcactctcggcccagtctcctctcatcctgcagtcctttccctctctttccccaagtctgctttttgtccctcctttaatcagtccttggaagtggaagcccaggagaagtctgttttagatcccctcgctacagtaccttcttcttcctccagccggccggctgccaagcccgagccgccgcctctctccgccaaatccgcctcaatcggtcgccctcgagtccgattgcttgagggtaaatcatctcctccttatcctcttcctttcccctaaggtttcggagatcaaatttgcccggataaaccaaatcgaattcgttttgagtttatctctccaaactaaccctagtttttcccggcttgatttctcgcggttggagtccgatctcttcaatacaagcctataaatagcatctccttggcgtcccctttcgtttgccccaactccagagttccctcgtcgctcgtagcgccgccgccgcgtcgtcttagtcgccgccgctgccggccgtcgtgcagccgcgtcgcgccgccgccagcgccgtggccgacgcctcttttcgccgccgttgggtgcgcacggaggaggagcatcctggccgccccttcgcagccgccgaagaccgccggagcgctgccgtcgacgtcgacccgagccgtgccgccgctagagctcgccgccggccaccattcgtcgtcgtccatcgcgtttgctagtaccggtgagttcgcgtcgtcgtcctctacgtgtagatgcctttagatagccctgccgacctctctatcgccggcgaggtcgtcgccggtgtcgtgccggcgatgatgacgtcagcatgacgtcatatttcctttttccagttttttttccagatgcaaatagattaaaacttcagaaattcataactaattcatcgtaactccaattcaagtggttcaagttgctaaatttttctaaaatcgagatctacatgttaaaaatatccacatatactatttatgcttgttttttactgtttatttggtttttattagtctttttcttcgttttgcgtgttagcttgttgtttccgtcgttgcgaaggttcgtgagtgcgtcggaagtgttcaagaagattaattgaagaccgattattgcaaggcaagtcacaaagatcctaaacacaatcctttgagcatgttgatcctatatttaaattctctatttatttcaactgtgtatttattttcgaatgtcaccggatggtgtgaacctattcctttgttatggccaatttgcattgaatgccctattccttgataccttgggtaataaattgattagcttgaaccttatgtattggtttggttcagctaaatgttatatatataattacttagccatgcttagaaacattagctcactaatgggatgaatcatatatactacattattatttatggttatatttaatgtagctcacgatggttaatcgtgttatgataattaactgataattaaaacttgtcaatggtgggttgtgagcacatggttgtgaaggtcgtgctcatggcaattaaggaccggttcgcgagctactattgtgaaacattaaccgtaccaaccaaaagccagcgtgggcaacggccttatcttttatatagcatgattcattacggggtgctagactgagaagcggcgagaagttcgtgggggtcgctggggagtccattgcctctggttttgagggggagattatgatccaggaatggtgcactgtggtgagttgtgttgtgcgaagggtattgtcacgatttccccctttgaagtgccgtggtggtacttcggggcatggcaacatgtgtggaatcgtgccttgtgggtacagtggtacacctctagccagagtaaaactattcgaatagccgtgcccgcggttatgggcgggttgagcaatgtttttcgtgattagtctcacacctctcaaataattattgatgcaataactggtaataatttgtttagctcctagtttggagttagatctgtacagccgggtatggttgttcaggatggttgggcctgtgcagcattggggtgctgttcagtgttgattaaaattgatgattaattactctactattttacttctcttaaatgtttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttattccgctgctgttttcttttcttttgtaagtatgtaacgttattattatgatggatttgtatattgaatt

SEQ ID NO: 12307 - DNA, 7378 bp, Oryza sativa
cttaatttttgaggattttactttaaaaaaatatgctccaatagatttcctattcagatgctaaacttgtggagtttctatcctgtaatattcgctctcaatactgaggctgagtgagggctcctctcctattcccaatcctacgctcccgcgtcttctcagcctgcgaggagtgaaaaatcatctttttcgcgtggctatgtcaaggcgtctccaaccaccgccgctgactcgatctggtcagatcgagcgccctccgtccaggtctccactgctagcatggagcctcatctcgtcggccctctcatccatgtccactgggcctgcgccgatctggacccacctttttccctaacgtcacgctagcctcctccgcctcgtctcttgattttcaccgccgcctgggctgctactaccttcgtctgcaggccttcaccccgccgccgaggggacggcgcctcctcgccgtcggccggggaacacgccttcttcctcgtcactactggtcgagacccaccgcatacagtcgtcaccatcaaattgactccgccgccagcaaccatgtccccttcgctgcctcactcctagtggcaagcactccaggctagacacctcaagcgaacaggcctcctgccgtcctgcctcgttggttcctatgctatgagaccttttctttctctgtttatctggtaggaatgaggaggaagagagggtctagcagcctagcagggtgagaactgagaaggggttgacctgtttgtgtggttatgctagcttggaacctcctatgcgttggacatatatcaaagtattggtactgtatcattttttttcttgctcagagagaattaagtcacccatggtctcactctcatggacctctacacgtccaacaacatcatcggcacgcagcaggacaaataagttgatttcttttggtagctttacatcggactcacttttttgttttagggatttaattttacctaatcttttggaggaataaaaaattttacacattaaatttcatttaggattcccaagattatttttttggatggaatatagaaaaaacttttggtgatgcatatgtgcaagaatgaaagaatacatatcgaaccaacttttaccttgccatgatggatggacgattaagtagaggcaaaatggatagagctttggcaggaaataaacggagaacaacaaatgtgaagaaaccgatgagactggaaaagcgaaagggaagggaaaaaatgaaaagcaaagcaacaattttgtagtgctgtggagcaaggggaaaaaaattaattcagaccctacaaatttacatccaccaataagcaacaagcacctaagcgtctaatggcagaccggcccatcaatcaaccaaacagctgtgtctactcaattgtagcaccgaataaaatcgataatatacactgtagcatatatcattgctagaccaacaccaatggagtagaacacagctcgggcccacaatacagagatgaaggatgtataggcaatgtccaccatataggaacgatatgactgaggagaccaggagtaatctagccaatagcatcttgcatactcttgcagtagtggagtgggcacacagtgctcccactacagacgtggtcttcgaagcacgcattaaaatccacccataaacaaaaaaaaatgttgtcacacaaggacaagggaacggcatggacatattctaccactgtgtgcatcaaacactggctggctgtacacggcaacagcaagagagagccatacaccatgcctacccaaaaacaaagcaacaacttagtattagctacttgtgtttttcgtcgctgcttgcgtgctctttcgtcaaccatccacctgtcaaggtgggccttgctgagtctgtctgccattggtccattgcggtgccgtatcgatgattgccagagccacacgatgatgatcgaacggtgtatgaaccaagcaaccacatgactcgaaacccagccaaaatccagcgccggatgacgtgtcggcacccagcgagggccacgccagggcaaaagccattttgagccgctaatccagctggtttgaagtatttaaataaatgtaccagtctacccacgtggcaagctcttgtataataaaatggtgatgtacggactccataaaattaatgtccatgaagccataaaataggaacgctttaattgtaccagccaccaaacagaaacaaatagataaactttccaataatttttattccttgcaaggcacagccgctttcctagcccatactataccaattactaatattctacggaaagcctctaattacgtgtatgtaatcacatatggaaatcagcaacatgatattttgcgacaatcataattacacatgatcttctctctagcattttataaaatatatatataaacttttattttgagaattacacagtacaatgcagacactcacaacacacactcacccttatgaacgcacgtacgcaaaccctacccctatgagcatcttcacacactcacctctatgaacgcacgtacgcaaaccctactcctattagcattttcgaaaactggaccagcaaatcatggagattgacgaagtcaccataggcgtctcgctgtcaatgagtatgttgcttaccactgaaagcacaatgtcgttaaatcctggaaaattcgctccccatgggagcgaacccaggacataaggtgctactgaggctcttttaaccaataggctagatgccctttcgcaaaatatattgaaaaactaattaacataaaaatcctacaagtaaaaatccaaagttgatgtcaaaatatcaatttccaaatgatataagcaatgttttctagttaaaacatacatttaaaatgctgaaagaatctatatattgaaattagggatgagaagactgctctgaaacatgtggaaactacctatttttgcttccatattttttggaatcagaattggaaattctgaaatccgtccctaaatatttaataccattgacttttttaaacttgtttgaccgttcgtctaattcaaaaacttttgtgaaatatgtaaaactatgtgtacataaaatgatgaggatgtaggtcccgatcttccgataggtattgataaacaacgatttgggcgaagtcgcgacacaactcgatctggcttctgaacgaacacgctattgagccccgcaattgcagcaccacgtctcctctgattatcaaccatgtcgaaacccggttgacctcgccgagaaggctaatccctgcatgcgaatcaaagaacacaagcaagaataagatatattgcaacacaattgcatatgaatgattaagcactcgaatttggggttccacaaaccgatctagcggcgaaactgttcttgacagaattatctaagcaaaacccaactctaaacgatgacggctactgaataaatgtgattagggacgtcctagggttgccctagggcgcgcacccccttgggctaagcccacaacacaattacaaggcccaaaacccaaatcagattcggacatggcttgttttgcaaattcccggcagctcggtaggaattttgacgtgggaccaaaaccatctaaaagtagacttcataagctttccaacaagtacttatgggccccgaaattccttctagatcatttcttgtagaacttcatttcttgtcttctatggaccaaaagtgacgtggtgagatgaaagaagaattggagaaggtcttggtttggtacccaatcaacttcttcaatcatccatgctttccttaagcttggtctcttttctttcgcccaagcaagtacctctgcaaacgaaaacacacaaaactcattgtgtagcaacgtttgttcaaatatataacaagtaaatctaatgtagaacatatgcacctttggtttattaatacataaggtagtcatggttatatccgagctagttgtgtcatcatcataaataaagtatatttaacaatgaatcaaatgacgaattaataattatttaaattttttaaataagacgaatggtcaaatatgtttaaaaaaatcaacggcgtcaaacatttagggatggagtatcaaacacaaacacaaagcaaacatgaatcaaagcgaacatggtaatgaatatttataggaatataaaaccccataaactgagcttcaaaattttgtctaaagcaatagataaaaattccaaaacttagcaactaacgatactacgagaccactttatcataaggaaatatcacagatcacagttgactttgccaagtccaaattttcatcttttgagatagtaaacacttcccttaaaaaaaatctcaaagtgaagaacaccacatctcatactgatatttatagggcagaagtgcacatctcagtatcacatatcacatttataagttattaacaatacaacatctcacggaggacaactggcatttatagagtaggaaatgcgcaacacaaacacagtcattcactgactcacaccacagacttagttcatttccgtttccaataaaaaaaattgaattcgtttcggtgaaattttctggaaagtttttgctttccgacagatagtgcccttcttgtgtctctgttgtcgagaaaaaataaatccaaattcgttttcgatgatttgtgaaaatattctgatagacccttttctttctttttcgaaaacaggtctggcatcaaaacaactttctgaaccattttcaaccaatttcaaatatacacttattgcaattttttatgggaaaagctcaggtattgcaaatttgagaatttaaaatgacatgaaaagctatctttctgaaaaacatgcatgacgtggaataactagttccctaattaattcccgccgtgcatgattaatttggcatgcatgttacgtgtaatgctcctctcctttcaagctattaattttttaagagtaaattgcgtccgtggtacacaaacttgttaggtgggtgcaatttagtgtaaaaacttgaaaaactctcgttttggtgcacaaacttgtataggtgcgtgcggactatgactaaatagaatagcaaatctaattttgctgagttggatgatgagtagaccgccaactaagcattcacgtaagaaggacaggtttgcctgctcgtaagcaatggccctgttttatcagaaaaccccttctattgtttggtatttcgatcatgtataatttttcagtgaaacgaatctgagaggtgttcatagcggcggggagctggggaggtcgaatccgcggtggctgtagtgatgggggtcgagcccgatagctacgtcgtggggggagtcgagtccgacggtggctacaatgggtaggtcaagtttgacggcagtggctgcaacagtattgccgagactgacgatagtgacagatggcgaggaggtcaagtttagtgggagagcttagaagttgatgctgcggtaggcatttgagtggcttgctttaggccaacatcggttatctcagactctgacaattcatatagcaactttgaagcctagctccaatgcttcagtgcagacattgaagcagcaaggaattaagccattgtgccgtcagattaacagcatgaacattaaatccactgaagcaacaaggatgtaatgcttaattgtacacattgtgacaaaatctgaacacaatgaaacacgtgagtgcatattttgaacagaaactgagatcctgaataaaattcagtgaatagcctgaatgaaaactaaatgcataacttgacatgaatttgattgtgcactagtaatgtagctcaaaatcgataacatggaaccaactttatgaatgcatagtataaactactgtttctttttcttgggagagtttttcttcttgggtgctgcacttctcttcctcaatgtggccctgccttgtttggttgatgtggttagtggtggttgaaccccttctctcctattagtagcaatgaaagcagactctagcactgctcctggattcaccctttcttgatggttgctagcagcctgtaaaagattatgtactaattttatgatggttgctattagctgacaaaatgctagcttaatgaaggattgttttttctttgagaacttaatgaaggattgtcacctccttaataaaagcttccaccacagatgaactcagatagttagaattttgttggggtatgctaagcaggtgcatttcctgaaacaaatatatgttatgtttaaaattccttgttagtgcagctaaacatatacacaagcaaaatgagcatcaatagtacctgagtgatgacaggttcctaaaacaaatatacaatgagtttaaaattcatagttagtggagataaacaaatacacaagcaaaataagtataaatattacccgagtgatgacaagctcttctgaatcaacaattgatgaagtcgccatttgctgcataggttgcttctgaagttttaagtcagccttcctctgtttacaactagttttgttgtgaccaccatttttgcagtagctacaatgcatctctactccatgctttgaaattttagtcccaccctctagttcttggggctattttctcctagttttctttggcctccccactttcttctcatatactggtggcttcacctctataccctgcatcttctcccagtggatactatctctcagtggcattatgttgtagctataagcttgttcatagcacctggttgaatagcaaaatgacactacatcctctggcttgattctttcatgtcttagacagaaaatggcatggttacaaggaatcccagtgagctgccacctcctgcaatcacatctctttacattaagttcaacaatgtattgagatcctctgtcgctaacctgaaatgctcccatcccagcaggcaaaacatagcatgtattagccatctctgtatttttctcgaccttccgttttatttttgggcagaggccacatggccaattcctttctagttctttttgcttggtgtacaacctgttcatgatctgatttctaatcctctcaagcatagacaaaataggcatctccctggcatcaagaatgtacttgttaaacacttctgagttattgttaagaaggatatcacacttcggaaagtcactgaaaaaggctcgacaccattggtttggaggaatttcttcaaggtacttataagcttcactacttaatgccttcatcttttccatattggcattccactcgggcacagtgctagatcttgcaatagcccaaagttggttctttagtgtctcccctttatgtaacacttgaaaa

SEQ ID NO: 12308 - DNA, 1267 bp, Oryza sativa
ttgattgacacatttttaaatatacattgatacaaggcacatatgttaacgaaccaaatttggtaatatcagcatcggagaaggagattagatcgaagctatcggtgaagtgggcccgggggtatgtggaatgaggggaatttacctttcccatcctggcgcatgacctacagcatggccctacccccgtaccccgcggatcgcaggagcggccagggggcctcggggtgccacgtcgtgcccctcgggccctcgcccgttttgccccgaggcctcggggtgtcacgtcgtgcccctcgggccctcgcctatccgccatctggcggggggagcaagcggggagggggcccaagccgaacctcctttaatgaacgcagcgccccaactgccccctgccgcattcaatgcggtaggggcagacgtgcggcatgcccaactggcgcgcgatggtcaggaatgactagtctgtgaccggcctgtcaccggtcacatatgactggacggacagctgtgcccccacgtcacatctgcctccggcagagtggaggtaggtatgacccgtcccatcggaagggtcattcgaggtcctccccatgagaggatggccaccacaattcttcatccattaatgggggattgacaggggtgtcccccgtgtcaggcaagggacggcgctgaaccccactcaaggacaatccgtggcttagcttccaggcgaaggcacgggtcgagatccggtcaaggtagggtgggccccccccacccgagagaagagtagtagagtcggtgcatgtggtatcccttgaggtataaaaggaggaccttgcccaccgaaaagggggggaccaagagaaaaaacctgagctcaaggagaaaggaagtaagggcaatctccagggcttagggacctttgtaacttgtgcctaaatcccatacacagcagtagggtattacgctcctttgcggcccgaacctgtataatcttgttgtgtgcacactacctggtagtctagtgggcggatacgtgattttcagaggcgggccttttcccccggtcgaactcacgaaagggggatcccacgatctcccgctagagaggatcactcctcgacagaagcggaatcgaagataagggctgtcgcgaaaacagagtaagaatcgggtagagtctggatcggctacggtcaggatcggcagagttcgagtcagacagggctagccgatacaaccgattccaagaatacgactcggtgtacatcagcgggtg

SEQ ID NO: 12309 - DNA, 16174 bp, Oryza sativa
ctaaatgctgtacgatgcaccaactagcaaccttgctgtactgggggactggacgaatcatgccacattaggtcgcgccatgcaactcctaccatgcgccatagttgcatcggctgcataacccgtggtcactctggtcgcacataccatcgaacatcggatgcatgtcaaacatcgaccaccacataaatttcgacataccttgaaaggtataccggaatgaattcgcgcatgccacatgaattcacatacatatttagcccattaatggatcatccgatacatactgcacttatgaaaagcttcaattgtgtctaattgacactacgctcttgccaaatcgatcctgcaagatcatgcatgttggcatcagcacattaagaaaagcactaagtaccggacgtccacaagaataggactaaaaatgtccaccgcaccattattgaaattcctgccacttcaatggactcttagctccaaagacaacgaaatatcaataaccggactattcgaaatgtgttgtccacttaaaagaatactagtgttgactcgacacacgtgcatgtcccacaaccataagggctcccaccgaaaaaaaatggaaatttttaacagaggtacgaacttatcctaaattccttgacaataagaaggattattttcagtcgtttagggggagagaaataacccttaaaatgataaatgtcaggaaaaatggtcaaagaaaggatggatgcacatttaatcaagaaccagcgaatgaaagtatggaaagcacacataagaattggataactacctatcacttttgtgatctggagagcatgactaagttgcattacccgaatgtaatgcaccggaggagggtgaaataccgaagaatgcaaaggtatacctcatcttgtccagatgcctcaaaaaataaataggacaagaactccggctccttaaatctctaaagtaactggagacgtatggtgaaaatgggacgaaaggaactttcaagctcatagtcactaaaagtaaccccagaatttgagggggagcctgttcagagctggcaaatggtatggaacctcagaacatgtataccacatcttcctatcaaggaagaaaaccagcagttggagtgcacaccaatgccggtaaaatgaaaggatcatgcccatgtcaaagaatagaagcataagaaaattgcatatccccatatatcgatggatactcacataagtgtcacatacaaccaataggaattggtaatgagacctgctatgggaaatattctcttcatacagcaaatcattggcagtcaacctggagtttaaaatcaactaaaagatcaacccgcaaagctgacctgtagttgacaatgaatggttaaagaaattttggattgggcactcgcatacaagcattaaaagtcccaaaccaagttgatgatcttaatatcatcgcataaagaaagaaagctcactctttccgaacaagtttgagataaaataggtagaaacctacgtttctttggctcataaacctacaacacatgaagaagtgaaccatagaatatcagaatgtgagaatacataggttccttggatatagttcaccatttctagcaagtaacatggttcgagctttgcccaaaccccaaaatcattatcaagaagataatgatatgtgcgtcacaccaacactaatagattgtatgatctctacaagttatggaaaaatcatgcaagatttgaccattgaagcatcactcggactatcttttgaaaacataagagcaacgagttttgatggttcacacttaaaagagatgcaaaattcaaggggggaattctgccagtctattaacaaaagcatgaactaaagaatcaagtacccaaaaacgattaagaaaatcgatacaagaatttgggtaaattgtactctttttcccttagataagttttcttgcagtttcttatcaaggtttttaataaggcaatctatgtgacatacatgcgtatgctatgtactctttctgcaatttttcccactgggtttttatggagttttaacgaggcatagacatcacgcggtgagtgcccaagggggagtgttaagaaactttaggcttggccgatgaaggcctggcccaaatacacttaatgggcccatcaacgaacctttcatatattggaatgcactatataaagagaggagggggctaatcatttgtacagttgattggaggattgaatagtaaagagagtctcacccctaaactttgtgtctccaatattttctgtagaattacgggaccctcttgaactgctttgtgtagcaggagggttgcgtaatacccttgaccctaaaggttccacaaccctgaccagggtatcattattaagaagtagagaagaagatgaggcactggaaggctgttatatgtccaagaaacattagctgccaccatcactttgggatggagagaaaaaagattgaaacaactaccatgtcaaaggaactctgaccatggttgcattcacatgggattataggctatagtgtcaagagtcaaaacctcgagaaggagataggccacgacgagcgcaagaatgtggatgtgcgctgtagtgaagcgcttgcttgagttcaaccatgtttagtcacatgtttttcttccttttatactgagggattgtttggtttagggtgtattcgtttgggaggaatttcaaaggatttggatttctaaggatcctatgaatgtcattcggttcgtaggaatgtagatatagaaaatcaaagaaaattttctttttctacaagttgcagagagaagaaaggaaactttccatccacataaacctcatggaaaaattcttacggattgaagtatgcatgcttttctattcctccacttttcctaatcctatgagaagtttctactcacagaaataggaaaagtgaaggagtggaaatgtatgcacacaccaatccataggaaattttttcaagagtttagagtaaattaaatgaaaatttttctagttttctctctacaacttggaggaaaacaaaaaaatttctttggtttttctatacctcattcctacaaaccgaatggcacttgtagtagttaatcattaggaatctaaattctttgtttttcttcaaaccgaattggtttagatagatccttaatttgcagcccttagaggatgcaatttttctttttgctatattcaatgaatgaaatagcaccgtctttgtgtctattcatttaaaaaaaatgattacttttgactggatctctacacgatatgcattggtgcagtacaataatagagatcatcttgcttcttattatattcagcttgattgacacatttttaaatatacattgatacaaggcacatatgttaacgaaccaaatttggtaatatcagcatcggagaaggagattagatcgaagctatcggtgaagtgggcccgggggtatgtggaatgaggggaatttacctttcccatcctggcgcatgacctacagcatggccctacccccgtaccccgcggatcgcaggagcggccagggggcctcggggtgccacgtcgtgcccctcgggccctcgcccgttttgccccgaggcctcggggtgtcacgtcgtgcccctcgggccctcgcctatccgccatctggcggggggagcaagcggggagggggcccaagccgaacctcctttaatgaacgcagcgccccaactgccccctgccgcattcaatgcggtaggggcagacgtgcggcatgcccaactggcgcgcgatggtcaggaatgactagtctgtgaccggcctgtcaccggtcacatatgactggacggacagctgtgcccccacgtcacatctgcctccggcagagtggaggtaggtatgacccgtcccatcggaagggtcattcgaggtcctccccatgagaggatggccaccacaattcttcatccattaatgggggattgacaggggtgtcccccgtgttagtcaacgcttggcgctaactaccaatcaacgacagaccgtggtttagtttgcagatgatggcatgggtctaggtccggtcaaggaagggtgggctcctccccatcccagagaagaatagtagagtcaggtgcatgtggtttcccttgaggtataataaggaggaccttgcccaccgaaaagggggggaccaagagaaaaaacctgagctcaaggagaaaggaagtaagggcactctctggggcttaaggacctttgtaacttgagcctaaatcccatacacagcagtagggtattacgctccttagcagcacgaacctgtataatcttgttgtgtgcacattagctggtagtctaggggacggatacgtgatttccagaggcgggccttttcccccggccgaactcacgaaagggggatcccacgatctcccgctagagaggatcattcctcgacagctggcgcgccaggtagggggatttcgcgcgcttcgaagagaagtcgtttccttccgctccaagccttcctccggccccaacgatcatggtggaggttttagaggaagaggtggaggtgcagacccttactccttccaggagtgaaggtgccagcgggagtcgcaacccgcgtcaccgccgacgcggctcgcggactccgcccctctccgaccccctgcggagggaggttcacgcctgatcgggtggctcggccctctccccgcctctggatggggggaggccatggcacgtccgagcgcgccgctgcctgacctaccgcgacggcagctcgccccagggcgcgctttaggcagggggagccctcctgcggcaccccccggtgaacgtggagccggaggcccccgtccaacgatggttggacgacgtcgccaacttggtcaccactgcccagcggcggttggccgtaagtggccgttccaccgccacaggtacatcacgtacctccaccaccctctcctcgtcagcaaggaggagggcccgtcggatagccacagcctcaaggcgatctacggccccaacgtcgtcaggggcctcggaaagtcggaggcgtcacgatagcctatacggggagcaggacgctcgagtcaacattgagcgtcgacgagacgagcgccgcgctacccgcatgggagaaggcgcctcctcgtctggagtgccgcgtttctcctcgcgcggcggcccgcccctcacgtccaccccagggggaactggttacaaggccttcgtggcgagtctccggaacgtccggtggcccccaaagttttgcctcaacctcacagagaaatataatggcagcatcaatccctccgagttcctccagatctataccacaatcattgtggcggcgggaggggatgaccgggtcatggcgaattatttccccatggctcttaagggtcaggcgcgtggatggcttatgacctagccccccgactccatccactcctgggaggacctgtgccagcagtttatcacaaacttccagggcacatacccccgtctgggggaggaggcggacctacacgctgtgcagcaaaagtacgacgagtccctccgctcatacatacagcgcttctgctaggtccgcaacattattccatgcatcccagcccacgcggtcgtttatgcattttggaacggcgtgcggcacaaccgcaagctggagaagatcgcctccaaggagcctaagaccaccgctgagctcttcgagctagcggacaaggtggctcagaaggaggaggcgtgggcttggaactcccccagcaccggtgcggcggcagcggccgcccccgagactgccccccgctccaagcggcgggacagaaggggcaagcggaagccagcccgctctgatgacgagggccacgtccttgcggctgatgggccctcgcgggccccgcgcagggaaagggccaccgacggcaagacgagctataccgccccttctggtaagggtcggtccgcggacaagtggtgctcggtgcacaatacttatcggcacagtcttgccgactgccgctcggtcaagaacttggccgagcggtttcgaaaagccgatgaggagaagcggcagagtcgacgggagggcaaagccctcacgaccccagccaatgatcagcgagaggagtctaagaagaaggcccccgccgacgatggcgatgacagcgagggtctggagttccaggtacctcagggaactgtcgccactctcgatgggggggcttgcgctcacacatcccgtcgtcggtcacatctgatctgtgaccggcctgtcaccggtcacatttgactggacggacagatgtgcccccacgtcacatctacctccggcagagtggaggtaggtatgacccgtcccatcggaagggtcattcgaggtcctccccatgagaggacggccaccacaattcttcatccattaatgggggattgacaggggtgtcccccgtgttaggcaagggacggcgctgaaccccactcaaggacaaaccgtggcttagcttccaggcgaaggcacgggtcaagatccggtcaaggaagggtgggctcccccccacccgagagaagaatagtagagtcggtgcatgtggtttccccttgaggtataaaaggaggaccttcccaccgaaaagggggggaccaagggaaaaaacctgagctcaatgagaaaggaagtaagggcaatctccagggcttagggacctttgtaacttgtgcctaaatcccatacacagcagtagggtattacgctcctttgcggcccgaacctgtataatcttgttgtgtgcacactacctggtagtctagtgggcggatacgtgattttcagaggcgggccttttcccccggtcgaactcacgaaagggggatcccacgatctcccgctagagaggatcactcctcgacagaagcggaatcgaagataagggctgtcgcgaaaacagagtaagaatcgggtagagtctggatcggctacggtcaggatcggcagagttcgagtcagacagggctagccgatacaaccgattccaagaatacgactcggtgtacatcagcgggtggagttgatatgcttcaagatgattgccacgcatggataaagtcctgaaaaggcaattgtatctattaattaggatattttatgcaaagtccttagagataaatgtgggcaaaagtctgtcgcaaagacttgtggtatcttagagtttgttagagataatagtcgtgtccggtatggacatatcttgtaatactcgggtataaatagacccctagctccatgtaattaatctaacacacacattcaatacaattttggcgcatcgccacccttttactttcattttgtttcaacgagttcttgctttcgggttgagctgcatcggtttcaatcttcaacaagaggtaaaacttgttatggctgcttgtgttctcgggattagtgcttccatctctatgatactctaatcttgtttatgtaattcatcaagttatcatatatcttgtatattcttcggtaatatagtcatctaacctacaatcagctaacatctgttagtagaaggcagccgattaggttaaatagcggtgttagcttggattgtacaagatacttaccactctatgaaacatccagtggcttgattgtctagatattgttcttcttttcatacttaatgctgcatcagttaagtttgatctatcaagtcgtgcttagaatatcaatctctagcctgcttcctggttgccgattagtatagcatcggagtttcagccgatcttacctgatttaactatagttatcctatatgcttgattgacatgttaaatctgccctttatgttaagatcttgttgcatttaagtatattatgcttctgtctgatatattctatttgctttaatatcttaatatagagtggtatcggagtattagccgatatatgctagatctatctaatcggctacgctattaacgtatatagttttgttgttgatttatatttcgatctaagtgatttatactgtctcggcatggcgaccgatctatcccaatcacttgatttaagtatatatcgacataagaattatatattgttaatgtctacagccaatcgagtaggtttagttcttccttaattattcatgactgctgatcgatgcacacatgacatcggtctaaaataaatgatgtcatcagtacccagccgatcggctatcatttatagatttaattacggtttctttgtcttcattttttgttgattgtaggatcaaatcgactggcacgctcatatatccgaaggcgagttttggacctgcactggagttaagcagatcttccaggcctcgtgttttctgtcaacaccatataaattgttgatgcgtgcatgatacatttaaatttttctgtagataattaaatatcacaaattgaagaagggatataatcataataacagtagtaggggtttgaccaattttattcatttagggaaatgcttcgcatagtttattaatcaggcggtggcgttgagctttgcgatttcgtcatggaatgcatcgacgtggtgagctgtaacacacgctgacatcaccctagccccttgctctgttgccttgagcatgacgcagatcggcatagcctttaccatcatcgacatggagagcaccaccctctgcgggtaggtcatcaccctcgccgtcttcccgctgccgaagtcaacatcttcgaatccgatgtttcgccatgatgtcaagtagagcaggctctcatatccatccagacgatggtcatcggcgagctcccgtagcatcgtcatgtcgctgccgccggtcatcttgagctgctccggtatccgctccttggcgcgccgtatgatgtctacaatgtcgttgatgtcggcgttcgccaccgcgccgctcttcgccacggccacgtgcatcgtgctgcagtttccgtagtacccgtccttggctccgagatactttcgcgcattcaccgcgaagagcagtacggcgggggcctccggatttttcatcaccgcccgggtacggcactgccaaagcacggcggcgacagcctcgaacacggtgacgtcgtcgttggttcgtcgtcctcggaatcggatgtggtcgatcaagctcgacgggacggtgatgttgttgaaggtgtggtcgatggatgccttgtggctggagctggacataaactgataaacggccatggcgaagggaggtatggcctgggtggcgttgttgtcgtcgtctaacctgaccgggacgacggacggcgatggcaggccacgggtgagctcgccgacggcttgtatgaactgtgccatgccgaagccgtcagccaggccatggttccatgtcaccccgactacgaagcctccacaggagagtgtggtgacctgcatccacagcagacggtgatgaaggtcgtcgggcgtgcagttgaaggcgagctgctgcaccaccgccgtctcggcgtcgggaggctggtcgtcgacgcaacacatgagctcctccatggtgcagttggcggacgccgccacgaacgtgactccgagctcctcgccggtgcagtcgatgtagaaatcgccgtcgtcgtcgcaggaaaggcggccggcgataggatagtaggggacgagcgcttgagcgagacctctcttgatggtctccgccgtgcactctgattggatggtgggatggtcgaacgcaagtagcactgtggttggcatcatggaactaggcttgtccataggcgacagaacgatcttgctgccggaggtagtcttcaccggcggctgcgatggccggacgaccaccggcgccgacttgctcaccacaatgctcatactttctctatgtctaggctctagctcgctctgagaataagttaggacaagcaattacagatcatgtatacaaccatacaatccttaaacaaaagcatcatagcactggttacctctatggaattgacgagacaaaagtgatcgaagcaatgtcaagactgatgagctatgagcccttttaaggtcttcatatccatcctaaccgttaacatacaattatttcttaatttaaaatatgtttgcatatctgtcaatcaataaatgaatggctttaatggaaaagagtaatacacgtaagagcaagtttaatagtagagctaaatactagctataagctcatctgaaaataatattagtcaacttgtaaaatggcttagctataaggttttctttatttttatcatagtcctttcttttcttctcacttatctagtataggtagaggtaactcttacataagagttagtacctattatctctctcctccacatatgcacgccacgagccaaagaagactgtcaccggttcaccgagagatggatatccatatataagtacatgtgacacagaatgagtttgacgatatacacatagggtagggggcatatcgattttgttagaagataatggatgacaaatttagaatgtcattctaagtgggtagctgagttaacataggtcaaataagatagtgttagaaataatcttgttattagtgcataatcatgtttgcttaatttggtcgcatgtagcaaataaatgtataggtagcaggataggataaggtacccgaagaagctatagtagtagtacgcgagatccgtatacgagtaggcccaagagccgtgcgagacggccgggtatgtgagatgctgcaggagcacacaaatagtggctggttagtagagtcattagcataatagccgggccattaggatcttagttaattactaggtgtgcatatggatgatctagtcgtgtggctaagagtagcatgcggctgctagtggcgcacgttttggcctctaactttgtctatttaagcatgtacttagcatctttgttaattgagtaaaaaagagaaaaacgctgcgtttgtgcagcaccaaactccactgttctttgcctctaaatgtgtgtgtgtttatcaggagtgtgtgcgagtctatctagctaggaagtgattcccaacagatagcaaatcaggttggaagagacggaagtgacttggaagtatagctgagggaaagtacgttagatgctattatatggtgaattgtaaacttttgatgcaataaaactaaaatcgagaactttccttactatagattcaattttacatttaagtagaagcaccaagtttcttataacttcctctctacaaagtttctttagtaatcaaataatgcatgactagagactgtcccatcaaatattaattggtagtatgggctaggagagtgaccgtgcctgcaaggaataaacatcattcgttatatattggtttatgcttgagctctctaataagaaaacatgcacgttcttcacgcagacttgctatagctaactttcaaatagtttaattcttatctactagcgctccaatattaaatatggttttattataggtatacatattaacaccataacggtattacgtccaaattaattaataccctctctactgttgatgttaatcatcacgtacgtcgccacactatgagcatattatgtgcaacctgcaatggcaatcagagacgagtcgtcacaaggaaggtggatgccaccaaaggaacaaaagcatcatagcaatattaacccgccgtggctgtccgcagagagaacgtgaagcaacgtaaagacgaatgagccatgagcccttttatggtgctattttataactctaagggcttcaaaccgatcccaagagtaggtacaatagcaggctcttagccagctgtaaatatgttttaatgagataaacgatgagagagaagagtagcgggctacagatctatagccagctgcagcacagactccaagacacactgtgtgtacgataggtgagatcatatattaatagtatagtaagcaactattgtataaattgactattagattagctatagatgaattggagctattagtgggctatactattatactagctctaagggcatccacaatgtagcatttcagcaggtaataagcattaaatgccctcttcttacccggtagcaaccattgtgagactagtaagtagatgcagcccggtaacacgactacaaccgggtaacaggaattaaactatgcccagttttcctaacaaaagttatagaaagaagtcacggctagagactgccatccatgattttttctgaagctggccctaccttgtttcccactgatatgctgatacattgtagagtgcatgattgcttactgctgcctgtagccctggcccacactactgacacactactaccaagttgggcaagtaacattgctgttgccctaacggttgatatgtaattgttttttgtaacttaaaatatatttgtgtgtgttaattaatgaatggataacttgaatggaaaggagtaagaggctgacaacgaggtcggtgagaggatttcttgagcacttcgagtgtgacagcgaggtcggcgaaaaatcacgtcaggcccaatgccgtagtcaatgtgtgtatccatcgccgccagctcgatcagagagaggaatggtggtggaagaagatgactaaataagagtaacttgcatgtaggtcccacatcaatcttttaatttcgttgatgacctagttgccatgtggatgccatctacaaataccaccatcaatattgtcttgtgagttaaattacatgggttataacagttttttttttggggcgggggtgttccagatatccggtattgcagttgagggatacgaatcagataggacctatatttaaaggagtcaaattggcaggattatatataaggcatatctcctatatgtgggtttttgttgtatgttaataccaaacctaatattatacgggaagatgcccttggaaacagtaataaaattgatgattctggacggaaactgtcttcgctgggtggaaggctctaaagtcctattcaaaaaacacaaggttcccatggttaattttctatttagggtctccgagttctacttgtagaaaaattaaaagtcaatcatcggttctaattggaggaaaatcaattatcgatacaaatataaagcccttatgaggatagagatcattgaattacgagccataaccaccaaccacatcagtagacaatccagaggaaaccgaagccctatttgctgataagctctcgctaagtcatactcggcgagttctaatcgacggattgccttagctagtctattctcctcatttgtaatcattgtagtcttttcctagatatacgtataaactgtgttagagctattactctttttagagggtctgaaccagtataaacccttgtccttgtctagatacaatctcacatatatcctagtatcaacgtcctccgtactttataaataccgtaggtagataaagcccataaaaaagtggtcttatttcttttgtttggcatagctttgatcggtttgcccattaattttgcctggttgagtaggctattatatggtactccctactccctcggtttaatataactgtcaccattgatccatactattgtaaccgtaattttaaaatggttagagtcttcgcaaaaaaatgattagagcataatgataaaaaaattaatacttaagcatgtagtaatattcttggataatatgatatctacatatttatggatttagaatttctttcagaaaagacaaacgaacacaatttaaatatgaatagtgctcggtttaataaatataaacaaatggatagagtggctttcctatgaatttttttgttctggaaacacgttacgagcgttcatatacacacgcacgtactctcctttataaacgcacaaatacacatcctagtcctatagaaaccaccaacagactatgccacataggcatatctcaagagtggtcttgggaccaactaaaaaatacatagctaaaggttgatgtattcatgggttttctctactggtaatgggatacagggtctatgagggtcaagatctgaagagggaggtagacaatgaagagagctagaacatggtcgctcgctagagagaagcgcttgcttgagtttaaaccatatgaagatgtaaacttttttgtgctatattcaatgaatgggcaccgcctcgtgccgatttgttaaaagaataatagattacttgactggatcggatctctacacaatgtatcgatggaagtacaataatagaaaccatgtgccttcgtattattcagttatatgctttcttcacgattaatatttcttcatctttgtttgtactgctatggcatgtattaaaaaactagaaaagtgcccgtgcgttgcaacgggatgaaaatataataaattgaggaaatattgagaaatatttacattatgtaattaattaaaattcaaattcaccatcttctttatacgaagaaactatatgtgtgtgtgtctctgtaattgcattttcatccctgctaaataagaaaatcgcaattacagatatatatgatgttgaagaaaataattaaaaatgaattctaaactgacctggctatatgttaggtctagcgatgtgtttggtctaacatcactgtactatctagttttggagtggcttgataaagcagtcgtgcttggaacgttgggactgccatggaaggaaacacagaaacacagaaaacgtaggtctagcatcactgtactagcttgttttgtcgtgagactgccatggaaggacacacatgaacacacggtcaacagatagacgctgaatcaaaaacgcccggacgaacgattggagttgcatgtaatgttgcgtcttagttgcacatctcctttgaaaagagatgacatcattgagttcacagatctcaagaacgtattttcatcaagtcattttcattaaattgatctcattgacctctattttgaagagcagcgacaacagaaattttgaatgatgcatgattcttgtggggtataggatatatgtatgtatcgtcctaatccaaattgagaacgggatggactgtccaccttgatttttgtttaagagatttataaatcattttataaattatttgtagaatttatcctaaagttcaattaattttccggtgatgtaaatgtgggaaataaaatttcccaaataaaatatagctggatttaatttttattaaattctccataattaattacactatctgaaattctttcagaattttcagagttcaattgttaattttaataatacaaatatcatttcagcatttatttaaataaaaatctaaataaaaacccttctttttctctgggccacttttagcccatttcttctgtcaaactgcagttgagccggcacgctttcttcccttctcctcccctccgcctctggcccttaagcgcaccaagcctatcaagcaaccacaagtctaatagtcctcgcttcgctcctctcactgtcgcgtgggtcctagtgctacaggtttgtctcctacctccagctagactcccgcagcttcaagacgatgtctaaaatcgtctccaccatgaaatctggtggcatccttggagataatccaaaactgagattgaggggtttcgatttttatctcatactctttccattttctgaagaatcaaagcaaaacctcatcgtatcgtgcttggaatcgaggcctatcctaaataagcgaactctagaatttctcatctcagagtccgtttcactagaatttcccatcacgtatacgtatgataacgacgatggacgaaagtagtcgcgaaatccttatgtatttttttgagtaaagtgtacgggtggtctttaaacatgtaggggtatgtcatctaggtccctaaactctcaaaatgaatattcaagtcctagaacttatcatagtgtgtcatctaggtcccaaatcgccacaaccccttcaggatcctacgtggcgttgatgtggcatgccacacggacatgatatggctggcattattttgactgacaaatgggtcccatttaatttttttttcctttttcttttttcttctttttttccctttcttctccttt

SEQ ID NO: 12310 - DNA, 8173 bp, Oryza sativa
cgccacgtaggatcctagaggggatgtgtcaatttgagacctaaatgatacactttgacaagttctagaacctagatatgtattttaagagtttagagacctatatgacacaatcctacaagtttaagcaccgctaatgcattttactctattgtttaattagatatagatgtaggctatgtgcacttgatagcccagtggccagtaataaatttccatatctaaaaattaaagaaccataaatgtatagtgaaatagtgatacaggtagaagagtcccatatagaattacttgttcatgcatgctcttgcacggtatatatattcaaatttttattgtagataaatcataattggcatattgaagaaggtatagatagctcgcatatatagttataatcaggtggtggctttgagcttggctatttcttgatagaaggcatcggcgtggtcagccgtaacacagtctgacatgaccctgaccccttcctctgtggccttgagcatgaagcagatgggcgcaatcctgggcatcatggacagcatcctcggcgggtaggtcatcaccctcgccgtcttcccgctgccgaaatcgacgtcctcgaacccgatgtttcgccaggatgtcaagtagagcaggctctcgtatccattcacctgcttctcccctaccatcgtccgtagcatcatctcgccgtcgtctgccttcagctgctccggtatctgctccttggcgcggcgtatgatgccgaccaacttcatgatgtcgccgttggccaccgtgccggacttggacacggccatgtgcatggcggtgcagcatccgtagtagccgtccttggcgccgaggtacttgcgtgcgttcaccgcgaagagcagcacggcgggggcctcaggatccgtcatcaccacccgtgtacggcactgccagagcacggcggcgaccgcctcgaacacggtggcacgacgacgagctccgacgatgatgtggttgataaggctagatgagacggtgacgttgcgtacgtcgaggtttgatactggcttgaggccggatatgaagcgatgaacggccatggtgaagggaggtacggcttgggttgcgatcttgtcgtccaacctgaccgggacgacggacggcgatggcaggccacgggcgagctcgccgacggcttgtatgaactgtgctatgccgggaccgtcagccacgccatggctccatgtcaccccgacgacgaagcctccacagttgagagtggtgacctgcacccacagcagacggtgatgaaggtcgtcgggcgtgcagttgaaggcgagctgctgcaccaccgctgtctcgtcgtcgggagcctggtcgtcgacgagacacatgagctcctccatggtgcagttggcggacgcggccacgaacgtgaccccgagatcctcgccggtgcagtcgatgtagaaatggccgccgtcgtcattgtcgcaggaaatgcggccggcgataggatagtagtggacgagtgattgagcgagagccgtcttgatggtctccgcggtggcgtcatggatggggtggtcgaacgcaagtagcacggtcactggtatcgtggcaacaggcttgtccaaagttgacagaaggatcttgtcggccgtcgatgtggccggctccgatggccggacgaccaccggcgctgacttgctcaccacaatactcattctaaattaatatccgtctgggtgttctaccattgataagttaggatcacgtaagcatataattaatacagtagtcatacagatctagtactatagagattacaaccatataatataacggatttgctataaacacacatacatacatacctgctggctgctggctgctggctgctggcctcctccgtgacttttcatatatactggtcgatatgcagttccacagtgttatatggttggccaatagatatcattggtcgttcctagtcttcgtcgaattaattatttatttaattagggcaagctttggtatttcgtcgctgtctcgcatcccgcgtgcaggtatattatatatttcctccatccagaaatctaaaattgtttgatatgtttcaaactctaaatcttattggtaatcactatgtgctaaattaaattattgatcggaaaaaagaagtcattttagtacttatggattgcacgctcataagttttttcatatggtggatgagttaattacttcctaatcttggtaataaaataaataggtgttagacttttgaatagagagagtattgttactattctgtccaaaaataacaagtcaggtttgtagttaggattgaagtagttaggattgaattttttatagtacggagggggtatttgcatgtagctcacatgcatgcacgtgcgaggcaggcccgtatctcccgagctaggacgccaggaatgtttaaatcgagcttcgctcatgagccaggcatatccgcgcatacgtgcaacctcctcgttgggatcaacgcctggactccatctcacaccctcacttaattatagtcccactaggatgctcatgctctgtactggtagtaagaagcaatctaaaccgtcgatctcatttgatagaaggatttagatctatttatattaccactctagttagtggcagtataaacttgaaggtgtattattataaaaaaaagtttgaacgggtataatcgttatttagaagtgattaaacttttttcttcatttttatctttttatggaataggagcaatgctagcgtaacggatgagaggttaagaccagggttttctgttttgggcattttactaaggaaaaaggccaatataactctctcagatataagtttaatcctatttatattccttatccgtaaaaccgggcatagtgacttctctaacagataaaaccagtattgatggtgatattcgcactactaaagaatgggctattggtgctggttgggtaacccccatcggtgccggatttcccaactggcaccatggagacgacactgatgagaatgactcaaaggtgtcagtttaagaaccggcacctttgatgtatatgatttgaaaaaaaaaactagctcaactcaatttgggccgagcagatgcttcacagccataaaaaataaatccaaaattagtgttaaaaaaaattcaaaaattgctccgcctccatccctccgtgcgcgtcgtcggttggatctactagagaaaagcttcttccaaatctagaaatcaagataatgttaagggaaagaaatggtgcgggtagaaagagatggatggaaagagaaagaggatgtgcgtcggcacatgtactcaccggaggtagaagcagcaggacaacatcgcagaagtgggtagatccggtggcccacctccacgctagtggccactgaggtgagaggagagaggggggggtagagctagtcttcacaggccacgacgaggaggtaaggagaggccgccgccgccgggccaccgccgtatcccctcccatcggatctggaggaggggagggcactgttagagataatgtttagccattagtttgttacatgaaatatcacatgtgatatggattggttgacataaggttgggctgttacaaccgaactctggctgatccgatctcattcttgtaagccacgtttgggagctattcccaactcatataaatacaattacgcggcctcgagacgaggtgataatgcttacataatttctatatggtatcagggcctatctgccacgccgaggttgcatctatgggcgatggcttcctccatcagtagtgccacctccaatcccctctctaggcaagcgatcctagacaaacttacccacagcaacttccttaccgtgatcaggggcgcacgtatggaaggatatctcaccggtgccaccaagtcgccgtcccagatggtgatggttccaacggagaaggaaggtggcagggccaccgaaaccatgaacctggcgtacgaagcctggttggctgcggaccagcaaatcctcggctacctcttctcctccttgtcaaaggagatcctgacgcaagtcgtgacaatggacacggcggcgcaggcgtggagggcaatcacggagatggtgtcctcccagtcgcgatcgcgtgccctcaacacacggcttgcgctctctacgacgcgcaaagacgacctcagcgtatcgaactacatcagcaagatgaaaacactcgctgacgagatggcatcagccggcaagcccctcgtcgacgaagaactgatgggctatgttttggtcggccttggtgatgactacgaaccggtggtctccagtttggtaggcaaacacgaaccagtttcaatttttgaagtttactcacaacttctcagtttcgagtccagagggaagctgcgacagattgcagcaaatcatggctattcctgcgctaatagcgcaaagcgcggcggcggtggaaaaggtggcagcatcggcggcttcgccttcaaccatggcggcagcaatggcgcagctcgcgggaacttcagcaacaatggcggtcgcggggatcgcggtggtcgcgggcgcggctacaatggaggcggccgctacaacaactccaagccgtgccccacgtgctagctctgtggcaagatagggcatgttgttgccgactgttggcacaggtttgatgattcttttgttccagatgccaaggtagcagcagctgcatcatataatgttgatcaaaactagtatatcgataccggtacaacggatcatattacgggagagctagagaagctgacgacccatgaaaaatacaatggcaaagatcagatctacacggcaagtggtgaaggtatggaaatcaaacatataggccattctcaaattcatacacccacacgcaatttatgtgtcaaaaatatactccatgttccgcatgcacacaaaaatcttatttctgctcatcgacttgcctttgataatcatgcctttattgaggttcattctcatttctttgctattaaggatctggacaccaagaatcttcttcttagaggacctcgccgcaatgggttatatctcctacgacagtcgtcgatccctccattcaagcaagcccttggagccatcaagcctagcttcacccaatggcacagtcgtttacgccattcttcttttgcaatagttcaaaaattgtgaagaataatagtctcccatgtttaggagatataagtgagtcaggagtctgtgatgcttgtcagaaagctaagagtcaccgactcccatatcctaagtcaagtgtgtcaagtgtgcctctcgaacttattttttcagatgtatggggacctgctcctgattcttttgggggcaggaagtattatgtgagttttataaatgattttagtaaatttacttggatatatttgctaaagaaaaaatctgaagtgtttcagaaattccttgattttcagcaacttgtagagagggtctttgatcacaagataattgccatacaaactgattggggaggagagtatgaaaagctacactctttcttcaccaaaattggtattagtcatcatgtttcatgtccttatgctcatcaacaaaatggctccgctgagcataagcatagacacattgtagaggttggccttgctcttcttgctcatgcttgaatgcctctaaaattttgggatgaagctttcctagctgctacatatctcattaatcgcacaccatctagagttatccaatttgccacacctctagaacgtctgttaaaacagaaacatgattagtcttccttaagaacctttggatgtgcttgttggcctaaccttcgaccctacaacacccgcaaacttcaatttcgatctacacaatgtgtttttcttggctatagtaacattcataaagggttcaaatgtttggatccatctaccggcaggatctatatctcacgtgatgtggtctttgatgaaaaaaattttcccttctctcaaatgcattccaatgcccggtgcaagactacggtctgaaattcttcttcttccacctaacttgttgaatcctgatgttgctagtgcgggtgtaaatgtgaatgatcatatgtttgattctcctgaacattctaatgtctctattgagcatgcagcagaaaattcagacgaaaacagtgcacaaaatagtgaagaaaatgaagcggcagatcatctagaaattgccgcagaagatcctgacggcgctgactcccagggcgattctcccgctcctcctggtcctgactccatgctgggatcaccgccacagcagtctgtgcagcctgacacaaacatctggtggtgatgtcgcccattctagtggcaacatgtcggctgctagcgccagtcgccgtgcgacataggggggcaatgatggcggcagtcatgatggcagtcgcagtagtatagcatcacagcagcagcagtcgtcgacaacgacatctgatcagcaacagccgtcacgtcccctgacatgtctatagagaggcattagaaaggagaaggtctacactgatggaccagtcaggtataatttacttgctgctagtggtaaaccacaaaacctagatgaagctctctgtaatcaaaactgaaaaaatgctatggatctagaatatagtactttgctgaataataggacatggcacttagttccaccaagtaaggaaaaaaatgttatagattgcaaatgggtttataagattaaacacaagtctgatggaactttagatcgatacaaggctcgtctagtagcaaagagatttaaacaaagatatggtatagactatgaggacacctttagtcctgttgttaagccagctacaattagaaccattttatctattgttgtctctagaggttggtcacttcgtcaacttgatgttcagaatgcttttcttcatggcttgttagaggaagaagtctatatgaaacaacctcgaggttatgaagataagagtaaacccaatcatatttgtaagcttgataaggctttatatgggctaaagcaagctcctagggtgtggtatgctaggcttagcagcaaattatgtgatcttggttttaaagcatcaaaagctgatatttcattgttcttccaaagtaaaggaggagttaatatgtttgttttaatatatgttgatgatatcattgtggcaagctccacacagaaggcaacagatgctttgttaagtgatttgaagaaggattttgcccttaaggatttgggagatttgcattactttcttggcattgaaaaggttagtgatggtatgttattgacacaagaaaagtatgcttcagatctgttgaaaagggcaggaatgattgcttgtaaacctgtttctactcctcactctactatagagaaactctcagcttataatggttctgaattaggaataaatgatgcaacaaagtacagaagtatagttggagctcttcagtatttgaccttgaccaggccagatttaccttttgcagtcaataaggtttgtccgtttttgcattgtccaacagtgcaacacacgatggcagtaaagaggattttaagatatgtgacgtctattgttaatcttgggttaagaattaacatgtcttcttcttctcttgtaagtgctttttcagatgaagattgggctggatctgttgatgataggaggtctactggaggctttgttgtttacttgggatcaaatctggtatcctggagtgctacaaagcaagctacagtctccaggtccagtacagaagcagaatataaagctgttgctaatgcaacggcagaggtaatgtggatatagactttgttgaaggaaattggtattgattcacctccatgtgcaagattatggtgtgataatatgggagctacatacttgttagtaaatcctgtgtttcatgctcgtactaagcatatagaggtagattatcattttgtcagagaaagagttgcaagtaagcaattagagatcaggtttatctccttaggggatcaagaggtagatggctttactaaatctcttcctgtgcaacagtttcagaatttcaggttcaatattaacttggataagttatgattgagggggggctgttagagataatgtttagccat

SEQ ID NO: 12311 - DNA, 1209 bp, Oryza sativa
tccaaaccagggcggaggtcctttcgacaagccaaccgttggtgtcccaaactgtatcagcacagccggcgatggcaccgactgcgcttgccgccgctcaagtcaatcctgaccctgaaacacaagccgaagccgacatggaggccatgcggcaaaacatgacacaactccaagacatgcttcgacagatgcaagaacagcagcaggcatatgaggcggcgaggcgggccaaggccgcttcggccctaatcctacagtattcggcaggctatgtcccaccccaagtctttccacaagcgccgatccagccccttctgccacaggccacgcaagcgccagtgtacttcgccgggcagccttcgactgcagccctgcacgtgcagccgcaagctcagcgtgtcgctgcccaagcacactctcaaccacctggccaagtatcgcaagcaatggcagaaggggcttcggctctgcaagcacagcttcaagctttccttcagcaattcaaccaaccccacaacatttcaagtacaaccccttcggcccagccggagggaaatacaggtcaaggtgcgcctagttggttgccgtcgaaccagccgggtccgggggcttcgccttggagtcaaggaccgcagttcgacttcgtcaatgttgctccggcaccaaccgctcggccacaagcaccgacaccaggcttcgggacaaaccaagcaccaaaccaggtcgccatggcatggacccagactacgtttgacccatccatggcgcctcaccaagcatcaccaatcggagctgggcagccgaacatcatgatacaacctcatgcgcaagccatgacttaacccttcgcacgccatacccgcagcaaggtgccgtgaacagggtaggggacgaaaaggggctaccactgagtgggggaatcaagaatcgtccaatcccaccccagttcaagtcccacccgttccgcgttactcaagcaaaacctttagcacaggcgaaaacagacgcgaagagcaaatattgttcgatgttgtcgacatccggtacaaatacaatgccatcttcagccgtgcgaccttgaacaagttcgaagtcatttcccaccacaattatcttaagctcaagatgcctggcccgacaagagtgatcgtggttatggggctccagccttcggccgcctcaaagggcgatctggccataatcagagct

SEQ ID NO: 12312 - DNA, 28071 bp, Oryza sativa
  unsure (1)..(28071): unsure at all n locations
gctggcgaacccggtgctagtgcgaaaatcaaacggcaaatgacacatgtgtgtcgatttcacggatctaaacaagtcatgtccgaaggacaatttccccttgccacggatcgaccagcccgtggattcgacagctagctgcgagctcatgagcttcttggatgcatactctggctatcaccagatccacatgaacccggccaacatccccaagacagccttcataacaccattcggcaccttttgccacctcaggatgcctttcggcctgaggaatgccggggcaaccttcgccaggctagtgtacaaggtcctttacaagcagttggggcgaaatgtggaggcttatgtcgacgatatcgtcgtaaaaagccgcaaggctatcgaccatgcatccaacctacaggagaccttcgacaacttacgtgcggcgggtatgaaactaaatcctgagaagtgtgtttttggtgttcgcgcgggcaagttgttgagtttccttgtttctgaaaggggcatcgaggcgaaccccgagaaaatcgatgccattcagcaaatgaagcccctgtcgagtgtacgtgaagtacaatagctcacaggtcgaattgcgacactcagtcgattcctctcaaaggcagccgaaagaggtctgcccttcttcaagaccctctagggcgcgggaaaattcacctggacaaccgaatgccaagcagcattcgacgagccaaagcaatatctgcaaagcccacccgctctgatcagcccagcaccaggaagcgaactgctactgtacctagtggcttcgccagtagcagtcagtgctgccctcgtccaagaaacagagtcaggccagaaaccggtctatttcgtctctaaagcattgcaaggagcgaagacaagatacattgaaatggaaaaacttgcttacgccctggtgatggcttcatgcaagctggtagaaggtcatgttgacaagtcctttgaggcaaaggaagaaggaatgaagaggtatttgaaggctgttcggtctatggaaaaatgcttcgcaggcataacggtcgaacatttacctagaggccagaacgaggaagcagacaccttggcgaagtctgctgcttgtgggggcccacattcgctgggcatcttttttgaagtcctatacgcaccaagtgtgcccatagagagcttggaggtcatggcaatcgaccaggcagaactgggcaatgatccagaggactggcgaacaccgttcgtaaagtacctcgattgtggctggcttccggaagatgaagcagaagcaaagcgccttcaactcagagccgcaaagtacaagatggtctcgggccaactatatcgttccggggtgcttcaacctttgcttcgctgcatctcttttgccgaaggcgagaaaatggcgaaggaaatacaccaggggctctgtggcgcacaccaggacgtaagagcagttgcctcaaaagtgtttcaacaaggtgtgtactggcccaccgtgctgaaggtctgtgtcgagcaggtcaagaaatgcgaaagctgtcagcgccatggccgaagcccaactgcgccccaataagagctgcagcacatcgcactcaggcatttcgccagataggggttggacatcattgggccgttcccggtggcgcgaaacgggtagaagttcgcaattgtggccgtcgaatacttctcccggtggatcgaggccgaaccactcggcgcgatcacctcggcagtagtatagaagtttgtatggaaaaacattgtatgccgtttcggagtgccgaaagagttcatcactaacaacggcaagcagttcgactctgacaagttcagagagatgtgcgaagggctaaacctggaaatcaggtttgcatcggtcgcgcacctacagtcgaatggggcagccgaacgcacaaatggtaagattctagaagcactaaagaaaaggcttgagggggcagcgaagggcaaatggccggatgaaatgctgtctgttctctgggcccttcggacaacccccaaaaggccaaccaagttcagaccgttcacatcgctcgccgaatgtcgaaaccgcaacagcttgttttgggaagcaaccaaccgaacacccttacattcgattaatatgaaaaaaaaaagtgcttctttcagcacagaacgctacagatcgaaaacggacgccgaaagctgaaaagtcagtagacctatttcgctaatatacgcaaaggggccgacatgctctgacctaacgaaagcgcaaaatgtgacaatgcgaagaatagcgaaaaggaaataaaacacatctttattagtttcaaaaaaataatcgaagaatacaagttttacaacatgatacagcccagcttacaagtaaattacaccttcgcccccacagccaccttcgccccctaaggaatggttgggtgagctgggttcgtcatcactactaatatcgtacatgaccctgagaggggaggggggcaaaacacaggctagactgtatcgacgctgggagatcgcctcctgccgatcggtcttctgatggttccgccaaaagcgaaccatgtcctccaaacgctttgtatgaacatgatcgtagtcctccagggtctgcccagggtgcgcccgcatccagccggcaaccttcacaaccgtatagatgttgccgtttatcatcatatcgcgataaacaggccaaaacgcacatcgcgcctttggcaaacccttaacagccacgaacttcttgttcctgcttcgccaatcaccaagagggggccgaacacacaattttcggtgaacaccctgctaaaataagtgcagaaagggcaaagagcgaagtgcaaagttaggactctgcagggagagagtgggcgaaaagagtaaacactctgcagcatacaaaaataatgcgagaatgatgcaagcatatataccaaaagacatcgaccataataagtggctaaactttgagtcatccattccatatatccaaaaggccgttttcggctacagtaaggagggaaaagggccatcggccaaatgtacattgttcgccttccgtggcaaacacaagaaaagctacaaaaatctaaggagagggcggagggcctcacacctctgggtgatcttgggcatcgcctcgacccactccggccgccgcgtcctccccttcgccctggtcctccgcctccgccttcgctagtttctccagaaggtgcgccttggcggcaaattggccgtccttctgccagaactatctccgccacgcgcgaagcgcgagcgaaacgtcctctgcactgatctcccagtcccctttcacatagttggggaactcggtgacgtgttgtcacgtcctgataaattcattccgaaataaaaatcattccctaaaaggaataatagaattaattaaaattcgaaaagaaattgtcaaacactaaaatacgtgccagaaaaattcaaatgtggtccgaagaatttttgttaaattctccttggtctaaaaggagccctcaaattttacttgaattttcagagcaccgaaaatatttattaaacaacaacaacaattaacaaagtttactaaaaagaaaaactaaaatcctccttcctcctttgggccaagcccagccaaagtctccctctcctcctcctcccggcccacctcttccctccccctcccgacccagctccctcccctcccctctctctcccgggcctgcctctccctcctctcctcctgggccgcctccgggcccaagccgagcggcgccctcccgcccgtgccgcgcatgtgcttgcgctgacggcgcgcccgcatgggtcccatccccgggtcgtcgtcgtcctcccgcccggcctccttcctttctctctcccgtgcaaaccctagtgccaatcctccccaaaatccacgcgattcaaaccgaggtttccaaaattgattagggggttttaatccccattccttcctcttcaattgcccctaattttccccttgaatagcgccttaaatcgccaggaacggacgcgccaaccccggccaccttccatggccgccggccgagttttccgccgccgttccccgctcctcccgtggccggctccttccctttgcctataaaatggaaccccctcgctccgttccctcgttttagccccttcccgagctcccccgtggccgcaccacctctccccgcctcctccttctctttcctcggcgccggctaccctccagccgcctgtgccgcctctcccgtgcggcggctgacgtcgccaccaccttcctcggcctcgcaggtgtcccctctacgccggcctgccctccgtttcgcacggggaccaacggagacgcttcctcgctggtgtacagtggcgttgccgccactgtaccacctccagccgcctgtgtcgctttgccagagcgtcgtcttccatcgtcgctgcctctcccggcacagcagcgccatcctcttccccggccaggccacggcatcgctcgaatttcgccggaacgtcgtcgcccgcgccggtctcgccctccgcctcgccggagttccttcggcagcccctttcaccgtgcccgtgcgtcagccggcgctgccgtctcctccctcggcacggtgacgtagccctccacctcatncactcctaagatttgccccgaagccgccgcacatcgccgcgaacctctccatccggctcgccggaatttccccggtcggcccttcctccacccgtgcaccgtcggccgcaccaccaccacctccggcatcgcagcggcagggtcgccctcgacctcgcctcccctccatctgaaccccgccggtgttcgttatcgtcgtctccgttcgtcctcgtcgacgactcctccggtcggtcgttcctcctcgccggctcgtcgtctcgctgcgccgcctccgtcgtcggattcgcagcggtgtgttccacgccgtcctagtctctgtgcagctgccgccggctgccctcgttgcctcctcgccggtcccggtcgtcgtcctcatcgtcgtggtgttcgtccctccgtcaagccgttctcgtccgtcgtccgcgtccatcaagcgagccgtggcagccccgttgtcgtcttcgtcctcggctccgcgtcatcaagccttgtgccggccgtgtctcgccttcgtccaaggatcgccgccgaagtcgttccctcgccgttcgtctacgccgcgcccgttcgtcgttgtcgttccctcgcctcgtcgcgtggtggtatggatctctcctctcgctgccccgtcctcatcctttcggtgtcgccccgtacccgttgtgcggttgtcgaccccagtacccgtgtaccggtgtcggtagtcgttcgcttgtacgtgtggtgaccctgttagtgtgcccgctcggtagccgcgtggtttcacgtgtgcagcccgcgtggtgtctagtggagtccgtttgttggccactcgcctcggttgacacacggggtccgcttccgtcgacccgtggaccgtctctgtgtactcggtctaccgcggtcctttaggttgacatgtggggtccgcatgtcaacggcgcagccttcctgtcttttccaggctagtgcttgcacatgttttatagttgcaaaacctaattataataatccgcaaatctccatataacagcattaaacttcggatgaccatgtcttggtcatacgagctccgaatcgatccgttcaagtctcctaatgtttgttataacctaaagaaccctgtgctttctttttatgtattgttattgcttctttataggcttgtagctttgcttgtgtgcttcgcgtagtcttcgtcgttccggaggttcccgaagcgtggtttacggtcgtcgccgaaggttcggaaggccgttatctctgagcaaggcaagtcacatcatccttgaacatattgaatcccaatttataaaattattttgatttaaattaatgcattatcgctttatttaaattcccgcgttatcattgttttatttagccatgcctatttatctttgttatgaccttattattattgctattgttattattaccttgttcaccctaggataaacaaaaccccaactagtgggtactctattcatggttccactagtatgaatttaggtagatgcttcgctgattaattaggcaacattaggtggttttataactttagactttgggaattctcatatcatttggacactatggaatggttggcttatgttggaattggacacacacctccccctctattcaaaacccccaaaatggttttaggctgggctcgaggtgcgtggttgggttttgttagtcgtacctcgggtattataaggattaagctcgggcctctgttgtaaagcactaccgtacttccacatgtctagtgggtaaagcttagtttgtggctcagtctggttataaacaaaagtacacggatggagatagatgaagtcgggggtcgatggacatctctaggacaaataaaggctacacgagctgcggcccggtagtcgagatgtcatggcacagggctggtgtcctgctgctaggggctcaatcctgcctgcctgtcctggaggttccggccgtaggtgggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagcctagcaatgtacccaagttagtgttttaattcttaaaacctgcttaacaactaaaatgtggaatgggtggcctgggttggcttgggacaagctgggacccagggtcgggttgccagctcggtctgaatcatcgtaggccttgggttaaggcaggttcgtgagggttcacggccttgattaataacactgtgtaactctaggatcgtctttataaaatggctttgggcaactaagtgacttttaaatgctgttttctgcaaaacttaacccctatattattaccccttgtacccccttgcattaatcatgcatctgccggtgtggcttgctgagtactgtggttgtactcattcttgctcaatctttcccccccttcagtaagagaagctttggagaagaagtcttaggtggagtcctggcttataccccagttgagcgcctgtgaagatggagccgtaggcccgctagtccgctgctgtttattttttattgtcaggccttaagtgcctttgtaataatgtaaatattatcgatataataaagatgtgtcttttatatcatgtttgtgtggtgtaccccggcttttcctgggacggggattaatacactagcgttcgggaaaatgtatttttctcggtcgcgacacgtgctcgcagccgcactactgcagaaggcccatggtgaaggccactgacactcgcgcacagcaatcgccgtacgcggtggcacaatccgagatcgcaccaccggcttgttgggtccactccgagaagtcgaagacggaggcgtcctcgccaggaactcctcgaacccacgcccccatgtcggagagggcaaggcgaagtgtttggcgcgccgtcttcgcagaagcggtggctttcgccatctcccgcgaaaaccgctgcgactcctccgcagctctcgcctcagctttactgacctccaggcgaagagcctccatcttcagctcggtgagattgtaatagtcagtcagcgccacggaatgggctctttccttttcaagttcgactctgaggcggtcgacctcagttctagactctcttcctttatccacatcggccctaaggcgatcaacctcagctctggcctctcttcccttctccagttctgcctggagtcgcttgttttcggctttcgcctccttgaaggtgttagcgagggcctctatctgcaaacccttgcggcctaacacgtcatccttggcccgaagtcggttcctgaatccatcaagacgggcccacacggttcgcttagtcgaacagtgagccgcaagaatctggatacaaggaaaatcagacgaagggagcaaatgtaaattgagggttctataagaaagaaacaaagaataaacaaaaagagagctaaaaaaaagggggcatacccaaagcgccaagcttttgatagcggaacacccctcgtcgaactcattcagttcggtgaatagactcggggtgctggcaggcgagacaaggttgcttacccactcgacaaagggaatgagctccgcccgggtctcaaaatcgccaggggcaaagtggggcgccacgagagaataatccgaggcagatgtttcgacggccgcccccttccccttcggctagaccagcggcgaaacgaccggctgacacaaggggcttccgaaaaccctagccgcagcttgcacgacgcgatcagcggaggctgaggccacggcagcgccactgccacccgctctgctaacgtcgatcgaaagaacgggggcggtcgaaagatctaagcaatgaccggcgggcgaagtcggggtttcgtcagaagactcgtcgtcgctaaaaacacgaccaacgttgacgagtcctctcttcttggcggcctttttaactggactccccttctccaccttgccagctgaaaacgcgattagcgctctcgccacctccgaatcccttcgatgaaggggggagctattcgactctaccccggtctcattgtgccccggacttggagtgggagtgtagccaggggtttcaacgcggttttcgaccgcgtcgtccgcagcccttccgaccatggcctccgcctcctcttcctcctcgccttcctcctcgtcgtcacgatcttcgacgtcgtcctcgtcgtcggcgtcagaatgagaggaggaaggggcccttcgcttcctaggggccagcttcacttgcccgcgctgtcgtaaacccgatttgcccggccggccgcctgtcgtgtaagcaactggctgtactcgacaaccgacacgtcgccgatcatcctctgggcttcggcgtcggcctgatcggtagccatattaagcgtcgaattaggcaaaatagcgaaagctgtcagaagtgtgtagcgaaaggtgcagtctcaccgttcgtcccctcaggaagaaccagcttcggcaagccatcgacctcttcgctttggtcaaccgcgacctaccacgactgggagaggggaaaaatgcgaagcatgcagaactcctctaccaagtcgcgacagctaaggcgggagtaaactttgcgcagcaagacgaaccgtgcttccatagcaccgtccacggtgatcttgggtttccggttcggcgcaatcgccttgcgccgacaccggagggatttcaccgactcagatccagcctcgaaggggatggtgtgatagaaccacctcaccatccgatggcgatcccacttcgacatggcggcattcaccggccaaagatcggagcgctcggggcaaacattaaagttcacgctaccaaacaccgtcttcttcgttccggccagggtaatcaccgtcttcgaattcacggtggcgaaaaatatggctccaagagctcggcgctgggttcaaacccggatgtccggcatgcccagtcgaagatggcgatccggaccagcgccgacggactcaactgtgggagctccacctagaaaaggcgaaggatctccggcaacaacacgttgcacggaaaccgaagccccgcctcaaagaagacggcgaacaacactgtccgattgtcgacgggcttcggtaccacggccttccccagggcaaaagcctgcccctccaccaatgctccagagctgaccaacttcgccagctcggcatcgtccatgagagagagccccaagaaggcggtggtgtcgtcgtcgattcggccggggtctggccctttcaccgaaacagggtttggcttgcgaggggccatggcgaagggtgtgccggcggtggcgaaggaaagaacggaggaagagagcgtgtgcggtaaaaacagcaagtgtggtggtgaaaaggaaaaagggggggaatatatagcccacgtaggcgacggttcgcctacccaccaataggaaagcaccacgtgtcgcaagggtaggtgaaacggtaaattcctattgaccgagccgcacaataataagcccacgaagggaaagcccattactatttctttcggcccgggaaaaataaaatatatatataattcgaccatccgcaggaggcggaggctgcgaaaacaatatcaaccgaaaagacaacaaattttatttgcaggaataatataggtttcggcaggagcatcggtcgaaagagggcgtcacataccataccacatggtttgcacggtctcggccgaagctcctatctcacccttgcccgtgaggggcttgttggcgatatggcatgaggcccttcgaccaagcctgccgaaactatgcgaccagcgaggattcaagcccaaggcatctagattagtcaaggcgaagccaacatggcgaagactatggaacaacgacggcgagggacagagaatcgcgcggatctcactaagccgaaggcctcttgggcgaatgatgtatggcgaagagtgtacgtcgaagggagacaacttcgccatagcaagttcggcctcacgggggccgatgaggccgaactatcatgccaagcctagtggccgttgggccaacgaccgcctgacggcccattaggagcccataaacttcaattacaatgtatacccatgtaaatgtccctttcataaggacaaccatgtaaaatcccctgtataacctaaaccctagtagtaagaacctgtaatggggctataaatagtcccatagtgtcatgtaatagggggatcagaaaaattctcaatttaatatacttcacttcttttcagccaccattgagtgaccacgtccttcaacgtgtgcggttgtcgtttcgactacaactgtggttcagagtctaacaagggtgggatctgatcacaacccaattctggtggagttggaaaatcaaataaccccttctggtcctaaatctttcaaatttgaaaaagggtggattcagcaagaaggttttaaggcttggataattgacatatggcctgagaggaggaaaaaacatatcctagatcactggaagtgccagagatatatcttgagaaggaaaatgagaggatgggctatgaataagaagaaggagataaacaaggaaaaagaggagctcatcagtcaaatacagaaaatagatgaagaagtggagaagaaagaactgacatgtgaagagtgggggcatagatatgagctggaaggtgctttgaaccagattttcatctctgaagagatttattggcaagggagaagtggggagaaatggatgttagagggagatgccaacgcagccttcttccatggagtagctaatggaaggaaaaggaaaactacaataaggagtttggaaggggaggagggacctattgagaatgctgatgagttgaaagagcacatttatggtttttataagaaactgtttggaatggaattacctcctaaattctgtcttagccataatatgtgggagggaagaggcagactttcttcagaagacaatatagaattaactaaaccattcagtatggaagagattgagggtgctttgagagaaatgaagactaatacggctcctgggccagatgggttctctgttagcttttacaaagaattttggcctcaagtgatgtgaccatggctactatggatacgaccattgctcacatcatgaatcaacaagaagacatcaagatcaagtcctccatgtgctgcaatctgattcggccacgtgctacattgctgacttcaaacggccgccaaatctacatacgtgctccgttttgggcccgtgagtacttaatggaaagctctcgaagtcctccttccaacgaatccagcctcatctcggaattctatcttgtttggccgcaatcacataagcaatgtgctatgtcacctgtattgggccaatgggcttgtaactttgtttgggaccctggcccatgtggggtgcgccccaatctggtggagcacgacccttggaccctcttggtcgtcctcccacctcaataaataggtaggtaccccttcagggtttcttgggttttaattaattgtaagtttagccattgctacttcgcttgcagcgtgcgtgtcggctaaaccgtccgtctgcttgttcggaaccccactttatcgtgtatcaattcatctttgtgcatcttgtctatctagcaattcagttgctttatatcttgttcttgcttgttctcgattgcttgcaggaataaggttgatctgcaccggcaagatcaacaacccacggagaggtgtatcgatcgctaaggcgcaacgcaacgtcttgtacggttgtagtcggatcgtcaacgtttctcccaaatcgtagttatcatcaactcaccgaaagatcgggccaacaacagccttgagtgtctcgagtggagctcagggttcatcaggtggtattagagctttcgttgctcggtgagtttttatctacctattatcagaaaatagccacaaaaaaaaattgcatcctgtacctagccatctttgtgcaattgctttgttctattcagtttttgctttgttgaattttgtgttgcatcgtctcgtcgtgttgctggtcttagcatctagttcgtttagagtttcgagttttggtcacgttttataccacagtcgtcatcgcctccgtgtctctattgtcgtcgggacctacgaaaacggaatcggcttgctgccacggttctatttttgtagttttcagaagtttttatcggtcggttttggtgttgcatcaagggtttgttgtttacccgggcttagtgtttgtggcgtggttctgttttgcccatgaggaagaagaaggggaaaggaatatagaagatctgtttggattcggttgggtggaaggaaaaaaaaggaaagaaaagaataggaaagaaaaagaagattggattaggtggaaatccgtttccttttattttgtgcatcgaatccaaacactagtgctggccgcaatattcagctccacctctccgtgcgaccttcctccctctgagtccgactcctccctctcttctatcggtttaagatccataccgtgtcttcccgcatagcttagtgaaaatttttagagtgtcggattggagatccgtttggaaaaacagaaccagtacaaattcagcattccatttttgtataattctaattttgggtttggacttttgcatttaagtccctgtaattttagtatttacatttgagtccatgtaattttgcattgaagtccttgagtcgtttttgcagaaaaaaataaaaaaaagtgagaaaaggcagaaaggtgcatacaaaagcaaaaaaaaagccgcaccaaaaaaaagaaaaagaaaaagaaaagaaaaaaaagaaagaaacaaagaaagaataaaaaaaaagaaaatcagttgtatttttagaccattttcatgtatcagagttgtgcttgagttgtgctatcttgtcgttcgtttgtgtactaggctcgcgtctctagtacattctagcctaggacaagcacggtacttgactttgaatgatcattcaactttttattctctagattgagcattttctattcctttgctacatatttaagcctacccagagctctacagatttgattacagccgtacagcatgtgtttgccaaggcatcgatacatccaaactccggtggggtgcttggttgagtcggtgtatgtcaccattccacttgctttggtaagaacttgtaagagcttggttaaaagcttgagtgtgtgtgatatttgagctgccactacctagtagttgataagagcgtacatattcttgtgtgtgttcttgtttgctactaaccatggcaggattgtgcaaggggaaacgagatgatcatgctcaacatcgacttcttcaccatcaacgagatatagtgacttcttcacgcatagcatatgaggtacatgataatgatcttgcaaaggtagaatctaatttgccagtttttgatggtaagtatgattccgccgcttatgttaattgggagctagcagtagacaaacaatttgatgagtatgatttctctaatgctcaaatgattaaggctgctagtaataagtgtaccggttctgcatctttttggtggtatactgttggcaataagcttgaaacttgggatgaatgcaaaacaatgatgaggaaaaatattgtgttttcatattataagcgtactctccttgagaaattagaacatataaaacaaggtgataaaaccgtgcgggagtactttcatgactttaaaatttgtatcacttatagtggtttaaaagaaaatgagaacacaatgactagattttttagagggcttaattctgatattcaggctgggcttattaacgtaacatataatcatataagccacttgttcatgcttgcttgcagtgttgagagcaatattttaaagagcccaagggagaaacgagctatgcttgtgcctcctattagtgacattttgcagggagctcagaacattcaccatgaggagaagagcaatatgatcgagatgccatctacatcgctcacgaaggaagaagagaagattgatgcacccacatcattcgaagagagaatcacaagtaatcttaatggtgcagcaataaatcaaggtgggtgtgttgttaatgaattgaatttgtccacttttcatgctatagtagagcaaccattagtggaaccaattgctgagatgcctttgtcacaagttgatttacttgttgttccttgtgataaagaagagttgtgtcataatgtttcacttatatccatgccacaactagtgaatgaacatgttagttctactatttctttgtgtgctgattctaagcatgttgttcacattgctaatgaagtagaggaacgtgaattactatcttctttaaatactttgggctatgttcagtttgatgatttttgtgagctcgataatttgaaggagaaattattagctaaatctgatttgccatgtccaactaatgctatttttcatatctttggcgaatataatgatagaggaatatttttggtgcatagagtttacatttgttcggatttagaacaccttgtagttctggataaaatatgcaagctagagagacatgttaatgctaatcatattatctcgagtttgtcttgttttgattgcaagaaacaggttgttttcagtggaccaagcgaagagcaccatatggaaaaaccgaggacggttttccatgaagaaggggaggatgatgtgaccatggctactatggatacgaccattgctcacatcatgaatcaacaagaagacatcaagatcaagtcctctatgtgctgcaatctgattcggccacgtgctacattgctaacttcaaacggccgccaaatctacatacgtgctccgttttgggcccgtgagtacttgatggaaagctctcgaagtcctccttccaacggatccagcctcatctcggaattctatctcgtttggccgcaatcacagaagcaaggtgctgcgtcacctatattgggccaatgggcttgtaactttgtttgagaccctggcccatgtggggtgcgccccaatctggtggagcacgacccttggaccctcttggtcatcctcccacctctataaatagttaggtaccccttcagggtttcttgggttttgattaattgtaagtttagccattgctacttcgcttgcagcgcgcgtgtcggctagaccgtccgtctgcttgttcggaaccctactttatcgtgtatcaattcatctttgtgcgtcttgtctatctagcaattcagttgctttatatcttgttcttgcttgttctcgattgcttgcaggaataaggttaatctgcaccggcaagatcaacaacccacggagaggtgtatcgatcgctaaggtgcaatgcaacgtcttgtacggttgtagtcggatcatcaacgtttctcccaaatcgtagttatcatcaactcaccgaaagatcgggccaacaacagccttgagtgtctcgagtggagctcagggttcatcatcaagtgagagatcaaattaaagagatgatggatttgttatttgaagggaacttggagttatggaggatcaattacggagtgatcactctgataccaaaggttaaagatgcaaacacaattaaatctttcagaccaatttgtttgttgaatgtttgctttaagttgctgactaaagtgattgctaatagactgtctaaggtggcccaaaagacaattagtgaaagccagacagctttcattcctggaagacaaattttagatggagtggtaattttacatgaggtcctgcacgaggtaaagatcaagaaacagtcgggtatcattgtaaagtttggctttgagaaagcgtacgataaggttcaatggcagttcctatttgatgttctagagagaaagggttttgatgaaaaagtgattgggtggataaaacatgcaacattgaatggtaaagtggcaattaacatcaatggtaatactgaggagtttttcaggacttataaaggggtgagacaaggggaccctctgtcccctctcttgttcaattatgttgctaatgcactatccgaaatgttgaccagagccaaagaggcagatcatattagaggtttagtaccacatttagttgaaggaggattgacatatttgcagtatgcagatgacactactctttttatgtctctgtcagatgaaaatatttgcacggcgaagttcttgctgttttgctttgaagaaatgtcggggttgaagattaattaccaaaagagtgaggtgatcgtactggggggagggcctgaggaaacaaaaaagggtggctgatttgttttactgtaaagtggggtcactcccaatgacatacctaggtattcctattcatgaggggagactgacagtggtggatatggaagtcgtaccaagcaaaattgagaaaaggttgggcacatggaaatgtggacacttatcaaatggacaaaaaaatgttctgatcaactcttgcctcagtagtatccccatgtacatgatgggtttcttcttgctgcctgagtctacacatcataagatgaactctatcagatccaggttcttttgggaaggactggagatgaaaaggaagtaccacatggtcagatgggaggctctctgcagaccaaaggactttgggggcctgggcttctcaaatactagagtgatgaacattgcacttttgagcaaatggattattaagctggagtcgggttgtaatgatgcttgctgcaagttgctaaggaataagtacatgcaggaaggggggttttttcaatcaaatgctaggggagcttcacagttctggaaggggttatacgaaatcaaaaagtggttaagtctaggcagtgcctacgaactgggtaatggtaagtcagtgaggttttgggaagatgtttggttgggagatacacctataaagactcagtaccctaacttatacaacatctgtggagacaaggattggacagtagggcaatgttgttcagatggggagtgggagattcaattaagaagatctttgggccctgatcttttaggggagtggaatgatctccaggacaagtttttgaggagttcatttaacaaacgaaaaggatattatggtctggaatctaacaaaatctaggaagtttacaactaaatctttatacagggaaattttgtttggtggggtaagagatgttttgatgcaagatctctggaaaatccctgcgcctcttaaagtcagaatcttcagttggctagtggttaaaggtagaatccaggtggctgcgcagttgaagaaaatgaattggaaaggggagcatttttgcaaattgtgcgggttgttgaagatgtagatcatttaatgtttacttgtgccccagctaagttcctttggtgttgtgtaagggatgctttactgtggaaggaaattccaacttctagagttgaactattggatattactaagagtgtgagcaacaggagggctatactttgcctctttgcagcttgtttttgggctatttggcttgttcgtaatgattgggttttgaatgataaattgttaaaagacgtgacgcaattacctcataaggtgatgtcgttcttgatgcagtggagaagtttggcgcaacaaaagctgatggggagttggatacggttcaagtattactgcgtgccaacattcactcgttgggggtccaagggatgcggcaagctccaggacaggggtaggcgtggtccaggcttaatctagtttctttttctcttagtgtgatcagatgtaatctctctggcttccctctctcgaactggcttccccagtttattttttttcttttcttgttgtatgaacctcgtatgctttttatgaaaagctgggctgagcgccttcgtctaaaaagaaaaatataagctaggaaatcacataaacagctaagtcacaaactatgggcatgagcagttttcccatcctccttttcatctacatcatatccagggagtttaaaaatatgtccaagcttcaggaagtagagatgtgctaggtgccatggttaaaagcgctatcgatttacaacgttcaagtcaactaagtggtttgttcgtattagctactcccttcgtctcacttactaagacacgattaaacttggaacggtctttaaaactacattttagcttaaaattatatttatatatatatatatataaacgattgtacgatacgccatccacaatgtgatacaaaagtactccataggtattatagggtctgctcactttgatgtcattttcaaccataccattttttttggcaaagttactaaaattttggctatgtttagtttgttgccaaattttagtaagtacatatgaaatcttgccaaaattttgacaatcttactaaaatttggcaatgccaaaacttggtaagattaaaaatggtagcaaagtgaacaagcctataatattctattcagctacctattaccattgtgcaactagtccatatagacaaaataaccaaaagtatccataagcatattgttaatgaccaaatttggtaatatcagcatcggagacgaaggatagatcgaagcggaatcgaagatgaggattatcgcggaagcagagcaagaatcagttggagtccggatcggctacgactaggatcggctaagtttgagtcagactgggttaggtaatacagccgattccgacaatatgactcgtatccaacatcgggtttgagttggtgtgcttcaagatgattgccatatatggatagagtcctgagaaggcaattgtatctattaattaggatattttatgtaaattccttagagataaatatgggcaaaagtccgccgcaaagacttatggtatcttagagtttgttagagataatagtcgtgtccggtatggatatatcttgtaattctcgggtataaatagatctcgaaccctatgtaattattaacacacgttcaatacaatctcggcgcatcgccacccttttactttcattttgtttagacgagctcttgctttcgggttgagctgcatcggtttcgatcttcaacaagaggtaaaacttgttatgacgacttgtgttctcgagattagtgcttccatctttatgatactctaatcttgtttatgtaattcgtcgagttatcatatatttcacataatccttgataatatcatcatctaacctatattcggctagcatctgtcaatagaaggtagccgattaggttaaataacgatgttgacttgaattatgtgatatatctaccactccatgaaacatccaacggcttgattgtctagatattgttcttcttttcatacttaatgctgcatcagttgagtttaacctattaagtcgtgcttagaaccataatatctagcatgccttctggttgccgattagagtagtatcggagtttcagccgatcttacctgatttaactactgtcatcctatgtgcttgatcgatatgttaaatctgccatttatgttaagatattgttgtatttaagtatattaagcttctgtttggtatattctgcttattttaatatcttaatatagagtggtatcggagtactagccgatacatgctagatctatctgatcggctatgctatgaatatatataatctcactattaacatatatttcgatctaagtgatttatactgtctcggcaagatgaccgatctatcccaatcacttgatttaagtatatatcgatataaggattatatatcattaatatctacagctgatcgggtagatttagttttgatttgcttattaacacttgccgatcaatgtacatatgacatcggcctatagataaatgatatgtcatcggcacctagccgatcggctatcatttatggatttaatcacggtttctttgtctttatttcttgttgattgtaggatcaaatcaactgtcacgctcatacatccgaaggcgagttttgaacctgcactggagttaagcagatctcccaagcctcgtgttttctgtcaacacatatgtactacccatatgaaataaataatactatttatcgctatttctctctcatctccaaatgctaccttgtatctatatacattgtggagattgctatagttaaagtctctttatatggattccatttatatagatcactttagctatatacattggtgatgttctaacaaatttttttcttccctggtatggcattgtttcagttgatttgatttcctgtgtcaccggagggtacacgccaaaatatcaaatcgtgtcctatataagagggtagaaatgtcaagccaatcagaatgggtacgtaccctcatcgctcggtctcccatataaccaaatgatgtacaatgcaaccactgcttcgttgaaaacaatcaccaaagttggtataggtgtcacccaactatctagggtacatgtgtgctcgcgtgcagattttccatctcatatatatatatatatatatatatatatatatatatatatatatatacacacacacacactataacgtttgtagcaacataccataatcttatatgaaagtaaaattaaatgataatcaaattacattattatcatcaaataatatttaatttataataatatatttattggtcaaatatttaaacagttaaatcttaaaatgtgtgtgctcgttagtgagtgggacggagagagtattctttagggggttttgtgttatcagctcatgtggtttcttcatatattttactaggacaacctactagttgataacttgatatatagagtaaaacttggttaaaattgatcctacagataaatttttagagagtggcaaattgggcactatgttaagaatattattctcggcttctaggaaatgattcacaatactgaaatagtttggtgctttgagtatttaaatcctttaagtttgtccccgaaatcaccaccgcaaacccagaagaaacaccataggaaatccaaaactgatggcgacaccgagatacgatatttggtaacagagttcaaccgaatcctacatcacctggcactgattatggatgttgttaacgcttttttaggtcaacacaatatcacctaacgatttgcgatgcaatcaatagagtcgccaaaatcgatagatcaaaatcggctagcagagccgatttcaaggttaattcactttcgcggaatcaagcgactaatttacaagcaaattggcaaagaagataaatatcgtacttacatgacgacgaacgactagtttccgagcaaactaacaaaggataacattctcgctttcgtggagaagcacgaccgtttttcagcgtaaaacggtaaagattaaccaaatgacttggccatgaaaacaaaatagaaaagaacagaaagtaaagaataggaaacgttagattgataaatggtagattgaaattgttcgggcctctcgccaacgtcggagctgtaaatttatactggcaccacacccggcaccataggtctcccttcatgttcggtggatccatccttccttcctatccgagtcgataccgtaggcatgtaatcaggctgatgatgatcttctataatgtaacatcctaaaaatccctaataacaaaaatcactaaaatttcaaactttttaaaacttttgcaccatgctggtgttattcgtttctctgttgcaaaacgggttgttttaattgatgaatatggaaagacaaatgataaaaactagaatatgggaaaactaaggttagaatctataatgttgggaataaaagaaatctaggttagttgtgataatattaattcttaatttttgggattcaataaatcatgaaattggaagtgttaaaatatagataaatatctgaaagaaataagaagattaaaccatctaaaaattattcacacaaaaagtctagaaaaagccctaattgtgatttttctcgggtcgctactgttcattgcgcgccagttgttcgatccgcgcctaacccgaccgaacacccgacgcagccctctccaatcactgccatgccgcgcgtgtgccttccgacccgtgcgccgcactagtcatgcccgtgcgccgcaccgcgtcgcgccacgccgcgtgggcccgccgccgaccgagccgccaaaaacccgcgccaaagctgcgctgccacgagtgcccgcgtcatcccgtcccctcgcacatcgccttcgggattgagtgataacggccgccacaacgaccccgcgtcaccctagggcatagccctgcgtcttccctatcgaggccgatatcactgtccgtcgccgtcgctcttgtcgccgtcgcgtcgccatcctgtcgcccacaactgagaccgctggatattagggtgctccttccctagctaatgatccctctcctggaaccctatcatctaggcaatcatgccggcacagtgcattgaactaaacctaggagagatcgaaacgtggctgagtcatcgattgaccttatccagtaggaatcgccctcccctcgcttgtataaactcgtccctagctcgttcttatcctaacccaaccttccattagctctttcccttcctaaaactcttgctcctccgaaaaggagcaaaaccgcgccgcccgccgggtgtcgaacacctggtgagcgggggttgcgccgccgccgcagggcctctcggccgatgtgggtggcggggtgtggagaggaggtgctcgcactgctgttaccgccattggagggagccgggagccgttggacgaagagggccgggcgtcgaacaccttcaagcctcgccgaccgccgtctgcccctatttcggccgcaccgcgccgcacgccgtcgaactccgccgttccaccactccgtggtaagccctcgcgcccgtagtattgcctggacacctagaagctatcggccccctcgatttggggtgtgagccgccgtagccgtgccgcctccgaccgccaccgcgccatggccgagctcaccgtggagggacctcgttccaatgcaacctaggctaggtttttgcttctatatgctccatgtggacccgagatggttaaatcgtcgtcggttgcgctcgtattggtccccattgtgccgccgccgattttgagatctcggcgccgccacacgccgtcgcgtcgcgccgagcattcgccgcgtttcgccgtcgccgccggcgagcattcggtggtgccccgccgctcgccccaccatgcgccgagccgtcccggctcgggccgtcgcaccgccgcgcgccactcctctgtccagccgcgtgcgcgaggaagaagacgacgggagagagaaagaacgagagagggagagattatgacatgtggaccccacttcattagtgcacagtaatccccaaactaatggtattattatgagtctatgacatgtgggcccggatgcttagaaatttaattaaatgaggttttaagtaaatgtatcaatgacatgtgggtcccaccggtgattaaagggctggcttgacctcagtcaacaaagggttcggccccacctgtcagtgacacatcgcatttcctttaggaaaataaaaccgagaaatggaaataggagaacggcccacatgtcagcctctgtggtttatggatttgtgttaggaataaaaataaatgaattaggaacagtaacttttcacaatttctcgaattaattcaaatttgaatctttaaaccctcataactcactcattttaactcggatttgaatgaaacttgaacctaaattcatctaaaatcaagatctatctaatggtaccattttctcaatttaatttgtactgtttgaatttttggtgatttaatttgaattctaattgaattcaaatcaaatccttcgcacgtaaatatagattccgagggagtagctgagttgactgaggagcagggacagcaagactgtgatccaggtaagtcatcactaatctttgagcatgttgaacccattgtgaacttattttggatttaaaataaagttgcatgttatatggatatatgtgaatgccctactttgttatatgccatgcctttgatattgatgatccatgcaatccttgtaatccatgatatcgtatgtctttactcaatatttggtaaatgcttagccatgctactttatgcatattcatatttatcaaaatgctttatgcttgggcaactacctttgggaaggtggttgagatgcggcatgtggagacatgagcgccatattgccatgacatttgtgacaggatttgtgaaaggaaaaataaaactaaacaactgttttcgactggggcggctgggtgacttgggtggagtccgataaaggctagtgccgtccctagtcaattaaggaccgagccatgaagttaagcatgaaacgaccccaatagaaccgtacttctcgtatgggtatagacctagcggagtaaatagccgagcggaggcagtatccctgcatagtggttttcttgatgtgtgtgaggcagggcctacggtggggcagccattggtaggaccgcgagggacgggtgcctacagtggtgtcgccatcggtaggactgccatgtgtaaacctaaacttaactataacttaatgcatgtgtgagtctttccttcccgggagcgccagaactcctctcactgctagaaaccgtgtacgcctagagtgcatgaggactcaagttcatggagcgggtactgccaaagtgaggtggttgaaaggctttgccgtggcaattctcattcgttgggacgtagggtcatgtgttgggcaagtcacggagtacgggtaaagtgtacatccactgcagtgtgagtaaatcaatctattcgaatagccgtgctcgcggttattgagcaccgggacatgtattacacttggctagactcaaatttcctaaatatgaaagggatgggatctgcatgatgattttgagctggtggatcaacttctcgagaggcgagaaggggtaaaccccagaaaacaatgacgaccagtaacgggaagccatctttgggaagacaatggatggtgaacagaaccgttgctgtgtaataaccactggaattaaaacttgactagtttatgctaaatcttaggcttgtgaaaaaaattgtgaaactagctttacgcaaataaaccaaaggccacaccttgaatacctctatcatacgcattgttgttgtggtagcttgctgagtacggttggtactcactcttgctattacaaatttaatcagtggatggcaatgaagtcgaggaggatccctatgcttatcttcaggaggatgcggaggatgacggcgccccgtagatgttagttacggtcgttgcctgtggcaatggcaaggccgctgcttaaattccgctgccttatctatttctgcttttgcatgtattccagaccgttcgggcctatgttctggtctatgcatgcgggcctatgatgtaataattcgcgctagacaatctttgtatgtgcacttgatatttcagcaatgtaatcgtgagtaccagactatttgatccagggaaatggtactattaacacgagtgattcctgttataaaaacgggggtttacatataatcttcaccacgtaccagtccacctgattcaccgttgtggctatccaaaactcctaatcatccggctgcacctgcatgatctgtatacatatatgcatatctccaaaataggtaaaattctacagccacccaacaaactgcacacacatttgaccaactctcaagcaagccattcaatgaatcgtgaagctaaactaaacaatctggcatgcctaaatgaattaactactagccaaattatggcataaacacatgccccctgttttcggtataactaatgcgtataacttttattttaccgaaaacactataaaattaaccaacccaaaccacaattattctctcagaacgatacaccacacacggtatcggttctgagcccatccacatccacagttgtcctctcaaaacgatactcagataagtaatcgttttaagaccacccacagtcgtcctctcaaaacgatactcaaataaataatcgtcctgagataatcaagctccccttcctaacttggcgaccaacaactaaacttgttaccccaagcatcaatggacaaaatcatttgccatactaaattatctatttgaaacgatttttcccttattatcttcatataagcctcaacccaatcatgacctacacactttgaaagcaacacatctatagttcggtgatataactgattatctacacactttaaaatccatcgctgaacttcctatctcaccagtctttcaaataatcaaccaaagaatttttcagatcatttggtataaatttaactggtaattcggttgtccctaatgtccacctaaccgaattagctcatctctgggcagttcttcgacataaaacattttaaaacaaacccatcttaactttgatatattttaaaaacaactcatcctatagctcggcaatataattcatcatccaacaaaatatatctcaaaacctatcgccgaacttttctatatatgatttaacctaggcttttcaaataattaaccaaatattcactccaatcacctagtcactactgattcgtgtaacgacccgcctctcccaggccgggcccgcttacatctggcagctttcataggtcatagagtgccctcacagaccaacacaagtcttttctgcacactttgtcctcactcgtgtgcaccgggaagaattttccggtcggtcacccattccaaattgctccaggccaagcacgcttaaccctggagttctttggagatcggcttccggaaaagaagctacaacttgttaatatgagtattctattaatcctattaagccctaggccgggatgtcacatcctcaccccctcaagagagatcgacgtccccgtcgatcaaccccaggccaggaacgtcccctcttgggcacgtttgtgtgcccagtgccagcacatgtgccatgctgtgtgaccactccggatccacaccagccatgcgcaccatgcttgctcaactgcgacacacgcgcccgtgaaaccgcgagagtcggctctgataccattttgtaacgacccgcctctcccaggccgggcctaattacatctggcagctttcataggtcatagactgccctcacataccaacacaagtcttttct

SEQ ID NO: 12313 - DNA, 19422 bp, Oryza sativa
  unsure (1)..(19422): unsure at all n locations
ttgctatctacccattcggctacacaattgcttttatttcccctgttcaatgatttagagttatccactatagaagcatcaaccttattaatattttccaattttagttttgtgcctctagctctagattgatcacaagcaaaccatgtagacataaactttggcaatgatgatatagaaaatttaaatactttattattgtcaacaagaacattaatctccccaatcgatcctttagaattattcatgatgaccgtactgatgtataaattatttttagatgaatgatcaaactgggaaataagtacattacctgtgaatgctaccttatctgacgtgttggagaagcatggagatttatttacttgaatgatatcttggttcgtccccttatgaccctccaacatctcctccgtgttctcaaggtttcgtgccctatcgtcttgctgctcatcaacttccttggcacaaaattcatctggcaaaataaaaactcctatgtctccagagaaatcaagcatagctacctcgtcttcattagccgataattctggatttatcggcttttgttcttgtgaaaaaattggttttgaccctttacttaaaatataagaattgattttttcctccacatctgtcacagcttgatttttcgtttcaggatttataaattatttaataaattatattaaatgttcattaatttacaagtgaagttaaatgtgggaaataaaatatcctaaatataaagcatggttggatttaatttttattaaattctccatgattaattatactctctgaaattttctcggatttttcagagctcaattcttaattttaataatacaaagaatatttcagtaattattcacatattaaattaatcattaaatgagctggtttcaattttgttaaatacttagagtgtccaagtatgttaaatatttttcttggaattatttgagcattagaagtatttttaacaattgaaagatcattttggtgattaatttaattagaaagtaattaaaatcaacttttccttttcgggccgaattaggaaaagtcctcactctcggcccaatctcctctcggcctgcagccctctccctctctttcccgaagtccagtttctatccctccttcaatcgggctgtgtaatagaagcccagccaaaagtctgttttgcctccctatcgctacagtaccttcttctactcctggacagagccgagccagccgtgccatgtcctactgccgccgatccccttccaaaatccggcctcctcgttgctcctttttccaaattagttacgggaatagaatcatctcaatctcctctacaatttccctaggaaatccccaaaagtttctatggaaatcttttccaatttcgcggttcaatcttttctttctccggcgaagatccaaaactttcccgagtttttcccgtcgatgtgggcttgatcccgagctcccatgcctatataaaggaccccctagtcgtcctctacctatctcctcaagtcccgtcttccgtcatcgccggaatcgctctccccgcgagctccttctctctccacctctggccgccactccagccgccgtgcgccgtcgcttcggtagtcgccgtcggtcgccgtccccttcatcagcatcacgaggtcgtcgccgtccccgtccaccgcttcgccgccgccgtagcacgccggagcgccgccgacaccgtcgacctgaagctctccaccgtcgccgtcggtccagccgcgccgtgtcgtcgttgcagccgccgctttcggtcgtcgttgccaccgtcgggttcgcaagaaggagctgcaccccatctgccccttcgtcgccaccaaaatccaccggtgctccatcgtcgccgtcaacccgaagctcgccgtcgcgttttgatctccggtgaagccctgctgctcctcccatcatcgccaagcttcgccgctgcctccattggattcgcagctgcgaagtgaagcccggccacccctccgttgtcgccgcacatcgccggaaagtcgtcgccgccgtggacagtacctcgccgcccttcgaagctcgtcgccggccatcttccgtcgccgttcatcgctgcgtaagtgctggtgagcatcgtcgttgcctcctcttcctcccggtgccctccgtttgcattattgtgccgtggttcgccggcaaccaccgctcctatgctgttcacctgtcaggttttccttaatccaatctaatctaatccgtggttcgtctagcgttgtcgtctccgtgtgttgctgaacattgtcatcatccctccctctccgaacgtttttgatcggtgagacatctgtctgtgtctccaagttgccctagtgccaccgtgtcgcagctgtgtgccgctttaacctacccgccgctttagccgttgctcggtagccaagttgtctagccgtaggtgcatcccttaattcctaccggcctatcgtttgccgtaccggaactttcctgtgaatcatttctaccccaccggtttagccgcagccgttgttgagtcgttcactcattcgttcgaacgaggtgttccccgtgcttcgttcgttcatctgtgtggagtcgtcctttagtttagagctgttcagagccgccggttccgttcaccggtttcggttgatcatttgggtgatcccgtgtcacgtagaattgactcgttgcgtcgatatctcgtgaggcccgcttgctagatcaatccaagccatccaatcttggtcgactcggtcaagattaatctcagccgtccaaaattgatataaatccgttctctcttttcagtgacattatttctttttaatatatgtcatctaccaaatatgatctaatcttttccggaggttgttttaatcttttgtctcagttataaatcatttgtaaatgatttaattaatttggaataatcttttctttaataggctttaattctaattaatcttgtaaaattcataattaattcatatgaaatcgaatgaggccgttcaagtctcataattcatctaaaattatgatctacatgtttgtttaatttatatgtattgtttatttggtttttattagtctttttcctcgttttgcgttttagcttgtcgtttccatcgtttcgaaggtttgcgagtgcgccgtaagtattcaagaagattaattggagcccattattgcaaggcaagtcacacagatcccaaacacaattcctttgagcatgttgatcctatatttaaattctctatttatttcaactgtgcatttattttggaatgtcaccgggtggtgtgaacctattcttttgttatgaccactttgcattgcttactctattctttgatacattgggtgataatttgactagttggacttatatattggttcagctagatattagatatattgcttagccatgcttagaaacattagcacacgattgggataactaatgtttcactactacttaatgatggacatgataatggtagctcatgatggctaatcgtgattggttaattaattaatgtgcctactaaaacttgataatggtgggttgtgagcacatggttttgatggtcgtgctcatgacaattaaggaccggttcacgagtttcggttgtgaaacattaatcgtgccaaccacaagccatcatgggcaacagctttaccttttgtatagcatggttcattgcgggacaccagactgagaagtggcggagataagcccacgggggtcgctggggagtccatgccttatttgtaagggggtgattatgatccaggaatggtgcactgctttgagttgtgttgtgcgaggggtactgtcacagctcctttccgaggtaccgtgatggtattgaggcgcatggtgacatgttctagggctgtgtcttgtgggtacagtggtacatctctggccagagtaaaactattcgaatagccgtgcccgcggttatgggtgggtcgaacaatgtctttcatgattagtcccacactactcattaacaataatgtggtaattgatggtaattaatttacaattctcgaatgtttgctaaatgctacttttgcaaatgagctctatattatgccattctttggtatccttgtgcacttgcatatttgctgtgtggcttgcggagtattccatgtactcaccttgcaataatcaatcaaaccttagtggaagaaaaatgatccagaaggagaagacgtttggcttatacccctgttgagctgcctgtgggagtggagccggagcttcgctagaccgttattccactgctgtttttcttttcttttgtaagtatgtaacgttattattatgatggatttgtatattaaattgtcagtttgtgtacctcggctgattcctggacgaggattttatgcacaaattatttcggaaattaccttgtcttcattagccgataattctggatttatcggcttttgttcttgtgaaaaaattggttttgaccctttacttaaaatataagaattgaatttttcctccacatctctacagattttttctgtaagactatctatctttacattgaattcctctacaaattgccccccaatgctcttagtatctgaattctgctcggccatgatcccagtatatgcacaatcaatttgctgtggactaaaagcattgaagtgtgatgtatcataagaatatgatatagagggctcttcatacgacatatgcaatggggggacatcaacacgttctttcggcaatgaactatgagaattgccgaaagtctggagagattcacgtgatgcactatatgccacaaaatcagacagaggcgtatgtatactcgttgaattttcattaattcggccataatcataaatagcacatgaggccgaattataagcgttggacattatacaagatgaaccatgagcacgagaagaaatctccgattgagaaatatttggtatggcatgtaatggattaatagaatcaactggataactaatattaccatgtccatacatttctttcatcggcaaaatttgttgtgtagtaataggttgcaaaataatcaccggtgaatcaaaaggtgcacgtacattgctagcattattaaaatttatagtatatgaattactttgcatagactgtgacatgctgtgttcataatttaaagagctcaaataattattttaactatcattagccgatgcagtatatattcattaaaagtagatctagcaacatttatatgagaatttataggacttgcaaaattatttgaaggaatagacaaagtatttacctcgcagttgacgtagtgaggtagcggtgtagcactccagtacccatccatgtattttcagcaagccttggccttttcctggtgcaattgatacgtacacctagcaaaatccaaaagagattaatttgcacttacagatcaagtgttactcctatatgcctgggtttggttgctgtgtagccgtgaaagctctcctgaatttcctgatcaagcactgtttaatatttgttagccctgcatgctacctccccaccgaattaaacaattcggcagaacagaccgccggcgacggccaaaatcgatctacagagaagattaaaaaaattaaatagagaaactatgccgcggtagatcggctgatttcggccaaaaagtttacggccaaaacttgtccccagcggagtcgccaaaatatattgacgcttttttagtcaacacaagatcacctaatgatttgaggtgcaatcaatagagtcgccaaaatcgatagatcaaaaccggctagcagagccgatttcaagattaattcactttcacggaatcaagtgactaatttataagcaaattagcaaggaagataaatatcgtacttacgtgacgacgaacgactagtttccgagcaaactagtaaaggataaccttctcgctttcgtggagaagcacgaccgtttttcagcgcaaaacggtaaagattaacaaaatagaaaagatcagaaagtaaagaataggaaacggtagattgataaatagtagattgaaattgttcggacctctcgccaacgtcggagctgtaaatttatactggcaccacacccggcaccataggtctcccttcatgttcggtggatccatccttccttcctatccgagtcgataccgtaggcatgtaatcaggctaatgatgatcttctataatcttcaccacgtaccagtccacccgattcacctctgtggctatccaaaactcctaatcatccggctgcacctgcatggtctgtatacatatatgcatatctccaaaataggtaaaattctacagccacccaacaaactgcacacacatttgaccaactctcaagcaagccattcaatgaatcgtgaagctaaactacacaatctggcatgcctaaatgaactaattactagccaaattatggcataaacagatgttcgtccccgatccagcatattacagcctatcagagttacaacgacctttgtccagacaccgcgggtagtgtggagattatgggtaccccatacccacacggcgtggttatccgactagttataggagataacttatatctatggaatatgtaacagatcatgacttgggtattacgtttcctttatattacgaaacggcctaaagtcctagtttgataatattgtaaagtagatttaggaaaccgataccgtattggttaaggtttctatcttataatcctgccccccatcctatataaggtgggcaggaggccctctagggggcatgagacaacctgatcgtcagatctatactatacccggcggattcaaatccccaaacaggagtagggtattacctctcattgagagggcctgaacctgtctaaatcatttgtctctgcatctatctacttttaggtctcatgtgctacccccttttattattgccgaatttatgtttcgacaggtagccgctccttctcgcctatgctaggtcgctatgcgggtacaataggtgtgcatctctatttaggaaagagcctaggataaagtccaactcttgctccattgctctatagctagttgaacacaagtcctaaattgtaatcgataacatacacatatttaacaaaaactgtaacaaaccccaccttaacgaatatgacacaccaacctaaatttatcccgtacactcgatcttcggtgtacaatcggacttgagttggtccttttgctgctcacgttaagccgtcccaacaagcgttcaataggctcatcgtaacaagagactccgcctatcaatatatgcaaccttttcctcttgactccacctttaatagtatctcaacttcccacctatcaccacagtcatcttgtcaatagaaatttaattaatcctttcaaggtgtcacattataaacttcctgaagactattttcaccttcatctttcggactattttcacctccatctttcgtcttaaatttttcttaatctaatccatagctagataacatatgtcatcaataaatagataaatcaaactcatcagacattaattaagagaaacctttcttccttctgtcctatgaactgagctaataaatccaatattcccgcttctcgcatctgtagagtaaacccatgatactgcaagaaaattcactgttgccttgaataactcgaagaaattatcaccataatgtttgctctttctttttagtaacgtagattttatatatctctcttatgcaaatcccacagattctgaatattttcgatattatcaaacaaacccgttgaatccatcaacgtatttaacccgctgttgtcctcaccgcacacaatttaactgactttggcaccagctaaattgaacaagacctgctcatgtgaatagacggtcatcgtcagtaaccagccaaccacataaacagtacgaggccccctaaacagtaaccagttatcaacagtagttggcccacaataaaccagcccaaaagaaatcggaaatgctttccatcgagcgtccaatcagacgctactttggacgcctcctctttcttcccgatttgatttacctttcccatagtgcaatggactttaaaaatgttgcacatatatagtattagttagatatttcaatgagtaattatttttatgtttcattagttcctttgtaagagttgcgtgccatactttttaatgatccagtaaagatttcgctttcaatagttatagatagatgattcatgtataaattgaaaatgtttcagttagaaatatatttttttcattctaaatatagccacgtgtgatcttattttgaagatttatttgcaacaaatataattaataatacaatcaaatcgtggatctgatcaatagtttttctgttaaatgcattgagcaggtaagtagtagcatatctctaatttttgtcaaattgtaatagcataaccctacacagacgaatagtaatggtattttttaattcgaagaagttgtaatagcatgatccaattaaccgtagtttgtacaaatgtggcttatatattacaaaatgtagaatatgtgcacttgacggtcaagacatttaaaattatttttcaacatccaaaaattaagaaacatatagcacagacctatctatctgtaacggctcagcaggcattacaaacaattggttacacatgtgtccaatcatctgtaacggccggagacccttaaggataaaactcatctataacagcttaaaattagcagccgttacacatagaggggacagttctagggtcttcctcttggttaaagataaaactcactagcaatagaagcacactacgctgcgccgcctgaatcaatcgcctgaatcaattgaagtccaatatgttcgaggaataatatgcatatactattcacccatagcattggtttatttttcgtctatatcccataaactacccttataaaaaaattgcacatacaaaaatatagtgtataggctaaaggagaaaaccaaaaggtattggaagtttgaataaatagaaaaaaggggcaaattacatgtcaattacaatgagtttacataggtttcaatgctaccccttttctctctatacgctagaatcacattggactattggatgctaaaaacagaagacctaaatgcctactgttggtccatattaaacatatgcaaagctaaaatgaacagatagaaaatgatgttttttaagtgcaacatgcaagtgccctagtcaacaacaatcctccgttatgtgcggttagtgacatcggtacacctaaaaaaaagtatactacctccgtcccaaaatatatcgcaattttgagctgtgtacctaaacatacctttcaagatatagggccagaagtttttatattttgggacaaaggtagtagaaagttttaatagtaatgttagtacagctaaaacagtatagtatcaaccacttatatagagagataatattttcgcttggcatcacaattctaaacacatgcaaccaatttttctaccaaaagttctatcttttttggagtggagtagtacaaagtgctgctaccatgtggccacgtggcaaagtttatgagcgaaagcatgcataatcacttaaccaaagtatggatgcaataacataagccttatagttctacaatgcatatatacttcttcaggttaggttccatttttttcttccctgttccttttaagtagccggcaaaatatacaacgcggaaacaaagagcttgtaaaagcacagtggcagcaggctacactacagtttgacgaaacagatcgactgcacaacttttaggatttaaaagtgtgctttcacaaataatgaaaaaaacatgtgtaaaatagactggtgaactaaacagtgaaataatctatctgagcacagacatgtaaaagcaaaccaactgaaagacaaaatataaaaaaaaatggactatgatattgctttacctttgcatcgtaacggttaggatatgtctagcaaagcattccgattgaacagttgatgcacaaactaaattgaaatgtaccttcaaaagaaatttacgttcgtctcagatatgaacaggaaatcagctttccgtgatggatccaatccatccatgtctttttcgacctaataaaaaaagaatatagagatatgtgatgaagcatgaataaatgaaggtcattctcgagactgctaatgttttcatgactcaaaaatggagccatccttcttttaaagaaaatgattgaagacatatcctaacagtgtatatagtcataatcaactgataacattcttttggcgcccttcatgttttgtagagatggcatgaaagatacacatcaatgctagtttaaaattccatctcaagtgaatctcagtggaaacaatataccttgatgaggtaactaaagtagaaactaaatattttaaatgggtgtaactcaatcatcaatgacataatggagctactgaaatggtgagaatcatttcctccattagctacttaaaagaggctaacagagcatgaatactcaattcacatcatatcacactggaagaggcactggcaacacatggatgaacaaattcttcgtactcagcaacaccaacagaaaaaatctcttcatgcaagcaggagaaagctttaaaaacgaattggtgagatcaaatagtagagacacaaaggctatcaaagtacaatgtatatatggaagaaatttcatcagagcatatgagagcagtataataacgccggttgttatgttaccaatgtaactcagaagttgtactggatggtctttacaaaaattaagctcaattatgtagttatgttgttatacaacaatttgtgtattattcagcaaatgaaatgcaagatacatgacgacgatatacataattaaccttaatcatagaatcattatcataagattaaagatcaagcaaaatagcaatatagtctatatggctctggggaacttgaacggagctggcagtatttttcccttacatatgcaagcagtgtaagtaacattttacacttgatggtgtaaatatccatgtctaaatatttttttgtataaaaagaattagtaagaatagctaatcaggttgtactggtcgaaaaagaattaaaacaatagcaggagcatctgtaatatagaaacctataaagggtgaaggagatgtaacaatgtacaataccttcaatagctttgataataataacagctttgataataataactccatgcaactcccactaaaagtatgatctaacattgttaatgttatgataggatactctgcatagagatgaagagatcaattaaagaacacatctcaacaacatatggatttagaatataacatgtgaatataaataactctgatatggtgacatacatctagttcttatgtagcaaaaaatagggaagcaacctagataagttaaaaatgcgaggcgactgatagagaggattttaacattgaactcataaatcccttccctaagaaatgtgctatcacttgccatatactttttgcttgtctgatgcactctacagatatttttatgatcatatatagacataaaaggctaatgaattagcttcagtcacttactgattgtactttgagataccggtcgatcaatgcagtaaacatttacccaatcaagttaattaacatgtaaagcaaggcagaatgggtatctacatccaagtggtgtatgtgtatttgcaggaaaaggtattaattagcaaacagacatacatatgtgatcctttcgtttatgcttccaaaaataaatgcaggctgcacataaaaaaaaaagttttgaatcaacggaatatggccttctaacagcgaaatctgtggttccaaaaatagatgcaggcctgcacataaaaatgagttttgaatcaacgaaatatggccttctaacagtgaaatttgagaagcataatgcaggtaaagcatttgtaacctcatatcttcagacttgattgaccatgcaccacagaaaaatcaagtagagatttccaccagtcatataagcctgatatgaagaaagcatgagatgcaggactgtaaagagaactgagaaatcaatttgaggagtagtatcagcaggaggagatttggctgctgccacccatgtcgagtttcacctgttggttgccgcgtgcttgtaggcgctcgatgcggaacagatcttgcagaaccaagttctcgtgggatggagaaagagacgaaatggcggcgacagtggacatcgaactcgcaagaagggggcagcagccgccgctagctcgctgggaagacgacgacagtaaccactggctccgcaccgcggcagcaacggctggctcagcgagcttgagaggaaggcagcggctccggcttcgcgagctcgaggggaaggcggcggctggccataggctccatgagaccatgagcagacggcggaggatttctgggaggggaaaacgtgagacaaaggaaaaaggaaagcacgaatgaccagacaaccatcgtcgccgagccgcggttgtcttcgtcatggtcgtgctcgagcctacacagggtggtggcggcggcctgctgaccccgtccgggcggcaacggcggctctcattcctctttaggacgccggatccgccggtaccggcggttctcgttcctttctctggagcgccggatccgccggcgaggagaacggggtcaccggatccagcggccccggcctcctcactgggagatccggcggctcattggtagggagcggcaatggtggcacggcgagtaggttgagggagtggaggaggagtgaggcggcaatggcggcaccgcgagtaggttgagggagtggaggaggagggagttgcggcggcgacgacgcacgcgagggaaggaggacggagaggctgcggcacgattgaaggtggtgggcaaggcggcgcgcgtgggaagaagaggacgggcggctagggtttgtacgggctggcgaatccagaccatccgtttccaatccaacgatctgacgatggtggaagggtagtcaggctgggacacgtggacggccagatcgaccttagcatgtgatccgacgggccacattaacggggatgtacatgctattagcgaaaagaacaagggattttctgaaaaaaaaacgatgacgtggcgccctaatcctcagccattcccacgattttaagtaaacaaatatatgtcacggttgctactctgtggcacattttcttttttaaaaaaagatccaattaaccagataattcaaagcatcattagaaacatttagaacacataactcatcaaaaaacttgttgaacctgaacaagaattcatcacagagaatcaacactacaatatgaacatgagaatcaccttgccccccagaatcctcacagagaattgacattcagcccgactaccatctcctctctgcgacgctgccacaccaccgtgagccgtgtcatcccttcatcatccaaaccaccactaggcgccacgagcttgaggaaggtggctcaccttagttggatcctagtgaccgtgtagtcaacgtcatcgcagccctcacgctagccatcaccatgccgacgcccacgcccttcgtcagccgaggctcgccactgccgcccattgtcgcatgatatggcggttccaaggccagctcaccgccgtcgccgagtttagccgttgatatatatgccatcccggctatggggagagggagctcccaaggcagtggcgtcggtggatccgctcacctctgctgcacccacggccactgttgtcgctctgggccccaccgccacctgcgccaatcgccgtaaacaggaaaagagggagggaggagggggcaaccaacgtgaggaccgttaacagagataaggagagagttgcaagctggtgacggatatggggaaggaggggaggggaaatgagaattcagggggagtgggcgggtagaagaagtttgagtaagttggagttgattataactagaaatcatatgcaacgacttccaatgttgagcaattatataggagggatacagatgtaacggctcctaaaatagagtcattacagataaggtgcacacatctgtaacggcacacatgagatggctgacatctgtaacagcttatcaagatgagtgctaatccctaatggcccgaatgtcgcccgttacaaatatgtggtatgtaatggcacacttagacccattacagatgactcgttacaatattatactccatctgtttcaggttataagatgttttgactttgtttaaagttaaactatttaaagtttgactaagtttatagtcaaatatagtaatatttataatactaaattagtttaatcaaatcaataattaagtatatttttataataaatttatcttggattaaaaatgttactatttttttctacaaacttagtaaaacttaaagcagtttgactttgaccaaagtgaaaacgtcttataacctgaaacggagggagtatatatacaattgatggataccgattggagaggccattaaattttccattctcacacgatacatttataattttattgtaaaggtaaatgacatgaagaaggtacataacaataacacaagtactacctttgaccaaattattttatttatgatcctagacacatatagaggtagctggcgtgtctaattaatcaggtggcggtataattggcgttgagcttgagtatttgttgttggaaggcgtcgacgtggtcgggcgtaacacagccagacatcaccctagccccttcctttgtgggcatgagcatgaagcagatgggtgtagttttctccagtagagagaagagcatcctctgcgggtaagtcatcaccctcgccgtcttcccgctgccgaaatccacctcctccaacccgatgtttcgccatgatgtcaagtaaagcaagctctcgtatccatccacctgctgcccatcgctgagctcccgtaccatcctgtcgctgccttctccgaactgctccggtatgcgctccttggctcgccgtatgatctccacaacgtccatgatgtcgccgttcgccaccgcgccgctcttcgccatggccatgtgcatcatgctgcagttcccgtagtagccgtcgttgacgcctgctaggtactttcgtgcgttcactacgaagactagtatggcgggagcctctggactcgccatcaccgctcgtgtacggcacttccaaagcacggcggcgactgcctcgaacgccgtgatggtgggggtggagtgctgcccaccatcgtcgttggttcgtcgtcctcggaatcgtcggatgtggttgatcaagcttgtcgggacggtgacgttgttgaaggtgaggtctaatggcttggaggccgggtaaaacctggaaaagggccttggggaagggaggtccaacttgggttgcgacaatgtcgtcttgcctgaccgggacgatggacggcgagggcagcccacgggcaagctcgccgacggcttgtatgaactgtgctatgccgacaccgtcagccaggccatggctccatgtcaccccgacgacgaagcctccacaggatagcgtggtcacctgcacccacagcagaggaggagggccgtcgtcgccgacgtcgggcgtgcagttgaaggcgagctgctgcaccaccgccgtctcgtcgtcggtaggttggttgtcggcgacacgcatgagctcctccatggtgcagtcggcggacgcggccacgaacatgactccgagctcgctggtgcagtcgatgtagaaatcgccgccaccgtcttcgtcatcgttgcaggaaagacggccggcgataggatagtagtggacgagtgcttgagcgagagccatcttgatggtgtccgccgtgggctgatggtgatggatgatgggatgctcgaacgcaagcagcactgtcattggcaccatggcaagaggcatctccagtggagagagaacgatcttgctgctggaagtcttcaccggcggctccgatggtcggacgactaccggcgccgacttgctcaccacagtgctcatacttctctatatctagctctaacaataagtcagcatctcgtaagcaaaaatataaacaaaagcatcaacttgttacgtttattgtggtgcaaccaatctactagagtttaagttctagacttaatataagtgttcgtatttatgactaattttttcagtggtaggcggcgtatccgtccataagaattaacgagacgtcttagttactttgtcaatctttatatatgtcggtatagatttttgaaattgctcgtaaggatagagtgtgattgtgtgtgttaatagagagaagtgtatgcacattgtggacgtatagatttgtactctatttaaaaaaaattatatgaacaaaatcatcgtaccagtagacagtagttgactcttgcctcacttcagttacgaaccagctgctgttgcctgacgagggagtggagcaatgccgagacggtatgagctatgatccccttttaaaggagccccatcttacccctaaccattaatacgtaattctttttctaatttaaaatatgtattttcatggttcaattaaaaaattaatagcttgaaaggagaggagcattacacgtaacatgcatgccaaattaatcatgcacggcgggaattaattagggaactagttattccacgtcatgcatgtttttcagaaagatagcttttcatgtcattttaaattctcataatttagtgtaaggtgggtgcaatttagtgtaaggtgggtgcacaaacttgtaaggtgggtgcaatttagtgtaaaaacttgaaaaactctcgtttcggtacacaaacttgcgtagtgcgtgcgaaccaagggcaagacatgacttcatcaccaatcttattgagttggcttgtgattaggatgccacattggcgcatacacacgttatgggggcgtgagttggctacacatatttgcaaataacccctcatacatcttccgattcctccaaatcttcttttgtgttgtagcccacgatgatgcccatgctagagatcagttttacgatagcctaccgccaattgagttagcaacaaaaggagataaatcaggagattgatatttggatcaaggtggaaggccgcgaattggatccaggcggtaggactttgctgggagaaaacacgccggccacgtttagggcagcggtggcagtacgttgccgccggcgctgaggcaacatggtgccagggctgcgaagtgaaggtgcacgatctcctgtatacagtgagtactttagtttatcatggtcaaaaatgagattgtctttctcaattccaatttttatggagatttcttcctcttattgtcgatttattaggtattgcaaacgagaaggactatcagttgttttaatttatgccaagagctagttcatggtacacaaaagctataatttttgttgacatttatggtatagaagtgatcatggcaaatttgtatttttggagagcaatttgatcattaatgtactgctagcttctgttgttaactatgctttcttcctggatatacccttaaacatctgaacctaaagtaaactattctgaagatgaataattatctgtacacaatatatgtagattccaaagatgaagaattcagcattgagatgcaccacggaggcttttttatgggaaatggtgtaaaccgggcttatgttgatggtagagtaagctggtttgaccattgtgagtcagattcttggtcactgttgtgggttgatgatttcattgaagaattaggatatgagaaatctgataacaccaaaatttactggttgcttcctggcaaacaattaaatgatgggttgaggagggttaagtgtgatgcagacactaatagtatggtcgctcttgtacctagggtccgatcatttgttttgtatgcagatcatcaagacatagtcgacgctattgacttagatgatgtggcaattattggttcagatcctttgcgtactgctgtgaaaccaagtaaaataattagggctaagagtgatggtggggagttgattgtagataaacgtgctaccgacgctaaaattgatgatgaagaggagtcaagaactgaagatctagattttgttgatagtgattatgagattgatcatggggatgatgacttgtttgataattgtgttgaagggcaaattgagttagcacataataaagaggagggttcagactatggttcatctgaagatgaaaggttgatgatgccagatatttctgaagaagaagaagaagaagaagaaatcaagttcagttttaagagttttagggctgatgtagacatggagacacctgagttcaaggttagcatgatgtttgcagatgctgtagagcttaggaaagcaatagatcaatatactataaagaaccgagttgctattaagaagacacggaataccaaaacaagaattgaagctaagtgtgctgaaggttgtccatggatgttgtctgcatctatggataatagagtcaaatgcttagtggtaagggaatatatanataancnngccctgcttggttctttnggagatcaaggccgtcacagctaagtatcttacaaaaaggtacattgaggaatttagagataatgacaaaatgacactgatgagctttgctaagaaaattctgacggaactacacttaacaccatctaggctcatgctaggtagagctagaaggatggctatgagggccatatatggagatgaaatatctcagtacaaccaattatggcactatggacaagaattgagaacctctaacccaaggagctcattctacctgaacctactttttggttgcttccatactttgtatatgacattcaatgcttgcaagaaagggttttttgtctgggcgtagacctatcatatggctcgctggatgccatataaaacaaaatctggtggccatatcctaactgctgttggtatggacccaaatgactgcatttttcccattcgcaattgtagtagttgaagttgagagcttgaaaagctggagttggtttcttgacactctaaaaaaagaccttgccattgagaatacatctgcatggacagtgatgactgatacgcagaaggtataacttcgtctgatttttcataatatacataacttacattttagttcctaactataattctttataattcgtttccaggggcttgttccagctgtgagaagggagttttctcatgctg

SEQ ID NO: 12314 - DNA, 12079 bp, Oryza sativa
tcatcaaagattgggcccggtaaatcaggatcatgacccggaggatgatgaaaacaggaagactcaatggtgtcctcctggcatatttacaaagaatcagaagagaagggttcaaagattgagaaactgagaacgcttgcaggaggtcgagcaagagatcaatcaccggctaaagaaaacaaagccgaagcaggaatggcgcgttaagaaacaagctcctgtagccgatgaagcaaagagattggccaaagggaaaggcattgtgattgcgtcggttaacatggtttttaccttgccagccgaatttaggatcgaccaagccgatgttgaggaaacagaagaagaataggctaaattgattctatcaccagaacaagcagtctttaaaaagcccgagggtgcagagaatcggcatcttaaaccattgtatataaatgactatgttaatgggaagccgatgtctaagatgatggtcgatggtggagctgcattaaatttgatgctttatgctacgttcaggaagttgggtagaaacgccgaagatctcatcaaaacaaacatggtactcaaagactttggtggcaatccatcagaaaccaagggtgttctaaatgtggagctgacagtcggcggtaagactattcctactacgttttttgtcatcgatgggaagggttcttacagtttgttgcttggaagggattgggttcatgccaattgttgtattccttcaaccatgcatcaatgcttgatccaatggcaaggcgacaagatagaaatcgtgccagccgacaggtcagtcaatgttgctagtgccaatttagctctttgggagatggacggccttgattgtttatccggcaaagtttgggatggagattttctaaaagtgtccgattctgatatacagccaattgaagatggagaacccaagctattactttgagggcatcgtggagggttcaaacgtctacaccaaggacacagtagatgatctcgatgacaagcaaggtcaaggttttatgtcggccgatgatttggaagacatagatataggtccaggcgatcggccgaggccgacatttattagtcagaatttatcttcagagtttagaaccaagctgatagagctcttgaaagaatttagggattgcttcgcttggcaatattatgagatgcctggactcagccgatcgattgttgaacatcggctacctaccgaaccaggggttaggccacatcaacaacctcctaggagatgcaaagctgacatgctcgaacctgtcaaggctgagattaagtgcttatatgatgctagttttattcgtcgttgccgatatgccgaatgggtttctagcatagttcctgttatcaagaagaacggcaaggagagggtgtgcattgattttagagatttgaataaagctactccaaaggacgaatatccaatgccagtggccgatcagttggttgatgctgcttcaggatataagatattaagttttatggatggaaatgtgggatataatcaaatctttatggctgaagaagatatccataagacggctttcaggtgtcctagtgcaatcggcttgtttgagtgggttgtaatgactttcggcttaaagagtgctggagctacgtaccaaagagctatgaattatatatatcatgatttaatcagctggttggttgaagtctacattgatgatgtggttgttaagtctaaagaaatagaagaccacattgccgatttaagaaaggttttcgagaggaccaggaaatatggcttgaagatgaatccgacaaagtgtgcttttggcgtatcggctggccagttcttgggatttcttgttcatgagagggggattgaaataactcagagaagtatcaatgtgatcaagatgattaaacctccggaggacaagacagaattgcaggagatgatcggcaaaattaattttgttcgaaggtttatttctaatttgtctggaaggttagaaccttttacaccattattgagattgaaggccgatcagcaatctacttggggggcagaacaacagaaggctttggataatattaaggaatatttgagttcccctccagttttgattcctccacagaaaggaatacctttttggttatatttatcggccggtgataagtcaatcggctcggtcttcattcagaagcttgaaggaaaagagagggttgtgttctatttaagtcgtcggctcttggatgcagagactagatattcccctgtggaggagttatgcttgtgtttatatttttgatgtatgaggttaagacattatctactgtccaatgaatgtactatcatatgcaaggccgatgttgtcaagtatatgttatcggctcctattctgaaaggaaggattggaaagtggatattttcattgactgagtttgatctttggtatgagtcacagaaggcgatcaaaggacaagctatagctaattttattgttgaccatcgtgatgattctatcggcttggttgaggttgtgttgtggactttattttttgatgggtcagtctgtactcatggttgtggtatcggcttagttataatctcccctcggggggcatgctttgagtttgcctatactattaaaccttatgcaactaataatcaagcagagtatgaggcagttcttaaggggttgcaattactcaaggaagttcaagctgatactattgaaatcatgggggattctttgttggtgatcagtcaattggcaggagaatatgaatgtatgaatgatacgttgatagtttataatgacaagtgccaagaattgatgaaggaatttcggctagtaactttgaagcatgtatctcgagagcagaatattgaagctaatgatttagcccaaggggcatcgggatataagccgatgatcaaagatgttcagatttaagttgctgtcacaacagccgatgattggagatatgatgtctatcggtatttacgggatccatctcaatcggtttcttggaagttaagatataaaacgttgaagtatacattgttggacgatgagctttattatcggacgattgatggggtgttgctgaaatgtttgagtgccgatcaggcaaaagttgcaatcagtgaaattcatgaagggatatgtggcactcatcaatcggctcataaaatgaagtggctgcttcgacgtgctggatacttttggccgacgatgctggaggattgtttcagatattataaaggttgtcaagattgtcagaaatttggagcgatccagagagcgccggcatcgactacgaatcctattattaaatcatggccgtttagaggttggggaattgatatgatcagcatgattaatccaccgtcaagtaaagggtataagtttatattggtggcaaccgattattttaccaagtgggtagaggcgattcctttgaagaaagttgattctgggatgctatacagtttgttcaagagcatataatctatcgatttggtatccctcaaaccgttacgactgaccaaggttcaattttcgtgtctgatgagtttgttcagtttgccgatagcatgggaatcaaattgttgaattcttcaccgtattatacacaagctaatgggcaggccgaggcatctaacaagagcttgatcaagttgattaagaggaagatttctgattatcctcggcaatggcatactcgtttagccgaagcattgtggtcttatcggatggcttgtcatggatcgacacaggttcctccttataaacttgtttatggacatgaagctgttttgccatgggaagttagaatcgactctagaagaacggaattgcaaaatgatttaacagccgatgagtattacaaccttatggccgatgagagggaggatctggttcaatcacggttacgagcccttgcaaaggttaccaaggataaggagcgagttgcttggcattataacaagaaagtagtgcccaaagatttttcggaaggtgaacttgtatggaagttaattttgtcgattgggactcgggatagcaaattcagcaaatggtcgccaaattgggaaggaccgttccaaattcataaggtggtatctaagggggcttacatgttgcaaggactcgatggagaagtttatggcagagcactaaatggcaaatacttgaagaaatattacccaagtgtttgggttaacgcatgatcggctgatgttgccgatgcatgatagccgatgtgtttacattgccttgagatgaccgatatggttatatcgcacttagttcttttcatattgtaatcggttgtggtttgccgatgtgcaatggtcgatatggttatattgcccttagtcgtttttataattttatcaatgtttttgacattgtaaaattaggggggcacatacatggaaaattgcaaatttttgagcatatttggcagttatgttaatcggcacaaaggattatctagacaagttgaataatagcactagggtatcttagccgagtacaaaaaatttcttgaggtctattatacagaatatcactaagacaaatatcgttggatagccgatatagccctctgcctaatttgttctacttcttctatggcttgggcatcttgagcatcggttccagggatgactttcaaggacttggtcatatcagcgatattcttgatagccgatttcagcctcgccttctgttcttcgatagcttacgggagatcggctaacttcttgtgctccatatccagctcggcgttgcattcttgaagttgtgccatgagatcaatcttacgagcttcaagccgatcaatatttgacttgatcgggccctcagacggctgatcaagcttggacttctcttcgtgcataagctgccgattgtgctggattgtagcttcgatgtttttgcgttcccggcgatcggctaatctctacttggccttctccagcttgaattggtgttgctcaaggtaaacggctggagtaagggcatcggttagttcatccgggagtagagcttggatatctgtgaacctggcctggatcgagccacagttggtcactaagttgtctaatgatgcttctagccgatgagagatatcctcgagcattctcttcacatcatcagacagaggagctacagctttactggtggtgtcttcctctatttcatcgagataatccttgatgtcgaaagaaaacatatcggctaagacctgcaagagataatattatggatggttaaggatcaaaacatgattggctgatctcagatttgtatcaacaaaaacttactggaataacaggagcagctggttgttcttcctcttcgacgttatgactgtctgcaaccgatggagtacggttgcttgattctcgctgcacaagaggtgaaggaggaggaggaggctataaaaagataaatgttagacataattccggccgagattagttaatgagaagacttagaatatcttactggtggagccggtttgagagttggtgctgccgatttcttcctcacggcagttttcttcttctgtgattatacatctatgagtaatcggctgaaaggtaaagtagttacagaggaaatcgaagagagatgcttactctcgaaaaatgagctggggcagaaggagttggaggagtctgcttgggtgaagccgatggtgttctctctgtatcgctcatttcggctgcagcctgatcaatgtcctcttcaatctcttcttcatctagcgcttgttcgatagatggatctagggcagacagatcatcaactggcttggttttctttgatttgattttcttcttgagagctggagctgatgtgtccatagtcgatgatctggtttttcttttcttgcctgcatcagctggttccctgattaagccttggagaagagccgaagtcttgggggcatcatagccgatgaatggaggagatggtccacctccatttggaattattcctggggcatattcgatatcttgccactattgctctggtgtgggggagaagattctgttgtctataaaacagaggattagattaatcaagcgatgaatcggctaataattgttcaaatacgattaataaaataaagacatagctaaggaacaatatctggaaataggtctatcttgaacattgaagccggttgatggaaaagatgcagcttccattcaccccaccatctgtcgaagtttctactcctgaatcttgccaactctatattttcaatgctgcccaatggaggtccttgaagattaagcagccgattcatcattaaggtagatgagattttccctcggcattggatcttatcggcaaaaaataagccaattggaagttggcccattccaaactgcctagcagagctcattggatgataaaattcatatgagacgtaagtgtttcttccttgataaatgccaacaggaaggatacatgggctgattgcagttgagaaaatttctctgggtttctgatatctgtcatggttgatgtcttcgaatctaaagtccaaaggattttccagaagcgttgaatcttcatagaggaaccagactcgagcttctttctggaatccttcataaaagctgcaaaaccaatctttgagcagttcggctgatagctttgctcctgcatcgattggtgtggaggcatattctccgaaggaggtgcatctccgatgagtgcgttcttctctgtcactgtctttaatcggctccagtcttgggaattcagcttctgttacaaatggccgattgacaaacttcatgactactaaattcaaccaggattgcagtagccaccatggtccacccgctccgactactgagccgacagctaacttagccgatgcattatttagcatttggtacaagtagccgaggaggattttgcctaaagggaattgtctctttgtttctaaggcttcggctacagattgccaattggttgtagggccacagcttgatccaaagaagaagaatttctctagccacatcagcaagaaagccacatgttctcggggggtgaccggaccctggcccatgtatgctgcaatatagcccgaccagccgcctatgctcttagtcttgaagtcatattggttttttgtgttcaggctcatagggttagccgatgaggtgatatctagacctgtgatcatgatgatatctatgagagttggggtcatcggcccttggttgaataggaaggcgttgatggtgttgaaccagaaataagtggcagctgccattaggggttcgtccttagctgagttggctatggtaaggtcgagtgcttggccgattccaatttcatcccaatgaactcttttactggccgataagcgtttgaaccatgtgatccagctcttctcgggtgaggttttctctagagatggccaagatttaaaggtattctttcagtgacctagatctgggttggccaatctgaaaggaatcctattggtttcgccattgatgaattcagtaggatcaagactaccgattggaccaagaaaatagtggttctcgtgtgacagacttggaattgcaaccagattggacagatgctacagatgcaagtagggatagagaagaagaatacaggataaggcgagagaaaatcaatctactgtgaaagaaagagatctagccgatgggtacttacctttgcatactcagccgatggtgcggaggacggattggcggaggttgacatcgccgagggcggaaatctggtcggggatgaagtcacctggggatcgccttatgcgtcggaggaatcgccggagagagagagcataaagtttcgcttgagcggtgaaggcggaaataacggtgtgagatttctcaaggacaacagttagtatttaaagagttggagtaacggttagaaaacggcggagtgcgaaacttactcggagttgatacgcggcaaatccggaacattaccaaatctcccgaacttggggggcttgtgttaatgaccaaatttggtaatatcagcatcggagaaggagattagatcgaagtggaatcgaagataagggctgtcgcgaaaacagagtaagaatcggctagagtctggattggctacggtcaggattggcagagttcgagtcagacagggctagccgatacagccgattccaagaatacgactcggtgtacattatcgggttgagttgatatgcttcaagatgattgccacgcatggatagagtcctgaaaattcaattatatctattaattagaatattttatgtaaatttcttacagattaatgtgggcaaaagtctgtcgtaaagacttgtggtatcttagagtttgttagagataatagtcgtgtccggtatggacatatcttgtaattctcgggtataaatagaccccgagctccatgtaattaatctaacacacacattcaatacaattttggcgcatcgccacccttttactttcgttttgtttcgacgagttcttgctttcgggttgagctgcatcggtttcgatcttcaacaagaggtaaaacttgttatggcggcttgtgttctcaggattagtgcttccatctctatgatactctaatcttgtttatgtaattcatcaagttatcatatatcttgtataatcttcggtaatatcgtcatctaacctacaatcagctaacatctgttagtagaaggcagccgattaggttaaatagcggtgttagctaggattgtacaagatacttaccactctatgaaacatccagcggcttgattgtctagatattgttcttcttttcatacttaatgctgcatcagttgagtttgatctatcaagtcgtgcttagaatatcaatctctagcttgcttcctggttgccgattagtatagcatcggagttttagccgatcttacctgatttaactatagttatcctatatgtttgattgacatgttaaatctgccctttatgttaagatcttgttgcatttaagtatattatgcttctgtctgatatattctatttgctttaatatcttaatataaagtggtatcggagtattagccaatacatgctagatctatttaatcgactacgctattaacgtatatagttttgttgttgatttatatttcgatctaagtgatttaaccaatcacttgatttaagtatatatcgacataagaattatatattgttaatgtctacagccgatcaagtaggtttagttcttccttaattattcatgactgccgatcgatgcacacatgacatcggcataaaataaatgatttgtcatctgtacccagccgatcggctatcatttatatatttaattacggtttgtttgtcttcgtttcttgttcattgtaggatcaaatcaactggcacgctcacatatccgaaggcgagttctggacctgcactggagttaagcagatctcccaggcctcgtgttttctgtcaacacgcttttggcacgcccattgggactgattagaagtcagaaagcagttttcctcatggccgagaagccgccaccatcgccgtcttcggctagcccaggttctgttaaagagaagatccagcaattagacctatctgaggttaatgagggcaacgtcatgaccatcactctggacaaattgacacctgatcagaaggagtttgaagcaatgatgcagcaagcacggaaccagttcttgaactcattcatgcagacccgcaagggaacagtggtgcaaaagtatcaggtgcgagtagtggctgatgtccccgggaccggttcttccaaggatggggagatgaaacaagccttaggtggctcggctcaaccgagcaacaaaggtgctacaaatggatcggctcaggagaatcagggtgaccactctcaaggagtacatggagttcaaggtgatggcactcaggggccacgaggaggaagtcttaatcaagatggcagtgcgtcacaggaatttttcaataattttcaagaccgggttgactatgctgtgcacaatgctttcatcaatcaatctggggtattagtcaataccttgtcaaacatgatgaagtcaatagccgatggttcaatagctaaacatcaggctgcaggcccagtttatttgccaggaggtacctttccgaattatcggcctttggtcaccgatattcatccacctattcaagcggttcctcccattgcatcatcagcctagccgacggcgccggtatcgatttccccatctactccgtcaatgtcggcaccaggtcagctggttaatcctcggcagttgatgagagagaacccacagcatagtgggcaggttgcgaatcggctaacgcaggatcaggttgctaccatgtttctaccacttcaacctactgttgatctagtccagcagcagccgattcaacaaacacccccaatccaacaggtcgtacaaccaattcagcaacaggttgtgcagtcagttgaacaaacgccaccaaggcagcagattgtacatccgattcagcagacgccatcaagacagcagactatccaaccgattcaccagcaaggcttgatgaatccatcggctgggcaacatactctgaatcaggttgttccagagcatttggtccatcacgtgcagctggatcatacggtagtacctcagattgtccctgagcacttggtacgaaatattcagccaaactagcagaattaccaggggggcaatttaagttatcaatatcaacctccttccccgcaagaccaatatcagcaagggggattaattcagcctcaatttgctcctcagtacagtcaattcgagcccatgcagcaacaatcgcaaggagcagctcaacaacgaccgtgggccgatgtaattgctgacgtgatgagggaacagttcgggcttaaaccaaaagagactggaaatttatactgacaaccgtatcctgaagggtttgagagagtccctctccctaaccggttcaaagttccagatttttcaaaattctcggggcaagatagtacatcgacttatgagcatattagccgatttttagctcagtgtggtgaagcatcggctgtggatgccttgagggttaggttgttccggttgtctttggctggatcggcttttacttggttttctgctttaccctatgggttgattaacagctgggccgatctggagaagcagtttcatagctatttctatagtggggtacatgagatgaagttgtacaatttgacagcaatcaagcaaagacacgacgagcccgtgcatgaatatattcagaggttcagagagatgaggaataagttcattagcttgagcttaactgatgcccagatagccgatttggcttttcagggtatgattgctccgatcagggagaaattctcgtctgaagactttgaaagcttaccgcatcttacacaaaaggtaactttgcacgagcagaggtttgctgaagctaggaggaattctaggaaggttaatcatgtctgttcttatatgtgtggatcggacgatgaggatgatgattctgagatagctgcagccgagtgggtaaggagcaaaaaggttatgccatgccaatgggtgaagaattctggaaaagaagagaggtatgattttgatattaccaaggctgacaagatttttgatctattactctgggaaatgcaaattcagctccctgctggtcatactattccatcggctgaggaattaggcaagaaaaggtattgcaagtggcacaattctggatctcatactaccaatgatggcaaggtctttaggcagcagatccaatcggctatcgaaggaggcaaaatcaaatttgatgattccaagaagccgatgaaggttgatggtaatccttttcccgtaaatatggttcatacagctggccaaacagccgatgggggccgtgcaaggggttttcaaatgaattcggctaagatcatcaataagtaccaaaggaagtataataaacaacaggagaagcattacgaggaaggtgatgatggtt

SEQ ID NO: 12315 - DNA, 683 bp, Oryza sativa
ctgcagtggaattcctcgagcaatttcctcgtcactggcgctccaatcgcctcgatgggcttctcctccagatacagctgcagatcctgggcgggcacaccgttgagcgtcacctcgtagtgcagattgcactcgttgtcaatggacatccaggccatgccgacggcatgtggattctgtgcatccgtgtgctcctgtcgcttcagcagaatgggttccgccgagtcccgagcatcggccactggacggggcactaggcggccacggatcaggctcgtctcatgctcggtggccacattaacgcccagttcgccggcatacagcgactcgaggaccttgggacccaacttctccacactaccaatggcctggttgaagttgaagctcggcgtcagatcctccagcttggccttccgcttgccctgctcctcaatcaaactgatgttgggcctatcccgggtgttcacgtgctccgtttcgatgttgtaggccagagatccatcggtgttcaagtagacccacgccaaaccgctgctcttggtcgaggattcggcactgtgcggcgccagcagggtctggaagatttcgcagctggctcgggtcacgatgtgtccctggatgcgcagatgtgggtacttcttggactccacggtcagcaggagtttgccacgcgacatcagtcg

SEQ ID NO: 12316 - DNA, 734 bp, Oryza sativa
agcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggta

SEQ ID NO: 12317 - DNA, 310 bp, Oryza sativa
aatccgtagagaagaacaacagaggaggctgccagctgaaattgggctagattgggtcagcccatggttcggctgaaccagggggttcggccgaaccctcctcagcgccatccgatccagggctttgcctggatggtgtggattagcccccaatgacggttggagggtatttcctaccattccaaccgtcacaaccgtcattgggaagatgatttgcttcagaaatgatacattagaccaagttcatctccatggggagctccagtcatttttgaggaaaagaaagatcatacctagaggatgtgtgtgg

SEQ ID NO: 12318 - DNA, 4052 bp, Oryza sativa
gcgttgaagatttggcgtcactacctctttggtactcgtacggaggtgtacacggatcacaagagtgtgaagtatatcttcacccagccggatctgaacatgaggcagcggagatggttggaactgattaaggattacgacatgggacttcattatcacccagggaaggctaatgttgtagcagatgctctcagcaagaaaggctattgcagtgctacggaaggacgacagttgccgtgggagttatgcaaggaatttgaaagactaaacttgggaattgtcagtagaggtttcgttgcagctttaggagcaaagcccactctggttgatcaagttagagaagttcaaatcaatgatcctgatattcgagaaatcaagaagaatatgagaagaggaaaagctatcggttatttggaagatgagcaaggaaccgtatggttgggcgagagaatttgtgtcccagacaataatgagttgaaagatgcaatcctgaaagaagctcatgacactttatactccattcaccatggtagtaccaagatgtaccaagatctcaaggagaaattttggtgggcgagtatgaagcgtgagatagcagagtatgtagctgtttgtgatgtttgtcagcgagtcaaggcagaacatcagaaacccgcaggtttgctgcaacctttgaagataccagaatggaagtgggaggaaattgggatggatttcatcattgggctacccagaacgtcatcgggccatgactctacttgggtgatagtcgacagacttaccaaagtggctcatttcatccctgtgaggacaacatattccggaagccatttggcggaactgtatatggcaaggattgtgtgtttgcatggtcttcctaagaaaatagtatccgatcgaggtagccagtttacttcaaagttttggaagaagctgcaggaagagatgggttctaagctgaacttcagtaccgcatatcatctgcaaacagacggacaaactgaaagggtaaatcagattttggatgacatgttgagagcttgtgctttagacttcggtggaagttgggataagaatttgccttacgcagaattctcgtacaacaacagttatcaagctagtctttaaatggctccttatgaagcactgtatggtcggaagtgccgcactccacttttgtgggatcaaacaggagaacgtcaggtttttgggactgatattctaagggaaatagaagagaaggtaaaaatcattcaagaaagattacgcatagcccagtctcgtcataagagctatgctgatagtcaccgcagggatctaagttttgaggaaggagatcatgtgtaccttcgtgtcacgcctcttcggggagttcatcgttttcacaccaaagggaaattggcaccgcgtttcgtgggaccttataagattgtcagtagaagaggtgaggtcgcctatcagttggagttacctcaatccttggcaggtgttcataatgtgttccatgtgtcacagttgaaaaagtgtttaagggtacccactgaagaagctaatcctgagcagatagaaattcaagaggatctgacttatgttgagaaaccaatccgtatcttggagacagatgagggaagaaccaggaatcgagttatccgtttctgcaaggtccaatggagtaatcagtcggaagaagaagctacttaggaacgagaagatgaattaaagtcagcccatccgcatcttttcgccagctcttccgaatctcgaggacgagattctgtttaagtaggtttgtcacaccctaaaaatcctaaatttataaattgttgtttaaatggaattattagaaatgattttaaaagccttgaagaaaagatctaattttaaataataaattccaatataaaagtgggctaaataaaagtttattaagtacttctcttgattctatagttcctagatttttctgggatttatttgagccaagaaagtatttttaataaatggaattgcatttcatgaataatttaaaaggaaaaaggtatgaaaatcctcttttggctttgggccgaaagtcggcccaagtctctttcttctgcttcggcctgctcgcgctcggcccaagtcggcccgccaagttaagccaccctctctccctcctctctctcgctgacaggtggggcccacctgtcagggtcgtcttcctcctcccgccgcagccgcgccctagccgtgcgcaagccgccgccatcccttccaaattccgtcacccctttcccaatccgatcaaattgatagaggggaaatgatcccttcgatctcctctatcttttctcctatagaaacttcatctaatttcgtttggaaatcgtcggattcgagctcgattcggatttgtttttttctcctctaaccctaaaatttccatcgtcgccgccggctgccgtgggcctagccactgccccctagcccctataaaaggaccccaagacctcctctgtccgccgccaccttcgccttagcccgctgtcccttgtagcgccgcctccgcgtcagcccgtgcgccgccgtcgccaccgccagtccagtcgtgcgccgccgctgttccagtcgccgccgtcgctcgggaaggccgccgccgctgttccagtcaccgccggagctttgccgttgtcgtcgacccgaacgtctcccctgcttcgacctcgccgccatcgccgttggttgccgtccgtcgtcgtccgagcctttggtgagttcgccgcattgccctctacccgtaggtgtggtccgtttgtgccgccgcgccgacgttcgcccgcgagcacgaggtgccgagccgccgctggtgatgtcatcgtcgatgtcagcgccacgtcagccgtagaccgcggtagatcggttagatctcggccatccattttgattagattagatctcggccgttcgttccatagaccgtttccgtgcacccggtccaccgtgaacccgagccagcgtgggcaacgggtttaccttttgtatagtgtagttcattgtggagcaccagactatgaagtggcggagataagctgacgggggtcgctggggagtccatgccttgtttataatggggtgattattatccaggaagggtgcactgcttttaattgtgttatgcagagggtattgtcacaatctctattctggccagagtaaaactattcgaatagccatgcccacggttatgggcaggtctaacaatgtcttacgtgattagtctcacacctctgaccataataaatgatgctgaaggtgttctatagtgatgctgaaggtgtggaggattaggcgtagccctggtgaagctgcttgtgggatggagtcgcctgcgctgtttatctttttccgctgcttagatctttattgtttgagaggaactatctacctctgtaatgactttatattcgcttaataattagataaatacttgcactctattatcaatttgttattgtgtgcctcggctgattcctggacgagggtttgcacacatgtaagcgtttggagttttggatagaaattccgggcgtgacaattaaccatcatgagctaccattgaatataaccagaagtaatgatgtagtgtgattcatcccattaataagctaatgtttataggagcaacgactcgcggcctgatgctccggaagaaagcttctggattttctttgaagttttccggaaagttgtaaccagtcatgcaccaccctattttcacaacaaaagtgaaaacaaccaaggttagcctgtaaaggaaaatgattatacagagggtaaatacaaaatattagttcaggtaatctctattatgtatcttccccggcaacggcgccagaaatgcttgtcggtatttgttaacgacattactagaaatataattcctagcaatagtgcagaaatactcttggtatattatggttacagagtttatccgcaagcgcacggatataccattgtagcatttcactcgagagtattccaagggtattgttgtcgaagtgacaactgcgtac

SEQ ID NO: 12319 - DNA, 11798 bp, Oryza sativa
gtatgtatatgtatttttatggttagtaatgctttgtggttttcgccctttgcgaagagcgaatccgtttttatttttatatgggccgaaatgaacagtggtgggcttccttttgtgggctttttcactgtgtggctcgatcgatgggtatttactgtttcgcctacccttgtgccacgtgcggcctatgattcggtggggaggcgaaccagcgtcttggtgggctatatattccccccttcccctttttcaccgccttaccctcgtcattttcaccctgagtgctctctcttacatggcgcccttggagtcaccagacctttcgctcgttctccctcttcatctccgcgcacacttttcgccatggctcctcgcaagccgaaccctgccttcacgacgggccccgaccctagccggatcgacgataacaccaccgccttcttaggggcttcgctcatggatgatgacgagctagcgaagttggtcagctccggagcggtggcggaggggcaggccttcgccccggggaaggccttggtgccgaaacacggcgacaaccggacgatggtgttcgctgtgttctttgaggccgagcttcgatttctgtgcaatgtgttgttgccggagatccttcgccttttccaggtggagctcccccagctgagcccgtcggcacttgtctggatcgccatcttcgactgggcgtgccgaaccgctaggttcgaaccgagcgccgagctttttggcaccgtgttctacgccactgtgaactcgaaaacaatggtcactccggctgggacgaagaagatggcgttcgggagtgtgaacattaatgttcgtcccgagcagtccgatctctggccggtgaacaccgccatgtcgaagtgggatcgccattggatggcgaaatggttctaccactccattcccttcgaggctaggtccgatgcggcgaaaaccctccggtgtcaccgcaggtcaattgcgccgaacaggaagcccaaagtcgccgtcgacggcggcatcgaagcccggttcgtcctgttgcgcaaggtctgctcccgccttagctgccacgacttggtggaggagtctctactttcctaaatgcacttgtgtttcgccccccccccttttcttgttcgacgcctgatgttttgacacgttttgttttcgcagtgctgactcttgcttaggctgataccgaagctcgtaggatgatcagcgatgtgtcggttactgagtatagccaactgctcacgcggcaggcagccggccgggcgaatcgggtgtatgatggcgatcttccaccccgggtgaaacccttcaaggccgatggcgacgaggggacgtccaggaagcgtatgcgcgggcaggtgaagctggcccctcagaagagaagggcccccgcctcctccgactctgacgccgatgacgaagataacatcgaagaccatgatgacgaagaggaaggggaggacgaaggggaggtggaagttgcggccgaaaaggctgcgtatgaggcagtcgacaaccgcaccgagacccatggctacaccccaactccgagtcccgagcatgtcgaaaccgggctggagtcgaatagctcccccctttgtcgaaacgatttggagtaaatgctattagctggtaaattgaagtaccaagaatgggcggcgccatctagagcgagatgtattacctttgccttggaattttagtcgccatgagcggcttcaatcgtggactcgtagatgggcaaagacatcgtgcaattgctcccatgagtaaatgctattagctggtaaattgaagtaccaagaacgggcggcgccatctagagcgagatgtattacctttgccttggaattttagtcgccatgagcggcttcgatcgtggactcgtagatggacaggaactcttttgggtccgtttcgcctgagtatcgcggaacgggtgagaacttgaactggggtgggattggacgaatcttgcttcccccactcagcggcagccccttttcgccccccgccttgctcacggcaccttgctgtagaggcccgtttggatatggcatggcgaagggcgaagtcatggcttgcgcgtgcggttgggacacagtgttcggttgcccggcccctgtaacgccccgattttcgttcgggattaaaaatcaattaataatgcattttctagcaatctaataaaaagttaaaccaatttaatcatgtgaaataatgggagaattaaaattttcccttaaaaatcattggccgggaatattttgtaatattctttgcgtccgaaaatactctccggattttttttccatgaattttcggagctcaacaagtaatcttaaagtcacaaagttcgattaatcaattaaataaaaagaaaaccaaataaaaatccctctcctccctcttgggctcggcccaactcccccttcatcctctcgagcccggctgccctccttttcccctcctcccttctctttgggccgtcgacccggcttgccccctccttcgcgcaagtccgcgtcgcctccctcctccccccgagcgtccgataggtgggcccctcctgtcggggtcacccccaacctctagcccgagccggcaactgccatggccgcctgagctgcccacgtcgccgcccgactcaagttgcattgtcggaatcggctgcttcggcttacctagcctgacttagacccagccgatcctaatcgtagccgatctggactccagccgattcttgctctgtttccgaactcgatcttcgcctccgactttgcttcgatctaatcttcttccccgatgccgatattaccaaatttggttgttaacacatgccccccaagtccggaatatttgataatatttcggatttgctgtaaatcgactccgagcaagtttcgcactttgccgtttttcgacccttactaccgtgctttaaatactaaccgttaccctcgagaaatcttacaccgtcctcctccgttttcgccactgaaaccaactttgccatctctctctccggcgatccccccgacgcacaagacgatccccaggcgtttcgttcccgaccaaatctccgcccgcggcgatgtcgtcttccaccagcccttctactacgccatcggtcgagtactgtcacgtcccaaaacgaccctaaaatatatcctttaaaattatgcctacaataattaaaaatccttgtgaaagcctccaaaaattaaaatgtgcaaatttaaaagtcaaataaggcttggaggatttttgtatatttcctaaaagcctaaaatgtgtaaataaattttagtggaattttcagagcacaaataataattgttaagaaataaacaaagttaaaaaggttttataaaaagaaaaccctaaaaatcccccttccctctcttgggccgcattcggcccacttccctccccctctctcctcttcccccgcggcccactcggcccctccccgcgcgcgcgccactgacgggcgggcccgcccgccaccctcgctgacgggtggggcccacctgtcatccccgtcctcccgccgctcccaccgccccgcccgcgccaagcgccgcggccaccgcgaatcccgccgcctcccgccgtccccgcttgcaataaaaagtggggggaaatattccccgtgatctcctctccctttcccccattttccctctctctcctgcattcaaacgggctgatttgctcccgcaaatttcgctggcgccattgatgtcggccagacgtcccggccggtttccttcctctcccggccgccctctcccccttccaaccctatttaaaccctcctgacacctccttcgctcgtttccaccctttgccgtgccttctcctcgccggaatcgagctcgcgccgtcgctctctctctcctccgtcgccgacgacgtccggccggccttctccgctcgccgggaccgtctcccgccccggcgtcgcctcctccggcttcacggcaccgccgccgtccccgtccaccccctcgtcgagctcgccgaccgccgaagcaccgccatccccgtcgacccgagccgcgccgccgccttcctccgctccggccgcctttttcgtcgtcgccatcgacctagggtgagacgtggaccaccgcctcttttcccccttcccttcccctctctcggccgccgctccgccgtgcctatggccgccgccggcgaccataggggcgcgggcgccgcctcccgccggctgcgccgtcgtggccaccttcgggcgcgccgagtggccaccgcgtggggcccggccgtcagccgcccgtgccctcgggtgcggcagacgcgtggggcccacggcgccggtcagtgcgagcccgggtgcgcccggtctaccatggaccgtgaggctgccgcgtgggccccactcccgtggaccaggttcgcgcgtccctcccactcggctgacgcaataaaccatttttaaattaaaatttaaataaagaaattcgcaaatatgcatttaaagagcatataaacttcaaatgcccataacttgcccatttgaactcggaattggaccgttcaagtctctaatttttccttaagaagtcaagaacccatttttgtgctttgttcctgcttgttatatggagtttattagagtaaaagcctttttcctttccattggtcgtgtagacgctgcagcttcggaaaatccgctcttcgtggaggttgaagccgacgtttgggaaagcgtgcaaggcaagtcacatcatccttgaacatattgaatcccagtttataaaattagtttgatttaaattattgcattatcgctttatttaaattctcgcgttatcactgttttatttagccatgcctatttatctttgttatgaccttattattattgttattgttattattcccttgttcaccctagaataaacaaaaccccaactagtggacactctactcatggtaccactagtatgaatttaggtagatgcttcgctggttaattaggcaacattaggtggttttacaactctagacttcgggaatattctcatcacctggacactatggaatggttggattattgtggaattggattcacacctccccctctattcaaaatcctcaaaatgtttttaggctgcgctcggggtgcatggttttgatagtagcacctcggccacataaggaccggtcttcaggcctctgttgcaaagcactaccgtacttccacatgtctagtgggtaaggtttagtttgtggctcagtctggttataaacaaaagtatacggatggagatggacgaagtagggggtcgatggacatctctagggcaaatgaaggctacacgagctgcggcccggtagtcgagatgtcatggcacagggctggtgtcctgctgctaggggctcagtcttgcctacctatcctggaggttccggccgtaggtagggttgggtcggtactcttgtctatggctaggatgggttggaaactatgtcacgtcttccgtccgtataccgtggtggtatgtggcacgtggttacacgtggggaagatgtgtcttgtgggtaaagatgtacacctctgatcagagtataacctattcgaatagccgcgccctcggttatgggcaagcctagcaatgtacccaagttagagttttaattcttaaaacctgcttaacaactaaaatgtggaatggttggcctgggttggcttgggacgagctgggacccagggtcgggttgccaattcggtctgaatcatcgtaggccttgggttaaggcaggttcgtgtgggttcacggccttgattaataatcttgtaaagctctaggatcgtttttacaaaatagctttgagcaactaagtgtcttttaacactgtttactgcaaatcctaaccccttatattataacccccttgtactcccttgcatttattctgcacttatgggtgtgtcttgttgagtacggtggttgtactcagtcttgctcaatttttcccaaacccagaagagaggagttcctggaagatgaaggctttggtgtctagctcgtgcctgctgtcaagcgcctgtggtcatcgccctagtcttccgctgtttttcgtttgtcttcatgtgtgctgggccttctccgcccatgtaataaattatctatttacgctttcgcttgttaaactctgtattgtatcaacttttggtgtaccttgcctcctgggacaaggaataatacacgcacgaaaggaacgcccgttgggttatttccggtcgtgacaagttggtatcagagcctccttgaccctaggacgagctttagatcccaagccttagcaaaattttcgaaataaaaatcctttcttatttgtgaaaatcctctagtctctctctccgtcttgctgcttcatttatcatcaaaagctgatctctaaaatactttttttctcttttgtctttgcttgtagatggccggcagcctcaaccgtcgtggcctggacctgactggcttcgttttggagctgcggggcatgtgcgttgtcctggggtatccgcatggagtggactaccagggcaagcagctcccggagcaggagggtgacgatgcagagccccacgctgcttgggaggtcactgcagtgatcctcactggctcacccgagaggacttcgttggcagtcaccgcgggtggagattctttctccgccgcttgccagaacgccgcactccttgccatcggcactcttcaccagcgctacccggacgagttgcagcactcgccctaccgctaccacccttgtcgaggaggagcccgcgactacgccaccttcagggatgctagctcggaggatgatgctaccatcatgcatctggcgcgcatggtggaggcgtacaacgcggcccgtatcgacttccatcgtatggtgcgccgtgggttggtcgagaacaacatgaagatcctggagctgcgttaggagaatttgcagctgaagaaggacttggacgcggtggaggcgcagctgtgtcagctcaagatcgcccagggagaggtctgtcgccccaagcgccgccgcgtctgccgcagcctgaagatcaccgcccgcaagagtacctccaggcctgagcttgttcgtcagtccttggcatggacttgcttcgtggagacccctcgcgccgagcccacgccctcggttcctcaggaggagggagcctctggtgttggtagcacggaggatgtgctgttgcttaccttccgccctggcccgttgcaaaagtagacgagcagttagtaggcttgcgcgtgtgttcttctcgtttgtttatctgcttgagtcgtgtggggcatggttatgctggtgtgtggtataactgtgtcggagcctgtctttattttattggcataagcaacttgaaccttaatgaaccaatttaatagcagaaataaattcaaagaattatggtagtcgtgggtggttagttttaatagtcagctctctctgtttgctggttctgtatgggattttcagatggtgacaaccaggagaagcgcggttaccggcaaaggcaatcaccccgaaggcagcaaccacagcaaccatggcaggccaccttcaccttcttccccgccaccaccaccaccacctgacaccaaccccatcctcacccaaatcctcgcccagcaggccaacatgatggctgctttcctccaccacatccaaaatccgccacagcataatgctccacctccaccaccacccccgcaacattctaaactcgccgagttcctccgcatccgcccgcctaccttctctagctccaataaccccgtggatgccttggattggttgcatgccgcggggaaaaagttagacaccgtgcagtgcaacgatgaggagaaagtcatctttgccacccaccagctgcaggggcccgcatctctatggtgggaccacttccaggctacgcagccagaggggtagcctattacctgggcctgcttcaccgccgctttccggaggacccatgtgcccgccggagtcatggcccttaagaagagggaattccgggagttaaagcaaggcaaccactctgtgatggagtatttgcatgagtttaacagcctggcccggtacgccccagaggatgtttgggaagatgaggagaagcaggagaaattcctggcagggatggaccctgagctgtctgtgcgtctggtctccggggattatccggatttccagcgtctggtggacaacagcattcgcctggaagccaagcacaaggaactggagtcgcacaagcgtcgcttggcaaatttccgcaatcaacagggggctaaccaaatgatccgatacaccaatccctatccagggggatcctcctcgcagcagcagcagcaaccacgctccgcgccccgacctcaattcgtggtgcgtgtcccacagtcgcagcaacagcagagtcagcaaggtacccgtgcgccccgtcctcctgcgccagccgtgcagcttggacaaggccgcagggatgctcaaggtcaacaacgtctgtgcttcaactgcttcgagcccgggcactttgcggataaatgcccaaagccgaggcgccagcaaggccaagcgcctccccgacccaacaacggtggtaaggatgtcactcggggtcgtgtgaaccacgtgactgccgaggatgtgctgacaactccagacgtcatcgttggtacgttcctcattcattccatccctgctaccattttgttcgactctggagcttcccactcgtttatatctgtgccattcgtggagagaaattagctgagggtagaaaggcttaggaaccctctgctcatcaccacccttggaggggtaatgacagcaaagtattatagccctgccgttcctatagaaatccagggaattcctttcccctcggatttgattcttctagacaccaagaacttggatgtgatcctcgggatgaattggttggctcaattccaaggagtagtggatcgcgcaagacgcactgtcactctgtatcgggggcctgatcaaccagttgttttctttgcacccccaacttccgccggcagttcagtacttaatcagctaggattgccagaaatacccatcgtcagtgagttcggtgacgtgtttccggaagaactacccagtatgccgccccagcgagagattgagttccagatagatcttgctccagggaccactcctctatacaagcgaccctaccgtatggcagcacatgaactggccgaagtcaagaaacagttggaagagttgaaagaaaaggggtatatacggccgagcacttccccctggggttctcccgtgatttttgtggagaagaaagacaagacaaagaggatatgcgttgactacagagctctcaatgaagttactatcaaaaaacaagtacgctcttccccggattgatgacctgttcgatcagcttaaaggtgccactgtattctccaagatcgatcttcgctccggatatcaccaattgcgtattcgtgaagaagatatcccgaagaccgcgttcaccacgcattatggactgtatgaattcacggtgatgtcgttcggtctaaccaatgcgcctgccttcttcatgaacttaatgaacaaagtgttcatggaatacttggataagtttgttgtggttttcattgacgacatcctggtgtacttacaatcagaggaagaccatcagcagcacctccgtctggcattgggaaagttgcgggaacatccattgtatgccaagcttagcaagtgtgagttctggttgtccgaagtcaagttcttagggcacgtgatatctgctaaaggagttgctgtggatcccgaaacggtgactgccgtcactgattggaagcaacccaagacagtcactcaggttcgcagctttttgggtttggcaggatactaccgaagattcatcgagaatttctccaaaattgctagacccatgacgcagttgctgaagaaggaagaaaaatttgtatggagcccgcaatgcgagaaagcattccaaactctcaaagaaaagctagtttcctcgccagtgttaatcttactggatactcgcaaggacttcctggtgtactgtgacgcttcgcgccaaggattggggtgcgtgttaatgcaggaaggtcatgtggtagcctatgcctcacgccagccacggccccatgaaggcaactaccctacccatgatttggagttggccgctgtggttcatgctctaaaaatctagcggcattatctcattggaaatcgctgcaaaatatataccgatcataagagtttgaaatacatcttcactcagtcggatctgaatcttcggcagagaaggtggttagagctcattaaggattatgatgtgggaatccattatcaccctggtaaggccaacgtggtcgcagacgcgctgagtcgaaaaagcagttgcaacactcttggcgtccgtggcattccaccggagcttaatcaacagttggaagccctgaacctaagcatcgttagccatggattcttggctacattggaagccaagcctaccttgctcgatcaaatccgcgaggcccagaagaatgatctagatatgcatgggatactcaagaatatgaaacagggtaaagccgctggtttcacagaagatgaacacggaaccctatggaacggaaatcgtgtatgcattccggacgacaaggaacttaaacagttgatacttcaggaagctcacgaaagtccttattccatccaccttggtagcacgaagatgtacttagacttgaaagagaaatactagtgggttagtatgaagcgggaaattgcagagttcgtggccctttgtgatgcgtgccagtgtgtcaaggcagagcaccaacgaccggccagacttctccaacctctccaagtaccagaatggaaatgggatgaaattgggatggatttcatcaccggacttccaaaaacccaaggcagatatgattctatatgggtagtcgtggaccgactaaccaaggtagctcggtttattcctgtgaagaccacctatggagggaacaaattagctgaactctacttcgctaggatcgtgagtctccatggcgttcctaagaaaattgtatctgatcagggaagccaattcacttctgacatctggaagaagctccaagaagagttgggtacccgattaaattttagcaccgcgtatcacccgcagacagatgggcagaccgagcgtctaaatcagatcctagaagatatgctccatgcatgtgttctagattttgggaagacctgggataagagtctcccctatgccgagttctcctacaataacagctaccaagccagcatacaaatggcaccttatgaagcgttgtatggccgcaaatgccagacaccactattgtgggaccaagttggggaaagccaagtgttcgggactgatatcctgagagaagctgaagctaaagtcagaaccattcgggataatctaaaggtggcacagtcccggcagaagagttatgcagatacccgacgccgtaacctggaattcgcagtggacgattttgtgtaccttcgggtcacgccattgcgaggagtacacaggtttcagatgaaagggaagctcgcacctcggtttgtgggtcctttccgcatcattgctcgacgcggagaagtagcttatcaattggagctgcccacatccttgggcaacgtgcatgatgtgttccatgtgtcgc

SEQ ID NO: 12320 - DNA, 672 bp, Oryza sativa
gaaggtcgcgtcatttaaagtcgggctggcgagaccgtacttctttctgaatcagttaccgtactttccacccgtctccgaaggtgatggagtgggcgtctttcgctccttcctccacacatctttggttttggtgcggatgcgtccttcttctgagccgcttgctctagtttcttggccagtatgggtggttctaccggcatcttccaatagcggttgttaggcatagttgtttccttctccatgaaattgtgcataaatttcaccaggctgtccattttgggtggctccacttcgacctcttggatattctgtgggttcggcccatactttattctgaccatggagtattgttccgtcctcggttgaaactcaaacttctcttccttgccgttgacgtggaacgggcgcccccaaggatgagcggcgtctcttttcccgtgtccatgtccagcaccacgaagtcaaccgggataaagaaatcccgtgtcttgactgacacatcctccgctatccctgccggtaacggactgacgaatcagccagttgaaggcgcatcggtgttggtgccaacactgtgaagttgagtctatcgaagacgtctttcggcatgatgctgacactggctcccaggtcgtataaggcctggtcgaattgttgtgccccgatcta

SEQ ID NO: 12321 - DNA, 11779 bp, Oryza sativa
ccctaagctctatattctccttgcggagtttcttcacttgcacggcgagcttatggatcgagggctctgacgacttcacctcatcttctgatattggccgggaacccgtcctgagatataccagccatgggtgttcactaggacttggatcaaaggtttttgagggtgaatgggagattgaatagagaggcttttgcaaaggaggaagaaagagaggaactagctcaggagagtgatccgatcgctctacctccaaactcgcatctaaacagactcaggacgggcgggggagtctaccatccaaaaatggggccgaacgggtgcgccctggttcggccgaaccctggtgggtccggcaggcctccattttctttcctaagcctactaatttctaagctaagcacaaacatgacaattataaagggttttaagcatgcataagatgagatcatcatggttcataattgattaattcaacgacatccacttcttcatctaaagtttcatttggctaaaggaaaatttttaagcgttgaccgtttaccttgaatatattacctgaatcgttgcggagagtgattgccccgtgcgaagaggtattgatgacgttgaacggtccttcccatttactacgcaattttccgtgaccgaaaagcttaacctcggagttgaacattagcactttgtctcctggcttgaatttcttgatttttatccttttgtcatgtcagtgcttcgtcctttctttatatatctttgcgttgtggtaggccttctctctccattcttcaagttcggtgatttgcattttcctccattctcctgctccgtcaaagtcccatgttccagtttctgatggcccagtatacttgctcaagttccacgggtagtcgacatgacttcctgtagattatctgatatggggacattccaatgggtgtctcatacgctgtccggtatgcccacagtgcgtccgacaatttatccttccatcctgtttccattttgttgaccgtcttctacagaatattcttaatccgtttgtttgatgtttctgcttgaccactggtctgcggatggtaaggagtggccacattgtgtttggctcccatctctcgtaggaggtcttggaaggttttgtcaatgaagtgagaacctccgtcacttatgaccattctggggataccaaatcttgtaaagatgatttctgtgaacatcttcttggcatgcctcgcatcagcggtgttgcatggcatagcctcaacccacttggagacatagtcaactgccaccagaatgtactcgcagttgcgagacttatggaaaggtcccataaagtccataccccaaacatcgaatatctcgacattctttgcatacatctctacttaatcgtttagtgacttgcaaattgtatgtgaggggcattgcatcgcgagcagtgattcctccttgcctctggcagcttgtgcatcttctgacgaattcttttgagtcttcgtacattgttggccagaagaaaccactttgtcaaatcttggcctgagtgcggaatgcaccgtaatggccaccatagggtgaggcatggcatcgctctatgatcttaagttctcatcagttggcacacatcttcatagtaagccattggagcagacccgatataggtatggctcatcccatatatgacggcgactttcataattcagtttttgttgattttcccctggtggtatgtacttggataccatgtagtttactatgttggcataccacgggttggagtcgcgaaccatcatcagcatgtcgtctctcaagaagtcgtttatcggctgttcctgcgtgtcagtgatctgcagcctggacaaatgatctgctatggaattttctactccctttttatcttttatttctaagtcaaattcttggagcagcaaaatccatcttgtggtttagcatctttcttagtgagcaggtacttcaaggcagcatgatcagtatagattatcagcttgcctcccactaagtaagacctaaacttatcgatagcaaaaacaaccgcgagcagctctttttcggtagttgcataattcaactgagctccggttagagttttgctagcagagcagattgcatgatgatttttatccttggtttggcccaaggccgcaccaacagcgaaattgcttgcatcacacatgatcttgaagggcagagtccatccaggaggttgaatgattggagcggagacgagtgcctttttgagaatttcaaaagattttaggcacgtgtcatcgaacacaaagggcgcatccttggctagcaaattggtcagaggtctagcgattgtagaaaagtccttgatgaaccttctataaaagccggcatgtcccaagaagctgtgaattcctttgatgttcacaggaggaggaagctgatctataacatcaattttaacccgatcaacttcgattcctcgttcggacactcgatgcccaagaactattccttcatggcccatgaaatggtacttttcccaattaagtaccaggtccttctcttggcatcgttgtaagactttgtctaaatttcgtagacaatgaccgaaggtctttcaatagaccaaaaagtcgtccatgaagacttccataatgtcctctatcatgtccaagaaaatagacatcatacacatttggaaagatgcaggagtgttgcacagtccaaagtacatcctatagtatgcataggtgccatacggacatgtgaacgtagtcttactttggtcctccggatggataggaatttgatgatacccggaatacccatcaaggaaacaaaaaaaggaatgatttgccagccgttccaacatttcatcaatgaagggtagcaggaaatgatccttttttgtagccttgttaagtttcctgtaatcattgcgggattagttcattttgagcatttgcaacgaccgtcattcctcccttctttggcacgacctggactgggctaacccactcgctgtatggtacgggatagataatcccggcatgctagagtttcaagaccactttctttacaacctctcgtgttgcattattaagccatcgttgaggttccctggaaggagtactctcggggtcaataggaatacgatgggtgcaaagcacgggattaatccccctgaggtcttgaagcgagtagccatgaacagaacgatgcttttccaacatggtgagaagacgttgagtctcgttttcagagagcttgtcactgattatgacaggagcttctctgtcattgtgtaggaaagcatatcgtaggcctggaggtagaggtttatgctcaagcggaggtcgaggtgacggttccatgattggcaggtcgagagtctcaacgggatctgcttcttccttgataaaatcggggacctcatcttccagaagggcctcgggagactcgtgagtggggagctgcactaacctcctccgctgactcaatttatgggagggaatcggtcaaggcgatccttgctcgtgagaatggaactgaaaattcattccctcccagtattattttgaggctatctaatcggggtgtgttaatgagaagttgctcaatgggcagcccgattaggatgtcgaaatcttgaatttcaaagacgtggaaatccaagatcgcctccctgtcttcaaagcagacaggcacatcttgtacaatcccaaatccttcaatgatatttccgtttggatgtttgaagaatttgttagtcggggtcattgccttatcgcttaaataagcgaatgcaaaagactaggaaacgagattggcccggacagttggactgtagagaataccgacgtcgttcccttccagatggcaaggaatgattcggggagcggtatttatccgaattactttggatgaaagttctgcctcccttagccattcatcgctcattatggatgttaactcccgtacagtttctcgtaggaacccgagttccataggattaggaggtggcaaaggaacgggtggtttcctctttctaaaatagttcagggtattgccgtagtcttcgtcaaagccgtccctgaacagaattgcggcataatccggagtctgaatttcttcattctcgacagtcggctgcttaggaaccttctcatcaatcgagctagcagaagtggatggttcagtgagtggctcgatcgttagaggttcctctatcttggacatggatgcctctggctagggttcattggattgcgccatgaaggaagtattttctagaatgcgatccaaaattgtccttccttctgacggcgttttgtgcatgaacgatcctcaagcggttatgtccagatagaatgcagactccttatccaaacccgtatggaaatgttggagtagcacatactcgggtaaggacagggttggtccggactacactaaattagtgaatttggaccaggctgcaccgattgattcatttttgatctgcttaaaactgagaatttctactcgaatggcagtaatacgagtaactggaaagaaggcaagacaaaatctgtctcgcaacttctcccagctaccgcctacacatccaacggtagaggtgtaccattgctttgctctctcttgaagagagaacgggaacaatttccaccgcacagtttcttgtctcatgccacgaatcttaaggcatgagcaaacttgttaaaagtatcgcagatgatggtagagattttctagatcaaagccaaaaaaaggtttttccctaaccatactaattagttcgggacgaatttcatagccagttgtataaatgggctctgatgaaggaggtggttcatagaattcgccccgaggagcagacagctcaaaaagcagttgctccatggtcgagaagagtttgacaggaatacttctctaggatagcaggggtgaaggtaaaaaaaaagtaaaaaggatgcgaggatgaacagggttcggaaatgatcagcaaccattccccggcaacggtgccagaaatgcttgttggtatttcttatggtcactgataaaatctgtaagtgcacggatataccgatgtagcacttcccctacggagtattccaagggtatcgaatccaagggaacgtgtgtgatcagatcttcctccggttcatccaaggacaccaagcaaatgataggctaggatagagaggattttctagtgagaaacaatgtctagggaaagcttaactttaatcctaatgcaatacttcaggcactggcaacccgctgttcccaaatgtcgctctactacgtacccggacagggaggacttaagtgatctcgagggctgtcaccacctctacacccacctcaaacgtactgtgagatacgcagcaattactggataacaactacctaaacaccatgtctaagcaattaatatctaccttagtgtttataactcaccaaagcaatcaatatattctagttgattatagtgaacaataatcccgtatgctacttaggaactaaccaagagataattctcacaagataaatccaaattactcaagaagaatattatattgacttcagagtaataaataaaataaaagaaataggagaatattaccgacaactccggacttcttccgactccttctactctactctcttcctattctagtatacaatatagtacaatagagcctcttataattcatctcaagcttgggagtgtgtgttgaagtgagtgagctgatgtccttatataggggtaggtacgattggcgaaggggaaatgtccgaagtgcaatccaaccgtcattagggatgcatctgggacgtccacgccaaaccccacatccaacagtggaggtggtggttcggccgaacctgggctgggccctcctggcctggccatcagctcatgttccccccggtcctcctctattcattcttcggtattttgggccgatttactgatgttttgatgaagttcacaacccatccttgcaggggtacacatttctcctcactttagtctgattttcctcccatcatcgaggtttatcatttgcaaacaaatatataccaacacatatggaatatgtgagattatgtacctatcactatgttggatgttttattatctgaactttatgcagatgttggcggtatagaattgacatttaacagccgccaacagttttctaagacctttcattagcagctcgctttttgcctaaagcatcagtggttttagcttgcgcaaagacgagatctttcaaggagggttggttacagaaattactgttattgttacctccttgatagaataggcgtggctggttccaccactgacctcattgtggatgatactcgttgttgttgttgcccatgtacatcgcctcttcacgggtttctaggcaatcaatcccagagtggcctgtgctgccacagactgttggtatttcttacgatcacggatagaatccgcaagcgcacggatataccgatgtagcacttcccctacgaagtattccaagggtatcgaatccaagggaacgtgtgtgtttatctcctcgtcaggttcatccgaggacacaaagctaatatgggcagagggtagagaggatttcctaatgagaaacagtgtctagggaaagcttaactttaatcctaacacaatacttcaggcactggcaactcgctgttcccagatgtcgctctactatgtacctggatagggggcactgaagtgctcttgagggctgtcaccacctctacacccacctcaaacgtaccgtgggatacgcagcaaccctggagagtaattacccagacaccgcgtccttcaaacactaaagcaatcactacaaataaatggactatagggaacaatgatcccgtatgctaattaggaactaaccaagaagtaattctcactaagaaaatcttaattactcataatgatatttctattaaagcagagtaataaacaagatacaaaagtaagaggagattaccgacaactccgggattcctccgattccttctagcttactctctccctattctaatatacaataaagtgcactagagcctcttgtaattcatctcatgctttggtgtgtgtgaatgagggagaggagaggggtatttataggtggagagttgcttagagagagtggagatgctccaagcatcatatgagcatattccttctagcttcatctcctcttgacaagtgtcctctctatgacagtttccaccggtagaaacggccacaaccatcattgggatgaggagtacaaccgtcataccgaatatgggctggactgggccagctaggggttcggccgaaccctggttggctcccctggcccacatctttcttcaggatgctgacatgtgggctccacttcatgatgctccatgttttggctccaaatgattgcacattttatatgttgtagctcaaaaccatgtgagtccatcagcacggaatatatttccattctttatcctcatcctctcccaacgttggtggttgatcacctgcatacaaatatacaccaacactcgtggaaattgttataaataaatcctaccactatgttggatgtttcacatttatggttttctgcaagtattgacggtgttattttggcacttaacaaccgtcaacaaaactctccacacttagctcattactcgtcccgagtaaaggttaaggattaatgtggaataaaatttcccaagatacaatacaagtacacaaattattctaagtcatacctgtacctatgaacctttgccctatctaacttaccatcttgggaaattgatgaatggaacggtcatgattcaagtccttctttttcctcctatcaatctgttagggttttcatttattttcgcaaagtagctttactcctcaaatgaccttctctcagatcactcatgtggtttgatttgtggatcctcaccatgcatgtttgccgaattgtccctattctactaggttgtataggtggagctcggtagggatcaatcggggcatacctgcatcacatatatagcaaagccaagataccggacccaaggagatagcaagtcatactctctgatcaagaatgtgcatgtgtgtgatctgtgtatgggtatggagaattgtgtggatggaaaaaggaaaatagaagataacaactcctttgatatatctcctcctccaattttctctctttggaaatttgagagagtgcatggctatctttttttcttcccttttttttcatcatgccccatactttgtatgagcagatttttttattcatttttttctcttttgtttatcaatgctccatacttgtatgagcaagactttttttccttcttttgcatagccatgcctctctctatctctgtttttttttctttgaaagaattttggagaaaaaggcataaatgacatggagtatttattttgtggataatgggtaaaataaatgatggatgagggatgctaccttccagtgtagaagtttagcatagtgtgtgtatatggagtgtacgtgatcttgatcatgaaagtatgaaaagcatctcacacgggtcacaataatttgacaaagctcaatgtaatgcaagcagcctaaacatatatcaggattttgcaatgagaatcatatatggcctttgtaggtaataatatagtcagtgaggagtattgctctaaaagaattttttaattttcgcaaagacaaaatcccaagtatcatgacagttggacaagaatttcttttgtcataaccatatcacatatatcaattacttatattagcaaggttccctataatggatgtttgttcacaagtgacaagtgttggcaaagaataaaaagtatacatgattaatcataggaaaattgtattcagtttctttttatttgttgagagttaatgctttcaattttcatttggacttaaactaaattgtattcaaattttctgccaaagtttaactcacaaacaagggaggataaggaaggagacgcgcaaacctgaccacacggcgaacgatgacagaactgagccaggcatgggtcaaatgaacacttggttcgaccaacccaaccaagacttggttctgactgctaagttttgtgcgcggccgtgggcgggtgttcaacatattgtcatgttgagtcgatgctgttgcacgtcaggagttccgaaaagactcccccacacttgttttgtaccttgtctttattcaacaaaatgatggaaagcaaaatgggcttccaccggggtaaaataccggtgagccaaattttattcaagtaattctaggcgcatgaagtgcctaaaattacttttattttatttcacttttattttgtttttatttatatttatattttatatttttttatcattttttatggcagcaatagaggtgatgggtaacctagcagggtggacatatgtgacgcaatgatacacagggtgtttcgaattcttactagataggacttaccaagctttgattcggatgcaagaatgcaacacaactttgcatttgctctgcctggttccctgagcatctgtcttctcatagtccaaggagcgtggtatgaatgttgagattattatacacttccccttagttgtctttttatttcctgcagaaggtcagtggacaacaaataccggagggaccacaaaaagttgaaaagattttatcatagcctcaagattagttgttcacattcatgctaaaaaggaattggattgaaaacttaatgagcatggatcccataaatttgccataattttatttttgtcattatttttactttttactcgagagaaaaatgtttttttttccgagagacatttcttttattcttgaaaacaatttttatcaaacttttatttaagaaaaactcatatagggctgagataaagttacataacatagcaaaggagcatttgacaataggtcacggcagctaaggcgggagtagaccttgcaaagcagggcgaaccgggcttccatggcgccatcgacggtgaccttgggcttcttgttcggcgcgatcgccctgcgccgccatcggagagctttcgccgactcagacccggcctcgaaggggatggagtggtaaaaccacttcgacatccagtggcgagccaacttgaacatggcggcgttgaccggccaaagatcagagtgctcggggcgaacattgaagttcacgctcccgaacgctgtcttcttcgtccctgcgggagtgaccaccgtcttcgagtttacgttgcgtaaaaaatggtgccgtaaaaaatggttcgaacccagcggtccggcacgcccagtcgaagatggcgattcggacgagagccgatgggcttagttgagggagctccacctaaaaaaggcgaaggatctccgaaaacaacacgttgcacggaaaccgaaggccgtctcgaagaacacggcgaagaccaccgtccggctatcgccgggcttcggcacaacagcctttcctgggggaggcctgcttctccgccagcacgccggaggtgaccagctttgccaactcatcctcgtccacaagcgaagccccgagataggcggtggtgtcgtcatcaatcctgccgggatcagggcccgtcacggaagctgggttcggcttgcgaggagccatggtgaaaagtgtgggccgtgacgaaaagaggaacagtcgaaaggtactagtgactcaagaggaccgtgaagtgagagggcggaaaagagagagctcgcggtgaaaatgacgggggtgcggcggtgaaaagggggggatatataacccacccaagcgtcaattcgccttcccacccaatcgtaagccgccatgtgtcacgagggtaggcaaaatggtaaattcccattcattgagctacacagtgctaagcccatgaagggaagcctgtcactgtttattgcggcccacggaaaaaaataaggacggcttcgccgtttgcaaaaggcgaaagctaggaaaatttactaaccgtaaaaatacatatgcacaaagtgtacacatttcctgtaggactgtattataggtttcggcaggagcgtcggtcgaaagggggcgcctcataccataccacatggtttgcacggtctcggccgaagctcctaactcacccttgcccgtgaggggcttgttggcagtatgtcatgagacccttcgaccagacctgccgaaaccgtgcaaccagcgaggactatgaagcaaagatggcgaaggccgaagagtcgtgctggtatccggcaagaccaaatgcgtcttgggcgaagggtgtatgccgaaggatggagacttcgcaataacaagcccaactttgaggaggctcaaggggccatcccggccgctcaggcctgttcgccaatcggcccattagaggcccatgtatccaaattacactgtatacccaagcaaacgtccctttcataagggcaaccatgtaaattcccctgtaaagcctaaaccctaaaggggtgaacctgtaataggattataaatagtctctagggacatgtcaagggggatcccaaagaaaaatcttaaattaatacatttactgtttccaacactgtcggtgacatggggccgggggtatcgtgactagaggcttgggtagccgcggtcaccctcgtggcctgaccccctcgggggggtcgggctcgaaggtgacgtggccacccctccctctgtctccccgagggg

SEQ ID NO: 12322 - DNA, 2018 bp, Oryza sativa
aaaaaaggaggcccaggcctaaggagaggggaagagaaaaagaaaagaagaagaagaaaaaaggagaagaggagggcctgaaactctccctggctctccggctctcggtattcctcactcacagatccaccaaaacacaggagtagggtattacgcttctcagcggcccaaacctgtctacgtcgcctgtgtcttgtgcactttctcgctcgctgacgttcctcagatcgagggcgaagaatctcacttagcgcccccggccgaaccggcaaaggggggcctgcgcggtctcccggtgaggagccccacgctccgtcaaacactgttgagtaaccacgtccttcgacgtacgcagttatcgcttcgacaacactccattaaggaaagaaataaaaaagaagaaataaaaacaaaaatacgaggatgacctagactcgaataaattagcaacagttccctagcaacgacgccagaaatgcttgttggaatttcttacaaccatagataaatccgaagcgcacggaataccactgtagcactttacattcggtgtcatgccctgaagtttccccgttcttctttctttaaaagttggttgaataaatcgtccgaagaaattgttctaattaacctagagttgaatccctaattaataaatgcaattaatagtcagaaatagcgtggtggaatttttcttgagttccccatgtcctaatgtattaacaagatttttagtggaattttcacagccctataaataattttaaccaattaaaattcattaaccgctgtcacaacctgaattttcgtattaggatttataaattatttaataaattattaatagaatttatattaaatgttcattaatttacaagtgaagttaaatgtgggaaataaaatttcctaaatataaagcatggctggatttattttttattaaattctccatgattaattatactctctggaattttctcgaatttttcagagctcaagtattaattttaataatacaaagaatatttcagtaattatttaattaataaattaatcattaaatggtctggtttcaatattattaaatacttagagtgtccaagtatgttcaagatttttcttttaattatttgagcattggaagtatttttaacaattgaaagatcatctcattggttaatttatttggaaaagtaataagaattttcccctcagcttgggccgaattcagctcattctctcccttcctctcagacgcagaaaagtctgtttttcgtccctctcgctacagtgctccttcttctacctctggacagcgcccgagctctccagcctgtgcacagctgccgccgatatccttccaaatccgacctccccgttgctcctctttccaaattagttgcgggaatgggatcctctcaatctcctcttccttttccccaagaaatcactaaaagtttctatggaaatcttttccaatttcgcggttcaatctttccttactccggcgagaaccctagactttcccgacttttcccgtcgatttgggcccggacccgagctcccgtgcctatataaaggacccactagtcgtcctatacctatcctctcaagtcccttcttccgccgccgccggaatcgctctccccacgctctccttctctctccaagcgccggcgccgctccagccgcaccgttcgtcgtcgtctgtcgtcgctttcggtcgccgctgccgccgttggattcgcaagaaggagaggaagaccggcctccacttccccgaagacgaagacctctggaagtacctcgccgacaagaatccaagcttcgccgcctccggccgccgctgcagcagccgtgcgccgtctcctaggccgtcgccctcctgcgccgacacctccatcggctccgcaaggtcgagctctaccccgtctaccggttcccctccgccaagtctcgctggaagtcgctgtcaccgtgaaggccgagtttgccgcctcggattgatctccggccga

SEQ ID NO: 12323 - DNA, 2260 bp, Oryza sativa
ttaaagtctctatttatttcaactgtgcatttattttcgaatgtcaccgggtggtgtgaacttattcctttgttatggtcaatttgcattgattaccctatttcttgattaccttgggttattataatttgactagttgagctttatatattggttcagctagatgttagacataattgcttagccattcttagaaacattagtacacgattgggataactaatgttttactattacttaatgatggatatttaatgattagctcacgatggtcaatcgtgattggttaattaattaatatgctaactaaaacttgataatggtgggttgtgagcacatggttttgatggtcatgcacatgacaattaaggaccggttcacaagtttcagttgtgaaacattaaccgtgccaaccacaagccagcatgggcaacggctttatcttttgtatagcatggttcattgcggagcaccagactgagaagtggcggagataagcccacgggggtcgctggggagtccatgccttgtttataagggggtgattatgatccaggaacggtgcaatgctttgagttgtgttgtgcgaagggtactgtcacgatttccccctttgcagtgacgtggtggtacttcagggcatggtaacatgtgtggaatcgtgtcttgtgggtacagtggtacacctctggccagagtaaaactattcgaatagccgtgcccacggttatgggcgggtctaacaatgtctttcatgatagtctcacacttctcaccataatagatgatgctataactggtaaaatttgattagctcctggtttggaatggtatattcctggtttggagatagatctgtacagccgggtatggttgtttaggtttggttgggcctgtgcagcatgggtgtgatgttcagtgttgattaaaattgatgattaattgctctactattttacttctcttaaatgtttgctaaatgctgcttttgcaaatgagcctattgttaacaaccaaatttggtaatatcaacatcggagatgaagatgaaatcgaagcggactcgaagataaggtttttttcggaaacagagtaagaatcggctggagtccggatcggctacgactgggattggctaagtctgagtcagtctggttaagtgatacagccgattccgataatacgacccatgtgcgacattgggttcgagttgatgtgtttcaagatgattgccacgcatagatagagtcctgggaaggcaattgtatctattaattaggatattttatgtaaattccttagagataaatgtgggcaaaagtctgccgcaaagacttgtggtatcttagagtttgttagagataagagtcgtgtccaatatggacatatcttgtatttctcgggtataaaagaccccgagccctatgtaatgatgaacacacacgttcaatacaatttcggcgcatcgccactctttttgctttcgttttatttcaacgagttattgctttcgggttgagctgcatcggttttgatgttcaacaagaggtaaaacttgttatggcggcttgtgttctcgagattagtgcttccatctttatgatactctaatcttgtttatgtagtccgtcaagttatcatatatcttacataatccttgacaatatcgtcatttaacctacaatcggctaacatctgctaccagaaggcagccgattaggttaaataacgacattggcttagattatatgagatatccaccactctatgaaacatccagcggcttgatcgtctagatattgttcttcttttcatacttaatgctgtatcagttgagtttgatctattaagtcgtgcttaaaatttcaatctctagcctgcctactggttgccgattagggtagtatcggagtttcagccgatcttatctgatccaattgcttttgttctacatgctcaattaacatgttggatctgcccttcatgttaagatcttgttgcatttaagtatattagatttctgtttagtatattctctttgctttaatatcttaatataaagtagtatcggagtattagccgatacacgctagatctatctgatcggctatgctatgaatatatatataatctcattattaatatatatttcgatgtaagtgatttatactgtctcggcaaggtgaccgatctatcccaattacttgattcaagtatacatcgatataaggattatgtatcattgatatttacagccgat

SEQ ID NO: 12324 - DNA, 1593 bp, Oryza sativa
ctccactccctccactttgagccaccgcccgtggggcccacatgccgtgccctttcctctctcttgagtcgctgacgtgcggggcccacctgtcggcgccccccttgctgacgtcagccctggggatttattgcgccataattaattaaggccttttctttattagtaaaaacacagattatcttctaaaattcataagtaattcatccgagctccgtttaagtccattcaagtctcaataaattcataaaaatccctagaatctattaaaaatggttttgttctctgttacagtagtcttatagcgtgtttttcttttgtgctttgtttgtcgcgtagatttcggccgcttcgtcgatccgcggtttctcgaagacgttgctgtggtctcatcagtgcgagagcaaggcaagtcatgtattacatttgatcgtattgtacccaatttacaaatatcccgcatttctattaaatgttgcattcttttacaatatcatatgggatgggtcctattattcagccatatattgtttaccttatgccattgataacttgggtttcaaaatgattagatgttggtttaggaaatgcttagccatgcttagttcaactagtacacaaagggggatcacattattacatagactttgactattagcatagctttggattggttccaccgcaatggtgttagttaattaaaatacactgaatggtgggctgtgggtgcatggtttcgctggtcgcacccatggcagttaaggaccagttcacgggaaaccctgggagacttaccgtgctgaccacaagagggagtgggtaactgcttgatctgaagtatagctcgacactttcctaggcaccggtggcgatggtgggcgtgatggagttgggtcggccggggtgtccggttgtctagctgccggattcaccgcggcgcaagaggggaccgcccactgccttttgaggggtgggggtgaaaccttagcgtggtgtgaatggttaggggagggttatgcggagggtcttgtcacgatttccccctttgcagtatcatggtgatacttcggggcatggcgacatgtgtggaatcatatcttgtgggtacagttgtacacctctggccagagtaaaactattcgaatagtcgtgctcgcggttatgggcgatcaaccagattcactgtgattagtctcacccctagtttagtttaatgcacattcagcttagaaattctggttcatgaatttctaggcgtgacattcgggtaaccccaaacggatatcgaactcagggaacgtgtataatctatctaaggctaagactatccaagaacaacaactgaaggtaggctaggcaggctagagaggactttctatgtttttaattatctaagctgagtaaaacataatttcctgtatgatgctccggacaccgacccctgctggtctgccaacgtggttccggctatagctctatgatttatccgaatgcggaggattactgggacgggattcagggctgtcaccacctgccgtctacctctgacaaatctgtgggatacacaataaacaattactactctaatacttg

SEQ ID NO: 12325 - DNA, 6799 bp, Oryza sativa
aaatgggtttggctaaactggtggttcaaccgaacccgggatggctccgttcggctcatttttcctcgtggacactaattttgaggcctttagcccattggcatggtggattgggccatttggaggtgtttaattgggtttttgggtccaaaactccataagtttgtatatgtgtttgattatcctccttcatgtatatttcctctcaactttgttagtttgtcacctgcatccaaatatataccaacactaatagaaatgattagtaataaaccctaccactaagttgaataccatattttattccattatatgcaggtattgatagtcatatattatgatttaaggaccgccaatagatacgagcggcacgagtgcttctaaggcaatcatcttccaggacaaatcagagatttgtgcagccttgaggtgaggtttttggcgatttcgagctgggcttttgtggaggccatgggatcggaaccagaagaatctggtaccaagatgtcacgggctagagagttggaatgaggattgcgatgcagttgatatttgaacaaagtggatgggcgtggccctggacctcgtcggcgcaacgtaatttgcgacatatgttggaattggacatacaactcctcgtcattcaaaattcccaaaatgttttagattgcgctcggggtgcatggttttcatagtagcacctcggccatcataaggatcggtcttcgggcttctgtttcaaagcactaccgtacttccacatgtctaatgggtaaggcttagtttggggctcaacctggacatgaacaaaaggacacggatacagatgtcgtggtagtcgagatatcgtggcacaggacgggcatccgggtggtcactcctgagggatgtcctgatgccatggggctcaactataacctacctgtccggggagccctgtccgtaggcgggtgttcagtcggtactcttgttcatggctaggatgagttaggaactatgtcacctcctccgtccgtataccatggtggtatggtgcatgcggcgacacgtgaggaagacgtgtcttatgggtaaagatgtacacctctgatcagagtataatctaatcggatagctgcaccctcaattatggataagccgagcaatgtacccaagttagtggtttaattcttaaaacttgctaagcaactaaaatttggaatggatggcttgggttggcttgggacgagccgaggcccagcttaaggctacctgtccggtccaactcatcgtgggccttaggccaagataggtttgtgtgggttcactgccttgtttaataatactgtgaagacttaggttcgagtttacaaagtagttttgagcaactattagtggttattaaatgccaattctatatcgccaacatatgcataaagtccagataataaaacatccaacatagtgataggtgttaagtctcacatattccacaagtgttggtgtatatttgtatgtatatgataaaccccgaaggtgggaggaaaagcaactaaaagtgaaggaggatgcatatccatacaaggaggagctttgaacttcatcaaaacattgaagaattagcccaaaattccgagaatcggataaggcaagcccagaaagagaaatgggccgaaggacaggccaagggagcccagccagggttcggccttcccctggtttcggccgaaccacaattacagtcgtccaagctggggtttggcgtggacgtcccggatgcatccctgatgacggttggagggcactttggacatttcctattcgctaaccgtcattaactgtcctatttaaggacctccctcacttcacacacacttccaagcttgagctgaattataagaggctctattgtactatattttatactagaatatgaagagagtagagtagaagaagtcggaagaattccgaagttgtcggtaatcttctcctatttcttttattttgtttattactctgatttcaactgaactatcttcctgagtaatttagatttatcttgtgagaattatctcttggttagttcctaatagcaaacgggattattgttcactataatcaagtaaaatatagtgattgctttggtgagttataaacactaaagtagatattaattgcttaaacgttgtgtttaggtaattgttatccaataattgatgcgtatcccacagtacatttgaggtaggtgtagaggtggtgacagccctctagatcacttaagtcctccctgtccgagtacgtagtagagcgaaatctgggaacagcgggttgccagttcctgaagtatcgcgttaggattaaacttaagttttccctaaacactgtttctcagtagttaatcctctctatcttagcctatcctttgcttggtgtccttagatgaactggaggaagatttgaccacacacatttgttaacaccataatttggtaagcccgatgtcatcatcggcctagagtcagtatcggcttcagagtcttggaattggccgatgggagtcgtcaaatcgccagcagttgtgttcttgacggagtcggatcaattaaagaaatttatccagaagagtccgagctcaaggaggaatagtttgttagtttccttttgtctttaggaaagtgtgtttagtgtccgataaggacttcgtgttttcctgttatctttaggaaagtttctttcttgtcctacaaagactagtatctacccatgtgtataaatatgtacacccggggtcattataatctatcaatctctcgatcaatacaactactctccgcgtatcgccaccttctttactgaggtttttacttccatccggcggaacttggcacctgacgcggggctgcatcggctttccatctctggcgaaggggtaagtcctacgttccgctggccctggtgaatctaccgactacattggtgttgttcaagactgcatcgcttcgatctcttggatcgctctggtttggttgatatatttgcctacctgatatctcaattctatccctaattgcattctgtttagagacacatcggtttagttgggactgtctcggttaggtctgatcttttgtcttagccgatatatctctacaatcacaatactctacaatcacattagacagatctatcggcttatcgagtatgagattatcatatacaatctcgtgctgcatcggttagtttcgacctactagattgttgttgataatataaatcttactaagtcgataggttcatgctaatgttttattggtgtgctagccgataagttatctggacgtggcatcggcttataaggattgcatatacatataagttggatttagcggatgacaacaaaggtttattgatttatctaaccttgtggattttatgacatcggacctccagtcgatgtatggtttaaccatcggaacagtacttgttctatcatatcatattgttagccgattggtttgtaaaggattatattgttgttatattgcgtcatcatcagccgactgcctttatatcattatcttcattggacatattgtcgatagctcaaaaccctatcggcatcgactaatatcggctatcggctggaactgctccatcggcttgtcagccgatcggctcattgatatactatttgcatattttgtcagttgcaggatcaaactgacgggcacacccacatatcgtcaacctttggacctacactggagctaagcagatctcccaagccagtgtgtgtttttcgagtcaatttttggcacgcccggtgggacacaagttttgcacccaacatgtctgaagaggaagtcaataccaagaagtagcaatctcgcaagccgatggttgaaacacttcaagatacagttgatgaagcaattcatcgcgcattgtttaatcaatctggagttttggcggatacattacaaagtttgatcaaggtaacagttgatgagttaattattcaaaaaagtcagctcggggggtagattgaagaacaacatcagcatcggctcggggggcaagcacatcggtgtcagcatgatgaggcatatcaacaatatcggccagaaggaattcaaagatatcattatagggaagatttggccaatagaattgcaaaggtaatagaggagcagtttggaatcaatcctaaggaacatacttctgtgtatcggctgccatatgccgagtggtttgatagggttccattgccacaccgatagttccaaattactccaaattttcagggcaagatgatatatctacaggaacaaatcagccaattcttagtgcaatgtggggaagcaacggctgaggaagctctgagagttagattttttccactgtgtttgactggatcagccttcacatggttttcatcactaccatcgaattctattggaggatgggccaatcttgagaagcaatttcatgactatttctttgctggcatcgatgagatgaagcttttagatttgatatcagttcagcagcaagaaggagaatcggctatggaatatattcaaagatttcggaatatctgcagccgatgttatagtttgagcctgagcgatgagcagctagcagatctcgcatttcaaggattgtcagcacatatcagagagagattcttttgctacgagtttgatagcccggctcatctaatgcagacagtatcggctcatgaaagtcgactgcacgaagcaaaggaagatcagttttggagtcaccaagacaagaaatgagataagattgaagcatgagctttcatactccaaaatttggggcatgtgttaacgccaaaatttggtaagcccaaagtcatcatcggcctaaagttagtatcggcttcagagtcttagaatcggccgatgggagtcatcaaatcggcagcagttgtgttcttgatggagtcggatcaattgaaggaaatttatccagaagagtccgagttcaaggaggatgcggcatggcaagtgtatctattaattaggaatagttcgttagtttccttttatctttatgaaagtgtgtttagtgttcgataaggactttgtgttttccttttatctttaggaaattttctttattgtcctacaaggactagtatctacccatgggtataaatatgtacacccggggtcattgtaatctatcaatctctcaatcaatacaactactctcggcgcatcaccaccctctttactaaggtttttacttgtcatctgacgttacttggcacctgacgtggggttgcatcagctttccatctccggcgaaggggtaagtcctacgttccgctggccctggtgaatctgttgactacattggtgttgttcaagggtgcatcgcttcgatctcttggatcgctctggtttggttgatatatttgcctacctgatacctcaattctatccctaattgcattgtgtttagagacgcatcggtttagttgggactggctcggttaggtctgatcttctgtcttagccgatatatctctacaatcacaatgatgttctaaggccctctttgtttaggcttaggcttattggcctagacttttaagtcagtttattggcttatatgatttataagtcagtggatttaatgtcctaagtttagtggtggagtcatacatctatctcatataagccaaaaaagcttctccaacctagcttttggcttaatagtgttagagtggcttatggcttcaaaaaagccaaataaaaaagctgcttgtttgttttggcttagacttttcgacttataagttggcttataagcctaaacaaagagggcctaaatagatttgctatatccatcatattagatagatctatcggcttaccgagtattagattatcatatacaatctcgtgctgcattggtaggttcgacctactagattgttgttgataatataaatcttgctaagtcgataggttcatgctaatgttttatcggggtgctagccgataagttatctggatgttgcatcggcttataaggattgcatatacatataagttgtatttagccgttgacaacaaaggtttcattgatttatctaatcttgtggattttatgacatcggacctccagccaatgcatgctttaaccatcggatcagtacttgttctatcatatcatcttgttagccgattagtttctactggattatattgttgttatattgcatcatcatcagccgactgcctttatatcattatctacatttgacatattgccaatagctcaaaaccctatcggcatcggctaatatcggctatcgactgaaactactccatcggcttgtcagccgatcggctcattaatctactatttgcatatctaccctatagttaaacaaatgattttattcatttactcattcatcatatcacatatctaacggtgtaaaatcatccgatgtgttagatcggacgtcccacatgggcgcgtgtcggtcctcatcctctcccgcacccccccccccctctctctctctctctatttgccgcaatcgacgcgcctcctccgcatcggcgcgaccgcgcatcctctcccgcatctccctctcttccggattcgccgtgcctcctccgcatccctcccctccgggtcaggatcgagcgccgcctcgcgcaggggttcaccggcctgctgcaagcgcatcctccgcagttcccgtggccggcggcgtcgcacaagcggattcccttcaagatcgacctccccgtggtccccttcggcccctccc

SEQ ID NO: 12326 - DNA, 19667 bp, Oryza sativa
cacattcaatactatggtgatcatataatttggagtacatgtttagaaaaaaaaactaatgcactaaacacaatgatgatttgaatgaatcaattattgctgacgatcgcatctgaatcaatggtagtttacccttgaatgatttgtctctgttcttctatgtttggtggtggtggtattatatacatgtttagacaaaaaaactaatgcagtataatttgcatatgttcttctgttcggttaccggaactatcataatacatttattcgtcaccattttctgatgcttgttatataaatatgagcatctctttcagtgatatcctctaaatatgtttcctgtgacatcctctaaattcacaatggaaacgtgttactgattcgaagtctcaatgcagtgacatgtttatttggacacatgtataattggagtacatgcatttgtgataagtttccttggtaaatgcaatgtgttcttcatcattgtcaattattctaggaggccttgatatgtcagttaccggattcatggccattgttccacaccctaggaattatttgaagggcaatatttttatgaagcttaaagattgaatttgaatccatctgccctggcttgaaggtgaacatgattttatttttaagattgcattttagttactcttaacatactccagttactcaatcatatacatatctgtttcacacatgatctatttatgcacttttgtcgcgtttagtctaaaacgatgctgtcaaattttaaaagggcattgctttactaaattgtggtgtatgtagtattagcatgtcaaattacatttatgcgtttcttgcttcccgaccatatgtcaaataactgaaagtgttagtacttgagttaacccttttttcatacttatgccatatagcaccctaattttgttcatgcgatcagaggataaaatattaagaggattctttagtatggctcattttattgtttctaagtttagggttattcagacagataacactttagctttctatataatattggttttacaactttgtctctcgaaggttttttttttttggaacgtattgatggttttcctcataatatgctcttgaaatccatcttgtccctgttcaatgcagtacaatccaaatattatggtatatcaacagcagcttcagtctgggacagagcaatacaaggtcctccctgtaagtttagtatgaacagtgcaatcaaatttataagtcttccctatcaaaatttcagtatagccccatttgtgctggtctgattaattatctttgaaatgatattctgctttgagattaaattacatgtaactaacttgctttgataccttcacaagtcgtgaaatggtttagctgtacttccatgtttgggttacttgtgtaatatttggtaggctataaacccatttgttgtgcctttttttttattatattgctcaataaagatagtcaatcaatgtgttgtaaataataagggaattggcttgtatcatttgtttcttctatgctcaagatcctgaactgttgtgcatgtatcatttgttgccactgagtcattatttggattcatcagagaacatccatcattttgattaccagactatggactgatttatgccatgcttgctaattgatagagggacatttgctacttctgcatataggacagataattaaactttttgtgcgctgaaatgctctttgtacggtgagtatatgacacgctaaagatgactgaaattaaacttaggatacttctgtttgcaactataagacatgagttcttttgctatatttctggataggtggagtaggttttatttttaagagtttggtctgtggattttcgtctgccgatgagtctccaatgtttgatacagtgtagcccatgagcagctgctgttttctgattttttttttcaaggtaatgtagctgctttgtgtatatgtgtttgtccaatagtgcctgccattccctttggatggtttgcattgcagatgaattacgattgccatctcatgttgctatggcactatgctaagtgaatcttgttcacttcctttattcaagcacaaggaatttatgtatgttcattatgaaatctgtaagttagataatgaacatacataaattcactagctgttgtgttatcacattgattgtaacatcaaaacaatcaactactagaaaatactaaagtttctaaatggttatcagaacacactggaatttttttatgggcttactgttccacactgcattccttcacaattgaagtttgccatctcttatggcactcttttagcttgataatctgaaaaaatagatgactaaatctatagtttccttttatccaggaggagatttggcttttcagtatgcttcagtaaggatttagcagatggcaatctttgctggtatgtagagtatttcattaggctaatcgcctatttgttgatgatcataattggcacataaattgataaatttgtattgatgattctactcattttaaatgttatatgggagcatcctttgtttgataaggaaaaatcagtgttctttgcatattcaattagagaagagcatgaatactgttgttactctaggaagaatgcttatattatgaaaggagcgctaacattgcgttgagaaaacaacaggtgatgttatctttttctgatttccttatattgcagtctgttagcaaggagcatcaagagttcctcggccttgtcgacaaagaggtataatgtgaacttgtaaattgatattagagtgacaattattcatgcagttatcttccatttttattgcaaatacttgggagggctcaataactcttggtctttgttgaatgcagattgaattatattatatactaatggaattccgccggcggtgtgaggcccactcagagtaggatttggagggtgcagaactgtttttgcattgccaatgaaaggaggaagaccgcctcaaagagccttgtccccatccaccaacatggtcatgataatcgttgacatcgaccaagatctctccagggtaagtagaacagcactaaaattaggattagcatttctagacaccatgttatttcagaaattgattagttggaatcttgtattcattttgctagcctgagtgcctaacttagtggaaatatattggaaaagtttctccatggcagattgaggctgttatttcctgtagatttaggtttcgctgtaaatactgaacaattattgcaattttctatttgtattgagtacttgggtggttctttctatcaaccaaatcaatttttattcatcagtgtagactctttgaactgcaattgttgtgctgctgatatgtgttatgtaggctgcagcagaaggtcaattttcccttttgtgaggtgccataattttgaaaatatgttaattttgtcaattgcttgatattaagtggagtatctcctttgtatgcaccaaccaattttggagctccagacaatgaaacgatagcttcataatatccatgaaaaagtgctattggatgaatccagtaaagatgtgttttctctggcattttgaatattgaagtgtgctgatgactttgtaattactaataatgatgcaatgcataaattctatggccggttctgttacttctttttatttggacgtaatttgcttgaaagatttttgatgtggctaaaggagaaatttttttaaggcatttggtttctcaggagtttaggagttggaaccatgcaaacatgcctcatgctaatgtcttcctgagctttcagaaatcgaagttatttctagcttaagatgatgttggagctgatcctggtgctgttagagaggccaatctattcaggtccagcagtttacatcaagatgatgttctttctagcgatgcatgtagtgaccattgatgtttcgattgcttgaggcgaccctctttgtaattgtgaaaaatgtggtgttatgaaacaaaaatatagatttacatccaggagataaaattattttattctgtattttagagtaacacggtatagctactggtgctatccatctctggacctgattttttttctgcatgatttaaaatttgttatttaaactgaacttttttttcttgactttaaaatttatctcattttatactttcaagatatataaaatattttgatttttttaattttgcattatcaaatattgtcgtagcgttagcacgtgcatattactagtcttgtcagttgcaggatcaaactgagtggcacgtacgtatatcgtcaacctttggacctgcactagatctaagcagatctcccaggccagtgtgtgttttccgtgtctaaaacgttcccttggattcgatacccttagaatacttcgtaaaggaagtgctacatcggtatatccgtgcgcttgcggattttatctgtgaccgtaagaattaccaacaagaatttctggcaccattgccggggaattgttgcttatcattttcgaacccagttcatcctcgtatctcttttcattttttttattctacctttacccttgctatccagagaagtattccttttaaattcttctcgaccatggagcaatctcttttcgagctgtctgctcctaagagcgaattctatgaaccacctccttcatcggagccaatttacacctccttcatcggagccaatttatacaactagctatgaaattcgctccgaactaatcgtatggttagtgaaaaaactttttctagccttgatctagaaaaccacaaccatcatatgtgggactttaagctaagtctgctcatgccttaagattcgtggcatgaagcaagaaaccgtacagtggaaattgtttccgttctcccttcaagacagagcgaagcaatggtacacctctaccattggatgtgtaaacagtagttgggaaaagctgcgagacaaattttgtcttgccttcttcccagatactcgtattactgcccttcgagaagaaattctcagtttccggcagattgaaagcgaatcaatcggtgcagcctggtccagattcactaatttagtgcagtccggaccaaccatgtccttacccgagtatgtgcttttgcaacatttttatacaggtctggataaggagtctgcattttatctggatataattgctggaggatcattcatgcataaaacaccgtcagaaggaaaagtaattctagatcgcattctagaaaatacttccatcatgacgcaatgcgatgaaccccagctagaggcatccgtgtccataatagaggaaccttcaacaatcgagtcacaatctgaaccttccacttccaccgactcgattgatgaaaaagttcccgagccgccatccgttgagaatgaagaaattcagattccggatggtgcctataaaaggacatcaccttctcacttcactcacacacctcaagcaatagcttctcatttgtctcaagtttagtttagtactatctagctggtggaataggaatagagtagaaatcaggagttcggaagccttcggaagagtttgggtatgtttctattagcttttctcttctcttttgtaagctttgtacttttattagaatactcttctaaatacatttatggtattgaaatactttccgagaatatgagcacctactttacattatgttcatgttatactaaatatacggctagcttatctgggagatgctttggtgtggatataatgtttgcttatgcaattactctatgtcataacgatgatattagagtagtatctggtagtttagacgtattgtctagattacgggatatcattatttggggttatatattgcggatgagaggtgggccactgatggtgacagctcagtacgggtattcctccgcgccggtatataatcctaagttaattccatggggagggtattccttcgtatttagccccgattgtatggtcatgacgggctgtcgtaaggaactcggcagtcaggggtggcttctcgaagtaccaggagggcatcggatagaatgtcggttaactagaatgtatgtatactatgtatattagaagtataggaatagattttcttcctattttctttccacttagcttagattataaagtatgagaatgagtagttaacgcttgtgtgtcactctacccttggattatcttaacccctgcttagaatatgattatcaccctcatatataaattattagtcaatgttctctctacatgatattcccacgggataaaataaatacgatacccttggaatactctcgggtgaaatgctacaatggtatatccgtgcgcttgcggatgaactctgtaaccataatataccagaagtgtttctacgccattactgggaattatatttctagtaatgtcgttaagaaataccaacaagcatttctggcgccgttgccggggattatatttctagtaatgtcgttaagaaataccaacaagcatttctgacgctttcttccggagcgtcaggcctcaagtagttgctccgcagaaaactctaccgacaaagaaaccaaccgtaccagcgccaccgacgttcaagactatggctaacaagactctccacgagttcgctgctccctctgctgacaatgtggtcattgggccacaggtgaacataggcgacgtggatttcgacttgaactctagcctcatcacgatggcgcaggctagcccgttttgtggcaagcctaatgaggatgccaatgctcatctgcaacagttcctgaagatctgtagcatgtacaccatcaagggcgtcagtcccgacaccatcaggctacgactatttctgttctcccttcttgagagagcgaagcagtggttctatgccaaccgtgctgctgtcaacacctgggacaaatgctctagggcatttctctcgaaattcttcccgatgggcaaaaccaatgcccttcatggaaggatttccagtttccagcagacaagagatgagtctattcttgaagcatgggagcgtctacaggagtaagtggccgcctgtcctcatcatgggatggacgactagctgatcctgcagaacttttacaatggactcaccccgatgtcccgctatcacctcgacgcggcagctggaggagccttcttctctaaaatggttcaaggagccgttgaactaatagagaagatggtctccaatatgggttggaacgaggaacgacttcagatgcgtcagcgaggcatgcacaccgtcaaggagtcggagttacttgctgccaagctggacctcctcatgaaatgcttggacgaccacgagaaacggccacaaggcaccgtcaaggccttggactctcacgtcacatgtgaggtctgcggcaacacaggtcattctgggaatgactacccggaaacccgtgaggaggcgatgtacatgggcaacaacaatgggtatcgttcacaaggaggttaggggtggaaccaaccacgcctatattatcaaggaggtaacaacaacggtaatttttctaacagccctccttgaaggatctcgtttttgcgcaagctaaaaccaccgatgcattaagcaaaaagcttgcggccaatgataagatcctagaaaacattaatgtcaagttagatggcttcgcttctgcttttcaaaaccagctgagcttcaataaaatgatagaaacccagctagctcagttggcatccttaaaccctgcaaatgaaactgggaggattctggggcgacccgactcgtgaggaggtaaagtcaaggcgatcacgacgagaggatgtaagtccactcgtgatccgctatatcctaaccctgtaggaactaacgggatatcaaaacaagcgccatctagtgactcggctgacaaagaggttcagccagagaagaccgtgccgcaggaatactgcgacacacggttgctgccgtttccccaacggtgtaggaaaccgtcagtggacgagcaattcgctcgttttgttgaagtaatccagaagatccatatcaacgtgtcgttgttggatgctatgcaagtaccaacatacacccgttatctcaaggacatagtcaacaacaagagaccgctcccaacaacagaggtggtcaagcaatgcagcaacgtgatactccacaagctcccggagaagaagaaaaatcaggggtgtcctacgatcacttgctagatcggggcacaacaattcgaccaggccttatacgacctgggagccagtgtcagcatcatgccgaaagacgtcttcgatagactcaacttcacagtgttggcaccaacaccgatgcgccttcaactggctgattcgtcagtccgttacccggcagggatagcggaggatgtgtcagtcaagacacgggatttctttatcccggttgacttcgtggtgctggacatggacacgggaaaagagacgccgctcatcctggggcgcccgttccacgtcaacggcaaggaagagaagtttgagtttcaaccgaggacggaacaatactccatggtcagaataaagtatgggccgaacccacagaatatccaagaggtcgaagtggagccacccaaaatggacagcctggtgaaatttatgcagaatttcatggagaaggaaacaactatgcctaagaaccgttattggaagatgccggtagaaccacccatactggccaagaaactagagcagccggctcagaagaagccgccatccgcaccaaaaccaaagaaggtgtggaggaagaagccaaagacgcccactccatcacctccggagacgggtggaaaatccgctaactgattcagaaggaggtacggtctcgcaagtcggactttaaatgacgcgaccttcgccaacaggtaaattggtatgtatccgcatatttgctttcaacaatttgaatttttgcatcatcatatatttgaacttcaaaattgcatttaggatttttgaattttgaggaaattcttcaaatgaatcttttagagcaaaccgaaataaaattttcaacgaatattcgctatgccaagaccacactgatcattggaatccaacggccgaaagtggggccggttgggcccaccaggggttcggccgaacaaccggccaggcaacggttacctgctacttttggcaaggtaacggctagtgggtcccacatgtcatttctgactgttatgggtaccctataaaagccagccagccgggagagggaactccaccccatttcaacacattttcattccctctccaaagtttgctctcaagttcattcaagttttgattgtttccctcaaattaaaatatttagttgcatgtatacaagttgctttggtgaaactaaccggcgtgtgaaattcttgtcatctctaacccccgccgagttactccgttcttgctccattgtgcagaatgaggaggcgactgtctcgtctgttcaaggggtccggctcttcatcaagtcgtcatgacgagtctagtactcattcatcagcagatgttttgatggaagacgccgaagctccgcgacgactcctgaacgacaccgacctcgaccttgtcagtgatcggaagagacaagcctactacatgctgagcgaccgggagtatgctcacacgcgagaatactcaccggagctgctgaaaaagataggtattgaagttgaatttcgttctatttggaaagcggttggttggcagagatttattgtggtagatgagcttggttctcgtttgcttactttgcaatttctgtgcactatgaaagaaatagaagatgaaatttcctttcgttttttccataaggagtacacacttacatggaaaggcttaagtacacttcttggttttcacgattcctgtaaagtcgatctccagaaaggaatttcagggttcgagaaaaataggttttgggaagacatttctggtgctccaatttgcaagaaacctagaacgaatgatattcataatcctacacttaggctcatgcacaaatggattactatgactttgtttcctagaagtgatatgagacccattaggggagatgaattaattatcatgtttgccatggttagaaaaatcaaaatttctcctgtgaaatgtatgataaggcaatggttagaaagtataaagttctctgctcctgttgagtgcacttctctgattactcggatagcaaaagggcttggggtcgttagcgaccaaattgcttttatctcagccgctcgtccgcgtattgatgaggcttatctagtgcaagggcatattttgaagcatggagcagatggatctttgatatacttttttcccggttgtacaaataaaatcccgttgccaagtacggggtatcatttgtacaactgccatgaactaaccattctcctgcagaccatacaagaatctcgtgcaggtggaacatatagggagacgcgcaacatgataaggaacgaacaagaaagttcatcatcctcaacacccgtgcagatgtatgaggcaggtgttacagaaaaactcaaagactgacattactattccttaccatgtttttgtcactgacttcctgttgcagcttcgcgcatactgcaattcccacatgacatcgtgtttcatagaaatgttggtttgcactatctgaatatatccttgttttatcctatatgttaattctgctagctatttccttggaatgatttgaagaaatcattttctcttgaaagggaactgtaatgaaaaaaagaactaaagtgataaattccaatttaaaaccttacatgcgattgatgcacaaaaattatcacataatttagttgcaaaactttctctggttaaccttatatattacactaattgaatgaactgaatttgccagttaatcaaaacatcttgtggctaatctcgaacaatgtcaaattagattacgctaaacaaatatagttgtattcgtgtttatatcctttgttaattctctttccccagtagatgatatgtgggaatagtgtatattttgtcaaagataactacatgaaaaaaatcaataatttgtcatactctgtcacaatgtgttgaattgtagttataaaattttatctagtagagcggttaattttatcgtgcaaatgatataaaactaaagttacagaaatatctcccagctgtactgctggacaaagggtttttaaccccggtttataaccccctatagtcccggttatgcaaccgggactacgaatacaggactacagatacccatctttagtcctagttaaaataaccatgattaaaaatatccatttttaggcccgattggtgttaccaaccggaactaaagatggagccaggccagctccagttggtagattttttttctttttttcattgttttaactttgaatattcatttcactacttccccaaatcatccccaaatcgatcatcgcagaaaaaagtatcatctctaaatctctaaattgatcatatccaaatacatcacaaattctaaaaaaaacatcacaaatacttcacatattcacatcacacacaaatcaaatacatcacagattatacatctcagatccatgcaatgaatcacaaattctcaaaaaaaagaacaaaaacaattttgcgatgtcgctgccgcctcctctctggcagaggcgccggccgcccgccgccgcccgcccgtcctactcgctcgccctctggcctgcttgcttgagaggataagaatagagagaggaaagggagaggataagaaaaaagaggaggataaagaagaggtgattgctagaggataagtgctagggattatatactatgcaccgatttttagtcccagttggtatttccaaccgggaataaaaagaatagggggcatacacttttttaaccaggactaaaaacgatctttagtaccaaccagactaaagatcataaaatagctatgggcttttcaaccggggctaaagatgatttttagtctgggttctttttggaaccggggctattaattgtggttttcggctaagccaacaaagattagttctccagtagggttgatagcataaactttagatggcacatgtgttatatcgtggtcaatattatattatctggttcttattatgcatgttggcaaagtattctcagccattatccatttctttttattgctggtgtcagtttaaattaattatattagtgctctttcaccgtgtcgtctattcaacgcgtgcaagtatatgaatatcaaacaattaataacaacggataatcagttcattaaaactcatatgtgctcagcttctataacaacggatatctatccaaagatcaatataattaatttacagtaactatgtcatatatatctgaacttttcatattggtagttaattttcaatatcatggaaaacatgtctatttttcccctgccagctgagatttaccagcataatatataagaagtttcttaccatccacggtaccacatatatttttatgataatatgtccttagtataccctcgggtatccaaaatattagaaaagtatcttaaatttgtatgagaaaatatagtacattgtactttctgaagaagatctaaatgatcattaaataaataaatatttaatcaacgtgcaaataaatacaaatatttccacccgtactcacatatggtatggtaagtggcaaagagtaaatgaaccctgtgaatcttattacctgactgaattggtcaggttagctagtataacatgcatagcctggttcgtccttattgtggttttccacgtgtttgtctctgtgtttgtaacatgtcgtgctgatcaggtttcaactatgaggaaggtagagctatctgcatgtacagacacaaggtgactgtagtgcttgggaagtgaggatgaagatgtcatcttccctcacctatctacaaattaagctcttagtactgacacaatccagcagtggaattaaaattaaaccatgcacatgcatatgatgccagaacacgctctctagtatatatttcctctgatgcattcctgcagctagcagtacttgcatggattccattctctacagtacatattcccttctcatttctccatgctactctttgttttcattttctcttcccaaataaaaaaatatgtataccagaagacattcctatatttcttttttggttcttgtatttatcatctgatagaatatacagtttcagtcgggctctgcgctcagtttgttcccttccttgcgcagccttgaggacagacacaagccccatccctagccttaacttttccattgcttaacgagaccaggcaaagtttccctgtgatctgcagagcatttaacaacaagacagtgattgcatccaggaaagtcacacttgtgtaagaaactgagaagaaaatgatggggccctattgggtactattattggttggaggaactaattaatagtactacagacgatcagaatatgagtcagttgcatccataaagacaagcaaatcaagcctctttctaacttccccggctagcttgcagctcttcttccccccttctgctccggccctctcatagctagatcctcacatgtactgctgtcttcctcaatcctgggttcagatgtttcacctcttctctatctagccctctttccatcatctttggcacctgcaagagctagagctgtaaaagttagttagtgtcatttgatggatccagcaaggtactggatcttggccaggaggaagctgggagatcagaaggcgcctctcttccccacccctcacatcaccatcggcgccggcggcagctccacctcctactacgagtcatgggaggaacgtgccttcgcggaagactccgcagggcatctcgggggctgcatctggccgccgaggtcctactcctgcagcttctgcggccgtgagttccggtcggcgcaggcgctgggcgggcacatgaacgtccaccggagggaccgggcaaggctcaagctctctggggttgtggaggacggcaccggcggcgaaagccacggcatgccgccaaaccaaaactacatgatacaaccatgccctccccaaattggcaccctgcagcacgcctacagcccaaaccctagaagtggcagtattctcgctgctgacactaaccctaattccatatgtgatgttgtcgcgtaccctgctagatccttgcttcaagttgcagctgctagaactgccttgggcaaacaagtcctgaacgcccctcttgtctcatcgaagtcgccgtcggctggtagagaacatggtaagagggagacgttgtttcttggtgctgttcgattggcacaggatcatgacacggtgagttctaatcttgacctgcgtgttgggaaaaatgaattgaagataactactgttttggggtgccgatcaagaagggactttatgtacgataacgaccgcgcggatgatgaaaagactgttgaagcaagtcacaagaaaagaagaatcgatttggaggtaaaccccctgattctaacttcttcaaccagtaatcatcaacagcaagatggtggtgatgaccaacatcatgaaaagatactaaaactttatcgtagctcctcggttgaagaactagatcttgagcttagactcggggaagccccaaaagaacagtagatttcatatccactgttgtatctcaacttgattacaaatgtttaatttgtatttattcaccactcgtgtttcattgaaatgttggtttgcactatctgaatttatccttgttttatcctatatgttaattctgcttatttccttggaatgatttgaagaaatcatttttctcttgaaagggaactgtaatgaaaaaaagaactaaagtgacttgttatatgctgtgtaagaaggtactgaattccaatttaaaaccttgcattgatgcacgaaaattatcacataatgtagttccaaactttctctggttaaccttatatattacactaattgaatgaactgaattgccagttattcaaaacatcttgcggctgatctcaaacaatgtcaaattagattacgctaaacaaatatagttgtattcttgttttatatcctatgctaattctcttaccccccatagatgatctgtggaaatagtgtatatttcttcaaagataccacatgaaaaaaaatcaaaaatttgtcatactctgtcacaatgtgttgaattgtagttataaaattttatgtagtagaccggttaaataaatatttattatcattgacagaaatatctttcaactgatatcagctgatagcataaactttagattgcatgtgttttatcgtggccaatattatctggttcttattgtgcatgttggcaaagtattctcagccattatctatttatttttattgctggtgtcagtttaaattaattagtgctctttcaccgtatcctctattcaacgtgcaagtatatgaatatcgaacaattaataatcacttcattaaaactcatatgacctcagcttctataacaacggaaatctatcaaaagatcaatattcaattacagtattaactatgtcgcgtatatatctgaactttcgtattggtagtttattttcaatatcatggaaaacatgtgtattttttcccctgccaggtgagatttatactagtataatatctaagaagtttcttaacattcacggtaccacattttttttagtgataatatgtccttagtacccttgggtatccaaaatattagaaagtatcttaaatttgtttgagaaaatatggtactttgtagtttctgaagaggatctcaatgatcattaaaaaaataaatatttaatattcaaccagcaagtaaatacaaatatttccatccgtaaggagtaaatcaagcctgtgtatcttattacctgactgaattggtctggttagctagtataacatgcatagcctggttcatccttattgttgttttcctcgtgtttatctctgtgtttttaacatgtcatgctgatcagctttcaactatgaggaaggtagagctatctgcatgtacagacacaaggtgactgtagtgcttggcaagtgaggatgaagatgtcatcttccctcccctgtctacaaattaagctctcagtactgacacattccagcagttaaaccatgcacatgcatatgatgcagaacatgctctctagtatatatttcctctgatgcattcctgcagctagcagtacttgcacggattccattctctacagtacatattcccttctcatttctccatgctactctttgttttcattttctcttcccaacaaaaaacatgtataccagaagacattcatatatatatatatagctcttgtattcatcatctgatagaatatacagtttcaatcgggttctgcgctcagtttgttcccttctttgcgcagccttgagtacagacacaagccccatccctagctagccttaacttttccattgcatatgagaacaggctaagtttccctgtgatctgcagagaatttaacaaacaagacagtgattgcatccaggaaagtgcagtacagcacgcacaagcaacatacgggcgatcagaaatatactagctagatgtcaactgtgactacatttagaggcccggtttagttcctacgcaaaaacttttcatcctgtcatatcgaatgtttagacacatgcatgaaatattaaatatacacaaaaagataaaactaattagacacattgcgtgtaaattacgagacaaatcatttaagcctaattgctccataatttgacaacgaggtgctacagtaaacatttgctaatgacgaattaattaggcttaataaattcatctcgcaatttacaggtggaatctgtaatttgttttgttattagtctacgtttaatattttaaatatgtgttcatatatccgatgtgacacactgaaacttttcacccttagatctaaacacggtcatagatgaatttaagaacatccttgtgtgcaccagctgtggcctcctgcaccaggaggccacggcattggcaacccgctgatttctcagtgttacagaagttttcagaaatcgtgaaggggcagcgcatgcatatgcatggtttgaaacctacaggctttcatgaatggctgcagtcaattaacttttacacttctctagaaacccggcaaatgatcaggataggtctgtaaagagtatactcaataaattaaaggagtactcaaattaagtgtgcaagctagcttctgtgtgctggccgctgcagatgcgagtatcattagtacagagatgcacttaactgtgcttgttttgatcgagagctggatgcgcgctcctggacaagtctgttcagtgagtccaacagcttgaagtgtactgaagggttgtctgcaagtgagctatagctaagctaatcagtttagtagtcatgcaaaatactatagtatatatggatgcacatggtcagaggaatgtctgtttaatagctagctagttacagggtatgttgctgtgtgattaattaactataacatttatatgtcctattctgtggtgcaaatgagattattagagctagcgtgttgtgtgaggggatggtggttggttagagcggattttatattttatggatgctatatagtactgcaagcaccatatatagtactggggagatgtctttaataatcgtgtgggagggaatatggaatcaaatgcactgatcgcaacaggtatattttaatcgaacaattgtactggatatgcgtatgtcgttagggttgagaaagacaaatacgcctttaggatatttggaaacgaaattatattttatggtatcaatactactagaaaaatggtctttagcgacgttggccatttatttttgcagatgggtaggcacctaaaaaccggagcaccacctaggataaatgataccggggccatggttttgttccgcctgcgaagatagatctttgtaggcggaccaagcgagccgcctgtaaagctccatcttcgcaggcggaccacataagggaccgcctgcgattattctaggtggtctaattatgtggtccgcctgcgaagatggaacttcgtaggtgcccatttggtgccgtttgcaaaaatcttcgcaggcgaccatttttcgtcgcatgcaaaaatcaggccggctatatagtcttgttcctccccgagcttctattcatatctgacgattttcactatcttaaaggcaccaaaatataggggtaggttttgaacttcaaattttcgagggatttttctacagtgattagatctatgcctttgcactctatatacatagttttttggtaatttaaacctccttttaggatggatctatgcatgtaaaatagtgaggggaaaagctagctcccatgattgtgttctcttttttttttttgtattttgctttgatatgtgtgttggatttatgtggtttcttgatgctatggggttctctcatcttctagtgattttataatgtaatataatggaataaaattatatacattgctcttatctatttgcctagatctagataggagagaaaacttcatgacatgtaaaaaataattattatgtttaatttccaatggtatgtttttgttggttttatgtatactctttgatgtcatgtggtcgtcccatcatctagtttgttaaatatgatatgttaatttcaaaatgttatatttgatttcataattgtttactaatattatgtagaaataagaatatatagtatgtaaggctcaaatgtatgatgctatcaaggctgaaattactcgattatatgatgctggttttattcggccgtgccgatatgccgagtgggtttctaatatagttccggttatcaagaagaacggcaaatttagggtgtgcattgattttcgagatctaaataaggctacacctaaggatgagtacccaatgccgatcgccgatcaattggttgatgctgcttcaggacataagattataagttttatggatggcaatgctggttacaatcaaatttttatggcagaagaagacattcacaagactgctttcagatgtcctggtgcaatcggcttatttgagtgggttgtgatgacttttggtttgaagagtgctgaagctacatatcagagggccatgaattacataatccatgatctgattggcttgttggtagaggtctatatcgatgatgtggtttttaaatcaaagcaggtggaggaccatatagccgatttgaggaaagtttttgagagaaccagaaagtatggtttaaagatgaatccaacaaagtgtgcttttggtgtatcggttggacaatttttgtgttttcttgttcatgagagaggaattgaggtccctcaaaggagtattaatgccatcaagaaaatttaacctccggaatataagacgcaactacaatcgtgatcggcaagattaattttgttcgaaggtttatatctaacttgtctggaaggttagaaccttttacacctt

SEQ ID NO: 12327 - DNA, 18253 bp, Oryza sativa
ccccatcgtgatgattcaatcggctcggttgaaattgtgcccttgactttattcgttgatggatcggtttgtactcatgattgtggtatcagcttggttataatctctcctcggggggcaagttttgaatttgcttatactattaaacttgtttgtatgataatttggcttatagttagtgcatgtgtgaaggacagattggtttagaattgatgatacaactgtcaaatgattcacttggaaaatctactccgtttacaggtgtaggaaattgtgatgcatcggtcatatgtgatagtattgactaaatgaatatagaccgatgtagtttataatattgtggcctgtgcaagctgattacatatatatgcatatgtatatttggtttttatgcaggctacagaagctatacagggcgtggtcacattacgttaatcacggaggcaggtgattatccctaattgggtgattaagtggcaagggaatccttcgttgctcctgcagatggaaagtcaggtgtcgtatttactgagccaaagagtctacatcgtcatcgagcgagccaggggctcagacgtgtggctgtgatgggagtgctgcttgcgtggatgtgatggtattcgctggatccaaccatcgcgtggcatctgcgttgagagcagggctccggcgaccgagccaagccgcgtgcgatatttatcaagttagaagataaagattttgttacatcgaattgtttcaaatattccggtaaaccatcgttgcatattgcgtgggaccgagtagaaatgccaaaagatcatggcaattagctatatatattggtccacggtagaatagaagggaacccgaacaatttcaatctaatattcatctcttttacttcttagttcttttctattttgttttcatggctgagttctagcaaccctataatatagttaatctttgctgttttatgctgaaaaacgatcgtgcttgtccacgaaagcgagaagcttatcctttgctagtttgctcggaaactagtcgttcatcgtcacgtaagtacgatattatcttctttactaatttgcttgtaaattagtcatgtgattccacgaaagcgatttaatctcgaaatcggtttcactagcagattttgatctagcgattttgacgactctattgaatacaccacaaatcattaggtcatattgtattagcaaaaaaaagcgtcaacatatcttggcgactccactggtgaaaacaatttcggtcctgcgattcaaccgaaatcaatctactgtgcatttttgtcagctgcacgccgaattgatctattcggtggcggcggccagtcagtcctgcttcggtatcgtttcgccattcggcgacgctatctaatctcatcacaagcttgcaatattcacacgatcaggcagatcaagagttgactttgttttgtttcttcgcacggcacaatagcaacacacgcgcaggaacataagagataaagaaacgatcaggtcagtgcttgtctctgtatattattttggtatatttgtttggtgtacagattgattgacgaggacatatctaactcggatataaccataactaccttatgtattaatcaaataaagattcatatgttctacattatatttacttgttatatatttgaacaaacgttgctacacaatgacttttgtgtgttttcgtttgcagacgtacttgcttaggcaaaggaaaagagaccgagcgtaactaatgcatggatgattaaagaagttgattggggaccaaaccaaaaccttctccaagtctacttctacctcatcatgtcacttttggcccatagaagacgagataaaattatacatgttttggattcggattcggccctcctgagagcatcaacttaaaatggacctagccgctgatctagaagtaatttttgggcccatgagtacttgttagaaagattatggagtctactttcatatggttttggtcccatgtcaaaattcctaccgagctgccagaaatctgcaaaacaagccacgtatctcatccagtccgaatctgatttgggttttcggccttgtaattgtgtcgtaggcttagcccaagggggtctacgccctagggcaaccgtaggacgtccctaatcttttttatttagtagccgtcatcgtttagagtcaggttttgcttaaattaatctgtcaggaacagtttcgccgatagatcggtttgtgtaaccccaaattcgtgtgcttaatcattcatatgcaatttggttgcaatctatcttgttcttgcttgtattcttcgattcgcatgcagggattagccatctcggcgaggtcaatcgggtttcggcacggttgataaccagaggagacgtggtgctgcgattgcggggctcagtagcgtgttcgttcagaagccggatcgagttgtgtcgcaactccgcccaaatcgactgtttatcagtacctatcggaagatcgggacctaactccctcattagttggtatcagagcgcagttgcccgttagttaatttatgttcccataaccagaaaattgccacataaaaatatttattctttacctggacaatttgagccgttgcattgttctattagattttgctttgttgaattctatgttgcatcgtcgtgtcgagtgctggtttaattttagatttaatttttagttttgagtattgcatctgttcatcacttaggtttagggttcatcactcaagtctgtctgagttgttttaggtccagtttttcatctggttggttgttgccaggaccttgaaaaattgaatcgtctcgtcgttgggtttccgttttcgtagtttccaaaaaattttatcgagcggttagagagttgatttattgctattgcttctgtgttgccgtgcttttggcgcgcagaggggaaaggagggtttatgtgttgccgtgcttgtgggcgcgcaccgaaaaagctattgggcgatcagtcgcgtgcacccctccccgcgcgactggacacatgtcgcgcgcggagaggggcggcggacgcgccgcgcgagaggagggagtagtgagtttttctcgtttcttttcggtttggtttttctttttttttccggtttctcttctgttcggttcttttccctgttttttcaaagatgcatgaatataaagtttgtattcgtatgtatgcaaagtttgtattcgtacatatgcaaagtttgtatacgcgtatgcgaagtttgtataagtgatgtattttctagtttttattgtatttttttaatacatacgtatataaagtttgtatacatcgtatacaaagtttgtacacatcgtatacaaagtttgtatatgtatatatttttttatacataaaaaatatatacatataaatatatatatattatagtagtaatactagtggtagtataatgacaatagtagtagtaatagtagtgtagtagtactactagtagttctgttgtagtactagtactgaactatactagtagtactgatcggctgatcgcgcgtctggagggccgcgcgactagtcgcgtattagggcccctcgggcgcgcacgagtatcagatctattaaatatctcctagaaaatagcatatacagggagagggagagatatatagagttgtggataagggtggaaccaattttgtttggctttttggtctgttcggtcgagtcatccataccgtgactgagttcctctagcacctctctccgtattttcctcaatcaagtattgttacactgaaattcctttagccaatttgagatatttttataaaaacggaacctacatgatatgagcaatccatttttgaggtgacccaattttagttttgcactttgcatttgagtccctataatattcatatttacatttgagtccttgtttgaagtcagtggttcagttcttgttaaaaaaaagtaaaaaaaataaaaaaagaaagaaaaggcagaaaggtgcaaagaaaaggcagaaagccgcacaaaaaaaagggcagaaaggtgcttaaaaaagccgtacctagaaagaaaaaaaaaaatcatcctttgagtatgttttcagagtgcagagttgtgcattgattcatatctagtcattagttttgtcgggtgcttgcttgagctagagttgagtctagactaggccagcacattgactagtactttgaactattattcaactttgcattttctgattagtacaattgcgttcctttgctactatatattgtgcctcccaagctacacatatatacttctggtcagcaccgctgatccttgcaatcgccacatcacgtccttcaaggtgtcacgaactagccaccggttgtaccgtccttagcattgctggtaagacacttgtaagagcttggtaaggtgctccgtttggctgagttgttaaggggcaccactacaccgcgtagcagattattagggataaccttcattgtttgttgttgtttttgtattcttaatgacaggtatgagtcgcgctcaaaatcagcgataccaacaaggtggacgtgatgacagtactttggtgcaacaagtactaagttctcaaatggagaaagcggagcaatggcagtaccacgaattatttgaaacaaagtttgtggttaaggatagagcatgtcgtactataatcgatagtgagagttgtaataactttgtgagtttagatttggttgagaaacttgaattgcctacacaaccgcatcctcatccatattacatcaaatggttcaactcttgtggtaaggtcaaggtaaatagagttgtgagaataaactttttgattggaaattaccatgatactgccaattttgatcttgtccctatgcaagaatgttctttgttgtttggtcaaccatggctatatgataataatggttcgcataattttgttgctaatacatacacatttagacaaaatggtcgaaaaatgaaattggtacccatgagttttactgaaattttcgaagataatcttgaaaggatgaagaatggaatcaaggaaattttcaaagatagtattgaaaggacgaaaaatagaatcgatgtgattttcagagataccaggaaagatactattgtgatgccttcaactaagtctgagttattacaaaacgaacgtaatgttgtgcctattgttttggatactaatattttacaggcatctgagaataaccaaggtaataatgacaaagagaagaaagacgaagaggaaaaagtcctatctatagctccatgcatgtttgaagaatgttcaattgaacaagcgcctataatttctgcagatgagaaaaaaggtaatgataacggtgctacagctactcaaggtatgcatatttatgaggtgccaactatgtctactacttacgctacattagagcaacccatggtggaaacaattgctgaaatacctttgtcacaaaacaatttgcttgatgtttctcgtgacaaagaagagttgtgcgatgcttcacttatatccatgccacaactagtgaatgaacatgctagttctatagtagagccaccaagtgttgagtttaaacatgttattcacattgctagcgagaatgaagaaattaaattgctatcttctttaaatacttggggttatattcaatttgatgatatttgtccactcaactgcttaaagaagaaattatttgctagatttgaattgccatgcccttctgatgtgatttttcatattattggcaattatgaaagtaaaggagaatataatgtgcatcgagtatatatttgttcgaatttgactatacctccttttcatgatgaaatgtattgtctagaggaccgcatgcatataagtaattctctatctagttcctctagttgtttaaatgagttacaagttggtttgcaagaggagtgttgaggttttcgactacaaagattttaggatccaatcatatgtccatcaagaaatgttccgcacaggatgttgtgatagacaaagataagtacaatacactccatgacaaggtgaaaccgaggacggtttccaatcaagaaagggaggatgataagaacataactagctcggatataaccataataactaccttatgtattaattaaataaatgttcatatgttctacattagatttacttgttatatatttatttgaacaaacgttgctacacaatgagttttgtgtgttttcgtttgcagaagtacttgcttgggcgaaggaaaagagaccgagcgtacctaatgcatggataattaaagaagttgattggggaccaaaccaagaccttctccaagtctacttctacctcaccacaacacttttggcccatagaagacgagataaaattctacatgttttggattcggattcgggcctcctaatagcatcaacttcgaacggacctagctgttgatctagaaggaatttcggggcccatgagtacttgttacaaagcttatggagtctaatttcatatggttttggtcccatgtcaaaattcctaccgagctaccgggaatctgcaaaacaagccacgtatctcatccagtccgaatctgatttgggttttgggccttgtaattgtgtcgtgggcttagctcaagggggtgtgcgccctagggaaccctaggacgtccctaatcttttttattcagtagccgtcatcgtttagagtcgggttttgcttagattaatctgtcaagaacagtttcgccgctagatcggtttgtggaaccccaaattcgtgtgcttaatcattcatatgcaatttggttgcaatctatcttgttcttgcttgtgttcttcgatttgcatgcaaggattagccatctcggcgaggtcaatcgggtttcggcacggttgataaccagaggagacgtggtgctgcgattgggaggctcagtagcgtgttcgttcagaagccggatcgagttgtgtggtgactccgcccaaatcgactgtttatcagtacctatcgaaagatcgggacctaacattccctcatcattgattgcaccagaaaaatacatggatgcgtactggagtgctacgtggtcaccttgctatgccagttgtgaggtacactctacagacacattgctcgttccacaaaataattcttcaagtgccatcaacactcatgtcaatgttgctagatatgctttaaatcaatgttcaagatctttaaattatgagaataacaagtcacagcctatgcaaaataattcacatgctttaaattttaataatggtagcaataaacaatatgtaggcgcaccttttaattcatcggcgattatttcggaacctattactacacaacaaaatttgccgatgaaagatatgtatggctatggcggtatttataattcagttgattctattagatcattgcatgccatgccaagtatcggtcagtcacatgttatatctcagtcttatgggtcgcactacataatatctagtggaaataattcggcttcatatactagtagcgattatagccgaattaatagtcgttccactagtagttccatcttcaaaatgtcaatcaaatagtactatgtatattttcaaacacgcacagagttcaaatgttgtaaattcggctagggggcaaactgaaatacgaactggcaatattgatcataagcacactttcgatcccgacaatagcattgtcacattagatgatttatctgaggatcaacgacgcgagttagagtgggagctcaaggtagaaagcgtggagctaagaaaacagaaacttgcacgccttctaaagaaaaggaaaagcgtcatggaaaaacaacaaaagccgataaatttagaattatcgtctaacaaagacgaggtagttgtgcttgatttctctagagacataggagtttttgttttgccagatgaacttcgtgccaagaaagttgatgagcatcaagtcgatggagcacgataccttgagaacacagaggagatgttggagggccattagaggatgaacgaggacattgttcatgtgaagaaatcaccacgcttctccaacacatcagatcaggtaaagtctgcaggtaatgcgattatttcccaatttgatcatttatctaaaaataatatttgcactagtaatatcatcatgaaataactcaaagggatcgattggggaggttaattttcttattggtaatagtaaagtgtttaaattttccatatcatcattgccaaagtttatgtctacatggtttgcttatcatcaatctagagatagagacacaaaactaaaattggaaaatattaatgaggctgatgctactatagtggataattctaaccgtgtagtcgaatgggtagatggcaaatctgaaccattcgtttgcttagctttaaaaccatctgcacaaaagtgtcggctagaggagaagaagtatacttttgacttaaccatgtgtgatcatatttttgatgcattgttgaaaaataattatattaaattacttgatcaccatgtcatgccatcacttcaggatctaaaagaacgaatttattgcaaatggcataattcgtttgatcattgtactactgactataacacttttcgtcagaagatacaatcggctattaatgaaggccgattgaattttgcaactctaggaatgtcacatgccaaggatgaccgttttggtaaaacaaatcggtctaggtggtctaataagaagtggtcttcggcgcaggtgggaggtagttcaataaggagcaaatatgggtgccgaagtctagaggtcaagaaaagggcttagctactagtgcacgtgtgggtgtacaaaaggcttcagttcagaaaaatgttattgaacctagggggcatgcacgtgtacaacaactagaaaatttacaccatgtgagtatgaagcgagaggcatcttcggcagagttagtaacaagtcaaaatctgctgaagagctcggggggcaatggcaatcaaccgagacactcacagagcttgtcaaattggcagaagaagcagctagaaaagctaagtgtagagaatgtgaagaagagaggtatggcatggattcctaaaggaagtgttcaggtgcataatgaaacagatgttaaagttgaagtagggtgtaacagccctaggttcataaccaggtatttagaagtgcttttgttgtcctttacatttcatatttactatattgcaatttgatcataggcgatgacaaagttaactctaatcggtaaaattgaaaccacttctatttgaacaataacttgaacagaagtgtacatttataataatttattcaaatactagtttatttatcaccaaaaaatataaattttgtggaatttttacttctgtttagtcctcctaaaaattcaaaccaactttcagcctaaccaatttcatcttttcaccagaattaaaatattttgaatttttgagtgaaactttgaaaaatggaacctagaaaccaacacctgtcaccacaccaaatcccttaatttttgaactagttttacctagtcaaattgaatttaccaagagagggaaagaaaataaatcctggaaattacaagaacgaatctatactcagtttttcacccacctctctcaccctcatagacagccacgacttgggcccacttgtcactgaccttgggtgcctctatagccccacaacacatccatgggcgtgctcccacctcaggacttaagggggggggggggcagagaaaacccctttcatcttcactgcttgttctatcttttcttcatcaagctgagctctcatctcactcctcctccccaaatcacatccaatagcccaagatcaattcctgcatgtttgaccacaacaattcccatcatccaagctttccatccatcccaacatcttgcacatgcatggagagttgagagagatcgagaaggaataaaagagtgctggtttcagcctacagggctgcagcagcagcattttgttttcctccatttggtgagcttccttttcatccatggtgcctcttttgaattccctccatgttgaacatccatagcaacgttctataggttgtccactccattgctgcagctagaaggtggctgcaactcaccccgagttcatctcttttgatttcggttgaagcagccctaggcaacgtctcttgccgtcagcccaagaccttgctccatctcttgccatcagcccaaggccttagcctcgcacaaccctacgtccaggttgctgccatgtgagtgaagtccggtggaagttggagaaaaggggagtgaaaatagaaatcgatttctgagatagctattgagctgaaagaggtgtgcgctttaaaaattcataactaattcatatgaactccgaattcagtgaaccaaatttctgtggattaagaaaaacgtgatcttcaacgttgtaaaataaaaatgaccaacttttgtactggttttcccagtaaaaatataaatagctatatgtatcccttgtgtggtatagctcttaataaattcgtaagaaattattggtaaaagctaaatttgtgaaaccaattttgttgagcttatattttagtactctttgctgttgtggtgttgtttttggcaaaactacctcttaaatcttgtttaggagttgtttagcattcccatgattttaacttgtaaaatccataaataaataatggcaacatatatagctatgaaataatttttcttaggacatgtgaaagatgtactttactctaaaaataatcattattatgaaaacttggtttgagttataggttgcttgcaatgctgtaaaggaaacattaatatttacagaaatgccattttcagcacctgagagcttgtcattttcatatctcccaaaccataagtgataatccggtgattctttcacctaaattcaagttaaaatatgatctacccactgtatttatttcataatttattgatcattttgcatgtacatgtttatttggctcttattcgcatattgcttcttttcgatagatttggagattccggagagtaatgagccatatccagaggaggatagtgacttccctcagcagcaaggcaagcacctaagcatatagaacctatgctttctctaaaaatgatttggttgcaatctatacatatatatatgtgcatgcattgcctagatattaatattgtcggtttatggtgtatgggaagaaactatttatgcatttagttcttgtaatattgatgtccttataacctattaccactggatgggattacttgggatatcttattcattaatgcttagccatgcttagtgctaatagaactatagggatggacattgctattaattgtggtacatagacaacttgctttattgggcataaaacttgagtacttacactaaataatggttgatgaaatatgttggacttggacgggtgatagggcgatgaaaggaggttggttttcgtctgatgcaagtagccccgtctgagtcattaaggatcgaacattttgacatctattcaagcacccttcatacttaccacatgccttatttgggaccagcttgtcctttactagttctactatcattatttataccacattggagagacgtgagagcaggtagccctttggagggcctcgggtgcctatgttggccgggggtgcctcccccgtggcccgcccgccttggtcacatcacgcacgcacgtgactgagtcgtcgggaaccccagcgtggtataggtggttggggtggggttaagaaagggcatgtaatgagcttgaatcacttgtgtaccgcacttgacagggtgtgtagcatttgatctttgttcatttcgtgtgggtccagttgtacacctctgatcagagtataacctattcgaatagccgcgtccttggttatggacattgcttgatgtgtatctcactcatgttagcatcaaatgtagattattatggatgggattatgtttgatggtggtgttggcatgttgtgccatgttggtatggactttggtggaccatggttgatgatgagagcgccgtttgggcttatttgcttatacatttcagaattatatacttgctgtccataaattaaaatgatgctagacttacttttccttgcttattttactcataattgctcaataaaattagctttatgcaaatgttgaacctagagacccaccataggctagaaagcttgcatacttctttctcccttatgtatatataattttgggtaagacttgcgagtacaatcttgtacttaacccggtgtctgcaatttcaggagaggaatccggttttgagttatgcttcttgtgtggtcagtgctctgccaagggtggtgagggcaatgagtgatctcttgcagcttggctcttgcccggttggtttgccctagtggggttgtggcaccaccgattttatcttttgcttatgaactctatttgagacttccgctgctatatttatgtgttgtatgttgggacctcggaccctattatgtgtcatgtacctcgctgcactttaaccctattatggtatttgctatgtttattaattgcttgcgatgaaagtgtgaggctagtcgcattcctagggactagctaagcatgagtaacgggttttgatcgcttgagataattggggatagcgctttggatcgagtcattggggtatgcttttggtcgccaccttcgagtggttgacgggcatatgacgtggtggactggcaagctatcttacgattatgtcttgtgcttactactcgacatttcgggtattataacagaaggttgtcaaccgcgatcatggacacattgaggacgagtggctatttatgcgtgtatggatcccacttctccaatagtatgtggtggtcgtgttggacactagatggtataatactcggggtgtccacatgggggcaaagaatgagaagggagttaggaggtgtgcaccaaatcaacagtttacatctaatcattaggttctttcgccaccatattatatatattcttcacttatgccactgatacctatgtcatggaaccaattctaaggtatgtatagttatccctcatggttttattcttatccttggatgtcatatgggtctttatatcatggggggatgttaccatatagttatgcatattgactaattactacaaatgttgatattaatttttagagaccgaaataattaagggctggagatatttttttttcttgtatttatatatattattctttagaatttatttcggtcatgttttgtgtgggttggcaaggagttggtattgttttatatttaccaagtaatattgcttatgacacatcggtccctatcagtccgtttagagtatccttgcactttagaccgagtagatgctctattattcggtttggaaagtttagtcgttgttggtgtgaggggtgtagatgctttcggtattttaatagtccaatagattaattcagcatttttcttggactgttaaatcattatttggaccggtgtttagatacattgacaggaaaaattaacaacgaaaattctttggcataataggattctagttatcaagacagtaaagtgtgtttttgataatagataaaccggctataattagcagtttggatgtaaaataatacatgcaccgactctgagttttgaggttttccaaaataaaattccttaatctttcttgatttaaaataaaataaaatggaattaaaagcagtgtctatacgtcactgtctactattttacaaacaagtggttttcaaacaacatgtatactatatctagaaataaatattttaaaatctttcccttgaaaaattattctagaattctatttgatttgcaaaaaaaaagctttatttacagccacattgaaattacattttttttactggtatcaaatggaaaggtagtcatctctttcgtcctgtcacacttgatatatcagctagctaagcacagaagcccaggatatgatgcactagggtgaaatagattttgccataaatcaattagtcacgcaagtgaaaaaaaaaacttgagcaagacataatgcgatgactgtgtgttgttatgtttggttgcctgccacttttcttcttttatttcctattggttctttcagtaaaaagagaaaacatcagagaatgcacctactgaaaagcttgcctacccctttgaaataataccttcctaccacccagtgtgtagaccgcattcaatatgtagagtgtggtggtaccgacaggtaccggacaaactagagtaaatcacattatgtgggtaaagctgtacaaactctgcagggtctaaaactaatcgattagccgtgctcacggtcatgagcgacttggtgaaatgatacaagtatagtgttggtgatttactaaatgaattgtgaaatgggtatggtgaatattggtgatggttttacccagtgtgggctaagaatgaatttgttacctgttgccatggagggcacaaggatgatactatgatggtacttatactgctactattatggtctattctttgttttaaaaattatgtttcaatctattattatttactattgcgaaacaaaatttgctttacgctaaaaatgaggcacaaatatagccatccttgatctcagcttgcaatagtcctaggtttcccaaggtttgggtaggacttgccaatacctcgtgtattgacccacctcttgttgtttttagtctcgtttgcaggaaacgggtgttccttctgttaccggagtttctaaggatggttctttctagggtgattcctagtcagttgcctgtgtggtttggtagatgggcatactgaagaacttatgtatctttatcttttccgctgcgtttaaactcttttatttggccagtcggcctaactactatgtaagaccattgcactgctaagttatgataaccatttcatctatttatatgtcaagtatgttgtatggatatgatagcaatgttgtggatgcgtgtgctagccactgatcatgggactagtacagtgtacgctccaggtattcgggaattccatcctttgttggatgactaaatatattgccgagctataggatgagtttttttaaaatgtatcgaagtttagatgggattgtttttaatttattttaggcccaagaactgcagccaattcagttaggtggacattacggacaactgaatttgtagtatagtttagtactaaatgggaaatatttgagaaggtattatccttatttgagaaggtagaaaacttgattgtcttagaacaaatacttatttgagtatcgttttgagaggacgactgtagatgggctcaagactgataccatatgtgggagtatcgttttgagaagatgattgtggatgggcttaggactaataccgtgtgtggagtattgttctgagaggacgatcgtggtctggattgattaattctatggtgttttcggtaaagcaaaagttatacgtccttcttataccgaaaacagggggcatgtgtttgtacgataatttggcttatagttaccagattggtttagaatagatgatacaactgtcaaatgattcacttgaaaatctactcagtttacaggtgtaggaaattgtgatgcgtcggtcatatgtgctagtattgactaaatgaatatggaccgatgtagtttatagtattgttgcctgtgcaagctgattgcatatatatgcatatgtatatttggtttttatgcaggctacagaagctatacagggcgtgaccgtcacgttacgttaatcacggaggcaggtgattatccctaattgggtgattaagtggcaagggaatccttcgttgctcctgcagatggaaagtcaggtgtcgtatttactgatccaaagagtcttcatcgtcatcgagcgagccaggggctcagacgtgcggctgtgatgggagtgctgcttgcatggatgtgatggtattcgctggatccaaccatcacgtggcatctgcgttgagagcagggctgcggcgaccgagccaagccgcgtgcgatattatttatctagttagaagataaagagtttgttggatcgaattgtttcaaatattccggtaaaccatcattgcatattgcgtgggaccgagtagacatgccaaaagatcagagcaattagctatatatattggtccacggtagaatagaagggaacccaatttcaatctaatattcatctcttttactttttagttcttttctattttgtttttatggctgagttctagcaaccctagaatttggttaatctttgccgttttgcgctgaaaaacggtcgtgcttctccatgaaagcgagaaggttatcctttgctagtttgctcggaaactagtcgttcgtcgtcacgtaagtacgatattatcttctttactaatttgctcgtaaattagtcgtgtgattccacgaaagcgaattaatctcgaaatcggtttcactagccaattttgatttattgattttggcgactctgtttaatgcaccgcaaatcattaggtgatcttgtgttggcaaaaaaaaagcatcaacaaaaccttatgcaactaacaatcaagctaagtacgaagcagttctcaaggggttgcagttgcttatggaagttgaagcccacgccgtggagataatgggggattctttgttggtgatcagtcaattggcaggggaatacgaatgcaaaaatgatgcgttgatgatctacaacgagaaatgctgggaattgatgaatagttttcggctggtgattttgaagcatgtctctcgggagcagaacgttgaagcttatgacttagctcagggggcatcatgatacaagccgatggtgaaggatgttgaggtggaggtagccgcaatcatagccgatggttggaggtatgatgtttatcagtatttacagaatccatctcaatcggcttcacgaaaattgtgctataaggccttgaagtataccttattggatgatgagctgtattatcggacgattgatggagtattgtttaaatgtttgagtgccgatcaagctaaggttgtgatgggcgaagtacatgaaggtatttgtggtactcaataattggctcacaagatgaagtggttgctttggtgcacaaggtatttttggccgaacatgttagaggattgcttttaatattacaaaggatgtcaagattgccaaaatttggagcaattcagagagcaccagcatcggctatgaatcatatcatcaaactatggccgttcagaggatggggaattgatatgatcggtcagattaatccaccttcaagcaagggacataagtttatattggtggcgaccgattattttaccaaatgggtggtggcagttccattgaagaaagttgattatggggatgcaatacagtttgtcaaggagtatattatctaccgatttgggattcctcagactattacaacagatcaggggtcaatctttgtatttgatgaatttgttcagtttgccgatagcatgggtatcaagttgttgaattcttcaccatattatgcacaagctaatgggcgagctgaggcatctaacaagagcttgattaagttgatcaaaagaaagatttctgattttcctcggcaatggctcacaaggttggctgaaacattatggtcttttcggatggcttgtcacgcatcggttcaagtccctccttataagcttgtttatggacatgaggcagttttaccatgggaaactacaagcggctcaaggagagtagctttacaggatgatttaacagccgataagtattacaatcttatagaagatgaaacagaagatctagttcaatccagattgagagcccttgcaaaggtgactaaggataaggaacgagttgctcggcattataataaaaaagtggtgccaaagtctttttctgaaggggagctagtctcgaaattgatcttgccaataggaactcgagataataaattcggcaagtggtcacctaattgggaaggaccgtttcaaatatacaaaattgtgtccaaaggggcttatatgttgcaaggacttgatggtgaagtttatgaacgagcgcttaatggcaagtat

SEQ ID NO: 12328 - DNA, 4502 bp, Oryza sativa
aaagtagcaaagctaaactttaatctaaacaaaacccaagaaactctagaggggtacctaactatttaaggaggtgggaagacctctaggtcgtcctccacctggttggggcgcaccccacatgggccctacatgggccggggtcccaaaaatagttacaagcccaaaggcccatgacaggtgatgcagcagcttgtttcttcatctgcggttgaccaggatggaatttggtgatgaggctagatccgttggaaagaggactctgagagctttctatcaagcactcatgggccgaaaacggagcttgtatgcagattcggcggccgtttgaagtcagcagtgtagcacgtggccgaatcggattccagtacttggaggacttgcacttgatatcttgttgttcatccatgatgtgagcaacggatgtatccatagtagccatggtcacatcatcctccccttcttcacggaaaaccatcctcggtttttccatatggtgctcttcacatagtccattcaaaataacatgtttcatccaatcaaaaccagagaaactgaagtagtgtgattagcaataacatgtttctctaaattcgaacaaatgaaaactctatgcaccaaatatattcctctatcgttatattcgccaaagatatgaaaaatagcattagttggacatggcaaatcagagttagcaaataatttctcctccaaattattgagctcacaaaaatcatcaaattgaacataacccaaagtatttaaagaagttatcaatttacgttcctcatcatcattagcaatgtgaacaacatgcttaaaatcagcacacaaagaaacactagaaatagcattttcattcactagttgtggcatggatataagtgaagtattatcacacaactcttctttatcacaaggaacaacaagtaaatcaactcgtgacaaaggcaaatcagaagtagtttccaccaaaatttgctctagattagcatggatagtggagaaatgtgacaagggagaagcacactcaccttgagtaatatcaacaccatttaatttaccttttatgccctcttcagataatgtaggtgcaccagtcttctcttcttccttcgtgagcgatggagatggcatctcgatcatattgctcttctcctcatggtgaatgtactgagctccctgcaaaatgtcagtaataggaggcacaagcatagattgtttctcccttgggttcattaaaatattgctctcaacactgcaagcaagcatgaacaagtggcctatatgattatatgtcacgttaataagcccagcctgaatatcagaattaagccctctaaaaaatctagtcattgtgttctcattgctttcttttaaaccactataagtgatacaaattttaaagtcatgaaagtactcccgcacggttttgtcaccttgttttaaatgttctaatttctcaaggagagtatgtttataatatgaaaacacaaaattttttctcatcattgttttgcattcatcccaagtttcaaacttattgccaacaatataccaccaaaaagatgtagaaccagtacacttattactagcagccttaatcatttgagcattagagaaatcatactcatcaaattgtttgtctactgctagctcccaattaacataagcggcggaatcataattaccatcaaaaacaggcaaattagattctacccttgcaagatcattatcatgtaccttatatgcaaagcgtgaagaagacgatatatctcgttgatggtgaagaagtcgatgttgagcatgaccatctcgtttcccctttcacaatcctgccatggttagtagcaagcaagaaacatacacaaatatatgcacgctcctatcaactactaggtagtggcagctcaaatatcacacacactcaagcttttaaccaagctcttacaagttcttaccaaagcaagcggaaaggtgacatacaccgactcaaccaagcaccccaatggaggttggatgtatcgatgccttggcaaacacttgctgtacggctgcaatcaaatctgtagagctctgggtgggcttaaaatatgtagcaaaggaaagcaatggttcaaatcagagaatgcaaaattgaataatggttcaaagtcaagtaccgtgctggtcctaggctagaacgtactagagacgcgagtctagacacaaacgataccataagatagcactaggaacaactcatgcacaactctgatatatgaagttcagctcaaacataacaatattttctcttttctttctttcttctttcttttttttctttcctttccttttcttttcttttttttagggtgtagcttttctttgcttttcttttttttttgattttttttacaaaaacagattcaaggacctcaatataaggctacagggactcaaacgtaaatataaaaattacagggactcaaatgtaaaagtctaaacccaaaattaaaattatacaaaaatggaatgctgaatttatgccggttccatttttccaaacagatctcaaaaccgacaccaaacaaatattcaccaaggtgtttgacacaactcggaaccgtgaaagggagggagggagtcggactcggccaaaggggtgagtggaagtcgtctaggaggtggagtggatggcagccgaatttggtgtatgggataaaaaggaaactgatttttaaccaatccaatctactatatctttccaaaacaaacttgactacttccaaaatcagatatggtaattcaccttcctcctctcgtgcaggacacaggcacggccaaaacagaagcacggcagtcagcaaaccaaagatgcaactcaacaactgcaaaaccaaccggtaaaaacttttgcaaactacaaaaatagaatcgtggcagcgagccgattccgttttcgtaggtcctgacgacaacagatacatggaggtgacgatgactgtggtacaaaacgtgaccagaactcgaaactctaaacgaactagacgctaacaccagcaactcgactcgacgatgtaacacaaaactcaacaaagcaaaaactgataaaaacaatgcaatggcacaatatggctaggtacaggacaatttttttatatcaattttctggttatgggtagataaaactcaccgagcaacgaaagctctgataccaaatgatgaaccctgagctccactcggcactcaaggctgttgtttggcccgatcttttggtgagttgatgataactacgatttgggagaaacgttaacgacccgactacaaccgtactagacgtttttgtgttacgccttagcgatcgatacacctctccgtaggttgttgatcttgccagtgcagatcaaccttattcctgcaagcaaatcgaagaaacaagcaagaacaagataaaagcaatctgaattgcagataggaatggagcaaaaatgataagtttgaggttccgtaacgagcaaaccggtgatctaaccgatcacgggattacacggaaaagtagcgaagctaaacttttatctaaacaaaacccaagatactctagagggtacctaattatttaaggaggtgggaggacctctacgtcgtcctccacctggttggggcgcaccccacatgggccctacatgggccggggtcccaaacatagttacaagcccaaaggcccatgacaggtgatgcaacaccttatttcttcatctgctgttgactaggatggaatttggtgatgaggctggatccgttggaaagaggactccgagagctttccatcaagtactgacgggctgaaaacggagctcgtatgcagattcggtgaccgtttgaagtcagcagtgtagcacgtggccgaatcggattccagcacccttgcacttgatatcttgttgttcatccatgatgtgagcaacggatgtatccgtagtagccatggtcacatcaaagagcaagttttcaccacaagcagaaagttatatattgcatcccaaaagttatgtttgcaaatttaaagttggaattacaagatttagctcatccagacatgtattttttgatggctgatattgccctttgcttaatccgatctacttcgtctatgatttggacatcgactgcatcagtgcttaggatcacctttcgagatttggttagatcggccaagtgcttgctagatgccttcaactttgacttctgatcctcaatggcttttggcaagtctgcaagcttttgctgttcaagggcgatttgtgcattgcactgctctaactcagccaggagttctattttttgagcattaagctgatcaatgatagtttgagttgaatctggaccagcctccaattcatcgagcttggccttctcttcattcatagaaaccctgttggcctggatggttgcctcaagatctcttctttcacgccgatcggcaatcctcctttgggctttttcaagtttaagccgatgct

SEQ ID NO: 12329 - DNA, 21898 bp, Oryza sativa
ttggctcgctagatttggaaattggggttggaggacgaataggctgaaaatacaagtacaaattagcatcggttatttaaaaaactgagagaggaaagttgatgaggtttaaaaatcaatcgatgcagctggtgcttgtggcttcttggaagcaatctttttctgcaagaaaatcaaagttgagaattggtataaaggcataatagacttaagctgaagattgaaaacatgcacatactcttggtttgtatgtgggacgtactggaggtgatggcgttctttgaggagcaggtggatcggctggaggagtttgttcccttgtttcactgacatgttcagccgcttcatccacatgttttgccattgtttcacccttcaggaattctgctacatccgaatctatggctggcaattcatcggcagtggtcttttgcttcttgggtttcttctttgcagccgatggtgcagcagccgattttgctctcttttttctgccagcatcaggggctattggcacacggggcatgccatgcagcagtgttgaagtcttgggggcattgtagccgatgaccggaggagatagtccactaccattgagcagtagccctggggcatattggatctctacaccgctgttgctatgatgaggaggagaatattctgttgtctgcaagagagaatttgcacaaggtcaagattaattcatcggcttgtagttaacataattgacaaaggagaagattcttacttgagggacggcttagggaatagatctattagatacattgaagacgattggtgaagccgatgttttttccactctatccaccatcggtcaaaggatgcacttctcaacatccttagcttgatattgttgatgctgcctaggggtggtccttctatgttcagcagccgatccatcataagtggtgatgtgatttctcctctactctggatcttatgggcaaagaagtgatttctcctctactctggatcttatcggcaaagaacaagctgatcggcagttgacccatgccgaattgccttgcagcacttgtcggatgatagaactcatatgtcatttggatttttttgccttgatggatgccaataggaaggatgcaaggacgatggctgctgagaatacttctctagatttgtcatatttttcggagttgatctcatcaaaccgtaaatcgcctggtagcttacaagtgccatgtccttcgtatgcaaactaaattctagtgtttttgggaaacccatcgtaaaagttgttgaaccactctctgaagggttcagccgatagcttggatgcaatgctaaccgatgccgcttctccaaaggacctgcatcggcatgtagtgattctttctccatcatcatcgatgatcggctcaaatcttggaaatcttgtatcggctaatggtggccgattgacaaccatcctggtgtgcaagtttagccagatctgcagtaaccactagggaccccctgtgccgattgatactccagaggccatcttggttatggcagtgttcagagtttggtacagatagcctagcagatactttccaaggggaaattgtttcttgtctacatgttgccagtttgcagtaggaccacaacttggaccatgaaaaaagaacttctcaagccacatcatgaggaaagctgcatgctcccttgcaaagatcggcctagtacccatgttcttggcaacatagcctgaccaaccgcctatgcttctgattttgaactcttgggtggattggatattcaagatggtcaggttagccgatgaggtcacatctaggccagtaatcattataacatccaaaagagttggagtcatcggtccttgagagaaaaggaaggtattcatggctgtggaccagaagtaagtggcagctaccatcatggactcatcttttgccatgtctgctgcagttaaagccaaggcttgggatatgccgatttcttcccagttggttaactttctagctgacatcctgttataccaagcgggccagctcttttcggccgatggctaagatttgaaggtgttcttccataggcttagatccggttagcaaatctaaaggggattcagttggtttcaccattgatgaactctgtggggtctgggttaccaattgggccaaggaaaaactggaactcatcggttatactagggactgcgacttgatgagagagatgctacagaaggaggaaaatcgaagattgagcagaagaaaaaccaatcttgcacggaaaagaaagaggattagccgatgggtacttacctcgacattctcagaggttgatgcgctcagaggactggcggtggttgacattgtcggcgatgaggagtggaatcacattagttacaattccagaggcccaagacaggtgacgcagcaccttatttatgtgattgcggccaaacgacatggaatttggcaatgaggctgtaaagagggctccgagagctttccatcaagcacttacgggccgaaaacagtggtcgtatgcagattcggtggccgtttgaagtcagcaatgtagcaggtggccgaatcggattccagcacttggaggacttgatcttgatatctccttgttcatccatgatgtgagcaatggttgtatccatagcactactgcaaaaacggcctgtagagacgttccgtaagagacggctaagcacgtcgtccctattaaagcccatctcccactttgcctcttacgtagatacgctaattacggacaggataatagaccgtctctacaatcacattaatcagcgctaaacaatttggtaggaatttttttttgctcgttccctccaaaaagatcaatctttccaactttttacctcattcatgcggattttttttatctcccttggaactcggaagtagttacgatattatctaagagaacaaacccctctccttctcttgtaaaatctgttccaatctttccattagctccaccgtgaagacggcggcctctcgcgtatgagccccatggccgccgcctgtgccgtctgggctcagcgccgccggcgacgccagggctgcgcacctactacccacgccatcgccgcctgcgccgtccggggtgaacgccgcctgtgccgcctagcacccaccgtccacccatcgccgcctgtgccttccaggctgagcgccgctggcgccgccagagatgcatggcccccgcgtcatccgccagccacacacccatcgtttgccccacagcagcagcatcgacacgccgcagattcatcggtgattttcttcctggtattgcccaaattcctcagccatcgaatcctggcaacagtagcaatcctaattgcaatactgtttctgcacacttgcacagctgatgtttgatttgtgttctgcttacagacaaagtatttaattcttaattatctgttatagcaacccaagtatattggggaaaaaaatttaatgcacagatggtttgtttttcctgcttgcatctaattattttataatgtataggtgactggcatgtaactttgcatatttgtgcaactgtaatttggtcatcgtagaggatatttacaacagctagcagctaagggaaacatcagtataatttgtagaacttggtgagtacaatatttaattatgtgtggtcaactaattcgaatgcgtatcttccaatttataatcatgtttgtgccaaaattgattgggaacacagcatgatctgaactttttgatgctctcttggactctaggcttgtaagatgtagacctacttaatacttcagcaaacattagaatttatactttggtcaatttagtttgatcagtggaaaagataaattacctataatgtagcaatagtatattcttgtgatctcgaaatatttataatcaaataatgctccacataatatctggtactgttatttacagtaatttatatgaattggattgttgcttctctatccattatattgatagcacctaatacgatgcatagtaacttattaacaatcaacaatacatcaaacattggctctcctaacattctaattcctcgatgttattttatttatgtttttcagtaattgagtactggataaatgaatagggactggattaataagcccagaacaactgctgcatataaaacaggagtatctcaattcctagaatttgcattctctaatgtacctcaatatgcaagggttatattgttacttatgcacctgtaacattctaatctgttttttaaatatagtgcaaatggcagcaaggtcccaaagactgcaaggcttggatttttcagagaatggagtacagaatcaagaaatggtcccaaatgatcactatgttgaagaacagaacataacaaatgcagaatggcgttcaaactgctatgagtatcgtaagatatattgtttattcgcttttaaaacttgtatgcttgtggactaaatctttaaacatgacagatcctgatggccgcattaaaagacgtcgaggaccaactaaactggcaaatgttgaaaatcttccggaaggtgttaagattattgtcaaattggatcgtttcaatgcaccttgctcacaatcttctatagttcttggatcctatttaggaacacttgttaggaagccacatctagctccactgaacattcttaaatggaatgataaactttataagagaatatatcatccaaaattgatttctgaagtacaggtattgcttgtttaattcacatggtttttaaatcatatttttatggtgattcctgtataatccattcactcttttcatatgtgctagagaaagtttgcaattgatggaagagctaaggattggcttctccaccagttagatggaaaatggaggcaatacaagtcaaatctgaagaaaaagtattacaaggctaacttacccatggaacgagtattgcaaatggtaccccaaactgttaatgaatctcaatggcctacactagtttcttactggtactcagaggactctaaggtaaatatgtgttgaactttttagtgagtgaacagccatcgctttgatttatatcaactcattgatggtatatgttgtatcattagaaaatcagtgatcaaaaccaagagaatgcacaaaatattaagcatccacacaaattaggaagaaagagctttgcaagaaagaggaaagagctggtaagaagtttagcatgtatttcttcattcattattgcttctatttctcatgcacttgacatgtataatctgcaggaacatgatagagtggaggtggacagagcaaccttctttgatgaatgccataagacaaaagatggcagatatgttaatgatgctacacaagacaaaatggtatgacatattacttgtttttctttaactctttctataataaaatacactatagtaagagtacaatttttccatgtagaatgaggtatatatgaaattggctgagaaaagagtagatggccaagaactcactgaagctgattttgaacaagctatgttagaagtgtttggaaaggatcatagtggtagagttagaggcatgggtccaaccattactccaacaaactattatggtggaagatttttgaatatgtcaggaagaagtgaacaagggagtagctccagtaatgtaaatggcttcattagttttatggtatcatatcttgctgagaaatatccagaagataatttgatgtctaggctgccaccttcactttgctaggctcattccaagacaagaggtatgggcacaagattactgttttgaatgttgcaacttatatagccataagctgacaaaataacatattcatggatgtatatgtaggttgattagaaccaaggaagttagtcatcaaataatcctccattctatcctctcttcagtttgatccaaatttaaccaaggaagccagacaccaaatactactccatcgtctagtactacagcatcatctcagacttgaagtgaagaggactgatttacaatggcgactgcatcatttcgcactacttgttgcattagaattagcacttgctgctgccggaaacatatttaagttttctcgtcgggaacaatgtatggatattgctttttctttaatgctaagctactagtgttgaaaatattatcaatgtggtatgatggtaactcagtctgctgatattattgtgtttatggattttctgaatgaaatgtttggcatatgtgactaatagcgctagatgcgggtattatttgttaattagacactgtgtagagacgggtgcacccatgtctatagaaatggatattgtctctaggagagaaataagtaatatattaaccattaatagagacggttagaaccgtgcctaaacaagacataaattgtctctactatatgatagagacggaagcaaccgtggctaagatcatcaagtgtctctacatgtttaatctgaaaatttgtatttcaaatttggaatgttcgtaatttatattagagacggtcaaatttaaagtagagatggttttcggcgtgtctacaaatttgatttgaatttgtagtcatgcgtgtagcgacggtcccaaccgtatctatcgaccgtctctagacgtacacatggctatttgaaccgtctctaatcgtttgacacgggagcaatggcaacgcctatgagacgggtgctaaaaccgtctctacctataatagagacgggtatagccatctctacatcacataaaaaccgtctctaggggctgtttctgctgtagtgtagtagccatggttacatcagagataaagctctcagataggcaattgtatttattaattaggatatcttatgtaatttccttagagatatgattgggcaaaagtctgccgtaaagacttatggtaagagtcatgtccggcaaggacatattttgtatctcgggtataaatatgacacaaacccatgtaatcaatgaacacacgttcaataacactttcggcacatcgccaccctttttactttcgttttatttcgatgagttcttgctttcggattgagctgcatcgatcttcaactagaggtaaacttgtcatggcgatttgcgttctcgggattagcacttccatctttatgacactctaatcttgtttatgtaattcatcgagttatcataaataccatataatctctgttagtttcattatataacttgtcatcggttggtttttactgttagaaagtagccgacagagttaaacctcgttattaatttagattatatcatatacttatcatctcttagaggttttcatcatcttgtttagatcttacaattatctttatgcttaatgctgcattggttgagttcgatctattaagttctatctataattttgatatctagcttgttttatgattatcaatagagatagcatcggaatttcagccgatcttacttgatatcatactcttgcttgttatgctaaatctgccctttatattaagatcttgtcacattaaagttatattaagtttcttatttgatatatcttgtttgtttcaatatcttagtataaagtagtatcggagtattagccgatacatgctagatctatctgatcggctatgctataaacctctatataatctttgctttaatgtatatttcgacttaagtgatttatattgtctcgtcatggtgaccgatctatcctaatcacttagtttaagtatatatcgaagtaaagactatatgatgttaatatctacagctgatcgactagatttagttttatcttatttattcatcattgtcgatcgattcaaatatgacgtcggctccgagataaatgatatgtcatcggcaactagccgatcggctatcgtttatgaatttaaccgcagtttttcttgtcttcctttcttgttgattacaagatcaaatcaacttgcacgctcacgaacctaaagcgagattttggacctgcacaggagttaagcagatcttccaggccagtgtgtgtttttctgatcaacaggtgtctagtggggtccgtttgtgggccacttgcctcggttgacacatggggtccgcttccgtcgacccgtggaccgtctctatgtacttggtctaccgtggccctttaggttgacatgtggggtccacatgtcaacagtgcagccttcctgtctttatggttgcaaagcttaattataataatccgcaaatctccacataacagcattaaacgataatcatattttgatcatacgaactccgaatcgacccgttcaagtctcttaatgtttgttataacctaaagaaccatgtgcctttctttttatgtattgttattgcttctttataggttgtagctttgcttgtgtgctgcgcgtagcttctgtcgttccggaggttctcgaagcgtggttcgcggttgtcgccgaaggttcggaaggccgttccctctgagcaaggcaagtcgcatcatccttgagcatattgaatcccagtttataaaattatttaaatttccacgttatcactgttttatttagccatacctatttatctttgttatgaccttatcattgttgctattgttatatcaccttgttcaccctagtaaaataataccccaactagtgggtacttattcatggttccactagtaagaatttaggtagattcatggttatgggcaagcctagcaatgtacccaagtttgtggtttacttcttaaaacttgcttaacaactaaaatgtggaatggttggcctgggttggcttgggacgaactgggacccaggtcgggttgccagttcggtctgaatcatcgtaggccttgggttaaggtaagttcgtgtggtttgacggccttgaataataatactatgtaactctaggatcatttttgtaaaatagctttgggcaactaggcgacttttaaatgctgtttaccgcaaaacctagccctatattattactccttgtacccccttgcattaatcatgcatctctcggtgtgacttgctgagtactgtgattgtactcattcttgctcaatctttccccccttcaataagagaaagctttggagaggaaatcctaggtggagtcctggcttataccccaattgagcgcctgtgaagatggagccgtaggctcgctagtccactgttgtttatttctgtttgccaggccttaagtgcctttgtaataatgtaaatattattgatataataaagatgtgtcttttgtatcaagtttgtgtggtgtaccccggcttttcctgggatggggattaatacattaacattcagaaaggcatatttcccgggcatgacaatattgtatctattacatgggctaccaaatgacacacacagagagaaacgactgttgacggtcgttatcgatcagttttgactgtcaatattaccaaaatagaggagagctagtgatgcttgcaatgcatatacatgttagaataataatattccactagtattaggttcactaaccttttgcagagaataaccataaagtggaggagaatcgacatcaactcaaacgataaatcaatcggacgatgttgaggatcagacttatgcatgaatgggccaagaactcagaattgacacaatgaattgggccaaaattcacaagtctacgaagtgaagcaatgttgtaggccacctgctgaatttggatccaggtttgggctggacggcgtggatcactccccaatgacagttagagggaaattccgaacattccaactaccacaaccgtcattggcagcctatataaggacttcactctcttcacttcaacaaacacctcaagcaagagctctctcatattctctcaagtttagtttagtattctcaatctagtggaataggaatagagtccggaaatcaggagtccggaagtcttcggaagagttcagatatggctctagtagctttcctttcctcttttgtaagctttgtacttttattagaatactcttctatatacatttatggtattgaaatactttccgaatatatgaatgccaactttacattatattcatgttatactgaatatactgctagcttatctgggcgatgctttggtgcgagtatattgtaattgcttatgcaattactctatgtcatgacgatgacattagagtagtatctggtaatttagaagtggtgtctagactacgggatatcattatttggggttatatgctgcggatgagaggtgggctgctgatggtgacagctcagtacgggtattcctccgcgcgtgtatatagtcctaagttaattccctggggagggtactcctccgtatttagccccggttgtatggtcatgacgcgttgtcgtaaggaactcgacagccaggggtggcttctcgtagtaccaggagggcatcggatagagggtatgagctagtatatcggttaactagaatgtaagtatactatcaatcaatctggggtgttagtcaataccttatcaaacatgatgaagtccatagccgatggttcaaaagctgagcagcaggctgcaggcccggtttatttgcaaggaggtgtctttccaaattatcggtctttgattaccaatgttcagccatcaactcaggcggttccctctattgcacgaacatctcagccgacggcactggcgtcaactcccctacctgttccgtcagcaatggcgccaggccagccagtgaaccctcggttattaatgagagagcagccacagcatggcgggcaggttgcgaatcggctgacccaagatcatgttgctgccacgtttctgccgcctcaacctattgttgatccaatacaacagcagccgattcagcagacaccccaattcagtaggttgtgcaaccaatccagcaacaggtcatgcaatcagtttagcaaacaccaccaaggtagcagctgattcagcagacgccgttaagacaacaaatcgttcagccgatccagcaccaaggttcaataggcgcatcggccgggtttgcaacgcctggtggtcagcctgtacaacattttttaaatcaagttgtcccagaacacttggttcaccacgtacagccggatggcacagtaatacctcaagttgttcctgagcatttggtacgtaatatccagccgaaccttcataattaccaagggggtaacttgaatttccaatatcagcctgcttccccgcaagcccaatatcagccagggggattggctcaacctcagtttgcgtctcagtatggtcagtttgagcccatgcagcaacagtcacaaggggtagcttagcaacaaccgtgggccgatgtgattgctgacgtaatgagggaacagtttgggcttaaaccaaaagagattggaagcttgtattggcaaccttatcctgagtggtttgagagagttcctcttcccaatcggttcaaagttccggacttctccaaattttcgggacaagatggtgtgttaacttatgagcacattagccgattcttagctcagtgtggtgaagaatcggctatagacgctctgaaggttaggttattccggttatctttgtctggatcggcttttacttggttttcctctttgccgtacgggtcgatcaatagctggaccgatttggagaagcaattccacagctatttctacagtggggttcatgagatgaaattatccgacttgacagcgattaagcagcggcatgatgaacctgtgcacgagtatattcagagatttagggaaatgaggaacaaatgctttagcttgagtttaactgttgcccagttagccgatctggcttttcagggtatgattgctccgattagggagaaattctcgtctgaggactttgatagcttgtcacatctgatatagaaagtaaccttgcatgagcataggtccgcggaagttaggaaaaactcaaagaaggttaatcatgtttatccgtacatgtatgggtcggatgatgatgaggacttttctaaaatagctgcagccgagtgggtgaggagtaaaaaggtcataccatgccaatgggtaaaaagttctggaaaagagaagtatgactttgatattactaaacctgacaagatctttgatttgctactccgagagaagcaaattcaacttcttgctggtcatacaatcccatcggctgaggaattaggcagaaagaggtattgcaaatgacataattctgggtcccattctactaacgattgcaaggtttttagatagcagattcaggtggccattgagggaggcaagattaggtttgatgattccaaaaagccgatgaaggtcgatggtaatccttttcctattaatgtggtgcatacagctggccaaacagccgatagggcccgtgcaatgggttttcaggtgaattcggctaagattatcaacaaatatcagaagaagtatgacaagcagcaggagaaggatcatgagaaatacgatgatggttttgatcctcattggtgttgtgagttctttagattctgctggaatgaaggtatgaggttgccatctatttaaaactgccctgggtgcagtgatagcgtcgagaactcaagccgatcatataataggggcaatcggttaaggcagacaagagtttctgttcatcaaagattgggtccagtaaatcaagatcatggccaagaagacaatgtaatcaggaagaatcaatggtgtccttttggtattttcacgaagaatcagaagagaagggttcagagattgaggaacagggagcgccttcaggaggttgaacaagaaattaatcatcggctgaagaaagcaaagccaaggcaggagtggcgtgttaagaattaggttactgtagccgattatatcgcagccgatgaggcaaagaggttggcaaaagggaagagtgttgtgacggcaccggttaacatggtctttaccctgccagccgaattcgggatagaccaagccgatgtcgacgaggtggaagaggaattggctaagttggttctgtcaccagaacaggcagtgttcgagaaacccgaggggacagagaatcggcatcttaaaccattgtatataaacggctacgtcaatgggaagccgatgtctaaactgatggttgatggtggggctgcggtaaatttgatgccctatgctacgttcaggaaattaggtaaaaatgccgaggatctcgtcaagacaaacttgctcaacgattttggtggcaatccatcagaaaccaaaggtgttctaaatgtggagctgacagttggcagtaagactattcctaccacgttttttgtcatcaatgggaaaggttcttacagcttgttgcttggaagggattggattcacgccaattgttgcattccttcaactatgcatgaatgtttgattcagtggcaaggcgacaaaatagagatcgtaccagccgacaggtcagttaatgttgccagtgccgatttagctctttgggaaatggatggccttgattgtttatctggaaaagtctgggatggagattttctaaaagtgtccgattctgatatacagccaattgaagatggagaacccaagctattattttgagggcgtcgtggagggttcaaatgtctacactacggacacggtagatgatctcgatgacaagcaaggtcaaggtttcatgtcggccgatgatttggaagaagtggacataggtctaggcgatcatctaaggccgacatttattagtaggaacttatctccagagtttagaaccaagctgatagagctcttaaaagagtttagagattgcttcgcttgggagtattacgagatgcctggactcagcggatcgattgttgaacatcggctacctatcaaaccagtggttaggccacttcaacaacctccgaggagatgcaaggccgacatgcttgaaccggtcaaggctgagattaaaagattgtatgatgctggttttattcgtccttgccaatatgctgagtaggtttctagtatagttcatgttatcaagaaaaacgacaaggtcagggtatgcattgatttccgaaatttgaataaggccaccccgaaagatgaatacccaatgccagtagccgatcaactagttgatgctgcttcgggacataagattttgagttttatggacagaaacgcatgatacaatcaaatttttatggccgaagaagacattcataagacagcttttaggtgtcctggtacaatcggcttatttgaatgggttgtcatgactttcggcttgaagagtgctggagctacatatcaaagagccatgaattacatatgtcacgatctaatcggctggttggttgaagtcgacattgatgatgtggttgttaagtctagagaaacaaaggaccatatagctgatttgaggaaggttttcgagagaaccagaaaatatggcctgaagatgaatccgacaaaatgtgcttttggtgtatcggctggccagtttttgggatttcttgttcatgagagggggatcgaggtaactcaaaggagtgttaatgcgatcaagaagattcagcctccagagaataagacagagttacaagagatgatcggcaagataaattgtgttagaaggtttatttctaatttgtctggaaggttagaaccttttacaccattgttgagattgaaagccgatcagcagtttacttagggggcagagtagcaaaaggctttggataatattaaggaatatcttagctctcctcttgttttgattcctccacagaaaggaatactgtttaggttatatttatcggccagtgagaagtcaatcggctcggttttgatttacgagttggaagggaaggaacgagttgtattctatctcagtcgtcggctcttggatgctgaaactagatattcccctgtggagaagttatgcttgtgtctgtatttttcgtgtacaaggttgaggcattatctactgtccaacgagtgtactgttatatgtaaggccgacgttgtcaagtacatgctatcggctccaatatttaaaggaagggttggaaagtggatattttccttaaccgagtttgatcttcggtatgagtcgccgaagttgattaagggacaagctatagctgattttattgtggaacatcgtgatgattcaatcggctcggttgaaatagtgccatggactttattctttgatggatcggtgtgtactcatggttgtggtatcagcgtagttataatttcccctaggggggcatgtttctagtttgcttatactattaaaccgtatgcgactaataatcaagctgagtatgaggcagtgctcaaagggttgcaattactcaaggaagttgaagccgataccattgaaatcatgggggattctttgctagtaatcagtcaattggcaggagagtatgaatgcaagaatgatacattgatggtttataatgagaagtgccaagaactaatgaaggagtttcggctggttactttaaagcatgtcactcgagaataaaatattgaagctaatgatttggcccaaggggcatcgggatataagccgatgatcaaagatgttaaggttgaaattgcagcaatgacagccgttgattggaggtatgatgtgcatcagtatttgcataatccgtctcaatcggcttctaggaaattgcgatataaggcattaaagtatactctgttggatgatgagctttattatcggatgattgatggagtgttacttaagtgtttgggtgccgatcaggctaaagttgcaatcagtgaagttcatgaaggaatttgtggtactcattaatcggctcataagatgaagtggttactttggcgtgcagggtatttttggccgacaatgctggaggattgtttcagatattatagggggtgtcaagattgtcagaagtttggggcaattcagcgagctccggcatcgactatgaatcctattattaagccatgaccattccgaggttggggaattgatatgatcggtatgataaacccaccatcgagtaaaggacataagtttatattggtggcgactgattatttcaccaagtgggtggaggcgattcctttgaagaaagttgattctggggatgcaattcaattcgttcaagaacatataatatatcgatttggtattcctcaaactattacaactgatcaggggtcattctttgtatctgacgagtttgttcagtttgtcgatagcatgggtatcaaattattgaattcttcacctaattatgcacaagctaatgggcaagccgaggcgtctaataaaagtttgatcaaattgattaagcggaaaatatctgattatcctcggcaatgccatactcagttggccgaagcgttgtagtgttataggatggcttgtcatggatcgatccaagtccctccttacaaacttgtttatgggcatgaagctggtttgccatgggaggttagaatcggctctcgaagaacagaattacaaaacgatttaacagctaatgagtattacaaccttatggccgatgagagggaggatctggttcagtcacgattgcgagcccttgcaaaggttaccaaggataaggaacgtatttctcggcattataataagaaagtggtacctaaggatttttcggaaggagaacttgtatggaaattgattttgccgattggcactcgtgatagtaaattcggcaagtggtcgccgaattgggaaggatcgttccaaatttataaggttgtgtctaagggagcatatatgttgcacgggcttgatggtgaagtctatgggcgagcgctcaatggcaagtatttgaagaaatattacccaagtatttgggttaacgcatgatcggctagtattgccgatgcatgacagccgatgtgtttgcatcaccttgagatggccgatatggttatatcgcccttagttgtttttcatggtgtaatcggttgtggtttgccgatgtacaatggccgatatggttatatcgcccttagttgtttttcatggtgtaatcggttgtggtttgccgatgtacaatggccgatatggttatattgcccttagttgtttttcatggtgtaatccgttgtggtttgccgatgtacaatggacgatattgttatatcgcccttagttgttttataattttatcaatgcttttgtcattgtaaaattaggggggcacatatatatcaaaatgcaatgcaaatttttgcaaattttttgaggcaaatttttgttggctgattacaaaaatttctgagtcctattacacaaaagttattgagacaagtatcgctggatagccaaaatagccctttgcctgatttgttctacttcttcaatagcttgggcatcttgagcatcagttccagagatgactttcagagacttggttaggtcagcaacattcttgatagccgatttgagccttgctttttgttcttcaattgattttgggagatcggctagctttttgtgttctatatctagctcggcattgcattcttcaagttgtgccaagagctcaattttgcgagcttcgagccgatcaatattggatttgatcggacttttagatagctgatcaagtttggttttttcttcatgcacaagctgccgattagcttggattgtggcctcaatctctttgcgatcacggcgttcggctagtcttagcttggctttttctagcttgaactgatgttgctcgagataagcggctggagttaggacatcggccaaatcttcgggaatcagagcttgaacttcatgcagccgcgtcctaattgacccacagtcaactaccaaactgtctaaagaagaggcttctagccgatgagagatgtcttcaagtgtttttctcacatcatcagataggggagctagggctttgcttgaagtgtcttcttctgcctcgtcaaggtaatctctgatgtcaaaagagaagagatcggctagagcctgcagagacaatttcggaaagaataagagctgagtaaattatagccgatctatttgttgagacaaagggaaacttactgggatagcaggagcagctgattgttcttcctcttcgacgtgatgactacccacaaccgatggagtctgatcacttgacgattgttgtacaggaggagaaggaggaggaggctgcgaaatagacaagtgttatatagaatcggttgagattgattaagtaaaagaattaaggacatcttactggtggagccgatttaacaattgttgctgctgtttttttcttcacagcagttttcttcttctgcaaccacaaagtctatgggtaattagccgaagagagaggtaatttcagaaaaagtcatagagaggtacttactcttataaaatgaacgggggcagaaggagttggaggcgtttgcttgggtgaagccgatggtgttctttttgtgtcacttatttcggctacagtttggtcaacatcttcaccaatttcctcttcatctaaagcttgttcaatagatggatccaagacgggcagatcatcagtcgacatatcagttggttgtggttgagttttcttgaatttggtctttttctttggagccaaggctaaggtactcatggctgatgatctggttttccttttcttgcctgcatcggctggttccctagttaggccgtgaaggtgagttgaagtcttgggggcatggtaaccgatgaaagagggagatagtccacctccattcggaattagacctgaagcatattcaatgttcttgccactgttactttgatgaggaggggaggactctgttgtctgcaaaacaggagcaagaggttagtcaagtaatgaatcggctaactggttatgcaatttagtaatgacaaagtttacctggggcatgacgtcagggaatagatctgtcatatacattgaagccgattgatgaaataggtgcagcttccattcaccccaccatctgtcaaagtttttgcttctaaatcctgccaactcaatattatcaacgctgcccagagggggtcctggtaggtttagtagccgatccatcattagagtggaattgatttgtcctcggcactgaatctagtcggcaaagaataagccgattgggagttggcccaatccaagttgtctggccgagctcattgggtgataaaactcgtaggagacttgcatgtttcttccttggtgaatgccgacggggaggatgcatgggctgattgcagctataagaatttctctggatttttggaatttttcatggttaatgtcttcaaatctaaagtctgatggaagttcaaggtctgctgagtcttcgtagggaaaccagattcgtgcatctttcttaaaaccttcgtagaagctgcagaaccagtgtcacgaccggaaataacccaacgggcgttccttacgtgcgtgcattaatccttgtcccaggaggcaaggtacaccaaaagttgatacaattcagagtttaacaagcggaagcgtaaatagttaatttattacatgggcagcgaaggcccagcacacacagagacaaacgagaaactgcggaagactagggcgacgaccacaggcacttgacggaaggcacgagctagacaccgaagccttcatcctccaggaactcctcttctggggttggggaaaattgagcaagactgagtacaaccaccgtactcaacaagacacacccacaaatgcagaataaatgcaagggagtacaagggagttatactataaagggttagggttgcagtaaacagcatttaaagacatttagttgctcagggctattttgcaaacacgaatctaatactatacaatattatttatcaaggccgtgaacccacacgaacctgccttaacccaaggcctacgatgattcagaccgaactggcaacccgaccctgggtcccagctcgtcccaagccaacccaggccaaccattccacattttagttctttagcaggttttaagaattaaaacactaacttgggtacattgctcggcttgcccataaccgagggcgcggctattcgaataggttgtactctgatcagaggtgtacatctttacccacaagacacatcttcctcacgtgtaaccacgtgccacataccaccacgatatacagacggaagacgtgacatagtttccaacccatcctagccatagacaagagtaccgacccaatcccacctacggccggaacccccgggacaggcaggtaggactgagcccctagcagcaggacaccggccctgtgccatgacatctcgactaccgggccgcagctcgtgtagccttcatttgccctggagaatgtccatcgacccccgacttcatccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagagggggcggtgtgaatccaattccacaataaccaaatcattccatggtgtccaggtgatatgaatattcccaaagtctagagttgtaaaaccacctaatgttacctaattaaaaagcgaagcatctacctataatcatactagtggtaccatgagtagagtgtccactagttggggttttgtttaatctagggtgaacaaggaaataataacaatagcaataataataaggtcataacaaaggtaaataggcatggctaaataaaacagtgataacgcgggaatttaaatagagcgataatgcaataatttaaatcaacataattttacaaactgggattcaatatgttcaaagatgatgtgacttgccttgctcgctttcccaaacgtcggcttcaacttccacgaagagcggatcttccgaagctgcagcgtctacacgaccaacggaaaagaaacggcttttactctactaaactccatataacaagcagaaacaaagcacaaaaatgggttcttgacttcttaaggagaaattagagacttgaacggtccaattccgagttcaaatggtcaagttatggccatttgaaggttatatgctctttaaatgaatatttgcgaatttcttcatttaaattttaatttaaaatcggatttattgcatcagccgaggggaggggcgcgcggaccgggtccacgggagtggggcccacgcggcagcctcacggtccacggtggaccgggtgcacgcggcttacgccggccggcgccgtgggtcccacgcgtcagccgcacacgagggcgcggcggctgactgccgggccccacatggcaaccgcggggcgcgctccgaagctgcctctccggcacagccgactggaggcgactcgcccgcgccccgatggtctgcggcggcgaccaccagcgcggcggagcggcgccccacagaggggaggaagggggaagtgaaacggcggtccacggctcaccccgggtcgacggcgacgacggaaacggcgaccggagcggaggaaggcggcggcgcggctcgggtcgacgaggacggcggtgttccggtgatcggcgggtgaaacggaggagtggacgaggtcggcgaggacgcggcgaagccgaaggaggcgatgccgaagcgggaggaggtccggggcgacggcggcggcgaaccggagctcggcggcgacggcggagaaagagggcgacggcccgagctcgattccgacgggga

SEQ ID NO: 12330 - DNA, 9072 bp, Oryza sativa
ccggcccaaaagggggaaggggggggcaaaggacttttagggttttttctttttataaaaccattttaactttgtttatttcttcttaattattatttgtgctctgaaaattccactaaaatttatttacgcattttaggcttttaggaaatgtacaaaaaccctccaagccttatttgacttttaaatttacacattttaattgttggaggctttcacatgaattttaattattctatgcataattttgagaatgtattttagagtcgatttgggacgcgacaaccagtccttgagtagctcagccgatagcttcgctccagcatcggttggtgtggatgcatattctccatatgacatgcatctgcgatgggtgcgctcttctccgtcatcttccacaatcagctctggcaattggaattcagcttctgtcacagagggccgattgacaaccttcatgactatcaggtttaaccaagtttgcagcagccaccatggtccacctgctccaactattgagtcgacggctattttagccgatgcattattcaacatctggtacagatagccgagaaggattttgcccaaaggaaattctttctttgattccaaggcttcggctacaaattgccagttggttgtagggccacaactggatccacagaagaggaatttttccagcaacatgagcaagaaagctacatgctctcgaggggtaaaagacccttggcccatatatgcctccacatagccagaccagccacctatgcttttggtcttgaagtcgaattggctcttggtgttcatgctcatagggttagccgatgaagttacatctaatccagtaatcatggtgatgtcgattaaagttggagtcattagcccttggttgaataagaaagcattgatggtgttggcccagaagtaggtggcggcagccatcagaggttcattcttagcagaattggctatggtgagagcgagtgcttggccgattccaatttcgtcctagtgaactttcttactagccgatacgcgttggtaccaggtggtccagctcttatcaggagtaggtttttcgagagatggccaagacttgaaggtattcttccagtgacccaggttagggtttgctagtctaaaggggatccagttagtttcaccgatgatgaaattagtggggtcgagattgtgggccaagaaaatagtggtttttgtgtgaaaggctgggaatcacgactaggctggaaaggtgctgcaaatccaaaggaattgggaagcagaaaacatgaggagaaaaggagaaatcgatttcatgcgaggaaaagggatctagctggtgaggacatacctcagggtacttgtcacgaccggaaataacccaacgggcgttccttacgtgcgtgtattattccttgtcccaggaggcaaggtacaccaaaagttgatacaatacagagtttaacaagcggaagcgtaaatagataatttattacatgggcggcgaaggcccagcacacatgaagacaaacgaaaaacagcggaagactagggcgacgaccacaggcgcttgacggcaggcacgagctagacaccaaagccttcatcttccaggaactcttcttctgggtttggaaaaaattgagcaagattgagtacaacaaccgtactcaacaagacacacccacaagtgcataataaatgcaagggagtacaagggggttataatataaggggttagggtttgcagtaaacagcgttaaaacacacttagttgctcaaatctattttgtaaaaacgatcctagagctctacaagattattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaactctaacttgggtacattgctaggcttgcccataaccgagggcgcgactattcgaataggttatactctgatcagaggtgtacatctttacccacaagacacatcttccccacgtgtaaccacgtgccacataccaccacggtatacggacggaagacgtgacatagtttccaacccatcctagccatagacaagagtaccgacccaacctgatgcgaacccgctagggtttgtggcccgatctttcgatgagaggtaagggataactcgattagatgaagtcgacgttcacggcccgactacaactgtccaaagacgctgcgccttagcaaccgatacaccgtctccaatggtcgccgcgaacttgtggtgcgcgtcaacccggccacgagggcactcgtcctgcaagcaatcgaagaacaagcaagaacaagtaggacaagcactgagattgctagataaagatgaaggtttcactatcaaacacaatatggtggggttccgattacaggcagacgggcggtttagccaacacgcgcgctgcgagccggtagcaagaagctatctctatcatcaaaacccgcctgttcttggcggcgactagaggtataaaaagaggggaagaacgaccatagggtcgtgctccaaccctaggacgcgcccctaatgggcccaacatggatacacagcccattgggccaaaagaggtgacgcagcaccatggacaaaaaatagtcgggagtaaaatgacaattgcggccgctccagaacagatatggacatgtggctggatccatttgaaagtagacttgataaactttccatgaagtacttgcacgcccaaatcggagttcgcatgaagtcgtggcggccgtcagaagttggcgctgccctgcagtccgaatccaccccgcgcgaatcctcttccctttggatcctctccatcgttcctgagtaaaacacgagtgcacgcgtctccgaggtataaagacgaggaatatgaactcaagaaagaactcacctgataatttagttgacgtgcacgagcgcgggtaataggaccatcatgctgtatatggggggacgtggatgtatcgatggtgttgatgtcctcatcatcctccccttcttgcatttgagtcgtcctcgactcaagctcatcttcttctcccaaatacggcttcaaatctgcaacgttaaatgtgggactaaccccgaaatctgcaggcaaatcaatcttatatgcattctcattaatctttgctaacactttaaatggtccatcagctctaggcatcaatttatactttctcaaatcaggaaatcgttcttttcgcaaatgcaaccaaaccaaatctccaggttcaaaattcaattcccttctacctttgtcaccagcaaacttatacttagcattcatgcgctctatgttttctttagttgtctcatgcagttttaacatcaactcagcacgttgcttagcatcaaaattcagtttttcagaagatggtaaaggcatcaaatcaattggagcacgaggcaacaaaccatacacaatctgaaatgggcacatttttgtagtagaatgcaaggaacgattataagcaaattcaatatgaggcaagcattcttcccacatcttgatatttttcttcaaaacagccctaagcatagtagacaaggttctattcaccacttcagtttgtccatcagtttggggataacaagtagtagaaaacaaaagtttagtccccaatttagcccacaaagttctccaaaaatggctaagaaattttgtgtcacgatcagaaacaattgtgtttggcacaccatgcaagcgaacaatttctcgaaagaacaaatcagcaatatgagaagcatcatcagttttatgacatggtatgaaatgtgccattttagaaaatcgatccacaaccacaaaaatgctatcacgccccctcttggtcctaggcaatcctaacacaaaatccattgaaatatcttcccaaggaacagtaggaacaggaagaggcatatacaaaccatgtggatgtaagcgtgacttagccttttgacatgtagcgcagcgagcaacgaacctgccaacatctcttcgcatctgtggccaaaagaaatgactagcaaggatgtcatgtgtcttcttggcaccaaaatgtcccatcaaaccgcctccaagcgcttcctgcaacaacaacaagcgaacggagctagctggaatgcatagcttgttagctctgaaaacaaacccatcattgatgacgaatttgttccatgttcttccatccttataatgcagcaacacatcattaaaatcagcatcatgcgcatattggtctttgattgtttctaggccaaaaatcttgtagtcaagttgtgtcaacaaagtgtatctcctagacaaagcatcagcaatgatgttctccttccctttcttgtgtttgataacataaggaaaagattcaataaattcaacccatttagcatgtctacggttcagcctcccctgactacgaatatgcttcaaagactcatgatcagaatgtatgacaaattccttgggccacaaataatgctgccatgtttctaaagttcgcacaagagcatacaattccttatcataagtagaataattcagaacaggcccactcaacttttcactaaaatatgcaacaggttttccttcttgtagcaaaacaccacccaatccaatcccactagcatcacattcaagttcaaaagtcttattaaaatcgggaagttggaggagaggtgcatgggtcaacttatctttcaacatgtggaaggcgttctcttgtgatgtgccccaagtgaaaggcactcccttctttgtaagcgcattcaatggtgcagcaatggtgctgaaatcctgcacaaagcggcgatagaaccccgcgagtcctagaaagctccgcacttgtgagaccgttttaggagtcggccaactctgaattgcctcaaccttggcttgatcaacctcaatcccctgcggagttacaacatagccaagaaaaggaactcgatctatgcaaaaggtgcacttctcaaggttaccaaataaacgtgcatcacgaagagcattaaaaacagcacgtaaatgattaaaatgttcacccatagacttgctgtaaatcaagatatcatcaaagtagaccaccacaaattttccaatgaaaggacgcaaaacctcattcatcaacctcatgaaagtgctgggtgcattagttaaaccaaaaggcatcactaaccactcatacaacccaaacttcgttttaaatgctgttttccattcatcacccaacttcatacgaatctggtggtaaccactacgcaaatcaactttggagaacacaatagagccactcaattcatcaagcatatcatttaacctaggaataggatgacgatatcgaatggtaatgttattaatagctctacaatcaacacacatacgccatgaaccatctttctttggtaccaaaattaccggaaccgcacatggactaagagactcgcgtacataccctttatcaagcaactcatgaacttgacgctgaatctccttggtttcctcagggttggttcggtatggcgcacggttcggtagggaagcacctgggatcaagtcgatttgatgctcaatgccgcgcaccggtggcagccccggtggcacttccttgggaaacacatcagagtactgctgcaaaatgttagcaacagcagggggcaaagaatgctgcatatcgtgaagtgaaatcaaagcatctttgcataccaaagcataggcaactgaaggtgatgcaatcaactcattaatatcagatttagtagcaagtaagaatttgggtttcaaattgattgtctcaggtttcttgccatcagatgggcttttttatcactctcacatttggatttggcagccttagcaacatcatcacgcaaaatatcttcaggagacatgggatgcaacacaattttcttatcatggtacagaaaagagtactggttggacctaccatgatgcatagaatccctatcaaattgccatggtctacctagcagaatattacatgcttgcatgggcacaacatcacattcaacaacatcatggtaatttccaattgcaaaattaatgtgcaccagttttgttaccttcgccttaccactgttgttcagccattggatgtattatggatgtgggtgcggtttggtgctaagtgcaagcttctccaccatctcgctgctagccaagttgttgcagctacctccatcaatgatcatgcggcaacaacgctctttgacgacacactttgtttggaacaacgtgtgtcgctgattttgctccgccttctccatttgtgcgctaaggacacgctgcacaatgaggctctcatagtgatccgcaaatgcagccccaatgtgctcttccggtggctcattatctgcatggtcagccgcaagcaaagcaagtgtatcatcatcgaaatcactagcagaggagtactcaccatcgtttttgactaccaaaactcgcttgctagggcagtcacgctgcacatgcccaaagcccttgcaacggtggcactgaacatctctcattcggcctgtggatgccattgaagaagcactcggtgctggctgagcggcctttgtcgctgacttgtcactagatggaggaggtgctgctcgactggttgtgggtgtggaagatggagaagcagtacggccggccggaggagtggtgcgtgtctgccatgatgaagttttacctgcagaaaaattagccttggcactagcacgtcgtccttgcacttccctttcagccttacaagcaagatgaaacaatcgggtcatattagtgtaatctttatagtctacgatgtcataaatctcgcggtttaacccacccaaaaatctagccatggcagcgtcctcagtttcctctaaattacaacgaagcaagcccatttgtaactcctgataatattcctctacacttttcgcaccctgtctcaattgttgcaatctattcagcaagtcacgtgcatagtaagaaggaacaaatctagcccgcatgacccgtttcaaagcatcccaagtttgtggcatgttattaggatttttcttgccatgttctatccaccaaaccgaagcaaaatcggtgaactcactcgtagcagctctaactctagtgttctcaggaaactcatggcatgcaaatttttggtcaacagcaatctcccaagagaggtacgcatcaggatcatattttccatcaaaaggaggaatcttaaatttaattttagaaaaagcatcatcattgttgcgtacctcgcgtcggcggtgaccacccatacctcgtcgattgttgtgtagccgtcgacgatcttgagcatctcgatcatcttgttcagtgtcagcaatatattcatcctctaaattatcctcgacgtactctccgtcaatatcatcgtcattacccccaccattgcctccagcattgagagcatcaaaatgcctcacaagagcagcaaggctagtgtcaatgcaggcgaccgctgtctccaaccctgtaagcttagtgttggtggagatctgcatggactccaattgtccaatcttctcatttgtcacctgcaaatctgtatcaagtccttctgtgtgctgcttcacttgccttgtaaagtattggatgatgcctttggtgcgtggggaatgagatgcaccctcctcatctttatcctctggacctaccatggtttagaaatgaaggacaacaaaacaatggaggatgtaatgtaagccctacacaactattgggatgtagcttttgcaagacgctcactctcacttcactcgcagcttgtctcacaagctcttaccagttcttaccttgcccacaggagcgggacagcaacaccacaagttagcaaccgtggaacgaggtgtatcggtgctgtagcaacaagacctgtcaagctgtagtcgggtttgtggtggagctgttggtgggctgaaagcaatgctcaagagaaaactagaaaccacattagccaaagcaaattgaataatcgctcaagggtatagtgtacagtgctggtcctaggctagtcgaagtagagacgcgagcctaaccacaaaggacgccacaaaacacaaacccaaacagcaacgaaaacaagaaccggtggtagaaggtggtgacaaagggggaatggtgtggtgtgctcgctggatactcctttttttttttttttttttttgcttgctctctctagtgctgaggagagaggcacaactttttttttttgatatttttttcacaaccaggagcacactagaaccaaccacagaaaatcttatctcaaacggacaaagtatgaagcttgtagaattttttttaaagttctatgcgaataggtcccgaagcttctcgccacaaaaacagaattttgcaagaggaatttggcgattttaaatttgccgaacccggcaagagaatcggatgtaacttttttttagatgtccgtggatatattataagcctaatttcgagtccgtatgaaaaagatatgactgttttaaggaaggtcactcgaatcagggttctatttcctttctagtggcggcaggatacaaggcaactaacaaaagctatcggcaacagatcaaacacaaatagaaagtgatttggtgggtgactgcgacggtggtgacggtggtgatgacggcaaaattgatgaaggtggcgatgtgcggtggtggcaagaacttgaaactctaatcgcctaacactaagaccagcaaattaacacaaccgatgcaatcgaaaactcaacaagccttaactaagcagtactagtgaaaaggcacaatggtctataggatcatggaaaaactaatctactatttttttttgttggtcttttctggactataggaaaaaaaaattaatgacgaagggaagggtaaattctctcaccgatgaaccacgctctgataccacctgatgcgaacccgctagggtttgtggcccaatctttcgatgagagg

SEQ ID NO: 12331 - DNA, 805 bp, Oryza sativa
  unsure (1)..(805): unsure at all n locations
gtcaaagcatatatccactttccaactcttcctttgagaattggagctaatagcatatatttgatcacatcggctttgcatacaacaatgcattcattggataacaaataatgccttaacttggtgcaaaagaagtataaacacaaacataatttttccactagagactaacttgtttctgtatccaatagcctatggcttaaatagaaaatagctctctccttgccctctagttcttgaatcaaaactgagccgattgacttctcatcggctgatagatataacctgaaaggcactctcttttgtggaggaattaaaactggacgagaactcaaatatgccttaatgttgtccaaagctttttgctgctccgccccccaagtgaattcctgatggnctttcaacgtttacaaaggtgtaaaaggttctaaccgtccagacaagttagatataaaccttcgaacaaaattaatcttgccgatcaacgattgtagttgcatcttatcctccggaggttgaattttcttgatggcattaatactcctttgagggacctcaattcctctctcatgaacaagaaaacatagcccccaagtnnnnnnnnnnnnnnnnnnnnacgtttacaaaggtgtaaaaggttctaaccttccagacaagttagatataaaccttcgaacaaaattaatcttgccgatcaacgattgtagttgcgtcttatcttccgaaggttgaattttcttgatggcattaatactcctttgagggacctcaattcctcttcatgaacaagaaaacacagcccccc

SEQ ID NO: 12332 - DNA, 1013 bp, Oryza sativa
tatggaatggttgcattattgtggaattgcattcacacctccccctctattcaaaatcctcaaaatgtttttaggctgggctcggggtgcatggttttgatagtagcacctcggccacataaggaccggtcttcaggcctctgttgcaaagcactaccgtacttccacatgtctagtgggtaaggtttagtttgtggctcagtctggttataaacaaaagtatacggatggagatggacgaagtcgggggtcgatggacatctctagggcaaatgaaggctacacgagctgcggcccagtagtcgagatgtcatggcacagggctggtgtcctgctgctaggggctcagtcctgcctacctgtcccggaggttccggccgtaggtggggttgtgatgaggacatcaacaccatcgatacatccacgtccccccatatacagcatgatggtcctattacccgcgctcgtgcacgtcaactaaattatcaggtgagttctttcttgagttcatattcctcgtctttatacctcggagacgcgtgcactcgtgttttactcaggaacgatggagaggatccaaagggaagaggattcgcgcggggtggattcggactgcagggcagcgccaacttctgacggccgccacgacttcatgcgaactccgatttgggcgtgtaagtacttcatggaaagcttatcaagtctactttcaaatggatccagccacatgtccatatctgttctggagcggccgcaattgtcattttactcccgactattttttgtccatggtgctgcgtcacctcttttggcccaatgggctgtgtatccatgttgggcccattaggggcgcgtcctagggttggagcacgaccctatggtcgttcttcccctctttttatacctctagtcgccgccaagaacaggcgggttttgatgatagagatagcttcttgctaccggctcgcagcgcgcgtgttggctaaaccgcccgtctgcctgtaatcggaacc

SEQ ID NO: 12333 - DNA, 850 bp, Oryza sativa
gccggaggcggtggtaggcggcggcgctagcggcgagtggcgcgggcgcgatagtaggcacgggagagagcggcgagcgcggaaaaaggaagaggggactccggggagggattttataggcgagggaggggagaacatggccgggaggtcgtggttggcgccggcgacgacgtgggggaggtggggagagagagggtgttgggggatttcaagtcccccaccacttgcgggcacgcgcgcgggggagatgcggggaaggtggaggaggtgggtggcgtgggcgcaaggtgcgggagcgagaggcggggaaggtgggcggcatgaggagcggtggtttcggtggcggttggcgccggggcgtgggcgactggaggtaggggacgacctgacaggtgggccccacctgtcagcgtcccagagaggagagtggggtgatgggccggactagtcaaggagggagagaggacgcgggaggaaggaaggttgggccgacggcccaacaaaggaaatagggaggaaaagaaaagggaaaaagggaaaggattctcctgggattaaatattgcggttgtcacgcccggaaataccctagtaatttccgaactaatttgtgcatgaaatcctcgtccaggaatcagccgaggtacacaaactgacaatttaatatacagattcatcataataataacgttacatacttacaaaagaaaagaaaactgctgcggaattacggtctagcgaagctccggctccactctcacaggcagctcaactggggtataagccaaacgtcttctcctttgcgacttgtcttcaactgagatttgattgattattgcaaggtgagcata

SEQ ID NO: 12334 - DNA, 24425 bp, Oryza sativa
  unsure (1)..(24425): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgaatctacgagaaatccctgatcgacgaaaatccggtaaccgcggctatacgcaaacaatcaaaacctaaacgaaagaccaaaagaaagaccctatttagactaattaatagtgccattaaatatatctcaattttacggcagtaccggaagttgaacggagtcaatcggagctacggattgagagatatgaattttggaagctcgaatgggattttccagactaggaaatgatttatcagaattttctggaatgtaaggaatggtttatggaatttatagaaataatattctcaagaatattattgacattcactgatgtgtgggaccaaaggaattgatttatggaatttcggaataataaggaattgatttatggaaaaggaaatggacgagggatgtatattagactttttcgggcggcaagggcgcagcccgagtgttgaaggaggctcggccgagccatttgggccggcgtgggcgcggggaaggcggcccattagggcgcgcggaagagagagggagcggtccggtggaccgagtgcacctcgcgggtcccaggtggggcccgcttgtcggtgacacggcccacggtgggatgggcgcacgtgagggcggcgctagggttcggtggggatggcgcacgggcggtgcgccggatggaccgagacgcgtcgggcccacgcgcagcctcacggctcgcggtggaccgcgcgcgcgagcgggagacggagggagcggcttaccggggtcagcttgacccggtccggccgagctggcgccgacgtggcgccttcgtggcagccacgcgggccggcgggaggaggaagaaggggaggccgagatggacggcggacggcggcgcggcgagatacttgttgttttgtgtaccctggctggtcctggacagggatttaatacacaaaatagtctggaaatttgggctaaatttctgggcgtgacaaagtggtatcagagccaactcgactgtaggttgagccaaatggtcaaaccctaaggacaagttttctgaaaaccctatttgcaaattgtctcctctcgcccttcggcaattctttgtcaaacagtttttcaaaattctcctcccagtctctccaattcttttagttgtcaaacctagaggaccagctgtcagcttcatgtctgttcggaagtcaagtcaattcgagcctcaagcttcgtgcaaggagcgagaagatcagttcagagtcgtcgttctgcgaagatcaagtgatgttttctcggagatgacctaaacccaatctttcccagaagagtagttccgttagctttctagatcgtgtgttgtttgcttgtgtgtaggggtatggtttgcatcattggtggggatgcgaccatactaggttgtttgcttaagcaacttgaagaataaaagtctactcacgacagatcagtaggcaagtggtttagtaccttatctttagcaacccctctcttcctcctctcttccgccctggcagaagatagtcagtgttagagagaagagcaacgacggtgtattaaagtcaccaatcaatggttcagttgaaagctacaaggtatcccagtgccagaagaaccctgctcgtgatcaacatttggtgtccaagattagatgatggatgtattgatgcgggagatgcaaagtccgatgcaacagatgcaacaacagtgtctccaacaacaagtacaagctcagatgcaagccggaatcaggatcagagcgatagtcagtttgttttcaaagaggaagcacccgcaacctcagatagtacgccaccaagtcctcagcaaatcagcacagctaagccaccaccaatcccaggagtaatatatgctacctattgtggttatggttttcaagcgcagtttttgcaaagtgtccatggaagatgtatgacagggcacatcttagagggttgttccccggtaagacgtcagcgtcatcacatccctaactcctcaagttgtgtcagttccaatgcagagtcgatcagttcagttttgaggaatcaactatgcaactcgacaccgaagtcaagctagaagcaggacagtcatgccagtagttagaacttatgggaaagttagtcaagagtcaatgtgtccctgagctaaatgagagtcacttttatgtggaatctcccatcagcaactgaggattaagttccaaatcttgctgggatgaaagtgcgccgtcattactctattttgatgaatcggtgaagtttcagttttcaaagtgagggcctttgtaagcaagagaagtgttggttatttttcaaggacaatagtccaattgttcctagtcaggagaaagtaagactactccctgtaagggggtaggtctcggagatgagttttggctcacttcgtcgctgttttagttgaaggttcaacccagtgcaacaatccgggtagtacttgaagaagccagttgcaaggtgtcagcagagtcaccccaatctcaggtcgacaggttcgattctaaggtacacctgtgaagcatgtcaacagtttagcttagaaaagcaacagcgaggacagttgtagtacagacgaaaggcaggtcaagcaggttttcctggaattacttgtcatttgaattgggaccagtcgaagcggacatagggtaaatgatttacaaatgccagattcaattttcatcctcttatagccagcgtggtgaattctaccaaaattgccaacctcaacagttcagtccaagataagtaagtttcaggagcatccgcagtcctagtctgggtcagttcaagcagaaccagtcggtccagttttggcaaagcaaaggaacagaaaggtcgaatccagccagttcaatcgtgcaggtttgatcaaccagtcaatcaatcagttcgaagcaggatgtggcagttcaatgtgcagatcagtcagaccgccgaccagcaccagctttctttctagccatcccagaatctcgggacgagattcctgtaaggggggtagatttgtaacgccccgattttcgttcgggattaaaaatcattaaataatgcattttctagaaattaaataaaagttaaatcaatttatccaagtgaaataatgggagaattaaaattttcccttaaaaatcattggccgggaatattttgcaatattctttgtgccctaaaatactctccggaattttccgtgaattttcggagctcgagaaatagttttaaagtcacaaagatcatttaaccaattaaataaaaagaaaacaaatttaattctcctttcttccccttcctccctttcgggctcggcccaaattcctccccctccttccttctctcctcgggccgccggcccagcgcgcctcccctccccaagtctgctttgcgtccctgcgcgcctcctccctcccctcaggccgacaagtggggccgtgggacccgcttgtcagacccttcctctacctccagcctccctcatccaaaccgctgtgccgccattgccgcccacgtcgcccacgattccggcctcttccgctcgcgccctcgcgcccaaaccgcatgaaatcggttcccatccacctcctctacactctccccatgtttcccccaaaaattgtgccgggatcgagctccacttcgcccacgatgtcacccacgtcgcgggtcattgccgccccaaatccgccacgcccggcaacggttttccctccccgagcttataaaatccatccccgggctcccttctctcgtttcccctcctcgccggcgcttccctcgccttctcccgctctccccacgccgctcccgcgcgccgccgctctccggcgagctccggtcgcctctagccgccgccctctgtggtcggtcgggccagccctggctgtgcccgtgccctgccaccactcccctcagctgcccgatcggcttggcccgatctgggccgtccatcccgtggaccggcggtggaccgtccttgtggtcccggtccacggtgcaccgagctccttgacccgctgacgtgtggggcccgcgtgtcggcgccggctgccccttgctgacgtcagcgaggtcctttttcctttgtaaaaataattaataattgcgcaataaatcgagtttaattctagaaattcatttaaatggctcaaaacttctaaaattcatatctaattcattcgaactccgaattgagccattcaacttgcaaaattcatctaaaattgagctctacatgtttgtttactttttatgtactgtttccttggtttttattagagtttttcctcgttttgcgtgccagcgtgtagtttccgtcgtttcggaagtccgcggtcgcgaggaaaagagttcggaagatcaaagtgaagaagcaaggcaagtcacacattccccttgagcatgttgatcccaatttataaatgttttaccgtttacaaataaatatgcatgttttgctaattacatgggatccgggtattacctatctgctcgcttgtgccatgtttacttgatatctatcctttgtcaaccttgggtaataaattgactagcttgtgttacttatgtgacctagctagaactatatgcttagccatgcttaattaccactagctcagtcgatgggataattgcagtattagacattctagtatcttgttgagccgcgtgctcgagacatctggccatgttttatggtcgtaattatccaactaaaatgcgactgaatggtgggctgtgggtgcatggttttgtgagtcgcacccatggcaattaaggaccggttcacgggaaaccctggaagacttacagtgcttaccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacccctaataaatcgacccaatgcactgtagttcaggtgggttggttgggcctgttcaacgtggtgtagcgttgatcagtggagatttaatgttactttaattactcaacagttttactgttttgctcaataaaatgttttacaaccgcctttatgcaaatagccacaaaccatccttggatccccttgcacgtctgcatcgttggtgtggcttgctgagtacggtggttgtactcaatcttgctattattccccctttttcagaagcgtagtgcttctgggctgaagacgaagttagaggaccaaggctcagaccccagttgagttttgcctgtggagtggagctgaagccccgctgctgctgcttttgtttcggtgtgaggactaagcgcctcttctgtaagtattttacgctttatttacgtttggaactgtatattacttgtcgttttgtgtaccctggctggtcctggacagggatttaatacacaaaatagtctggaaatttgggctaaatttctgggcgtgacacatattaaaccaagtttagagatctcgatgcacgttttgcaagttcgtggacctaagtgaaacttcgttacaagtttaagtaccgctagtgtaatttactcattttataaatagactatagctggcaggtgaaatatctaggattttttttctcaaaatgaaaatgacgtatctagatttgtacacgctcataattaattaattgattggagatttttctttgggaggggggaggggggttaaaaattgcatgctaggtgctttcgttgaagaggttgtttgtttgagttttgacgcacgcgcttcgtcgacaaataagatgcttagcagggtgtatactattggttgactactaaattttgagttccattgataacacagttttcgacaaatttcgaccggtttttgataaattttgactgaatttcgaccaaatttactgtttacccttcgaaattccaatcgaaaattaattccgagccatgtcaaaacgtcgaaatttcgtagaattcgaccggttttcgttggaattgtgaaccctgatgcttagttttccaataaaagttgcgtgctgggcactgtttgtatcagtcatcaacagatcgatcttatagcacaaaacaatcttatagcacacagcatacagcaacacgaacatcagaataacaaaacaagcacacatacaagacttcctataaagcatacgtacttcacaacccggtgtccacagtcaacggaagaaatcaacctttgagcctttcaaaaccaaactagtctgctctacatcagcctctacagatggacatcaacgaacaatttatatggaaaaactcggcactccccaaggtccaattttttgcttggctactgacaaaggataggctacccacatgcaagaaccttcacaagaaaacaatcatccaattgccgttgtgcgctatttgtcagtctgctgatgaaacttcaagccacctttgcttcctatgcccgtttgtggtcagcttctggaattcaatccacagatatcctggaggcgtgcacactcatgacctgcacttgattgctctaccaaacaatctgccgcaggcacatttcaaaaccttctatctgctttgcctatggagtactctctccgtccttaaaaaaaaaaaagacaaaccctggtttccgtgcccaacgtttgactgtccgtcttatttgaaaaaaatatgaaaaaaattaaaaagacaagtcacgcataaaatattaatcatgttttatcatctaacaacaataaaaatacgaattataaaaaatttcatataagacggacagtcaaagttggatacggaaacccatggtttgtcttttttttttgagacggagggagtatttggaatcaccgacaagaagttgtcttctctgaccagcaatcatccttacatcggcttcttctccgctgtaaggatgagactactctgtggacagaacgacttcttctgcgcgacgatcgcctagttgctataacctggaaatgtattttcaacatcgcaattaattctctacacatgtaatgcgtgccgctggttacgtctgaactctatacttgtaaacctcttcaaatggtaatggaaattcaggtgggaacctctccctcctgtgattattccaaaaaaattgcgtcaaatttttttttacgtaaacaaaaaaacccaaactagtactgtacaaaatcgtacacgcttcgtactagtttctctggtggaaggtcatcagggcctcggttcctttcaaaaggcttattcgtttcaaacgaattgtaaaggaaaagtgcaggactatgcaatcctttgaaatgaacactgtattgacatttgtttcaaagaaatgcaccaaagaaaaaagggaacatatcctaagcacataaaaaaattttcgtgcacaccaactagcaaatgtcacaaaaaattctagaaaaaaaaactaaagatgtactcttaatagtattacacatatctacaaactctcatatttaaatttattatattttagccgtgacaaaaaagacaaaattctgacaaattttatctcttaggccttctttatttaggtttaagttttattggcttagacttttaagtcaacttattggcttatataatttataagccggtggatttaatgtcctaaatttagtggtggagtcatacatctatctcatataagtcaaaaattaaagcttctccaatatagcttttggcttaatagtgttagagtggtttatggcttcaaaaagccaaacgaaaaagctgcttgtttgtttaggcttagattttttggcttataagcctaaactaagagggccttaaaactgtcagattttcacttatttgttacggctaaaatataatgaatttgaatatgagactttgtagatagtgtaatactattaggagtacatctctaattttttctagaattttttttatgatatttgctagttgatgtgcacggagtgtgcatataaagcttgtatgcataggatatgttcctaagaaaaaaatttttatccctccacttttagagggaaaacaaaggaaagaataatccactccaattcaatgttttcaatcctttggattgtttgctacacaaccatagggaagtttcctatgttttcaatccttaggttacacatgtattcccatactattcctccattttccctatttctacgttttgaaaatcctacaaaccaaagaagtctttgcaacaggctttcacttttcctcgctcctcgagttgaattaagcttcatccaacaacatatgtactccctccgtctctaaatatttgacaccgttgacttttttaaacatgttttaccgtttattttattttaaaaaattaagtaatcattaattcttttcctatcatttgattcattgataaatatacttttatgtatacatatagttttacatatttcataaaatttttgaataagatttatggtcaaacatatgcttaaaaaataatgttgtcaaaatatttaggggagagggagtaccatgtaaagcaacgttgctctctggatggattgacggtttcgtggttgaaagatgaaagccagaagattatacaagcgcggtcttcggttagtgcagtaatgcttgtgtccttgtaagctattgtttcgttccaatgtttcagcagcgatgaaaattcgtgttcaccccaaaaatgaaatttttttattgtcctaccgaaaacctaccttgcgtaaattgacatggcaagttgtgttgtgtattgaggactatcggacgaagacaaaatgtagagcaaaggatccgctagattaggttagagaagaccaaacacaaagctgcgttgacgatgacgaccgcacgaactcgcgctataccggccggcccgcaaatgcgggagctcggcccaactactcgcgtacgtacatacgtatacggcccaactagacgcgcacgcaatcccgtcccggcccaactcgagaactgctcggctgccagcccacgtccccgcggcgcacggcgaaattgctcccctcccatgccggaatcccaaaaccctcgccaaaatcgccgcctccgcctattcgcgcggcggcggggacgcagctgcggaagtgcgggggggtcaccgcctcggccgccggcgcgacgacctccacatcctcgtccattgccatggtacggcgtcgccagctccaccttctcccccctctccttcgctgctgtttgcggttaggaacatacaaatgcggaggggccgcggcggtgtccaattttagttaggttttcgaaatttcaatccctggtaggcgcctgtttagtagcactagtcaatagttctgtagattgtgaaattttgaagggaccctgtgttccttacttagtaagggctataattgggctttcgtagaggaagaactgtgttgcagcagcttggtctcttcttttgtgctaccatagggccataggtggttgatgacagagatttcgccgaaaaaatcactgtagttaagcttggtctacctcacaaaactattggatctgccactattccagcttgtgcctttcaactgagcagtttaatgacaatgttgcattgtagtccttaacaacagagaattgtatccccatgcgtttaacatcgtggtttgtattcaacagcaaatttgttaaatggatcagtttcgcaaactatcacatccgagtatgtatgcaattcatggcacgctaatctcatctgccataccattttactgcctctgtttttggtgagctagtccatttctcttatccttttgatgccatgtactgtttaatttccctcaatccacattttttggatctgttagaaccctgccagctttatgttttgcaatttatgtgataccaaagctggctttgcatagtggaactgtcagccattttcagtcctgattttctcatgtgaaatttaattgttgttcacccatttcttcttcttgtcagtaaatgtgttgtcttgaattgggatcatttactcgctgaatcatgaatacatgcagaactatatacgttatactgtacatatattgcagatgaacagatgggcaacattgattgtcttgtaatctttaagcccatcacatgcgtctattcaggatccaccactaccttgtcgggtggagttcatttcgtagtatgtttctttctcacttgcgacttgtctgaattgaaggtaattgagggcatgtgtggtaatttgacttgtacgagataactctatactagactttctttttccttctactatcaaatggcccagttattacattgaattatcacaagttgcttttgtgcgtgcatcaatttggtctttttttgcatgcaaaccttgacctgaacttttgaccagtttgatccaaagttttctttgtaagcatgcaattttctgttcaatttaccagtattatgtgtattttccattacccaacaagcttcatagaaagtaataactaatgtacagtgatttttctgtccaggtgtttctggctgagcaatacacaccaacatcatagatattgcaggttccctccagaagcttgtttcctgagtaaatcaccaatgctgggttcaatgaatgcatctttggtatgttgtgccaacccaagcaataataggccaaggaattcagatatatcgaggcaacaaaaagatggcctgctttttgggaaaaaaaaagctttaccaagaaatatatatgactgtgagaacatttatgattttgattgttatatagtgttctccaaaggtggtccagccatctctgtcctctggggcaagcaattcacgcccgctggcaacatcaactccagggataaggtagaagattgtagagctatttgaaatgatccaggcacaactgtgagcgaggtcaacatccggagcacaaaaggcctgaacctacagaagatcagtgggagaggggcagtgttgatccaatccttaatttgctaaggaaacactcatggaactcaaaaggaagatcaacgatgggaaagaactgagttctgatgaaacgtggagaggcaatgattctgggaattaacagaactcaaggatctttggtgtgaaaaatgacatttaggaagagcgaacgtcctactgcatacaaggccaactccaaattgcaggcgaaggtctcttgttcgtggagtgaggttccagcctgttgttaccaatggcgatatgcagttgcagatgccaagtctatcacagatagcatggttgataatgacaagtctgtcgcagatagcatgattgattattgcaatggttgattgacaatggcaatgattgaaaatcacagatagcatggttgatgctgatctaaaaggtaagatatcaccaggcatgtttttccatacgaaatatgaccagaaaacatgtctttggatgactttggcattattccagatgatgattaatctgattcttcggatactaaaccttacgatggaactttctgatgttactggtagcaatgtatctcatgataagatcatggaattttcttgtgcagaagctctgatataaataagctctttcaaggttctggagctaagagaacttgcgaaatcttgaggaatcaagggctattaaaaaacgagtaaaaataaattggttgaactgttgagcaacatggtctgcttctgatccattaacgacagagtctgaccttgtatttgagccattctgctcaactatgtcctggacatgtgtgccacgtttgttttgtcaataccaatccatttagatagattaacaatgtaaattagtaagtttaacaactttacgctgttctgtgttgatcatgtgcagacctacttttttctaccaatttaagcttcttaatgaaacagctgcatttcttgtcttccctctactgtagtgctgttgacccttgattgcattgttttacttggcgaacttgtaaagctagctctattaacctgggaggtcctgcttacattgttctgatctgttggtgctctatctgtcaggtttgcgccattttctttaccaatacaaaaagatatatgaatggtatcgcctaatattctttttctataatgcaggcaaataaaggtgtatctatacagttctgttattgactgcggctgcagctttgctcgtgaagcgaagaatgaaagcggcccagtggattgcagacggcagaattcctggctgcattattgttcggcctctgtcttctcgtccagtccaagagctttgcttgtgtgttgcatcctgctgctaatcaatctctcgtgatccacgcacgcggcgtctcttggccgtggccggggccctcccctcttgatttctgggagccgtcagatctgagcgattggacggttagttcccccgtctcacgtgcctctgcccctgctgtcctcctcccctggccctctttgcctgcctgtatattgtctgttggaaccctgattaaagctgcatcccctcgttcgttttgatacgattgcagatcagtactagcaacaaatttccagtcgcgactctttcagaaaaagaaaaaggattcagtcatcaatcactagagagaagtaaaaagaaaaaataaaggtaatcctctactcctctcctctcgaacttgtgtagaactactttctttgtctggtcgcctcacttttgcagccactcgatcagcatgcatacctatataacttttatgcatagcttgctttctttcttttgctttccgtcatcactagtaattaattaaacttctagtaattcttttttttgcgcaaattcatggccttccaaaggaaggcctaattaaatagattgttaattagggctgttttggtttgatgccaaaattttccctaccaaatagttggcactttaaatagtaccttgtagatatttggtttgatgccaaaatttaccaacggtaatataattcctataaaccaactttaccaaaatattggtagtgccaaatattatccatgatttagcactactaatgatttggtagggcatcaaaccaaatgagcccttaataaacatgaatactgatcatatgcacatgccgtaggcacgagtcacacgattagaagtctagaacagaagcaagatacaaatgtaggtgcatggctgttggcatgtactccgtagggatagtagaagcgcagctggtccatgtatatgcatggagatgaagaagtgaactgttcgaactcggcttggaagttggaattaaagcacgacgaggccaggctagcaagctagcttctagctgggttactggaacccggccaatactgttcgtataggtcagtgccagtgcacgagtcagccatgctgccatggcgtcgtcgtcgcatgccaatggcttgcatgcatacagacagttcaaaactgaggatgaccagtccacatcatacagcgcccgtgcatatatatgtacgtggaccttagaccatacacatggagtttgtgaatttttggtgagcttatttcctgcttacatcacactttgcacatgtgacggagagagataacatgaaaatataagagctggctatcatgcaagagctatcttagcatgtgctcttagaaaaacaaattaaatagatatgtgagattaagacaaaatggtaaagtgtgtatacaccttgtagctccaaaaagttaagtagatatcataggtatattttaatattataaagacaaaatggtaaagtgagtggattatagctatatatgtgattacatatagctactagttgatatatcgatttactatatctatttcatattataagtcactttgattttttctaagttaaatttatttagttttgactaaatttatagaaaaatatgacaatattttcaacataaaacataacaactatcaaaatatattcatttttagatttaataaaattaatttggtgctacaaatgttgctgtatttttctataaatttggttaaatttttaagaagtttgactttagaaaagtcaaagagatttataatacagaaggtagggagtattaaacttgttccaaaatgttgtgccatgctcataatcttctcccatcctaacgagcatgctctcttcttctgttagttgctagattataattttagaatcagggcttagaactcgatcatgtagtagattgcgactcataaaataggatgcaatcataatgtttgtggaagtaagtattgatatatcataacaaacgacatgcatgttttcattccgggagcacacacacatgcacgtcctacgatatgtagtcacgtgtagtttttacatgcaatccaagctagaaagttccaaacattgtactgtgagatggtaaaactgaacaagattgacggccggtgtggatcgaacaggaaaagaagctagaagatggggagggcgtctatctgggagctgaggtcgccgtcaagattccactatcagtggatgtagaaatacacaggtacgtacgctgtacctatcgatctctttctcaagctaggacaaaagcttagctagctagctagttgcattactactggaatgcatatagatgagatgtgcaggtgcagctggctagtcccacgttgcgtgcatcgtatgcagggagcaaccagtccatgtacagggccgctccctcgttgctgaccggcggccggcatgccggattcccggccgctgccttaatcctgggccccgccggccggcgtatcgccggtggggcacccggccgcgcgcccgcgtgccttcccccacatacaccgaccgaccatcaccggtgtgtgtgcatgcatggccccggcctcggccccgatgtacatatgtaagcatatactccattctctaaatgttttacgccgttaacttttctaaacatatttgtccgtttgtcttattcaaaaacttttataaaatatgtaaaactatatatatacataaaagtatatttaaccatgaatcaaataattaataattatttaaatttttaaataagacaaacggtcaaatatgtttaaaaaagtcaatagcgtcaaatatttagggacggatggagggagtatgtgctagctagtacagtgtttgcacgcattgcatgcttagttaatgtgcatatttgatcatggtctcgaccaaaaccacggccttttgaccgccctagctatatatgagcatgtagcatataaaccatcatatcatgcccgcctgtctcgatcgatcgatcgagcgatctagtagtagtggcagtatagtatgtgtgtcgttcgatctagtgatgagatagaccgtgcaattgctgtcaagtcatgagaatcagaatctgaatcagagatggtgctgttgcatgccatgaaccaggcagcagcagctgcacatatgcagtgctgctagctaagcttagctagctgatcgctgtacgtacatgtgtccacacagtgtcaatcagctggcccttctgcctaccttatgtgtgcctgactgcctctcggtcctcgggcatgcagtaacgtagtaccagaggcgtacagctccctcgttttcgtcgttgcagcggcagcgatgaggggggcagcgtacttgcatatattcaccaatgtgcataggttctgagggtactttaccctgctcccagcccacggaacgacgattgggaagcctactttgtactagcgcactgcgccccatttccatgtagccatagagatttattgtatgtagttgatgggtgctggtcaatgtgcccagggcataaactgtagatgcacatatacaatcctccttctttccgcaccatatgcatgcatttgtgctatagctaggagtactaattaatattatcaccaattagaagcctccatctaacccatcacacacaaaatgcagccaagaaccagctagctgttactgttaatatatagacatgcagtgttgcatgcatgcaatacaatgcaaatgcagatcgatcgagaaaatgcgcatgcagtgcacaggattcgtggtgatcacaatatacaggagcagtacatgttagatcacggttcagtgtgcccaagctttacttcaggcaatgcaccagccaaaactccaaaattttgcgaatgaccattggttcgtatgcttgcagatgatgcatgatatagctagctagcaagaccacacacagcaggcaagggtaactagcaaccccctttagtctacagtcttcttctcagtctcgcactttagctgccttcctttatttggacagacattctatggctcccctaactccactgctcatttatcatcatcctctcctcgatccctctgcatgcccatgttcatcttatagctagctagcagccaccgatccatgtgtatgctcatccatctaatttctagttagttcctcatttctatgtcattttcgtatgcccaaaacatatattctaataataattttggcaaagttaacttattttgactatacagattctagaacgacacttatttgtgaacgaattgaagggagctagcagttggcatctagtttagacttaaaaaatttcccgttaaaatttttgccatagtcacatggtcgtaggagtgaaaactgatcggatattatctgatccgctctgaatttgatcggatatggtataggtttttagaaatctagtgaatatggatgcggttgcggatatgatatctctaaaatcctacggacgtggattgtccaacatttctgctagattatccgataggtcgtttcccggataattcgaaattattaacccatataaccactctatctgttgcatataacatgagatggcgcatctaatggcctaatttaccaattaacctaaatttcttagtttgaggctttcaccatctatatcacacttgtttagttgtatttttatattatgaatatcatgtattcatattgtttggtacttaagtacataattattaagatgggtcgttcattgattattgcattgttgtcccttgcattactaactcgatggtgtattttttgcatacacacataacatccgataaatttaatctgtttccaaaccgagtccacaccaactccgcaccattttggacatccgaaacaatcagctctgcatccgcatccactccaaattcgcttaaaaaatgctttaggatttggtatgaccactatccatccgaatctgttccgttttcacccgtacaaggtcgtgtactaatgtagcatgcattatgcagatttggttgtcccatgatggtgtgttacaaatagcttttattaatattaattctatagatatatgtagctgaaaactaaattttaacccaacactttcttttaagaaaaaggacaaacgaaatgtacatatatcatcacctgtactgcagtccaagctacgcgagtactctctccgtcccaaaataagttaatctagtagatagtaccataaatctaaataggagaaataagttaatctatactggatatgacacattaattttactatgaatttggataacttcaaattcatagtattaaaatgtgtcacgctcgctattagattaatttattatgaccaggggtagtattgattattctctagtagcactcaggcaaattttagtacatttatgttctgaggcaaggacgagtacaatcatgatcgaccggtgcgcgcgcctctttggccgaggcgactgtcgtgcatccatgtcgatcgttctgacatttaattgtttgcccaccggccttgatagtaatcggtcagctggttatagttgagtgttggatgttgcactggagatggagagattagcaagcagtttctgtttatgagctgacgtatgcacggagatattgatggtaggtagcactacacgaaccgtccgaatcagccatatacactgattgaatgtgtgtatgtacgtacgtagtcacgtacaagcgcttgcagcctcgcatacatcatatctactcgaggtgtctacttcatccctttggatagtgatgtaggccttgtcattgtgtcaataatttgtatatggagttatatacggctctgatcggtcgagcagtcgagctgctacgtttgacaagtcaaattatgaagaaagcaaccaaagttaatacataagtataaatttaagttttaaaatttaaattttgactgtcgataagccaataagatgaggagaacctatattcgggcttaggtttattggattaaactcgtaagcaactattttttcttatatggtttatgagctggtggcttttaagccctcaagtgtaatggcgctacttaaaaaaagatttttgtatgtggtcagaattgatcttcgcaagtggctggcggaccgcatgcacgcaaatgtctgcggaaatcagcattttcgcatgcgggaggcccaactgcttggggagattcattgttgcaggccgatgagctatgtgagctggttaagtcactgaagtgttcattcttaaatgtaaatattacatttctcagctccttagcaaattcttgatatagtgtatcaaaggtcttccactaaagagcattggtggattgtcgaatcataccatatgtcttgcggttttctcgatactatctcatcaactcatcgtcattaggatttgagaacaagcgcttcatgacatctttcactggcagataccatatcaccatggtcggaatatttttctttgtatgcaccgatgaatcaaggtcgacaacctctctattagaggacccattacctgttctgtaccgactagccccacaggttaggtaactgttcaagtctacatattccttgtagtacaatacacaatgatttacacatgtatgtatcttttggacatatgagtttcttcgcttgatacgtgttagatggcaattagttaggtttaggaagcaaaacacttaagagacccaacaaaccattgaagctactatcggatcatttgtgtctggtcttcaatctgagaagttcaagcatcgaaggcaatatcgtaaaatctttctcacatcccttggattcgtcgtaaagaagatccttcgctgactaaactaacgtctcctaattatctaatcctctcgctgaacccattagcacctttggtttagcgtgacgtggcatatcccccagaccagaaagagctttaaaatcatcaatacgagtagaactgttctcgtccatctgtaaataatcatcaatatgatgaatgaattcttcgcatctcgtacatccatgtctgatccatctgtaaataatcacgacacgaataaaattaaactataggtgttttccaccaaaacatgaaaaatacacgcatctcctcgaaaataatgcaccattacattgaactagcatgaaaactagtgcttacaatagtaattttgctcatctaaatattctattatagttaaaatttgcaaaaatagctcataagagtcgtcttctaaaactgcaaaattctccgcattgcaccgatgaaatattttttaaaaaaatggcggcaaatggaggaggtaaggaagtatataaccttgtatatcaatttaaagttcaaaacctcccccaccctatttgttgcttgttttgaagagataaacttttggttgaaatggggttagctcgggttgggatcaaatatatgggcatatcatcgcgggcaggactcttaagggcccgcttgcaataaccgcattatcgcaagcggccctttaagatgccctcatgtgataatgcacccattatcgcaggcgggtctcttaaggggggccctgtgataatgtgttaccacagacgggccttaaactaccccgataaagtgatttttacatgcggaggcagttacggcctgtctgtagcctggaaagggcattgtccgcaaaaatcaaatctatagcattgtggtggtgtcacttttccactttatacaagcgaaaaaaaagttactccaacttagttttagcttaacagtataagggtgacttgtgcctttataaaagctaaacgaaaaatttgcctatttatttaggtttggacttttttcttataagttaccttgtaatatatcgtgcctgaaaaaaaagagggcagctagggacaaagctagctagtagcaagctcgagaggtggtgaacagagaagaattcaatcccctttgtaatagtttgaatcttaatggttggagttgtatgtatactatttatgtaccaaaacgcgtgtatgggtaaggtagtaagaaatataggattgagacgaacgttgcccatgcttgctctcgatcgatcactttctctttctttctagagcagctatgtgcaagttgtagtatcacattatcttgtccatctctacccatctagcttaaatattgccactctcgaattctcatcagtagccaatagccggtcgatgggaactaatgattttcctcagcgatctgcagggctttttgactgattaggacgtgtcgtcgccgtcgttgcactgcgttatcgatcgattgatcatccgagcatctcgcgctcgcgggcccctcgtgcgggcgcaacagtgccatcgattgctccctctcatggctgcataagaattgcagtgaagtacactacccatcctaaaatataaggatttctgagttttataagtaattataaaagtagataaaattaaattaattatgcttagacggttagattaagatgagagatgattacgatcgtttgtaatgaaaaggtagatggagaagttgctatatcatggaacaaattttagacaatacaaattgctattttttaggatggagggaaaagtcatttttctgtatattattgtttggttctgcgtcttccacccatgattaatttgatcgatggcgacgctctgaaaatgacattaatatacaatcgatcagttccttaccgtaatatgctacatgctcgcttttttacttcaaaaggtgaatcatgtgtgtgcaccaggacttataggtcaaaagtagatccaacaaacaaacagttcaccaatagtattacgctccacattcatagaaactagcgatctgtattttatggatctgaggaagagaagagaaaaaaggcgaacttcgttggagggggagtatcgaaaatccgatggtccttgagggaggcagcaacatgagattgtgatatgttggcggcggcgtaccgcaagctatggcatagtaggaggcgacgaaatagaagcgggaggtatagtgaggcataaggcagagggaagtgtcggatttcggcattccttgaggtggtagcgatggggatcacggtagtagcacatcgtcccgaaatctcatagggcctgggaggtggcgtgcggcagtgacggacgtggtagtggtgggacgaacgttgtgctgtccgccagccgcactttgctaccggtcgccgctcgacactggccaccaagtcttccactcactttttggtagtagcggtgggtgtaggtggttgttaccgttgcagttgtgttgtctttcaagtactaatatcggtgacgcctatgggagtcacaccttcctataagcgttgccgcgatgcccttcccggtggacatccatgctatgcgatgaactgtcccggtggagatgatgttctagatgtctgaaatagcgatggtgatatttaagatgtcgcaaccttcttgaagtcatagcattggaggtttcttgttagtgtgatgtccttatgatggtgtccccgtcgattcgtatacgatggtaattgtggtggtaatctgggcggatgattgttaactactctttgatgttgacttcctctttggtttgacgttagtttgctgatagcgatgggagcgaaattcaatcaacaaatgatgttgtttttatggtttgataaagacatgaactaatacaagccgttggtagaaacaacggttatttatacttggacctttttagggtgctattgttgtttctaatcaagccataattgtaattcataattattcatcgtgtagactctataatagttggttgtaacttctatggagtaatgggaaaaaataatgctattataaaaaaaaaattacactccaccttcataacccgtattatggcatgatgtttcatagaagcatggcgatatatatgtgcatatagcagccgtaaaccctttttttttaccaaaaagcggtcctaaattttgacgattgatctgtgtaaaaggtttaacatgtagttaccgtggtttaaatgtatggtttacctgtccaacctattcaaaatctccattatatttcggacaaattagctactacacatgggtcttacagttggcaaccactaatgggcccgggtattataaatgcatatgtacattctttgaaagttcccctaaatgcttagcccctccagatgggacgagccatgcacatatgcatatgcatcatgcatagaagctaacctgaggttttgttcttgcttttttctacaaggttttgactctagaaactttatgctttgagacgtgaacgattatatggtctgcacactgcgaatgtggtgtttaaacttggagtgttatcgtttaaacgatgtgctcgaatgttgatgctatgctagtaccatttgtagtgaaacatatggcctcaaaggtcgatgcaagccaagacatgggtaggccatgaacgtcttgtgtcgtgtgccgcgctatagggccacgtacagtaaatggtgcccatttagcaagagtcgatactctgttaccacttgtaacacaccatgcgacaaccaaaaataatccacactgatcgtgtcaattgtggtacaccgcgcgacaataaaatccacacaatgtctaaacacccatgtggaacatctgtgtatgggtaaaatctcacctggattctacttatttagaagaaggagagagagagagagagagagagagtccatttttctactttaaacttttgagtctaaaaacccctcaaaatttgaaaccggatactattcaataacgtaaacaaagaaatccgtcactcccaaattcacctatattttgagtttttttgtgtcaattggcaatttaattatgtggctcaaaccgaaaaacaattttagttcaattgataacttacaagattttgcaagttttctcgtttgcaccacaaaaaacaatgtttcaaattaaacaaaataatctttagtggaataattgcaatccattcaacactatatataatttatctagcctgttgatactgctatatatatgtaacttttctttagcaatttcttgagtgcacttaataagttttataactcaaaagcattatttgaatttagaaaattaataaatggctttgaacaattctagaatttttttaaaggtggacgttgatgtatttataaaatttatcgatccacaaaatatttgtgtacttcctccgtttcatattataagactttctagcattgcccacattcatatatatgctaatgaatctagacatatatgtgtggctagattcattaatatctatataaatgttagcaatgctagaaagtcttaattataacctgaaatgaaggtagtattaaactatattttctgcattccgattgtaataaatttatccaaagttacaaatatgctgatagcagatatatttttataatttttgttaagacctctagctagggcgatcaagtagctattcttgcacggcatgaattaattagatgtttattatttctagtatttattttaagactgttcttgctagtaaatcatgttgtactgcaattaatacatgcaatctgcaacactgattactgtcactgcatgtgatttactttccccgtcccataaaaaaccaatctaactagataaataccccgcacaatgttgcaggagaattgtgtgataatagaaggcacaaccaccccttaacacaaacaccaagaaataattattatcatcttgta

SEQ ID NO: 12335 - DNA, 47448 bp, Oryza sativa
  unsure (1)..(47448): unsure at all n locations
catagttaatggtatgcatgcatgcatgacttatattattgaacataaaaaaaagtggttgtaccttatattatggaatggaggtagtatatatgagttctaaaattttcttccttatctactatacggtttttttcatgtgtttatctattttttatacttttatcaattattcaaatgttataaataattgggttgtatggtatgccttttgggggaaaagatgcaatttatacccttgatgaatcatccaaaggctaaaaacaattaaggtgatgtggctttatgagagaggagagaattagcattaactacacttactcgggatgaactttatagatctatataggatactggatgtgacacatcctagctagtactatgaatctagatatatctttattcagatttgtgttctagatttgttttatttgggacggagggagtaggcgccaaggtatcccaaaccactggggccggagttatcgcgccccggcggtaagcacggttaccgcgcggtaaccacggtaaccgtggcaaaccgtacgaaaccgtgtaaaatttatcaaaatttcaaattactttttaaatttatttgaatttaaggaggttaccgtggttttctttttaccgtacccccacagtaagcgtggtaaccgcggttaccggcggttttgtaaaccctggtaggcgccaatgccatatatgaattgtgtcgaattaattaattagcttgtgggtaagtagctgcatggagcattaagggggtgcttgaagaaaggattagggtttcgtaaattgcaatgagtgggatgccagatctatgatctatctcctcataggcttatatatatgtttgcaagtactagagcgccctgtactctgcgttgtgttgatttccgaaaagaaaaaaaaattaccatatgcaaactaactttcactacttgtcactgtcgtcctcctacctcagctccttctccatcgtcgctccaaacaactttaatttcaaactcttccttctgaaaaggcactgttcatgcatgctacaccccttcactctctctaaaaagttcgtgtgtttgtacatgggttgtgggcgcgtacattcatggccctactgtgccgaatcgaagagagacggtggccgttgtgaagcagccagcgacctgttcaattaatttccttgcctggtataaatttcttttatgttctgcaaccatgcacggctacacggagcctaatcattgataattcaaaatagtaatatctaatcgttcatttaaggacactgcggtaaagaaattttactatctataagagataaaaataattggtatcttatagtatctgagatacttgagagctatctatcaaaatttagatttcaaagagtgtgatacctctcagtattatccacttaacattgccacataaatgatcatccatgtcgcctcatcattgtcggttcagtgtgaaccgacagcgatagcgtatcattgtcgatccaccgtgatttatggtccaaactgatcacataatccagcagttatactgagtattattgtcggcttttatcacaaactgatagtgtttgtatcattgccagcttatgccatgaaccgatagagaaaactggttgaccaacatttgaccagagctaggagaggttaaaaatttcctaaggctccacggctgaaaacataagttgttggtagcctatcagtcgccacccaccccaccccaccccacgtcaacaaaatcccctcttcttctctcatagtttccctcttcttccttccctcctaatctgaccatggtgccaaccgcaccacgctagctctcttcctccctgtgtacctctcccttccctatatcgagccctctccccctcccccttctctccctttctctctcccaagtccaggttgaggtctatcttccctccctctcccatgtcgtaggcagctggtgtggtaagtgaggaggataggagacagctggcgaggtggggtctagatccagtgaccccgagctaggagtggccaaattcggcccacgggatggcagcggctcacgtggcatgatgacttgtaatctctgtgggatcctttgaaacaaaggttttattaaaggaattttgtagatatgaatcctttggaatattttcctatatatatgctcctttggataaatggaatggaccctttcaaattcctggaatatggccaagttcataaggattttggaggaaatctaacatgagctctaattaagctcttggaaaattaactttatgccatcctctctctaaattcatatattgtttttatatgaagtatccaaacaatacaattgagcaattccttgggatcacattggcatgccactccaattcctatattgttattattcctatgtttctcaattcctacgttttaaaggagccctcaggagctttgtacaagaccagctaccatatcgggggtccacacattttatgataactagtttcatgtcgtatatgtcctctaatagttctggatcaccccattagggattagcatgaagtacaaacccagtaacggttgcatatatcttatggaatcgttatatatcacttgatttcaaacggtttctgtgagaatcgttagagattagttgtcgaagattaattggctagctattttctagttgtgtacattctagcttagtattattgggcatgcatgtctgtactgtacatgctcaatcagtactgagcattcatatgcgcttgtctcctgcatgtatgtgctcaaagctaatttactattcgatcccccatttttttggccagatcgatgcacacaaatggactcgattctgccacaagatatgttcggctatatatctcttataaatcttttttagaataacaataagcagatctaacttatatatatgtttattggtcatatccagacaaaatataggagaaaacgtaatttttgatattggctaaactagctagtcataaattttgaaaaaaaaattgatcttttatggttaacatgcatccataacttaatttgatcactatatttttaatattatgtatcagtatactagctatcaaattataatattgagagattaattaaagcattttatgaagagtttactcctatcattttcatatagccaaacatactttctaggcaagttttggttagagcacattttgactgcacacatattgcaggcaatatataataaatttcccctgcatgtatctcatttttatttcaatacctaaacacgatatatttgcaaaaaaaagtcagatacgatatagtttctcaaataataaattttcccttgatatgtttctcattttttaatacttattaaacgctagtatttgcgggaaaaaataaaattcagatacgacatagtttcccgaattaagcagatatagataatctaggaaacaatttatacggtatatatgaaaaataattaagggcaggggcatatcatgcatgagagagagagagagagagagagagagagagagagagaggatgattcagcattcaggtggatgggaacatgcagccctgaccacaccagtcaatggtctacagcaaaacactacacctacaatacgtgtacatataagggatgcacatatataataagcatccaacaatatatttgtgcaccacataccatatttcatgtcgtctacagtagtaacataagtggcctgttcactctagctacatagtgtgcatatttttctatcagttgtgtgcccgtgcaacaccgatgcacccatccatcccatcatatgatcctatccggcggccacactgcaaatctgcaaaatgatagaatttaaaaacacaaaaaacaagttagggtcggtcaaaaatcgacaagaaaagcagcagcaggagagaaacaagaggccatcccctccagattatcctgcagtcatgtcatgcttctcccctccctgcaggcctcaaggcatggaaggaattgcaaagataatattattgctagtacatggatggaatatatacttgaaaatgaaatatatttatacaaacatcctaactttatattgttcaaactttggaattaagagagtgaaaggtaaatgggataaaacaaaaaagaaacatctttaactggtaggtgacatcaccaatagtgagacactttgtgacttcagcaatctcaagacatattagctgtaatttctggtaagtgtgtatggtgagtttgtatattacacctcccagaaagctagctataaatatgcacacacccaccatacacactttacagaaattatggctaacatgtctgaaattgccgaagtcacagagtatgtacagacgacgacgtgtgcatctgtattgtatttcgaatattaatttctctttaattaactttcctgtcattttctcaccccctgagtagctagcaccaagctgtctagccttcctataccctactaggctctactacacccatttctacctcacacacctagctagcaagtaggctctctcactccacacccacactactcctcccaggctgcctgcctaaaaggctagacctatccatctcttccccccactcctccagcatcgccatcatccactgttcatccactccatctctctctctctctctctctctctctctctccatcgatccctgcaggttcttgctgctgctgctgctgccttgcttgctgtcaagcatggcttgaccacctgagagcgaggagagcatagcgtagtacttggctagctgctgttcaattcctcatggatgattggaggatcgctagctaggtcgcccggatccacggacacctctcctcgtctcgtgctcgtgcatgccaagatcgatcgatcccagctgctgctgcgagtggagcagtggaggaggagatcggctgctacctgacctagatcgggaagcagattcatccggtacatgttatatatagatatagatcgttgcttaggttcttctcttcttgtttgatttcgtcggagcaagaaatgatgcttgcttcttgtgattcaggttgcattacggcggcgaggcgagggcgaggatggatcgtcaccatcaccaccaccaccaccaccaccatcacatgatgtcgggcggcgggcaagacccggcggcgggggacggcggcgccggcggcgccacgcaggacagcttcttcctcggcccggccgcggccgccatgttctccggcgccgggtcgtcgtcgtcgggcgcggggacgtcggcgggaggcggcggcggcgggccatcgccgtccagctcgtcgccgtcgctgagccggtacgagtcgcagaagcggcgggactggaacacgttcgggcagtacctgcggaaccaccggccgccgctgtccctgtcgcggtgcagcggcgcgcacgtgctggagttcctcaagtacatggaccagttcgggaagacgaaggtgcacacgccggtgtgccccttctacggccaccccaacccgccggcgccatgcccgtgcccgctccgccaagcctggggctccctcgacgcgctcatcggccgcctccgcgccgcctacgaggagaacggcggcacgccggagatgaaccccttcggcgcccgcgccgtccgcctctacctgcgcgaggtgcgcgagacgcaggccagggcgagggggatcagctacgagaagaagaagcgcaagaagccctcgtccgccggcgccggagccgggccctcgtccgaggggagcccgccgccacccggcggctcggccagcggcggcggcgacacgtcggcgtcgccgcagttcatcatcccgtgagttcttctcgatccccatcgccatctccgcatctccattgatcgatcgagcctcgcagcaagaaattccaatctccttggcagaaatgccatcttgctttgccagtacaaggcatcatatctcttctttcctcctgaattggtttcgatctctcccattttgcaaaaaaagatttctcctctttttaatttcatctctgtctcgctttctaagctaggacgaaggtcatgcatgagtgagtacttagtttaattcttgtttttttccttagctttgggacgtcaattaattggtagctgctgtcttcgatcgatctcgtcccgtttggtttaattattttgatgcaagaactggagtaaatttgatgagaatctcaagctagctagcctaattaggagttgtaatatttgttttagtctgggggatttgcaagaacaaaagtagcagaagctgtaggcatagcaagctagctagtgttagtatctgtagaatttgttcttgtaatagcttgtcgccaagctagccaagtgcagtggcgtcagcaatgcttccttctatctatcatgtactagtgatgatgtcttggtcttcctttcttggttgagcaaaagggcaaaaagggagagatcgactagctgatgagatgatgagtgatttcaattggtagcttaattaagacagaaacaacatgtgttatgtgtacttgtcctgggaacagattccatatatatgccaaatgctttaatttgggctatgatctgtgtgcaatgcaatgttcttgatatattcatgatcaagtgctccctttggtcatcatgtgtgtgctggtagctagactttatacaaaaatatgttgcttttgttctttgctttgaacaatgttttgttgtgtagtgccagtttttgaatggtttacagtactggatactaccttctttcacttttacaatatgtgcaaagtggtaacagatgaagaaacaaacaaaccaaacaaaagaagaaagaaagataggagtcttttcaaaaaaggagagaaaagaaggcagccaggcaccaaaaatatataaagggttcaattgggtgtgcactagtacgattgggtgatccctatttttgcccatgctttgatgcttctgattcctttccttgttcaagtttgaattgctggatttgacttgatttaatttgtcttcacttgtttattattcctgatgatgagtatatatagtagaactgacctgcacatatatatatgtttctgtaacaactcaaatgatcaatgatcagaggttttttcaaaaaaagagaaagaagggagaatgcatgttcaggtagctagcagacagcagtaaaactacaattctctttgtggttaaagttagtttaccacctttgttagaacctgatcagatcattctttttgcatgaaaactattcacttctaaagtcttttgtgtccctatcaatgcaacagtgccacacacatgttctttcacttcatctctgctgtccccatgtatatatatgtatactatatgatatggcattgctaccagcttagcaggagggcattcaagttcctgttttcacacagttgatgcatctatcactatcttagattttgcttgtcctttcaatgcatatatatgtgtagttgagaaaactttttctttcatatatatatggaacagacaaattaaagtcgactgttctatgtattgcttctatttaatttattcgacaactttgcgtgcaactcaatctgcttctcttttttgggggattcaaaagaatttttagcacatggccggcttcaatctttatgtgagtgatatgtctgattgatatatatgtactgactgactctctgtagccacagcttgcttgattgtggttgcataccttgcatgcatgcgtgatgagtttttctacctaattgagctagtatatatactgtatattgattaggtatcacagtatcgtcagtgttttatttgacccctaggcctcctttggaatacgacaattactaaatttccttcgttgcattgcctatatatatgtgcgctccacttagtttgatcaatacatttttatgagtgcttatattcatgaaaacaagccacaatattggctctaattttatacatttggtttctgcaaaggtgtataaaaatatgttttagcttatatatgtgtgtgataaaatttatgctcttttaatgcaatatgattgttttttgtttctttgattccaaatatataggtaataacaaatactaaacattgtgttgtctaaatgcaaatatagttatccacataatgtctattgaaaaaaataatatcaatatcaatggtaaacagttactcaccataaaacaccatattaggtgtgtgtttttcatcattgtttattttcttaagcttaattttatgttttttcattatattctattttccagcatttgcccttaaaccgctcatagatatgaaaacttgtccatgaattttttttcttacttcatttattttttttcgtgatttatcagccatatagctcaaacaatcataacccatttaactatagcaacaataaatgttaaaaaaatatgttgattacatgcacctttaattttatcccaaaactgcattatacatcacaaaaaccattcatgtaggtttcctgaaaataaaagggggcactcatgcttttatctatccatggttttcttaattttcagcagctaacaacccatagaattatgtcaaatttcttaactaaacataagcatggacacttcctcccaacatagtgtcttaaaaaatgtcaatcaacaagacatctaatacatttattataaattagaaaattatttcgttcattttttttgctacaagtcaagtaatcaactaatttaatacaacacttgatagataaaggtggtatttaaatgtaaaggctagtttaatttcacactttcgacacgcatcacactcacaacacgtatggatgtttttttaccgtcattttgggaggtattgagagatagatgtttatcatagctagcgttaatcatgacgtacacaccaggattaattatcacaaaagaactatatatatgacataaaagacatgttatccatgcatagattagcatccacaaataaatttagcagatcatggcgatggaacattttcttaattgtagtttagattgttgttgctgaaactccttggattaatgcatgggaacctgatcaacgacaagtgttttgttgtccctcaattaaattccttactatgcctccatgaacttcttgatcaattaatcatctcggtataccttgttgtaactagtatagggtttaaagcgatctttagtcctcccttggatgcatgtatgcttaattttggcctttaattcccatatcttctgttgaagtgaatattggccatggcacatctcttgtccacattattatagaaaatgaaatataagaatagatctaatacaagcatatatatccatgtgcatgaattgtacatgaaaaatgaaggtacctgaaacctctactagtcattctagttattcatatcttatattttgcggggtatatatatatatacacacacacgatcgatgctgaccaaattaacacacaccttggagcaattaacagggatttattcttacattgcatatagcgatagagctatatatgcattatactactttggcttctacttcaaataagacggacaataatcaaacgttggatacagatacacacagctgcgtttaaaatgggaggcagggagtagaagtatttaagcatggggatctgttcattgaaagaagtagatagaaactggaacgggtgggcgccaaaatttggcgaaacaaattcccccctaataaatgaaaaatccctggctcgcgttctattggttcatgttgcctgctctactgatactactttgcatgtacccatgattgacgaagagtacgtctagctagtgcagggccgaagaggctactgaaattaaggtggcccaatcgcacagaagaacaaactcgcacgtacgctgatgtgtcgtaatctgagaggagaaatgtatatctagcagcagcagcagcaactcagtttgcaggctcctttgcagcttctgatgcatgcagctgagactgataggtgagaggcatcaactagggacgagtttagtttcaaattttttcttcaaactttcaacttttccatcacatcaaaacttgtctatacacacaaatttccaacttttccgtcacatcgttccaatttcaacaaaacttttaattttgacgtgtgaacgaaacacaccctagctctgaatcgctctgatcagcaatgcgaaggaggaagaagaagaagaagaaagagagtgtagaaaaaatactactacactgctagctagctgctgctcgatcgatcgtagaaaactccatgagagtaatcgtccatggatcagaaaaatttagccgcgggatagatctgtggcgtttgtgtccaggacaaagggccactgttggcgatgtcattcaattcatttccaccgtactgtacctaccccgctctcccttcatttactccgatcctaacgtacagtatactgcagtcgtgtatgtgtactccactacgggaacacggcttaattttacccacacgcagtgtaccaaagtgcaccgtacgtatttcatcaatcttactactatattggttcagtgctttagtttagggcaatcacaattaatttttgttcttcattcgtcatcactgctttgtacgtaccaggtacgtacttctggtatctaggagtttcggtttagaaaatgtcaagatatgtactatgtttaacacatgcatggtagactatatagtacatacgtcctcgttccaaaatatagaaaaaataggatttaaatcttatgctataatacaaggatttttagcactattcacagtattacttttcccatcaatcatttaccattaaaatttctttccatcttaccccctaactaacctcccaccgctattcgttacaaatttattgagatacatcgaagcctttcttttcttaaccttaatatctactaaataatctagaaatgcttcttgggggagtatcttcacccttctcagcgtaggtgccctagcctaccaaccagaggggactctgaaggaggcccggttgaggccttggtaaggcctccaggaaggacctagtctagaatggcaccatcctcgaggtggctccggcaaaatgcgacttcacgaagcatctatgacgagaagacgggccatttagggtgcattcaatgaacccaaccatcaatgacgtatccgcggcgagagcaagcaggaatgccgaggcgcctcgatagcgtgcctcggcctcgagctgtctatcccgagattcgtcggaaccccgtgatggggggtttaatggaggcagcccctttctggtcgcctagagttttaccttcttgctctcgaggccaagcctgccagccagcctccacgtagtgggcggaggccaaagggccccttcgtaacttcccatataatctctagggatatataattgtaattcgctcctcgaaagagggcaatggagacaacgatagagaaatcgcgttgtttccttggtagactctcaatccctgttggattttattccaacaatgcttacagtttggatcggatagagcaaaacatttctgacttagttaaaatgctcatggttgaccttagaaggtcttttcggttgtgttgctgtagcttgccttctacgacaagtgccaagtagctagacacagggtagaccagaatgagacagaagacccgtgtgacagcaacaaaagaattattattgtggccctgtttttccagctaccagattattgtcatggattatttgctccgttccttccataatatatttttttagagaaaaatctttattctaatgcattacctagatatcttgttatggactattaatttcaaaatatttaatttatgtcaaaaaagtgtaactataattcactgcaataataacatggttaataattcgttttaaactactaggccttatagcgtttcaccaaatcgttttcgtttcttccaaagatctgcgtggtacaaccgtacaaagcaaccctagtagtcaatttggtcaggaggagcagcagcagcagaagctggaccagtgggctgcaccggtgacttggtgagcagtgctgctgctgattcaggccagggaacagatctgcctgcgtggggcctacatctacagtaatcatatgccattttgggccgggatcaatccgtcaggcaggccggccgttcgattggttcgtttagcgaagagttgaatccagacggcccataatctgttgcatgggcctagcaaaattgaagttagagctaagcccaggcccacagtcagatgaatagccaagcccattagtgagattccctgtgatcctgccatactgggccatacttttcggcttttcctttggcccaacttaagaggcaggcccacggtcaatcagtcactccagctggttaggtgatcttactggaaaaacgtaattaaccactgtagtaagaaaagtattcctaccagctggtcaaaaaaggtaaaaagtaggctgacatgcaagcaaagcatatgcatattgcatggagtacatgggcatgcaaggttgggcggtggtcaagccaacaaaagctggccgcttttgctaacactgacttggacccatccatatgccaggctgcttgctgcctgcctagcttcaacccttcaagcatgctgcaccacacagcagatcgatcgccgatatatgccgcattgtcgcgatggatggctaaaaaaaaagggttggaaggagagatgcccggccctccgaacattttcaaagaagaaattacgaacgggttaagaattaaacacgaaacctcaagattaaaatcatacaccccatgtccccatatcactgtattatcaagcgtaacatcgataatataacctagagctgatcaaaccggtaatacgaagtactataactacaacagtccatgaattggacaacgcttgccaccagcaagagattagaaaaaagagtccattctctcatctctatcctatttacggtatgaaaaatttagaagaaaagaaatcatatatagtgttagaaaacttgcaacgaatttttagcagcgaaagttaaggaggatgctaattaaaacctgagccctagcaaaagcaaaattactctcaaaacttatcctttagctttgtttatcttatttttctctggtatatttaacaatattttggtgcactttagatactgggttgttaaaaacaaaagaaagcaaaaatgtaacactatatttgccatgccatccccccatgcatgtatggaaaaaactctacgatcgagtgcagcgtacgtttgatcgcggctgtgtaagcttagaagcgaactaaacgttttgtttgtttttcctctgaaaatgggtaagccgaagagcagtgaagcaaactataattaacaccaaatgataacacactagatttgttgccgatcgatcgagattcgagcgtcagatcctttgcttggtttggcaaccaaaatcatatctttggcttagatttattctttctgcttctgtccaaacgcctagcaacgactacgctgcttaattaaattacgtgcagcgagacgcaacaaattgggacatgtgtcacttttatactcagtactgtaggtacacatgaacagtaccttctagttaaacaaatcttgatcccgacaggaacagtgagcaaagtactacatttatattagggtgacatgctaattaacaacagggctttgcaaggtcccaatcctcttgttctggcttagcattactgtatatattttgctattaattattattttttcgccgggctggtattaattattctctctgattttagataatatagatgataccgttgactttaaataagtttgattattggtattattcaaatacgcaaaacgtttgaccattcatctcgttaaaaagttttgtataaatatgtaaaaatataaatcgtagttaagaacctttagtgataaattaaacaagtactcacagaaaaataaatattaatcaagtaaaaagattaaaaagaagaatcctcaaatgtatatcaaaattgattgcgtcattcattaaaaaccgatagtacgtccaaactcgatctttctatcagtacaaaattttctatcagtataaattaaaatgctccaaaggatctcagcaaaagttagatagcttttgtatggccgccatctgtataggagcaatagcttaattaattaattactacctagttaaacctaccttttatatagatcatatcacgttacgtagtcagtgtgctagttcggtactactatccaattaaggcactgctcatcagtctaccacacctatggtgattcaacatataataaaactaaactagctttatcatattaaactacattgcttcataatttatatgtaaactacaactacggtatgaaggattgatggtaactaattaagccaggtagcatcgatcaagtagaaattaaaactgtcgacacagatcagaatgacgtagttacgtgtaaacagcagctatccacacaccaacttgttttccagcagctagctagctagctagaattcatcctcatcctcagcatgcatatacatacgcatgcataccggccaaattcaatctggccagaacttgattttaacggtaaatagtatagtaattaacatatataagaaagctatcccaaactagtgaagctttagcaatgggcaaaataattaagcaacaggggatgacacatgcatatggcctgatctgcatgcatgcacctactgcatgctggacattctgtcggcatttttgtattactatgctaatttaataatttatatggaactatggaagggattgaatacttaattacaaattaactcatcactgcaatatagtataagtacactatatatatccagtgtgctcagattagttgcttctaatcaaacatctcggttaattgttatattgaaaggacacttgcgctatagctaatacattcggaacagcatgtacctaggctgataaactaattaattagctagctagctaggtcatgcatgcatacacacatatatatacatggtcgatcattagagcttgcaattgtcaattaagctagaagcaagcaagttggggataaataattaatcatcaagtaaacgcggtatattagtcggtccattagctgcatgttttaattactttacaatatcgtctctgatggaattagttaggtaaatattaacaatatatgcacatgccatttgaatatatatacatgtatgcatcacgtactcgatatagctcatgtacgtattgtacgtaataacactgtgtacgcattttcaagctagatagcaaattctcttttagtttccttcgtggattaattttctcttctactttaggtcaacatatttgccacacttttggaattgatcgtcaaggacctttttatccactttggataacaggattctaatacagttcatacttatgcttttgtacttaacgtaatatttatatatatacataatttatatgctcctactttgtacattttttttatctcatggccggggacgggttttatttcttactgagattattttttttaactcaaactagctttatggttgtgtgtatcctacattcaaagatagaggatataactatatcttccttatcttaaaatggtcaaggggatcccatgttatatatctatcagttagaggccacgtaaccgaccaaactttgctgctgttaatttagtaaccggatgacgtaaccaatcgacacagccaatgatcagcaagacagcaactaatctgcaattagtattagattagctatgctctgcgtgtcttgcgtatactgtttgtgtaatatatcatttagaaatgatatgtggtcatgtccatagataatttgttctttcttaagtgcatgcgaccagatttcgatcaacagtacaggtctgcatgcatgaactcgtcacatgcacacagcaaattggttgctgcagagacgacaaattaaattgaaccgaacaaatcgatattgcaatccacccgttttgctaattaaacacacatatatattgcaatccatccgatatatccatatctcaaaaccaatcagtttacaatcatgcacagagtcaacatcaggaccagtacttctgattgtgaataaacataaagctgcacactcttcatgatgcatatatgcctcaagaagattccataaagatcagtggtctaattattccttgatgaaaaacaaatgttttttttctgatgcatacatgtatgcttgcattagtatagtgtgtggtcctacccaatctatacatgatatatatgtaagaaattaagcagcaaacgatcaatgtgtaggggaacacacatgcatgatcgttcagaaaaaaaaagttagtagtggtcctgcctgctctagatgctatgctatttattatgaccatagaaattaagctagcagaagcactgtttgacatgcaattaatcaatttgcatgtacttaattttcagtgcacaatgcacaattaggcagcatctgatggatgatgagatccctgtgcccttagcttagctaactgccaaaacaagcattcagaaagcgtggtgatggatggacgttgcgagataggggccccggcgccgatggaggacaagacatcagatcatatcacagaaattaacgagaaagagaacaaacgaacctagacgacaatggccggcttgggtcgttgtgtgtgcttcgttcagtactactgttgtgtgacatacaagaggcagcctgcacccacatgcatgcagcagcaagactgatatgattctcctgacttagcagcttgcatactgttgctccttcgatgattgttgtttattttctttatcagcttaagcttttaagttgaattagttagtgtacgtaactcaatatgttagcgagaccgaaaatctgaagttcaaatcatgtcagatgcacaattaaatcaataattgtagctcatttctatttcagtctcgtctcgaggtttgagggaacctcgcgtagaggtgagtgttggcatataagccggttgaagtaatgaataggttgtgtttgttcacatgatattgagaggagaagatttacctcatacattttcttttccgaactaataaatgatgtgttgttcttaaaaactttcaatagaaatgttgctttaaaaatcatattaatccatttttaaaattaaaataattaactatttaattaattatacgctaatatggttcatcttattttgtgtatcttctcaatcttccacttttccctcctctcaactccttcctaacagtgtttaattaccttgctggggttgtcagtcaattgtgggttagatcctatattaatggccactgcatatttacagcagtatgttgggcaaattgttgatgattctacaattacgtgtataaaactagctggctctcttatgtaggatggttaagttcctctgttaatttgtgtggatcagttagttaagtttgaaaattccacacagatacagcaatgaactaaaactagctctcttatgtactaggatatataattaactaaaaccaggtagctaatattaactacctgcagctgttaatttgtatggatcagttagtgaagtttgaagcttccacactgatacagactgaaagatacagcaaaggactagaaaaagggttccaaattaagtactccattaatatatccacccatcaacagaaactgatcattcatacattatatgtacacatgcatgacgacgtctgctactactgcaatctcaatcaaattaaaggctaagatatataatttacctccaaacaatgcaacagcgctatacgacgtaccactataccctatacacaggtgcgcatgtttgcatgcacaatcaacgaaatctgcacaagctgatcgatggaatcgatcaccacgaaacaaatcagatcaaacaatcgaggtgaaaagaggttattaataataaacgctagctagctgcgctgcagaactgcagctagctagcagctgggagtgtgtgtaagctagctaagctagcactagcagcaccgacacctatggtggatcgtcacatcggcatcaggccgttgtaattgtagtgctcctcgagccctagctccatcagaccgcactgctcgccgccgtcgaccctcgatcccgccgccgacgccgacgccgccacggcgccgccgtcgagatgctggctgaagtcgaagatgctgctgtacagcgccatgctggtggtggggatgaactcgttgagggagccgccgccgccgccggtgacgggcatgtggtggtggtggtggtgatcgggaggcggcggtgggtggctgctgtagtggtggctgctgctgcaggcggcgagcgacgccgggaatggcgggggcgagtgatggccggcggcggctgggtcgtgagacgaggaggagttggagtagcatccacccgccttgatggccgcggcgctccgtgccatggcgatcaccgcctcctgctcgttctccatgctgtacgacgactccgtctccgtctccgccttcttcttgtagaacactctgcacaacacccaatcctcctgcatacacatatgcaaaattaaacacacaaactcaagctcttgattaaccaaaagttactactatactccttcaggttataacacgttttaactctaataaagtcaaactatttcaagtttaactaattttatagataaatatagtaatatttatgatactaaattagtttatcaaatcaataattgaattaattttcttaataaatttgtcatgggttaaaaatattattattttttctacaaacttggttaaacttaaaacagtttgactaaacaggtcttaccataacccgtgctggattttatttatttgaggatgaaaggagtaaggaaattattggagaaattagttggattgtgaggactaaccttgggaggggtgtgagggttttccatgcgaaattcgtgcatgacccagttggttttgacgccgttgggggcgcggccgcggtagaagacaagggtcttgcgcatgccgacgatggaggcgcggcggtgggcggcggcgtgcagcttggggttgtggatgacgcggtccttgccggtggccttccagtagccggacttggtggcgcggttcgtgcggagccccgtcgcgtacttgcggtcgcggaagctgaagaagtaccactcgttcgtgctcagcttcgccacatctgcatgcacaccataattaatttttcacatcacaactcgattaatctagactaatctgagatcaaccgtaatatattcagtatgtggtataatactagctacttgattaattgttcgatatgattctgattaaacttgttcctgcagttttgtaaagaaataccgttaattattcagaaattttggaaagcagatcgatttgattgagggaaattaaacaaaccggttaatttaatctttttcaatattatgtatatttttattgttctcagtttttttttttttgagaataggatgggccggcgcgcggggaaattaaggagagtttatgcacacatatagtagtatgtcctgaagaaaatgttgatatggaatgaaataagttaaattttaaacatgtataaaaattgatgggaaatttgatcgtaatcgtaagagacaaagagaacaagctatagctagagcttagatagcccacttgcagtcataaagaaataaattatagatataggtatatgtatgcttgcaccagaagcaatatataacacactgttgcacatacgcgcacagagatatacgtgatggatcgacccgtgccttgttggttaattaacaagggggaagaataacgacaatcctaattggagccaataaagcgtggttgcgtgcgtaattaatcattccatggaaacggaggaaccatctacgatttaattaaccataatcatgcagaagaggggagagagagggcgcgtggctaagagcaggtacaatagcaagctataagccagctataaacatattttaaaaagataaaggaagagagagaagagcaggagactataggtatatagtcagctgtagcacggactctaagacgtaatatgtgtatgacaggtaggaccaggtattaatagtacagtaagcaactattgtatgaattgactattacattagctataaatgatttggagctagtgagagggtcgcttgtgggagaggaaaaaggagtagtaattaattaattaattttgattgagtaagtgattacctggtagctcccacggctcgtgggtgtggaggtccacctcgaccatggtgccgccgccggcggcggcggctcctccaactccggcgaagcgatgctggttcaccaccttgttatgaaggtagtggcagacaagctcctcgtcgctcgggtagaaccggaaccccggaggcagcgtcagctcgatgtccctcaaccccatgtggctatcacctgctaaatttctttgatgatctctctgtctatagcaatctagctatatctatatgtgattgatctctgtggagtattttggaagtggtagctagctatatgtacatagctaagaattaagctgcagattgatgcagagaagaagaagaggaggagagaaattgataggtaggaacttggaagtagctagcacatatatctgtataggttggcgattgtgtgagctcgggaagaaggcaggaggcaaatatatatagcttggcgagggaataattatatgcgcagctagcagctgagagagagaagtgtagggaagcaagcaacaaagcagcagcaggagcaaagggtactactatactatggctagcaatagcaatagctatagctccgatctctatctctgtgtgtagtacgtcggtatgtaagtatcatgtatatggcagtgagcaatcgatcaatcggtcgagagctctatctgcagtaatactgttgcgcctgctgcttgctagctgctgcaagcaggagatggcgctgtcacgtacgcagcgcgcgggaggaggcggaggacgcgggagaggacgcgtgcgcggacgacgtcgcattcactgacgacctctctctctctctctctggagagaagaggaggaggagggcaggtggggttggggaggaagaggaatcaaggaagaagaaggacagagagagagagagagagaggagatccagggtcgcaagaaagatcatcgccacggccggcccacttgatgatggacgatcgatatgtacatatcccccaagtgcagcgacaacggcaacatacatggcactatcaatagagacgcatttggggaaaaaacgcgagctcgatcgatctctagctgcccattatcattgtgtttgtgtgcatatcaattcaaccgcgtgcaagatcggggagccatcgtttcggttattcgtggtacaagtaaaacggcatatttgtaaatgaaaaataatttttaaataaaatttttataatattcttagcgatcaaaaatcaaaggctaaaaaataaactttgataaaaaaaacctcaaaaccagatccaaatttaagattaaaaatttaaattttgactgacaagtataagcgaaaagatgaggacatacgtatatgacacagcttagctaggcttaattattgatccgtcctacgtacagcatctcctcctcgatcccggcctctagtatgcatctctacatgtctctctgtctgtctatgctctaagcttgttaaatttgcttacaagtaagtgcatctatgtgtgtgtactgtgtttgtacagtgcaggtacatacatgggtacacagtgtactgtataggacggtgattaattatgcaaaatgcaagccaacaaaaatatcgagacggaggataaaacaaggatcagcgcccctgaatatatcaatccgcctacacttgctagcttgcgtatactgtacattcagagaagttatcgagcatgttgatcaaagaaatatcatggataacaagtctaggtattaaacctgtgtgtgcgtgtcgtcttccgtgtaattgaaaagagaaattaacggcacgattaataaggtagtctacatccacatacaacttgcgaaccgcctatgtaggtgtatggctaaataaaatggttcaaactaacataagagaccacatcagttacaacttgataattattaatttcagaattcggagttgttataatagtaaaatcgagagatcaagacgaatacaatcacatattaagtaatgaaaaccatttcgctggactaccccctcaaattatttctttctttctaaaaccccttcaaactatttcagcggagcacttagcccctcaaaaaaaatctcattcgcaccgccaaaccatcaaaaatgtttcactttacttcctaacatatttctcttttctttctccctatataagtcgtattttgtaaataaaaaaatgttaggatgatgaccgatgtattgcaacttacgtctcaatatattttttatttttatcactgttttcatagggctgaagcacctaaggctgatttaagcatcaagattctaaaaccaagcaaacaatcatgaagaaaattaaaaatacttttgaactttcatagtggtgttatctatggcactataaaattgcaacttaaaatataacttatataaaaataaaaaaaagagaaatgttattagggagtaaagtgaaccagtttagtagtttaggccaaatatgagaaaaaatattttttcagggagggattaaacgatccataaaatagttcgagcttgtaaaatagaattatttgtttgtttgttttaaattttaaagatattaaaccattaaaataggaataataaattttggactacgactacaaactaaatacaactttgtatttattaattcgaatttcaagattatttggaaaaaaagaagcaaatttaacatgtatatgcaaacaaatgtcccgtgcattctcaacttgtggagattattactagctaacagtacgtgcatcttaagcaaggtatacgtatcttagcttgattaccgataattagcagggagagaggctgtcaggaactagctgcaggtaatcaccgtacgctgcttcaccgcttgatcgatcgatcatgcattttgatgcgaatttaatcatgagagaatcggaaattatttcttctactccaagaccagaaagcgacgagagagatgattatattaaacaaacggtagaggtagtacaggcatgtcgaaagaaaaggaacgacggagataatgtcagaaataatgtctgttcagcctgcatcgatctctgtacttctctgtagtctgtacactgtactgccgattaaattgaatcagatgataatgatatcacgacggcaaaacgttctctaattgaagtagtagcagtgcataatgtacaggtgtattgttgatgatcaattcaagttcttcatcatcatcaatcgagaaatgcgaggtacaatcattgtgtacatgtataataatactttatacgtatatttgccgtgtttgtcgtgtgctctctggcgtataaaaactgacgaactcctgcagtagtactgtacgtgtgtgtgtcattagggcacatgcgtatatacgcagctagagctatatatacgttacatattaattaattatagctaagtacctattccaaaacagtgggatgcgacttatgcgacggaataaaaggaggatatgtacagtacgtgtacaagtacagtacgtgtaattttttttgagatgaaaaaaagtacagtacgggtattcgtgatcagtatatatcaaaagtacatgtaccatatgctagctgcgtcgtacatgcatatggttgttgcggcttaattatccaaaaattaattaagttattacatccctcccctgatcatcaattaataatctactcttctcattaataatctctatatagctaagtaccttgtgcagaaaaaatatccatctcgatctaggctatacacagcaagaataattaataaaagcggcatgtatgtttaattaattactatatacttgagtatgagtatgagcctatgcaaaagtatatatgttgggaattaaagtagacgatggtcggcgatagatttgatcgatgcaggactacaggtaggtaggcacaagcaaatacatgggcgatggtaaaaaaaaaagagagagagatatggatattgtttctgtgtgatatagcagtattctttgtgcgagttgcagttaactaaaatgattggcttagagataaatactccaggtcaggacaggattgatgagagcatgcatgcaatgcaatttcatggcagttggaggcaggatagataaactaacttggggagatgattgagtgacgtcatgcaattaacaccaaggaacagggcataggacggaattaaaaaagaggcgatcattggctttaaaaaacgtgggaattaatcgtggggaatttttcgcgaacgctgaataatcatggggaataattagcattaactgcttgaattgatcaccctgatgtgtatgtatgtatgtatacgtatagtactccctccgtcctaaatgtttgattccatttactttttaaacatatttgattgttcatcttatttaaaaaatttaagtaattattaattctttttcctatcatttgatttattgttaaatatatttttatgtatacatatagttttgcatattttataaaagtttttgaataaaatgaacagtcaaatatattttaaaaaattaacggtgttaaatatttagaaaatgatggagtatatattaactgaggacgagatggatgctgcgcttaagccggcgactcgatctggaaggtgtccaatcccaatcacccaatgacagcgatacctctgcagctgggacctagaacaagctaacctagccagagtatttagctgctacaagctgctcctcccgtttcatattataaatcatttaaatcttttactaatcaattttttaaaaaaattaattaaatttataaaaaatataatagcattttcaacacaaaataaatatattatcgaaatatatttaatgttaggtatagtgaaactaatttaatattttagatattgctaaattttataaacttagtcaaatttaataaaatttgactataaaaatattaaacaacttataatataaaacaaaacggagggattactaattaacgggagctaggatattacatagtagatttagctcagaaaagattagccaggagggaacaccgattcagacatctcctgcttagctgctggtactggctagctaactggactttttctattttcttcagagcctgaaatcgttggcatcttactccaaaagggcagtggaaaagagaaaagaacaagaccggtaaagtactacataaagtacttgctactacatattctgacttgttatgaatgatgcaaacaggagattaaaatcccaatttgttaagctatggctgatgatgagtcgtagcgaaatgaaagaagcaaccaaaaataatttataaataaatctcttatatctatactattcatggcttaaaaataaggctgaaaaaaagatgctactacggtgaaaaaaaatcataacataacttttaaaattaaattttgtttgtggctgataagccagcaaacagacgatgcatgagatctgtttgcagtgcagtgtgcacgacggacatatgtctgagaaaattaaaactgattagcagcagctagatattgtcgcacaagtgcagcagagtcgaaaatccagcaagaaaggtatggttcaggcagggagagaatcagagaatcgatctggtccagaaacagtctcagtgaccatgctgcatggatgtagctacatgtctgaggaacaagtcagtcatggggtgccatcgagtgcacgcggaaaagcaaacgcggcatccagtggagatggagagcattagagcactgtgcagtgcttatgtggagtgctagcttgtgtaatccaaactttccaaagtgtcaatcaggtctacagaaatgttaattatgctttgttcgttgtcaatgcacagtacattaccatcccattatcggataaaaacacacagtatattatccatttcttgatagtactaattgattgatcctgctgcagcttgctatcaaggattcagtgaaaagctcctgtccaaatgtttggtggtagagttgttcttgtacaggtaaaaggtgctggaaaaaaggaacagtcaagattgtgatttattttctcaccaacaattcatgagtttccacttaagtaggccctatatataatgccaagatatgcatatataaatgaattgtttatgctacttctggaggcatcttaaatttgtgagttgatcccctgtccttctctgaacagaaacagagaaaagacagacgacgttgtgatcgtttctgctcttaatcggaagccaatggaggagatagggatccctaattaagaatactactgccacaacacaactaaaaagcataaccacatttgcttagttattaattactactaataagcttcttaaatggaactggcccttatccctttctctagaaaagaatataacggacacaatcatcatgagctgatggcattctgtacatatttttataattattcagagatttcttttttgtccctgctggagtttttctagggttgtttataggaagagtgacggctccatactccatttcttccaccaattccttcctactaatcagactcaacactaacagtgccctttttcaaatcctaagaaagcgacagaaaccaaaagagcacccccaaaattctcgcttttaaactagttttctctcgagtagtagtatatctcaaagtctacatgaacattccattgaagcattgactcacggaattaaaacatgtaattgcaactagtattatattgtcatgagggcagggttaaggctaaagcaaagtacgtacgcatgcaaccgaagctgcatatgtaatctgccatcaatttgcacattaagaacaaaataaaaacactaccctccatatctctcaactctagctgcttggatgatgttgaatacagtatatatgtttgtacgtagggagtatatatggaagtaagtaactgtaggaacctaattaatactgtaacattatacagacagcgacagactgacagtgtcggattaatcaagttggctagctattgcagtgcagcatctaccagcctgatgcttggtttttggctgcgtactgaaaatttatgcgagatcaagagctcaatcaagctttcctccccaagaaagaaaaagcttcgcttatccttcctctgtctcttttccttgctaccattaggatccaaattacacgaaatcatcaaatgtcccatcgatggtatatgcatgatgtgcaaaacggccatgcatatattttttttttctatgtgcagtgcttgcattgggctcctctgatctccaagaggaattatgcaacacaaaaaacatatatgtactgtggtgatattgagtgggctgtgtgtctccatttcaggaatggcctgtgcactatgcatggacagcattagttatgcttaatcgttgagtcattttcaacgtcgcatatacaccctcctaagctagcccagctctctgaaggccagccaactgctgcatgaaccatgcatccactgcatgttgaggtaggttaatttcattttgttcaggaattaatgaaagcaaatatatatctgtataacaagtagtcagtctgatctttcaggaggtagtagtagtaactaaggctgtgtttagttccagcggtgaaaagttttggcgtgtcacattggatatacggacacacatttaaagtattaaatatagactaataacaaaacaaattatagattccgcctgtaaactgcgagacgaatttattaaacctaattaattcatcattagcaaaatgtttactgtagcaccacattgtcagatcataaagtaattaggcttaaaatatttgtctcgtaaattagtcgtaatctgtgcaattatttattttttaacttatatttaatacttcatgcatatattgaaacattcgatgtgacatagcgaaaatttttatcaggagatgtaaacagaccctaagttaacctgagaggtttaaacttgtgccatctgccatggatgcagaagtagcaagaggagacgaggacgcggccgggcggggagcagaggcggtggtgaaggagaggtcggaggaggcgtgcggcgaggccgtgtggcaggcagccgcaatgattgatacgactcgtcgtcagcaaatattccctcctagacagcgacctcgtactatactacactttgcagcaaggcacgcgtcctaatgttaacccgtatgcatgcatacagattagcacgcttaattagagcaaggataatgtgagctactccctccgtctaaaaaaactcaatctcaaataatgtgacccctcctaaaacaacaaatctagataaaagatagttatactaggagcggtcaaatcctctcctagattgagttttttttttggaacggagggagtataaacctactgtaagctacttcctccgtttcatattataagactttctagcattatcaacattcatatatatgttaatgaatctagacatatatgtatgtctagattcattaatatctatatgaatgtgggtaatgctagaaagtcttataacctgaaacggaggtagtagcttacgtggaggagaggtgtaaaaaaattaaggatgttagctctcatacaagagctagcttaatataagcttgaagacaaatatatcaaatgtataagtaagagatagaaagaggagaaaaaaaattatagcaaaccttatagctaatctctattatatatgttagctttaagataaactaatgaactctactattattcttgctcttaatattttctctattataaaataagtgcaccataaataagtgcatccgtatattttaaatttgaactacatttaagtcagagagagtattattactagccaattaccattgtgactacgtttaccgtggtatttattggtagcattttattatccgtatatatattattaggataaataacctttaattgttaatgtatgagttagtatatgatagaaaattaaagttacttctctatggtactgtggcagtataaatagaggagtgaatttaaactctcgacgggggcatttcctctttatttatatgtcatttaaatagttataagataatttgaaaagatgaattaatatgtgatagatcacttcacaaacatgcaagttaaaaatgtaagttgagaaaaaaaatatagctagctaacatatattcacagtcaaattcatttttttattacatgtttgtgaagtgatatattacatattaatctatctagttgatttgttttctaaataaattataagcatttagattacatgcaaataacaagagaaatattctcttgaaagtttagaatagtaaacgtatattgaattaaattaggaaagatgaattgtactacaactcatcatcgcacatgttatatacgtatacgtatatgccgagtagtggatacgaggcagagagagggtagagcgtatcgcatacacatacagagatacagggaggtggtggcatatgcatgggggtgggggggtgggtagcttgacggggtgggaaaacggttgtctgcaagtaagctccggtggatcatccgatcgttggatggcaccgcacatatggcatgcctagcttccaggcctggacactgacccctccacctgtccgcctcccattggtcgcctgcctcttccttgattcatttctcttcctattctctcatcgatcgatcgatcgatctcttcctcgtgaaaatcaaggctccttcgacatcgcctcgcgacaaacctcgcctccctatcacggccgatctatcagcacactaatccatcatgtagatttttattagtatcaattctgtttcagctaactcgtcagtctgtctgccaagccgcgcgtcgagcatgcacgcccccctgctttgcccatgatatattaatttaattaactaattaattggtattctatccgtcttgaaatataaaaatctagtattacacgagacatatcatagaaattctatcaagatttgcagaattagaatgtactccatatctcatttcttactccatattttcggataaaggtagtactatcagttaattaaaccttggatgcacgaggaataagttgatttgatcgatcttggtgaccctttttgccctgtattgaatgctaatttgctttcaagaaacccccaaaactgacgcggccgatcgatccatcgatcgatctcgccgccgaaaaggagggaaaggagaatgacaccaactgcaagagaagagattaaatgtggagaggttgacagcatctgatcccctccactaattagccagaccgcgagctgatcgatcgagcgagctcagtcacagcgatcgctccagcgacaaacgtgtgggggatttgatgcttccatctccgtcgatcgccctaaagctcaagatcgatccaaatccagctcctaattaagattaattagctatggatgttaagggagaaagagacgtccatggcgatcatccatcaccgacgcaatctcgatttcctatctatctatctaggtccagatccatctgcatgcccatgcggcactaacagtacaaaacagtatcattactgttaaactaatctttgcgataatccaaaacgaccactcttgggaaagagtcaagagctaagatagcagctagcctgcaagatcacacactggatcatgctccatccacagataccaacaaacggttcacgggtcgatccaaactgaacctgccattcgattcagagttcagaaaatggccaaaaggccttgctgtgtttctgatcacagattctaatatagatacagccaggtgcaagtgcaatgccgatggggatggaatcatcctcgccgatctgtccggcgaactgccggctcggcgttgcaaacggacatgctcgtcactgtggactgaatactgaactaatctctgaataatatgcggcggcagctgagcactcgatttcagaagggagggaaggggctgagacccaggtagatatatgcaggaaaaacggtaggtgaactaccctacaataatgccgacagcaactcgatctcgattcgattgatagatcgatcgatcacacagatggtagcacatcgatcaacagcgaatcaaggagaaaatgatgctctctctctctgtggtccagggacatctacttcagctctctattggccgataagaatcaaaaacgctatctttcagtttggtcggttcagtacctcccagtagaagcaactgctggttcagagctcgtggtgaaagtgaaatcgatgacatttggatgccagttttattttatttttttgaaagttcagtaattagcaagaaacacatatttgcatatccaattaagctacaaattcagcattgaattgctgcatctatgtcatatgtatacagagcccacaggttcagtagaaacgagttaccgatcacagaggaaaggaacaaggcaccagctgaccagcatctacacacaaatacacaatctcttccgagtgtaacagtggcgatgagtggaatgcaacaggtgtcaggcactcaggctatcagagtgcagcaagacgtaaagggtggatgcaagtggcccacttcaattttcatatatgtgctgaatgatttctaatccaaagtgttgcaggagatgtactgctagatggatactgtgaacagagaatatatttgaaagaacaggatagaccactgtttctgaaagttccttttcttcttgggaataatctgtttctgaaaattctgaaacttgctactgtatctgaggtggatgccacttaagcagccccactataattggtgtaaatgtcatgttaatgtagcagatgtatatgtatgtttgcacgaaaatgaccaagcatggacaaaagattataatatgtggaataatgtggaatgaagatatttacagttcagaggcttgccccaggatggtgtattgtcattgttggcaatgaagaagacaaatgacaaatcttctttgtttcatagatggtaatattctctcattttactgaaaattaagtttctccgtccttgatcaccaaggtgcagacaaactgaacatagaatgcaaccagatacctatctagcatcttctatatttgttttcgtcatgtctccatctacaggacccgaaatgatgaactggcatttttaaattgagaggagttacaatatggagtagtcaattagtgatcactatgatcggtatttctgaaataatacaaataagtataaaataaaactaatacacggtgcaacacaaaaagaagatactgtaaaaaagagagagaatttacaaatgcacacagaggcagcttggtagagtactagagtacactgaaatataaacttactgagggcaaatgtggggaaaggtaagcccaagaggcatgtggaccaggcgtggaaaaaaggcccatatggcccgtgatggaagcaagaagcccatatggtcggcttgcggatgaactgatcggcccgaggcccaacttgacccattataacattagtatacagtacaacgtgacaggccgtcacttgttttctcggcccaactctacattacatatacaaactctaacgccacaaaaataagtacaaaataaaggaataaatgatgtagaaaaatcagaaaagaaaagagaaaggcccatataaattcttcctagttgatggcttctcctgcaagcagcccggagtctagacgaaaacctcaaatacaaattcgaaatcctccccccatatgtttcgtgcttgccacgccaaaaaaaaaaaaaaaatcagcaacgagagagcgatcgcgcgttgcagcgtcgcctcagaagcacttgtcgccgtcgtcatcccccgccgcggccggcctcgccgccgcggaggggccgccgccgccgcctaccgacgacgacttggaccgccccgacgaggtgccccccgacgccctcgccttcctccgccgctgcttcggcgccgcccccgcggcggcttctccctcgcagttgttctcccccacctccgtcttcggcggccgccgcgacccctcgctgcctccgtcgcgccgctctttgccccgccccgcccgccgcggccgctccgcctggtccgctctgccgccgcctcctccttggttctcctccgcctcgccgccttccgtgccccccgccgttggcttgaactcgttcatctgcgaccagtgatcggagcagttagagacatgggagatggcgcgatcgggggggaggagcaagggggcggcgatcacccagctgggcgcggtgacggaggcgttgtcccagccgatgtgcgcgacgtgcttcacgtccgtcgggttcccgatctgcatctccggctccttcacgctcggatctgcaagcaaccaaccccacaacaccagcgtgcgcgggcatgcgcgtgttcgtcagacaaggtacacaatctctcacaacgccatcccgtaatgcattttgattttcgttgtgtggatgaatgatgatgaattatcaatgtgtggcatgaacaatgttgaggtgaattggattggggaattggggaatagggattcgttagacttggaaattgatggtgttcgaggcgtaccgaaaatttgtgagatgtatcggaggcccttgagaaggcccttcatcttaaccggttccacaggcggctgcccgcccgcggtgctctgcgaggaatccaccacttatatgtttgtcctccaccccttgtcccttgatctagccttcacaagtaagcaataacattacaaatttttcgccgggccaatatcatttaaaaaacaaaagtaagaactaacaattctatgaaatgggatacaacctattgaccataagcttgattttacaaatatgaaataccaccgtgaacagagataaaaaaaacgagaaaagccatctgaatgtttcgtcaaaatacaatgttgataatgctataggtgttggggtgagatttacatctaccgaccacgtagcattgaaaacaaaacaactattgtggtctatcgtaatatgatttgctggaagatgaagattcagcaatgtatatatttgttcttttcaacattctgaagttcagtttctatttgacacacacaaatttgtggcgcctaattgaatcagactcacataccttgcaaagcagatttaagagggtgatgaagcatgatctaccgaatttcatcttctttatgacatcttcattgtgtctgcagcaattctcttcacctattgctgtttgatctatcacaatttagtggaattgcaatcccttccaaagctcaaacaggaacaagcatagattctctcttccaagttggagaaatggaagggcagaaagtttgttgcctcgatctatttatggttccctatttttggtctaggctccttttggttgaagttcattttgacatacagcagtttgtgaggccctggttttgcttaactggtctgcagcgcaaatggcggggatggacaactcagaacatgaaaaaggggtcatttagctaacaagccaatctgcctcttattttgacaatttccgatcatatcccatatcctttcgtaggtagttaacgaagcttgcattggagcttgagttcagcagcgcaaaatgatctaatacttgattcaatcagtatggagtgtccggtggaaaacaacggataaagtatcggtgcaaatgttttgatatatagtatgattatcgtaggtttcttagctttttcgatcaagactttcaagcggcctggtcatgtttcttaatgtagccaaattgttttgccacttccgtctctagtccactggaagctacaacaaagaaaatgaaaaataatcctttaaacaatatttacacacatggtcggaatccaacaagttgattttctttttcctaactcactgtattcttaagaaatagtgaacaaatttattgcagtgtcaagaacagtaggaaagaagaatcatgacgatgttattgcagcataattccaccgataccaaacatttcgtgatgtacctttacaggattggcgttcctttcttttgtagtattacaaagaaaatcaaagaattgtataatacacacacgtatcaaaaatggggaaaaattgcgatgtagctgcttctccagttcacaaaaagcccaatcgaatatcgtcacttaagatgtattaataaggatctgtaaatgctactatcatgcttttacctgcagtttaggaaagtagagagttattttagttttgactcctgactcctgagtgcgtctaaggccatataattatacaaatggattaacagaaatcttactgtggttaggtatctctcatgaatcttcagtgcccctctgcatgccttctttgcatccagacttccagtgatatcgtttaatatctgtttgcaggggacaagcacataaacaacataatcgtgtatagctttctacaatcatcatctcatgacacacacatggagagagagagagagagagagaccttcacgacatcgtctagaccttttgcatcagtcagtatctgcttgtttctagcctctatgacactagccacaatgaacacagatagaggtatctgctcttcctttttagccgcctgtaagtttttctgttcgaattttccacactgctttaaggcattttcatcttttgtgtttgcttgagatgtactgttatcactctccaacatagaaaagagacctggattgtactccatagaccacatgagctgcaacatttgtaaatcaaggaaacagccttataaaccttccacagtacaaatcaatacttgattgtaagtagaaaccacattttgattatgctttattaggataatcatgagataataattgaaaagtcaagaaaattcttatggtgcagggaactaatcaacacacctaaaaggttaaattatgcgaccttgttgggaagcttacctcccaaaggtacattgtgtctacaaaagagaactcccttcggaaaagaaccatcagcatacggaaggcaaataagtattcccctccatcaagattttctgcaaaaataatcttttgatcatggaataaatcacgctacttatagttcaataattcagaaagaaaaggcattgttcctttggccattctaatgaacaatatttggctccaaacaactctacctaaatgctcatgtagcttcggatcaacggctttcattacggatgacaatatggtcagttgagatcgaactccaatggaggttgaactactcacgaaatttcctcgctgcagagttagcatgtacaatatcaatctctcagtatctgtagaaaaattaacagagacagataacacatgcagcaaaaccactataatcaatcttaggggtttttttcccatataatgttcattagttcatatcaatatcaattattgttttgataggccatgctaagttgcaaaaatatttccagaaaacggttctgcatattacagcgaccatattgaccttttaagtttactgtaacattactgcagttgtgcacaacttttaattaacatcatatatcggaagtataaattgtacccttagcagcggcggagtcaaggcccagccagccatggcaaatgcccaggctccgcctaagatgctgcagtagattagcaattcattaatcatgcaaagttagcatattttttaattaattaccttaatgaatgctagattagttgagaaaattagcaaagcatataattaaggctcacaccatcacatgtttgcagtctatcagccccatctttttgcttatgcttatgcttattagccaaaatttgaattttcaatcttaaatttagagttgattttgaggtttttttatcaaagtttatttttcagcctttgcttttgggtcgctaagagcacgtatattaaagttgtattcataaattatttttcgtttgtaaatatgttgtttggcttattcttataataagccaaacgatggagccctataggccatcacagcttatatactgcaactcgtactgttaattttacttgtgtcaatggtaaaatggtctgtagagttgtacaagttcattttcatttgtacagtactgccagtggcttgcccggggtcaataaaatttctagatccgccactgacccttagggtaaaggatctggatatttcttagtgaataaaaggctacatgtgtaaaggtgcttaccaccctgcgcataagtcgctcaaagcaccaaaacgcatccgcttcgtgttccaagaggatcgacattggtgagcaaagatcactcattcctgcttacaaacaagaggattttatgggggggaacagcaaaatttacataacatgacatttagcaagctaacatggttaagtgttccttttccttttactatgactggatttgcaaaaggatcagttttgcttctgtaacgcaccttgacaataaccgatgtccttgtcaacccatgaataaactgcaagaatgtcccacaacctggccaagttctcttggctctcataatagactagttgacgatctgtacgattaacatcaagacctatagttgaatagtggaataatcagaccaatgaaagtataaaaaaatataacaatatgtgcccagtgaactctctcttttttttaaaaaaaaacataaaacggattgagggatgctgaaaagagaggattagtactcaccaatctggtgcagagttagcttccattgaattacttcctttggtaggggtgtgtcactagcttgttgttctgcatcaactgagttaggatcctgtataggctggccatcttctgttatgacaggcatagtaattacccttccgctaccgactgccgtgtccatttctcggcactttgttttcagtttctcatattctaacctataaaaaattagaatgagatattagaatgaatatacatgatcaaacaataaaggtgcaattaagaatgaaccttcgctgttgtcttaattggctcttttgttcagtattgcttttagggtcataacaacccagcaaaaactcccaaacttctcctttgatatttgggtgggtaccctgtttagccaaccaaaataaacaaggccttagtgtgaggtcatgattcatgaatgcaggaagaaaatgaggaattcctgatgtcccatcatgtttggatcatctgtcaaccattgtctcattgacatacggacctaggcttgtgttgttagtgagaaggaatttttgcaaatatctatatattactaaattattaaaacaaggcaaatattagcctccacatttgcacttcatcaggctacaatttaccatgttaattggagaaaaataaatagttcatagttcacattgttgattgtgtaacagatccatattagtgtagattaaaatgaagagtcaacatcaatacaatgtaggataactgaaaatctcagaataataaaaaaaactagttatttgatttctaagcatataacagtataattctactttctgaaaaagtataatttagcctggcgctgtggtgcaatcacggcgtaaattcagctagttcggagcatgcaagggattaatcgaaaagtatagctcaccccacgctgcactcttttgatcattccagctatgtctaggacaccttcttcattgtgaagcagcttccatctccttggacttagagtgaggccaggctgccaaaaggaagaggaaacagcacacaacgagtcaatgcacttcataatcaaatacatggctggcactaatctcgctagtcagaatcctcgatgcttccgctcggcaaatcgatctgagacaacaaaattctaccttcaaactaaatgccctcatcatcttgcaagatcaatcgattggccatctgagcctaattcagctcatccaggtaacagtaacagttaagataaaaaaaaaggtaacagtaacagttgataattagatactagatccaatccagcgcaagatgggcactgtcaaaatggggacgggggcataggggacgcggaattagattaaaacggagaattagaaatggatagaatgaatcaattaccctgggcttgaatcgcgtcttggcggcgtcttcgcggcactcggggcggatggggtagaccgtgtccggatcgatgagcatgtccggatcgttgtagcagcacgccatgaacatcatcctgttcatcttgaccgcccaaatcgagccgcggccaaagaggcaggagggatcgagacgagaagacgccggccgctgctggtgatcagctggaaccacacggacgggggggcagtgcgcagtgaggacgaatcaagatttgttcttcactccctcctttcctctcctttcttccttcctttcctgatttgtttgatgatgtgccttctctgtgattgagatccttggccgtagagagagagagagagaggagagagaacggaaggtggtgtaacggctaaatttggggggtcgggaggagagagacggggagacnnnnnnnnnnnnnnnnnnnnnctgcttggtttgtatcagggcttcgtcgctgagatggacggtccgagcttgagctggtcgtatatttctctttcgaaactgatgagttttcttgattgttccgttttatataagcgttctaggacttgtttgttagtagttgccgtttctgttggctgattgagggaatgaactgttgaggatacactatttaaagatttttgttagattattcaattagtaaaccgttggttcgaagagaaaatcattagttagataatctggaattcttccgttaataatcgtaaacacgagtgcacaacaacttcttggatcttgggtttcggaatatctgctatctctctcctgacttggatagacgtgcgtgcttgcttgactaccgaacaatattcggttgaagttttccacaccaatctctgaatggatcgtccaacatgcaactaaggtcaatcaagcataaagaagcaatgtactagtaactgggggtcagtacgaaattgtcaatgcaagcttcaggaccgctaatcaggcccaatgtttatagtatgtactatcatatagtgtagtatcatatgataaaacccacagaaaaatgtcgctgctaactctatcgcaattgtttacctaatgcatgtgcaagccaagttctggcttagactggagatgctaaggctccaacctcccaaaaggccaaagaaacgaactgcatttcagcgagtaccaaacaaatcatgcacgtacatgcgcaagccaagttcttgtcttaaactttcgaagctaatagctcgcatgatataatgtcgcttaacgatgtgaagcaaccagatgccgacactggcacgatgttgaaaataggaaccccatcaggtgtgcaggaaccaacaccaccttcttcaagctcggcgaatgcctcagaaaatacacgggacatcacatccgcagtcactgggtgctctactgaatagtagaatcttaacatctgcagatttcagcccagagatgatggttagagttcgggaaaaggcagatgcaaaatgattacaggacagatacgtaccgttaggttgtcccaggaaaagccattatctatcagaatcttagcaagctggaatgcacaaaatctagccaaagctttcaaatgctcctccgagtggtatagttgttcagttgtagaacagattttcaatgcaatatcatttgtgactgaaacaacagcagagcaaattttcccaccgattgtgtgcacctggcagcatgaatcatccaggtcagagtattgtgcgctccaggcactaaaagcttcgcttgatgctggcaatgaccctccagcctcctgttctctggttgggactccatcatcattagtgggactggggacatacaatattggttttatctccacgtatgctctgaaaaaatgaggaaaagtctatcttaacttaagaagagcacttgacattgtggtgcttcaagtatgagagtccagacagcactaaagcatttctctgagaaatagaatgacggatatccttacccttttggaagatctgatgcaaatacatagagaatggtgggatatgatccggtatttgagcaatccaaactggtgatgtacgaactacgaagtgtatgttcaacttgttctttttcactggacgtcaagtgtgcagaacagtacaccagaaagtgtattgccgaagaaaaaatggagcaaccaaaggcattagcaacagcttcactgtttcgtaatgcgaattctagttcagccgttgggcccccaggacagagcttcatcgtagggggatcaagccccagctgaccagccatatagagaatctctccatgaagtgttgcctaagcaaaattcaaaaaactttaacactgagaatgtacaactgaggagaaaaaagaactggtagatttggctagcaactaatctacaggaaccttgcttatgaattctatgtagaatattgtatagaagcatacaactttcaacatacccatgacatataaccacatagtgcttctcttacctggctataaggtccgatgcaactaggagcccagcatgaaatgctttgtacatgtagaactctcttgacttgctcctttgtaactagaacttccacatatgcatggcctaaaccaacctgaactagtggcaattcaactgtactacgtgaaggaacacccagagggcatttttgttcagtaataaagctcacataaacttcattggccaatccaaattccttcatgcttgaaatgaagaggtgaacatacagaacattcatccaacctaacccttcttccttgagctgattctcgattctgctcaaaactgctactagatctgtcttcaggcctatagacataaggagatattaaatggacgtttcccacaaatgaagatgcaaaagaaaggagatattcctgtcaggcgggactatggtcaatttaatgttacacagaacaataaggcacaagagcatgcaccttctgaagtaccacagggatcctgaatccaacaaccaatggagaacaactttttgccagtctttgagatgcataggtctatatttgtgcaagcatcaacagttgtaactggactcaaggtctcttgtttcttttcgacatcactgtgtgcaatagctccatctacttcatacaaataactagaattctcttgggcaatagcactatcaccaacggtgccaaaagaatttggcttgtgttcaagatgaaattttaacgggtgaagaattcctactggagcgatggaatcaggcgagtggagtataacttcaaaatcatcaagaacaattcttgcattctgcagtacaagaaactcatcagttccatcttggtaacaaaatgcttctgctgcacatagcacataatagtagtataaattatgaaatgcttcagaaatctgataagcatgctcagaatatagtcaatagccaagttacagcgtttcattgaatgtgattcatgcttaaggactggtccacatgttcagacaagtggcatcagattattcacattcagctcttatctccttaaacttacacggaatagagggcagtcaagagttagtgtttcatattcgccaccttcaccacagacattgattccataactcctagtgggatatagaaaaacaaaaggagaaattacaagctgcacagatgcaagtgactagtattgaccattagtaagaaaatcatgagaacagacataaagagagcgatatgttgtgatatgtttcttggaaaccactccctcattgatcactacgagaagctaaggcctgggtcattaacccacaagttataacaggatacaaggtcttctaatacatgaaacctccaagaggaaaatggctaaatgggatctatgtaggcagtggggaacatactcattcagttggagcagatgacacttaagttcagccagttctttccctaagtgagcagaaggtttgagccccattgcggcaacctataaagtccaaacatcagatattccatgtgataaacagttaaatacatacttgcaaggaagttaaaaaaaattatgtaccaagagaacaaatgcatgagtgtgctgtatataccttgacgattatagctactatgccccttcttatctgcaaacattaataaccaaaacagaactagtaatttgagtaaacagtttctgatatgccagacaatatgcagaagaagaaaaaatgaaattgaagttaccatttcatcaagaagcaaagtctgatcctgcttccacaaatacgccagcgataccaggcccaaccttgagcagacactctcaacacgaagcctctgataatcagacgcaatggcgcctgaagacactgcagtgatggatgggatttgccttttaacctcgctcaagagcgcaaacatatcctccacttcatcgcctgtggtaacattatatttaagaccctgctccctacaagcaagtccaatcaatgaaattgcatcaaatttcatctagataagaacagtagcagcatataacaacaataaagacaatccctgcacagatgccttgccttgaggatccacggatgcgcctccggaacagaggcaagcccatgcatttcgcataactcacgacaatctggtgcccaacctgaagcctccagccacatcaacaataggcatagcaatcagcgaatttgacagaataccagcaacgaatggccacagcccagcgctagaagcagctgctaatcagctaacgatgagtgaagagaggagtgcatacagtttgatacatgtagctgtcgagctcgtcgacggcgtcatcttcggggatgaggttggccagcgcaacaatctgcaagcattagcatgtcaatgaaaaacggatgatagaatagaactgggtgattgggttgcgctgcggttcgttgccttgccttgtggccatagtccaggcatcgcatcatggcgaagcagctgtccttgccgccgctgacgagcgccaccacctccatctccgccgccgccgcctcgcacctcctagggttggagctcgttttgttcaatttcttcttccggtcaaaacgctactggattccccccttcttcttcttctcctactggatttggggcggagcgaggtttgtgtaggcggctgcgcgcggcggagcaggacggagcagggcgcggcggacggtgcggcgagtccacggcggcggcgcggtgtgtggactgtggaggaggcgtgaagcgtgaggtggtgcgagctcgaggctaccgaggcccagagaccgagcccaatgttttggaaaattttgtggcccatcagaagatttaccggcccacgtaagtgcgttcttggagcccaggccaaaaatatttcctcattaactccggaaaaagaatgttaacacaaacagaaagatgtgtgaactacaaacttcatcataacgcttacacaagaaggaaggtgtgccaactttctttgccataaccaccgacaagccacgttgccgcaacaatgagactgggagctttgcacaggggagatcctttttatcaacttctgttgaataagcaaatccagagttgaataagaagggggggatacacgaatacttgtctctcaggaaaagttgccaagtccagggggggtaaggtaaagaaacataaatatgttgaatcttgaccacctctaaattaatcatcacaaagctaggacttggccctaacgcaacagcgaacacacacaacaaaaacaaattattgctatctatgaagcaatgatacaacagggccggagcaccatgaaattatgggatgctcctggtgaactgttgacaaataggtgataatcctgtcatttacagagtcgcaaacagcgtttcttcctttctctttccgttgtggagattcctctttctcttgccatattatttcctcttaccgccaccaagggacagcagctccaggctgcggtggagaggctcgtcgcgggaccctcttgcaacggctgctcgtgagagagaagtggcccttgtctctccaaccgatggattaaccctctgcgtgctggaaggacggcttccactgcttgagaacaacctgcttgtccggctgtattgctgctccattggttccaccgatgaacctggcctgctgcttgacgcaaccgctctccttgatgcactgcctgtacgggaggatgtacggggtctttccacggtcctttcgccggaccggtcggtgctatgcatctgagaaggtgaaccatttcatgatcgtcaaattacacgtaggagagatacacaaggggaagacattatacagcataggaactggactcctatctcaagttcatgcggggacggattcaacttacgatttcctttagtgacattgacggccgttgtgcataattgtcactctgattcaaagaaccagtaggattccttctgccagatgcttcacctgcttaaaataagatgttcttacgggctgtattgtttgtattatagttttgttaggcgtctttcatgggtggaagaacagacctggggccttttccatcttctccatagaaggtcccgcagctccactggttctttcacttggctgaatcaacaagaagaacaaagtcaaatcaagtgtatcaaacaggagagcattgtccaataattataacagcagaatgcataccctcatcagtggtttggagcctatctggggatatttcaaaatggtccagtcaaatacataatcaaattgatatcctgtatcaatgatgccattagaaatgtgcagaacttatcctcagtttaaaaaaaacactgagggaagatggaaagaagtacaatttatgatcatgaggtaaggatttatgtttaagagaacataccctcccggataaagagatcacggaatagcctctttaagtaagaataatctggcttgtcttcaaacctcaatgaacggcagtagtggaagtaagaaatgaattctgatgggtaagatttgcaaagaacctagctcaaaaaacaatataaaagtgtcagtttgatgcagtttgatctttgaaaaaaacaagagcagataccaaaagtatatatcatgaattacctccacaggagtaagcatctttttctcacttattttgtcgtacttctgcttcttagtgcctgctttcagcccctgccatggtaggctgttggaagttgaatgatagcaaatatttagcattgtttacagaaaatgatgtcaaaaacattacaagaaaaccagatgtctgcaatgctgaatatcacaaaccaacctgcctctaaggaagtacataaggacataaccaagagattctagatcatctcttctgctttgctctgtatgaacataaaacttaaattaggcaaaagctcttatcaaatgtactccatcagctagaagacacagtaaactcaccaacaccaagatgggtattgacacttgcataccgagctgttccagtgaggttcttgttctctctgcataatgaacatgacatcaacataaaaaaggtgaaaagagaagtgcattgagatatttgccaatgtccttataacattatacaattttgtgctggataacaaataaaacaacagcatatgcagtaggcataggcgtaatttaaagttgtacaccaacctgtatgggatgtgcttgtgagtctgaaggtccctatatttcttcgcaagcccataatctattatatatacctgaaacaaggtcaaaaatagtcaaaattaactggattcaagatttgctaaccaaatcttgtttctttttatcccacaagttatctacaattattattaacagaccacagtt

SEQ ID NO: 12336 - DNA, 22312 bp, Oryza sativa
  unsure (1)..(22312): unsure at all n locations
caggcccttaaaacccaagccatatcattctactggaacatctttttggaccttcatagcaatgaagagcaccaagttacgaaaaatttaaggcgttagggcaccactgtatcaaatggaataccatgaaactattgatgtggttaaacatgcagaaacacaaaatggtaatagccaggtaggaacgcaaacctgattggctttcctaccaagccccataaggaaattatcaggcttgatatcacggtgaagaaatcccttctgatgcatgtactcaactcgattgatctggataacgaacaaatggtgttacgtcaggaatctatatagggcaagatacagataccagtttgattctacaacgattaacaaattagaatatatggattgaggaaatttgaaaataaagcatcagtgtcctcaccatctgatcagcaagcatgaggacagtctttaacgagaatttcctactgcaatagttgaataggtcctcaaggcttggcccaagaagatcgatcaccatcacattgtactctccctccacgccaaaccacttcaagtgcggaataccagctttagccaagaaaaaaggaaggtcaactcaatcataacagtcatagaaggcgataacaaagtaacatttcaacaaaacggatacgctaacaggctctaggcgcaaacttacttcctccctgcagaagcatgtacagcttcgactcataatgaagctgtgggtgcttcgtcttaacattttcctgtgagaccaaagcaaacaggtcagcaacaccaatgtctgaaaggtttcactataaccaaattcccaatagtaccaaaatagtaccaaaggaccaacattcgacacaaacattttactacactgttcattcccatcccatgatctcacggtaaataagaaattttatcaaattattcttcccccaaagaaaaagaactcttctaggtgcatcgaaaatggaggacagaatccaataccaatttgacggcgacttcctctccagtctgcacattaacagctgcaaacaaaaaagaaaacatcaacaaagtgagcatcttccatttccaaacataataataacatgttcttcagaaaagataaacatgagaaagatatagactactgaccaaggaagagctccccgaaggatccactcccgatcttctttccaagcttgaacttgcccccgactacatgatccatctccttgctgctccgatggtctcaaccaaacgaatcaactgccccccccccccctttcccctctaatcccaccccgagatccaaacccgtcgaggcgagcggcgccgcgccgaggcgaatcgaatcgggattcgggcacgagggcctctaggacgccagatccaggcaaaccaccaagaaatccggtcgaccaaactcttccctccccccacaatcgaacgaataaaaaggcaaacaaagggaaaaaaataaaaaaaacgaatatgaacaaatcaaagaagaatcggcggattaacaggaggtgtgcggatccggagaaacggatacaaaaaggggatttctcctaataaaattccctgcgccctctcggcgaattcgccgcgagaggtagagagagaggggaagcggcggaacaaaggggaggagagagagagagagagagagagagagagagggtggaggaggagaagacaaagacggagaccagcaagagaaaaagagtgaaggagaggggacgattagtaaatagacaccacccgattaaagaaactgattaactgggagcaggttgtttgtttttttttttcgtttttacaagtaattgacaggtgcggccatcttggtttgttgctcttttcttttccttcttcttttctctctttttctggcactttattgtttcttgtttgttatggtgatgggtgtagtacgcatatagtagcagcagtttgtttggtccccttttccttacaatgcctcaaaacaaaacaccaacaaattgtttagctttaaaagaaaggggagggtcaaaaatagttgcttcaaacaaggggagtatctttagttgtagacttgtagtagtggttgaacgtaccatgcttgttgtgctcttaaaacaaggaagtgatgtacacgttcggggcttttcgtggtaacaaaaactaatgcttgtgttccttctcattttgattatgatatatgggaaaaataagttcagaaacacgagttaatagcgtagcatcttgtgataattaccttcctttcaaaattatcttatgatgatttcgtgttatactaaatgatactgctttatataagtttatgacggagctaggagctaccgaggattttctatatggcctacaaaatatgttgttgtgtatatatcataatactaaggatggaattgagagtgcagtagcggtagcacaaacccgactcaaaaggataattgttctatgtttgtgacatagcaatttgtgatttgaattactatcttttgattgtagcattaaaaacattaaaagtatgggaatcttttttttacgaaacttatagagtattatacttgaactctatctattttgcacttttgataaaaggagtgcatttgtgtctctaaacaaatcaaaatcataatatcctactccttcgaatgccttgtacggtgagaattgaaactcgcgcgtgtaaatatgttatcatatgagtatttaggtggcttctaaaggtaggatagggcattcttaggataagggttgacgtgcgtatagatctcaaaatgggatacgacatgatctggttccacgtcatataatatttattctataactgttttgtttgactcgttttaattgctccgctaaacgacatcattccttttggttggttggatgttatgctcacggacattgtctttttttttccgcctatgccttcagtggttctggagtaggaccaatgtctagaaccctagcaccgagatagatggtggccatgtcataggcggatgaaaacatgtccttatagtgtcgaccttgtacatacgtaggcggataagccattttggtgacgacgatgcaatcacgagcatggtaaggactctctgtaattgatgaaactggcgatgagagtgctcatgtcaatgtatcaaggacgggatcagattttacgaatagtagagaaaaaattgtctaggggcaacaactcctaataaaatacaagaagttatggcatgattgattgtgatggaactcgccatatttgaagagtgaaactcatggcggagatgatggaccattttaatttagattactaagtgaattattgtctcggattatctacttgactatagagataaactaaatatttttttaaaaaataaatttgatagataatttaaaataggtgatctaaataaataatacagtagaagaaagttttttaaggaagcatattttccgaagcgtaaaataaataatccgatttataatatgaaatgaacatgatcaatgattgtgcacaattgtgtcttcatcttatggtatttgcaggatcattccattcctactacccaatctcaccacatcgttcaaaacaacaatatgccatcctcccatcacataataattttacagccaatctaaaaaaatataaaacctttcatttagttatgggcccggaaatctttctactatttactctgttttaaaatataattattttgagaatttaaactttgtaccaaaatatttagcatttatagaacattaaaatataagtatttcaaactaatcagaagcttgagaagagaatacaaaattcaaatttgaactaacgagacgattaaaaaatatttcttaaaacaacctaaatttttctattttaaaaggaagtagtaccacaaaggctgttcccaattcacatcgtgctgaaaaagaatcccacatcttttccacttcccataaacacaaaagttgagatagcttaggggcattttgcgtgcggataatgctaccgtccatcgagccctcgaccctgactagacaggaaaaccagccgaaatgacgtggccaataattaaagatggccaattttataaaaagcgacttgaaaaaggaaaaaaaataaaagagagagaagagggaggccaatgttgcaagtagcagagcagtgtatctttttttcccagcctttttaccggataaaacgctgtctcgtggtgggccccgctacggtaggtagaggccgacacgtcttggcccccccccccccccccctttccccccagcgactccgcacgggaataactacgcggatagcggcccatctcggccgttgatcctccgtgtccgacggctgagatagcgacaggttacggacgtggaggagcaaagctggcgcctgggtggagtacggctgatctgggccgtccatccgcctactggcctctttggaatggacggtgctgcgcgacagttgaccgctgacggacgcggcgatcgtatggcggagtacggcattttcacggttgcttcccttccatgccaaactcgttcttctcgtcgcctttttttttcttttttaccgaaacgaaacaagtcacacgccaacgattccaaacatattttcctcgtgacgctttgataaaaatatataatcagatactttgacatggagtaattaacaagcctcagttatcgatgcacaaatgaatctatccatcttctgaaaaaaaattcactaaacgtgggttacctggtccgacgaccagggaattgaagtttgaacttggaacaggtctgtgtaccacggagctcaaactccagaaatattaagtcccacgttggaattaggtaacttctgaactttatatagattcaatccttgcaaaatcccgtacggctcatgtactcgactcaagcaggcatcacgtattaatagtttcgagttaaccagcgaggggagaatgcatctatctgtacacgagcttagtacgtaagtacagggtcacagaaaattcagaaatgctggtgcatatgctggaattgtctgcacaggtttgattaccaacccagtgatgattatcactaatgagtcaatggtagacactactagacagcatggcctgagagcagttagctatacggggatcagacatgattgccaacataagcatgttgataaaagacaatgcctgcctactgactgcatagtgtccaaatgatcatctggaacacattacggattagattaacaaataagaatgtgcaaacctgagaacctggcaagtggcaagagaccgagcaatgggtcacagccagagataccgcatcctgtcatcctccacaagttgatgcttatcatgcggcttccttccaggagtgcacatgtaatgtaatgcaatactacatgcaaaggaaagcaacaattaaagcaatagctggtagccaaagttgaccagatagcaaaggagaaaaggttaccatacctgatcagctcgtacaagcctcctaagctgttttatatattcatataagcagtgaagttgctagtacttgagaagacaggtacacattactttctcgtgataaatggggccatttcttaatgtacatcaagcctttctaaagaatgacagggactgaattcatgtagtattagattatcagaaagaagtacagaaatgaacttgatgggtactcactgctcatcggcacaagggtaagttcgctttatttatatattaggtacaatgccgtagaaagggatgagaaacagaacagaaacaaattgtggaagtatgattaattagcaccagaataggtgtagaggtgggaacaatcatcaacggtagtaggccatgtggcgtgaagatcggaacggtgaagcatcaaatggagaggagcgcctgggctgggtctcaggacggggatgttctttcttagggagtttggtctcagatcgcagccatgactcgacaactgacagcaagtttttggcactctttagctcctcaacgtcagagtattttgctgattttctcaattcaccttcttggatgtatgcaatgtcagtagcccatgattccaatccatcaaatatatgagtggcatagacaatggttgcttctctctgcagtgccgaaaccttccatgttatgcaatgagaagcataacagacagaagagatagaaagaacaaaaactgtacctgttcacactcttccttaaagaagtcaaggagatccattctagtcacaacatcaagatcaacggtgatttcatcaagcaagagtacctgtattgatctcaggtgtcatagtttcatagcagtctttggcactacactaacacaaatttaaccatgagaatacctctagccaaacataaggtagtttttctatctttaaactaaaatgatgtgttgggtgaattctcagaatagtctaggcaataatgctattacccttttgggggcacaataccattatcatatcagggagcactcagcccagcaatgagccaataactatggcgtactacaaatgtatgatggagcactcaagagttattatgtctgtgagtcactcttagggtgctacatatgaaataaaagaaacaacagaaaactaggaacacggtatcaccttgtatggatgaagaagacccatgcagatttgtaccctgcggcgttgtccatctgagactttatgcatgcgccattgcagatcaatatctagtagatcaacaagcttctctcgcctaacaggatcaaccccatcaactgctcatgtttcagggtagagaaagaaaaggcatgcttacatctaccacaccagcatgaactgctaaaagcatttttactatagtaaggttgacttcattaattaagcttgactaaactgaataacaaatctaggagcagcatctatttaaacaaaaaaagaagaaagaaacatgcaagcagaaagttaactgaaagaaaggattgaaacctccagggttttcaaataattcaaggaccactgagtatgtgaggcacatcattgctttcatcccataagaacccaagaatgacaatgggatatgaggagcattattgtgcatacagtacctccaaaaatcatgtgttcagcagagaagtcgccttgcagaggaacgtcaccctgagaaagttacatgggtgttatatgcatataaattgcactgagaaaccaggcaaacgcaagaatgaattgtcaatgtgtagtctactattgtcatgccatttactgttatcaaactccacacatatgtaataaaaaaatcaattaagtaaacatgaatcttctaataattattttggacagcacataaaccatttcagagtcaaagacccctaaaatctaagaaagtaaaacagaatgaaccaaagttacaaataactattcagctaacattggtgaaaagtagggaatggcttccatgaatttcttggaaaaagcacgttagcaagaaatgcacttgtacaaacattgatcatgaagaaatataaatcaatgatgaactaatttctatttcttatagaaagtaaacagaaaggaaaacttacagctgaaccgatagcccgactccatgaaccacctaagtaggaaaggtcaccgttgcacacaagctgtgtgtcatgaaaagcagaaccattaagaacacggacaacatctcttcctccaaccatatgtttccccgcaagaatcttcaagagagtggtcttgcctgtggtttggcacaagttggtacattatataggtgtgcatgtgcatgatagattacagaagataagaacataacatgcctcaattacaggcactgtacatgattgtgcagtgattgatttaaaaaggagagaatttcttttgataaagagcacccttattcgcatttgcaagagcaatgtataggtgcctcacaactatcaatgacaacttgagtatataataaaaagtataactcgtttgaactccatttttccccctatcacctattcaccttagtatctacaagcattccattgagattgtgctttagctccaactttgctcaagcactagtgcagaacaaccttgccttgaagaaggctgaaacgtcagaatgcggaactccaaaacatcaagggtgacaccatacacaaattcatggtcattcaaattcgaaagggcacactagaaacccgtattgcaactagcaaacaaatacagtaatacacgcgaattgcttcaaaatacgaatagaggaaccatagatcaatctatatctaattctaatccaaacgacacgcggagtgaagatagcctatatattatagctaaagccaccaatccacgcgaatccatcagaagagctcgcccggagcatcgaatagtggaaatcgacgaaactacgtaggaaccacggctgatgggaggggttagggttaggcaaacaaaacctaacctgatccgttcgcgccgatgaggaggcatcgtgagccgggggcgatgcggagattgaaccgcgcgaagagcggcggctgcccgtcgtagtcgaactgcagtgcgctcacctcgatgccgctcctcctccacccttcgtcctcgccgccggccatctccgcagcctcgccgccggtgggtgatccgagcggagtttggtgggggaagtgggaactcttttcccttggctgtgtctccgccgcgtcagagcctccgtgcacttgtatcttctcattttctcacgcgactgcccaccaaacacgactactgggccttgggccgactccatccctgggccctggcccatttctcacttatgggcctgggagtaacaacgaacagctccacctaaattttcagttttgaatttacacaaactatgcacagtgtagttttttttagtgtaaactccaaatttctcatttttcgttagcacgttttttaaactgttaaatcagtggcggaccttctcttgtggcaagggatggcgccggccatacctacaaagtaggtagggtattcaagcatatgaccatctcagccttgatttcagatgctaattatatgattagttggctgtatttcatttggtacaagcttattcgtttagttaactggtggtaaagacctatagggggactgccttgtgtctgcacaaatgaatgaatagtctagctaaccacaaaatgttaatcggtaaaaatcgaatgctaaaaaatagatatgtaacttaagtgaatgtctacttataaataaacacacctaaaaaacaggaaaacactcgtagaaatgtggtttagtcataaaagttacacaacaaatttaacactcgtagaaatgtggtttagtcataaaagttacacaacaaatttaaggcttcagttgtaaaaacttcatgacaaatttaggattataatcatcgttaatggcatatattctaataagtacgaacatattatagtttgtgtataataaaatgttacatcatttttaaaataccacgcacttcgtccttgtgtgatgatccgccatagctaaattttagtgctgtatccgccactgtgttaaatgatgatgttttttataaaaagttttttttatcaaagtttattcgaaaaatcaaataaacatatttttaaagtttgtaataactaatactcaattattaatgaactaatggtttttcttgttttatatgtcattgaaaagctaaatcaagctgagattcaaacaggtctaaaatggtaatacagacatactcacatcctaatacaatgaatcgaatactgttaatagattatgtccagattcattgtactatgatgtatcacgtcgtagcacgattatgaatctaggaggggtaggactatgaatctggagtttttttttaagtacggagggagtaatatagaaatgtactagtgaccaagcaatagacagaacagcagcacagcagaagtaaacgaatcgaatcatattcatattcaccttgttggccacagacgcatgacccgcagtgtctagccacagccactcgtgtaacatggttacacttcagagtttaggtttgcagaaccagcctatagctagcaaatttacagacagaacagagccagactatagataaatgatgatacatcgttgccaccgttgaaatgccaccggcgacaaacctacgaaagatctaaccgatcttcttcaggttggaagagctcaagctctgagctcacggatgtagttagggctcattgggttgaccttcggcgagagggcggcgaggtgcacgtcgttcagtgccgaattgagcttgctctccagtgggctgaacggcatctgctccgtcgccggctgcttcttgacagcgcgcaagcaggctaggtagctgttcggctggttgttgcagcttggcagcttgcttatcggcacccctgcttccttctctctggacaccggtgcgccagaaggatcctgcaccaaatcagagatccccacatatttctccttatttgttttcactgacaagattcgatcctccaatgcaagatgtgatagtggatgaatgacattgcaaggaggaagaggtagcagagaacacttggatgaaagcatggcataggtagtagtagaggagctagatgacgtaccccgagaaggaggaaggtgaactgctgctgctgcttgctccctgcttcttcgaagtgatcctccaagagctttctcaggtcagaaagacacgagttgctcagcaatttcagaccttttatcagatggccggactcccatttgatgtagacttcaagcaggccgtcttgtccagaagcattgttctccttgttctcatcagctgcctccaaagcattgcatgatttcagctgctccgacacgggcaacttggcatcgtccacaacttggcagacgataggtgaaagctgcgaggatactggactgtcggtcactctgacgtcgcacattggaggttctatcgctccccatgctgaagggtccttgttctcatctccaaacactcgcttcgcaggctgctgcttgttctcatctccgaatgtttgcttcgcaggctcattgttctcatctccgaacgccttctttgctggtgactggaccttcttggctaattctcggtgattcccacaaagcctgaaaatgttctgaatccggttattccttgtggcagggtcttcaggctctgcaaggggctgttgcattacatagctctcttcgacaacttccttgcacacttcctcttcaacgccactgtctttatcttcttcttcatctccctcctcaaagacagtgctcaggaccaccttttctgggtacccagacagcctcacaacatcatcttcttgctccacagcgctggtgcaagagcctgcagtatttgcttggctccatatctggccctgcttgcgagtatcctccttgatcaccttcacgtcttgcgcagctggctgatctcccatatcaaaatcaatggacatatccattgacatggactgatccgccctagcggacatctctgacagacgtgccagcaatctacctccgatgatatcctgctgcacaggcttttcacgctcaacctccttcagccgctgttgcaaagcaaggagttcttgctgctgcctaagcattttctcttccatcttcatgagctcagtcctcaaactctgggtcttctccatgacctttgagttaatctcttcctcctttgcagctgctccctgaccttcaatcagcttgagcttcgccctgagctgtgcaagctcctcttcctttttccttagcacactctgggcctcattgcgctctttctcccttagcttgttctctttctggagattgtagatgaactgattcatcgcgacaattcttgaattgagcattgtagatgactcttcagagctcattttgtcccttggggttgcagcgtgggcagcacggataatgcacttcgctttagcaccatactccaatgtagaaactgtcttgtgcaattcctttgggtcaggacttgcacagagaatcatcaagatttttgatttgtcatcctcaaatgaatcctgaaaattcatggaagatcgtaggcattacgttagcagctttaattttacagtataaatttgtatcgaggaatgtgaaattttagaatcttgtacctgcaagagcattgtgagcttgctgtctcgaaatggaacatgggagtcaccattagcaatggactcaaccactcgtttcaaagccgtgttcccttggttaatctttgcagtctgttcaacagtaataataatgtaaacaaaatatgaacttctgttatcgaacacataacataatttgcaggaaaaaaagtactagtagctaatctttgcagtctgttcaacagtaatgatcatgtaaacaaactatgaacttaattatcaaacacatacaataagttgcagaaaaacaatataatagtagtacctaaagtacttaaaaacagcgtgactgtgataatatcactttatcattcaaaaaaagggagaaaaaaaacctacaatgtggtcactgctttgcagaccgttaactgttatgtttagatttttcattacacaacagtgttaattattcttctgtattaggtattcattgttgaaggggtaactttaaaaacgtcctgctgaaagtacaaaattatacaggcattagtgacatcacagacctgcattttggcttcaaatccagtttggcctgctgcttctatgttctcagaaccagccatatccacaagcatgagccttccccccaccgatggaacatccaaaattatctagagaagtaaagcgaagcttatcaatagcgagttcatttttgaaatgaagattccaggagctaacagctcaatacgagaacgcaagtgtgcaactaaccatgcagtggctccgggaactcctctcattacaaagcgtgctcttgacaatacgcctcttttccacttttgcaacttctcttgatatcttcccggcttcatttccagatatgtaggttgcattcttggctttcttccccattacttctagcctcgcctgcacataaagtaaggagtaaggactgagaaacttcaacaccatagaaaatttccaaagttacgcagttaaaactattaaaatcttctgtccatcatatgttcccgaaaatcatgttaaaacctatgataagtatgccaatccttggaacttacaagccatgagcttcctatttaagcttacagtaattatccactcaaaaaacaacctgtttcagctcacagtaagtatttcagcttccaatttcatattaccatttgtttatccctaaaatgctgcaatccgagcaccagaaaacaacttaattcagcttaaagtaattatccgctcctaaaaaaaatgtcagattcataactgacaagcaagattcactgaaaaggacagtgacagtaagaaagcagacaccacctgttaactttcaaacttcaacacacatctatcttaattaataacatttcctaagcactaggcatcatcacatatgaacccaattgcaaattgcagctgcattactaacagttaataatggcatgtggaaaattagtttcggtgtatcaccttgggggcgtttcctttagcattcgctccgctccccacgagcaaatcgtagatctcctcgttgtagatctcgagcacggcaacctgcacgaacagccccatcccgaacccggcgtcatcctcgccacggccatcgccttcacccccaccaccagagacacctccccctcctcctcctcctccttccagtatatcccggagagcgcggtacacgatcccgggctgcttggcgcagccgaacatggtgtggctcttcccggagcccgtggggccgtacaccatgacggtgcacttggcgcccacccgcaccccctcgatccgcgaccgcacgaagcggcggtagaacccctccagatcctcctcctcggagaccgagaccccgtcgagggtgaagtcgcggcacccgccggcgtcgccgcggacgcgcacggccgtgcccccgcccgcgatctccagcgccgacgcgccgcccgcccccgcggcgaggttccggatgcggccgatcacctccaccgggtgctccgtgccgcccgccgcggcgcccccgccgccgccgttcctgggcgtcatggccgggaagtggaggcggtgcttggatgcgggcgtcttgagcggggtcgtcatggccgcctgcggcgtcggcggcggccccggccggggagagggcgtcggcggcgccatctgcgagagagagagctcgctagggtttggagatgtgaactcggattcgatgcgagagaaagagagagagaattggagatcgagttgcgggtgaagagagagaggagaggagagggctgggacttgggaaggggaaggatttgaaagggaagtagccgttggagtcgtaacggtaagtgtgtttgttttgaagctggacgagagggagaccgcaccgcgccgtgtaccgcccgccgcgaaatcacgagattttcggtcgatgcaaaatgggggaaaccatgcatcaaaattgaattctgaaacaattttatatggtaacttttctttgtttccttcttaagaaaaatgctccctccatttcagattaagatgttttaactttggtcaaaattaaaatagtttgatcaactttgtagaaaaaaatagtaacaaatttattatgaaaatactatatttaattattgatttgatgaaacttatttagtattatcaacattattatatttgtctataaacttagtcaaagttgaaatgatttgactttgatcatacttaaaacgtcttataacctgaaacggtggaagtaatgtagaacgatatctcgttcggattgaatgatacctctaagatatcacctaggcacttgatttttgataggtatcagttgatacctgttcagataagatgatacttaccagatatcatacgatatttttaaggtatcatttcgttcaaacgggataacatcgtatagattttactcttttttttttgtccaacgtactatgtcggtctgatgcgaatatatagtattgtttggattctactatgcatttatgggtttagtttttttatttggtgatatcctttgtctgaacatagaatcgggtggtggtgcagcgaaactgtgcaaagataattaatttgtcttccgaaactgtgaaaaataaatcatatagtgatgttaatcaaagtgtttttttatttattactcctatctacttgtggagtagctttaaaatcatcttataaatactcgtattgggatcgagcgtcacccaagtagtactacagtaatttagccgatttttttataaattggtcatttttaaaaacttattttgaaactagtctctgcaaaaaactttaatcaaaaataggccatggactcagcgccatggacattggcgctaaactataatccgtggtgatatgaattcgctgagtcatcagatcttagcgccaaggtatttggcactgaggtccagacggtttaaataatcgcgcaagcaacatatagaaccaagaccgtgatagcgtggtggttggatgcttgggctgtcatccatagggtactaggatcgaatcctggtttccctcatgtattttacaaaataagttttgttctcttcactactcactctctttaataagttttgttctcttcactactcactctctttacaaaatgactgttccgtttgtaaatttgttttattttgaatttgatttgaaatttcagtttaagttctcatttgccatataatatagcactttaatatttttttaaattaaaaaaagtttcatattaaacatatattttgaagatagtattacaagacaaaaaaaagaaaataaataaataaagatagaaaaagaaaacgagataaaaaaaagaaaaaacatattaatactcactcttattctttacaaaatgactgttccgtttgtaaatttgttttattttgaatttgatttgaaatttcagtttaagttctcattttccatataatatagcactttaatattttttttcaaattcaaaaaaagttgcatattaaacatatattttgaagatagtattacaagaaaaaaaagaaaataaataaataaacatagaaaaagaaaacgagataaaaaaagaaaaaatatattaataaagagtgagggagagaagaaaaagggaaaactaaaaggaaaaaaaagaaaaagaaaacgagataaaaaaagaaaaaaatattaataatgagtgagggagagaagaaaaagggaaactataaggaagagtgagggagagaagaaaaagggaaaactaaaaggaaaaaaaagaaaaagaaaacgagataaaaaagaaaaaaatattaataatgagtgagggagagaagaaaaagggaaactaaaaggaaagaaaaaaaaagagagatgggagtcaaaccctgctcttcaaggatagagtagaactctactaccattatgctatcaatggggtgttactataaatgcctccgcatctatttaaatcgtctaaacctgagcgccaaataccttggcgctaagatctgatgactcagcgaattcatgtcacctcggattagagtttagcgccaacgatgttggcgctgatacgttatagcttagcgccaatgtccatggcgctgagtccgcggcctatttttgattgaagttttttgcagggactagtttcgaaataagtttttgaaaaggatcaatttgttaaaaagtatatacagtattttgtgttccattatcttcatttcacctggtacgatgtgggccccgaagtggcccatgagacggggaaatgtaacatccgtacttatgggctggcccaatacggacatattcgtatttccttttttttttcggggatattcgcttaggtcttgagccccgaacactagtcgaagttgggaagcatccaatgaggtatggaactataaaaaataaggtaaaatctaaacagagaggcctctctgtttagtctctgtttagtcttaataggagacggtatagaaagtctacgtacatagcagagaaagcctacacatctgtacgggagacaacagacaaatgcctacacatctatataaaatttctttttacccttcttataaaattttctctaaaattacttatccgatatacaatccgattacaccattgtattcattacaattaaatctttacaacaagatcttacatgattatattgcgacgaaaaaaatatttatgtttgtaaattacttttattatatatgtaagttacttttatcatatatataaattacttttagatttgactaagttacttcttatacattcataatgctctaaattgattatttgtattattgtttttagtaaattctgtaatttgtggactttaaatttaatttttcgatagaccatattttctttcctacaacgaatttacttctaatgttataacaatttacttgcattttatgctaagttacttttatgatttatgtaaattattatttctactatagagagagttagaagtacttctattacataactaaattaattctgttgcatataattacttctactacagaaacttatttctattgcatagctaagttacttctattgtatagctaagttacttctattgtataactaaatcacttctgcaatttaaatacattgcttttaaattaataaaatatttgaatatatatcaatatggatcttgtattgtcacatattttatgtagagcataatgacgcaaatagatactaaaaacaatacgtgatttaaaatatataagttattaaagagcttaaatcacatatatgacaaaagtaacttacatatataataaaagtaacttacaacatatatatatatatatatatatatatatatatatatatatatatatatatatatatatgtatgtatattatcagaatataatcatgtaagattttgttgtaaagatttaattgcaacgaacacaacggtataatcggatcataaatcagataagtattttaagagaaacttctctaaaaagaaaaaaaaacatagatattgagtgtactggtagcttcttttggaaagaatagtgtctctctttagcactatcctgctagtactctcggtgtagttgtgtccaaaaaataaactttgttagcaagccagcggtaatgttgtgtttgtttgggactagaaacctcgttaacgcgtgatcaattaagtattagtaaaaaacttaaaaataaatcaatgtaaaatttaagcaacttttgtatgtattttaacagaaaacacaccgtttaatagtttggttaaaaatatttttttcttagagcaacttttttattttttttataaaaacataccccctccgtctcaaaatataagcatttttagctaaaaattgctatattttgggatggaggtagtacttattttgaaaaatatggaaaacaaaagaatataagttgtcccaacccctctccctcgttttccgcgcgcacgcttttaaaactgttaaacggtatattttttttgaaaaagtttctatatgaaagttgtttaaaaaattaaattaatccatttttgaaaaaaaataattaatgcttaattaatcacatgttaatggattgttatgttttccgtgaatagggtgagtagcgaacacacccttaatactgctctagggctgcacataatcgccacataagctgctattcggcgtcaaaagcgacataactttatcaatcctaattatcatcacacgataggtcactagcaaaactgacaggcatcaacctttccagacacacacagagtgacatagagatgctggcattatgctgcagtgtttaaattaagatgcttgctaaaattatcattaacttaggtcagacaactacacctcattgttatttgtttagtacagatgcatgcccatcgagctagctaaacaaaccatctgcttttggtcgctcacagttactatttgctgtcctaatcctttgctctagctaataagcagccgctgcaagaaaataattaagctgggctgcatgcatgcttatcatggagggaggagggagagatatcgctttgtgagaaggcaagatcacatgagctgagatgagaattgagaggagaagagagaagagagaagctgcagcttgcttgatcaggggaccaatcgccatggatgccattggggtccatgactccatggatgcacacacacactgtcagtctgtcaccgatcttatttatatgtgctagtggtagcctgttagctatgcatctttgctgctttgcccattctgaaatgagatctcagcaagccggccagcaacaagaatgcttctgtgcgtgaactgtaggacatctgaaactctcgatggatggattggatcaactgtcgctcgatcgacgagatttgtttctgcataggattatcctccatgaagctatcgcaggatatgatcagtgtagttagagactgtaacaacattattctgaatctttctacttgctgaatttagtagagagctgctcttcctcagcctcaagctagaagcgagttcagacttcagagcagtaaaattatactccctccgtctaaaaaaaagacaaaccctgggttttcatgtccaactttgactgtccgtcttatatgaaatttttttataattcatatttttattgttgttagatgataaaacatgataaatattttatgcgtgacttgtctttttaatttttttcatattttttttaaataagacggacggtcaaacgttggacacgaaaaccagggtttgtcttttttttttttgggacggagggagtatatctctttaattgtagaattatagcaaacagtgtactcgtacgtgatctggattggcacagtaacaacaagatttgagctagctaatggcgccatgtttcacagctgtgccctgcagccacgagagatcagggggcctacttgggctgagcagtagcgagatttgtcagagacagaagcatccgatctagtgtgaatctgcaggtacagagaacactgtgctgcccatatctctcaccaaccattagatttcctcctcctgcagccgttgcatatgcttgtgccttgccggctcagctgctctgctcatctcggtgaccaatggcgaattgtcgattaattgcctggttgatctgtatgtttgacacgaccattcagttctactatttgtcatcaagtagcagtaggctaattgcaattgcaaccaactaccgcgcaaacttgtctgcgtcaacacggcaccgaactgccaaacaacacaacaaccaatgacttttacaccgttttggtcagggcagggcagcctctcttattatgggttgattagttgcatggtctacagattaatcactgctagttactgtaaatactagtactcccttcgtttcaaaatatttgataccgatgactttttaatacgtgtttgaccattcatcttattcaaaaaatttaagtaattatttatttttttcatatcatttgatttattgttaaatatactttcatgtacacatatagttttacatatttcacaaattgttttgaataagatgaacggtcaaacatgtgctaaaaagtcaacggtgtcaaacattttgaaacggagggagtgctattgtactagcgatgatcacattagccaggttgctttatttggctgtgtcagtaataaagacaggagatataaaccgtttttatcaattattaagaggtgtttcatcagtcctaaaatgtaagaacctaacactggatgagatatttcctacccattcaaattcactgtactagaaaatgttccatccagtcctaggtttttatattttaggatggagagagtagtttgtttttttttctttttcttcttctttttctttcttcacgaggaggaggagatcgatcattagattcgatggatatatcgtagctaatgcgggtatggattattaaggatatttaaccgttacaaattcgtcctgcagctatatgccgtacgtgtgtcttggtcggccgtgtgtaaatctcacggaaaaggacgttgtcagggttgttcaacaaagctttaaagtgatgcaacgacaatgggcatagtgtcatccattgatgacattaatcttacacaagtggggtgttatgtcatggctcatggggaccttattcaagtttaaagagggaatagcaattaatggataagtgacattaatttagacaagtgaccagcattctttccctctttttagttatagccccccaatacaaaaatgcgtcccacatgtacacaatatcacagcactagctacactaactcataagttcaagtttctgattttcttttggtgccaggcaacgtgtgatatagtgacttcgttaatttcaagtctattagtctcaatcgttcgaagttgcttataagagcgcatatgcatacaattgataagggtgacgagcatatactggctccatcgtaaaatatagctatcagatgcgacatatcatgtattagttagataattcctccgttttagaatatagcaaattagaactagattaaacaccatataacacaatgtatctatgtgatgtccaatctagtttctggttactatattcctgagacggaggaagtatatttaagaaggatatagcaattgtttgcgtttgtattgcgtttagcgtagctcaactggttaggtttattgtggtggaactaacccacatgggcttaagtcataaacttgatacggatggtcgtattttactgttaattatttatttagtggtaggcgacgtaccccttgacagcgagacacccgtggtgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12337 - DNA, 660 bp, Oryza sativa
ctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcggggcagaattggtaaagagagtcgtgtaaaatatcgagttcgcacatcttgttgtctgattattgatttttcgcgaaaccatttgatcatatgacaagatgtgtatctaccttaacttaatgatttt

SEQ ID NO: 12338 - DNA, 1884 bp, Oryza sativa
  unsure (1)..(1884): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgattgtgaatgtgctgcagatatttaggtccattctttttttagtggatttatgttggttctaaagatacgctgaacctccctcttaacctggacctagtcctaagagcaaagttaatagtatagccaactactagctacaattcatctataactaatctaatagttaattcatacaatagttgcttactatactattagtatatagtcccactgtcatatacacattatgtcttggagtccgtgctgcagcgggctacagaagctgttcttctctctcatcttttatcttattaaaatatgtttgtagctggctaatagtatgctattgtacctgctctaagagcacccgcaatggtaaagtaaggtgctctctataaaacatgtatatctcagtaatagattagattaatagtaaaccacctcaatagtatttctacatgggtatctatagctctctcatccattgtcttgtttttctctatagactctccaggttagtagatagctttactctctctctccatttaatctcttacaagtaggaaaatacgattatcttttatagagagcatatagataaccattgcgggtgctctaataacactagctaagcgcaaactccgagttatccatttcgcagcatttaccttgacggagtggacctgaaacgctaaacgcatgagcaaacgtgtacggaactcctttggtcaatcgttggattatccatctgaaactccttttgttttcgccgggatacccgtatgaaactcctgcatccgtcgccttcattcgcaccggtgataccgtactcatttggccggcagaccaaacatagtggattagtggacacttatgtgttgagaataccgtgccggtcctttgcgaaagcacatgtaacgcctaggaaagcaaggagcagaagcaatctgcttgtcttgtgtgcgacaacgaggccagtgcgttgtcctcgcaccaagcgaccgcctcgccgccgattgttccgtgcgacgccacaccgaaaccgaaccgggacaacctatttaatctttcaacaaatttaaaccttcaaatcttgaaaagttttcaaccaatggatgcaattcattttaaataaaataattaaaaagcatatcaaaaataataaatctagatataaaaagagttgtataatctaattccactatacttacgtagataaaacactgttttacgtaaaacgatatggcattaatgtataattaatagagttttaattatcataaccttaaaaatttatttatagcaactttcatataaaaagttttttaatgaaatataccgtttagcagtttgaaaaacacgtgattatctaaatttttatccaatttttattacataaaaaagacctaaatttacaagaatattctctctctccgtcccataatataagttattttggagagatatttattttggagagatatgacacaatctaatactaccaatctagagtaccagattattatgatacattcctttaaaattaattatattttgatataaaatcctacgaacgaaaaatacaaagacagaaaaaacgaaccgaataaacccaagcaaagcaagcggaaatccccgcgtcgcgttaaccttctcgcccgcggtttcttcccttcctcgcgg

SEQ ID NO: 12339 - DNA, 41855 bp, Oryza sativa
gcgcggcgggcgttcgccaccgacctgctccagaactgcgacctgcctcctcccgcgaagctcttcggcccgctccccactctgcaaaggtaggcgccgccgcgttcccatctccctctctcacacgatcgatgccgtggaattcgcgagtgtggcattgcttagagcggcgcggtgtttttttttttgttttttttaccctttttgttgatgtggaggttggagaacgcggcggcgtggacgagcacgagcccggatcggaagggcggggacggcgaaggcggtggtggtgacggcggcgaccgcctgatgcgtgcgctgcggctgtcgcagtcgcgggcgcgggaggcggaggagaagctggcggccgccggggcgagcaacggcgagctctcggcgctgctggtgcgggactcggtggtgctgtcggcgcaccgccggtgggtcatgatgctggaggccgagaactccgggctcagaggagcagcaggagccgccggctcggccaaggaaggcgtcggcgaggacgaggacgaggacgacgacggcggcgcccggcgcggggccgctgcgtggtggctcgcgctcgccgtctgcgtcggcattgccggcatcggcctcgccatgggcaagctcctctgaaaactaaccgtttcttcacctttttgttaaggggaaactgcacattggaggatcagatcagacatcatgaaaatccatcgttctacgaaaaaattctgcacaaaaaaaaatgttgctagcatctggaacatttcgatgattaggaatcacttgtaaatgatgaacatgatgaacagagaggggtgatgactgatgagaactgtagaaacttaggaatcactgttttcagaaggaagttgggttgtgactggtttggttgtgaagtttgtgtagataggattatcatcacgcaaaattggcatcatttctattcccaaagagaagcttggatgatggggaatgggctggaagatgccgtatctattgctgcacgctaccacattcatgactgcgtctgcgtgtaggataaacttttaaaagagagtagtaataccttgtttggataatccgtcccaagataagtgtaggataatccgtcctaaaataaatgtagttttgcatcgttcgtgtctagcggttgaccgtttattttatttatttttttattgttattagatgataaaatatgaatagtattttatgtgtgaatattttatttaaatttttgtcaaataagacgaacggtcaaatgttaggcacggatatccaaagctacacttattttgggatggatatagtatattgtttggataatccgaagaattctatagaatattcattgctccctccattccacaacttagtacaaattctatcttaactatatacttataaaatatggtatttacagctaaagagcatgtctaatggttgttaatactgatctctcagtgttgattaggaatattcgttgacatggaaaaaaaaggagacaaaacatagttgctatgggtaataacggttcaacaaccattcttagtctctataatatggaaacacgattgggtgagagtaaaaaaaagaaagaatagtaaaaggagaatatttttagttaatttagagcctttttgcctttcaactattattataaaaacacgaaaataattttgtattatctcagagattatactcgtctctgccgattgactagctcttggttttattaccaagttaactaatccaggttcacacctcacccacacaaattttgacaatttgatcctttgaaaaagctaattttacaaatgaaccgccgccaaaacttatttaaaaaatgactttttttcagcgccaaatcatatggcactgaatttagacatctcagtgccacgtcaactggcgctgaatgccttgccaccacggatggaaggctaagtcagcgtgccaacgtacattcagcgccgtactatttagcgctgaggtatctaagttcagcgccatacgatttgacgttgaacaaaagggtcatttttgaaataagttttggcggtggtttatttgtaaaaatagtttttgcaaagagttaaattgtcaaaatttgtgcctcaaccactggtggaggcaaaataagtatttccaccctttttaatagctttgtttatgtagaatgttcttttattttattttaggatagggaaagcagctcagccgagtatcgttgctttgattctcttgatggttgtatctctgctgctcatacggcgcaagtatttctacaaaagaaaaacaattgagaatatatctatttgtttaataatttatgtttatatatctacacgggaagaaatgtcacaaatatacgagctccgcagattgaatacataggagcaatcacaaatcgcgttgcgggaatgcgggagcgccaaccagggtgttcccgctgaacgagcaagcagaaccgctagtccgccacggtccggtgggctgaacttgcgggaccatgacggtcctgcggaccaggagtgcggcagcgtggcttcattgcgtggaaccaactctgtgaacagtggcaaacaatgttagacggtactcaatagtgtttttgaacaatattaaaaacgcatgtacgtgttcagatgccggtgccgcggtgccgtgagaccaatccacaggaccacgtcggtcccgcgcaattgccccacgacactacccctcttgtcggtttcgcgccttcgagttgcagtgatggcgcgggccgcgtatgtggaccgcgggaaatgtatatttctataaaattttcatacgcatgtatatatatgcaaaatcaagaaaattacttcttccgtcctaaaataaatacagttttacactgttcatattcaacgtttgaccgttcgtctttttttatttttttatgactgtacttttattgttattagataataaaacatgaataatactttatgtgtgtctaaatttttgttagctttttcatattttttttcaaataagacggacggtcaaacgttggacacgggtaccaacgattacacttattttggaacggagataataatttatattttaaaatttaatttgtatttctactacttaaacatggagtcatcgatcctttccccacctcgtgcaaagcatggaacatccaatggggattttctgcggtaccgctagtgcggtagcagtggctgatgtgtgggtccggacccacatgtcagcctttgctactgcatcagcagtactgcaaaggatctgtatcctggactatcaccctaataaactagaaaaaaaatcaaacgacaaaaaaaagagagcaaagtatatatctacactcacaacccatcctcaagtcatgggtctagttcgttataattcacggatatattactaatgggagataataggatgggcctatacaaagaaatatatccgaaagacttggtggatattttgagtaattgctatctcgatgattaggaatcacctataaatgaaacatagagttgtgagggtgaaatatgtagaaagatactaggaagcgcaattggatttgtggggatccatgccattataaatttatctgtttggaaatataccactataattcgtgaaattaaaactataccattacaatttaacatgtatttaaggggtagcactgcttaccccttcaatgcaatttctaagtttttctgaccaaattaccctcctttctcaatcatcttcttccttccatgtgctctcgtcgtctgctggtcatcgcctcagcccctggcgagctcgtgcagccaaccgcagcgctgccctgacgagctcatgcagcaggcgtccacgacgcacgaagagctgctgctggaagggaccggcaggaactccaacgcatatccagcgaccttggtccaaagcagcatgggcgagttcttgttgcagttggacacgagctcgatggctcccgccgtccctggatgtgctccatggccgctgcccacaccagcaccgacgcccccgccgttgccacccccaccccccacccctcggctgccagatctgagtcctaacagcgacgtgcgtccaggcgtcgctggcgtccgctggtcctcctcgcatcactggcatcatccggccaaccaactcgcgtcgtcgccgccgtccggtctgccatcctcacgccgtcgtccgctcgtcctcttcgcatcgccgccgctgtcctgttgtcctcctcgcgtcgtcgccgccgtccgtaaccattctcacgctgtcggtgtctgcccatcttcctcgagtcaccggcaccatctagccatcctcattgtgtcgccgccaccgtacgctcgccatcctcacgccaccatgttcttctcttcctcctcgcgtcgtgtcctctgctcgtcctcctcggcaggcgggcggggcgcgaaggagcgcctagaggcatggtttaggccggaggaggaggagcttcggtggaggcccaggcctcactaggcgtgagggagagaggagagagaagaggggagaaggaagaaagggaggagggagcaaaaagacgagggtaaaatggtcaaaataatttttataaatacactgaagaggtaagtagtggtatatcttaaactgttgtaaaattataatatcatcgttacaaatatatgaattataacggcatattttcaaactgaagaatttataatgtcatggatccaattaaccctcgcataaagggagtttggttgtggttggtggtaacgtttgtgtagctaggatcatcatcaggcaaaattggcatcatttctatccctgaaccaatcgctgattcgctgcacggtgcacgctacgacgactgcgtgtagccgtgtaggatacactttgaagtcgcatcctgtttggatccataatcggaaattcggaagtctcaacggaacattcaataggttatatctttatgagcctcagttttcaacggaacattcaaacgtttaatatgatagggtgtaaaatttttacgtgggaagtaaacatagcctcagtttgtacgagggaggtcagacactgctaattgtacatggtcccacaagatcgatgtaagtgccgaaccaaagtaaaggtttgctttcgtgcacggccggtaggcctatagggacgatccactgatttggtcatcgacatcttgaggaataagttcatctgaggtcccttaacttgtcaacgaattcgacttttgtccctcaaccgaaaaaccagacacaacgggtccctcaactatcaaaaccggtgtaaattaagtccctcgatggtttgagggtggttttggctgacatggcgcctacgtggctaatttgacttggtcttcatctgacgtggtgcttacgtggcaattcgatctagaaaaaaataataaaacccatgggacccacatgtcagtttcacacacaaattaataaaaaatggtgggggcccacgtgggacccacatgtcatcctcgcccctcctcttcttcttcctctctccccgactccccttcatctctctcccctctcctttgtcctctctctagacgcgagtgaggaggggcggcgcgcggcggacgacgggtgaggaggagcgacgcgcggcgccggcgggagacggaagagttggcagcggcgcgcggcaccagtgggagaggagggagtgactcgcggtggtcgacgagatacgggaaagaagggagtggctagaatgagcgagctcctcgccctctccactgcgccggtgctccacgcgcagctccagcaggcggaggctgcggcacaggcgaggggcaaggcggtggaggacgacgacaacccacgccggcgccgcggacgacgtcgagcaaccggcggccagcccacaaacgacgacacctccttctcccttttcccctctcctctcgtcgccgtggatccaaagggaggagacggcagcctcgctccccagatcagcgtcggcgactcggcggagctcggcctaggcgtcgatgacgccgcgtggccacgatcctagcatttgggatggcatccgctgagaaaggatcgtgtccgcgtaagttgggtcatcgtgcccacgttctgtaatcgcgtatggataaaagggaaagaaacagaaaatgtcgcaagcaagtaatatgcagcgccaaaaagactttcccaattggtttgttcttctcgcgtccaagcgtgtgtgtgtgttgcaggtttcactgcagttgccggagtttagctaacatcgtcccccacctcttcattgacggcggcggggattaagacgacgacgacaatggcgacggccgtgaggcggtgccgtggcgcgaggagaagcacccgaagacggccaatacccatatctacaccaccattgacgcaatcccggtgctgttcaatggtttccctctcctcaagggtgtggacaagccgtactggttcgaggacaccgacgatgacggcggcgtcctttcagcctcatcccgtcgccatctccaggagctcgcctgccactcgccccctctctgcccaccgcccctctgctgtgcccgccacctctcggcgctgcggtgccgccgccccttgcccgtcgcttgtgccagcttgctccagccgccgccgcttagctccgccggccggccactccgctcagacctgctccgcccaggtgagagagagagaggatggagagaagagggatgacatgtggggccaaatgggtcccaccatttattattattttgtatgtagctgacatgtgggtcccatgttttttattttttaaaattaaattgccacataagcgccacgtcaatgccacgtgggacgaagacctagtcaaaggagccacgcaagcgccacgtcagccaaacccgagcataatactgccgagggacctcttttgcacggttttgtaagttaaaggatgtgttgtacctggttttgcacttaagggatgaatttcaaactcggcgacaaattgagggacctagaatgaacttattccacatcttgattggtatgttgggccgggcccgtcaggccatgggccaagccgatgccaggtcgtaccatcccggcctgacgcggcctagtcacctgggctagcacaatgggagggctgggctttctgtgccgtgtaaacggcccattcttctcgtctcttcggccttgagctctcgaggttcccttaattattttccgtttgccttttcagttcccttattctacatttggtcaattggctgctttatatattttgagaagaaagtgaggaattgcttcgttcgtgctattatagttctcttgatccttcttaatatataaatccggaccaccagaaaaaaaataaaaaagaaaataaaaagtgaggaattggattctgcatcgaccaatctcctttgatcattttctatatacgaagggcaggcagtggtaggtggcacccttgctttggcagcttgggggcaccttggcagtcaagcgatgccatggccaagactaatagctcgattccagactttcagtagctgcattgcatatcaggttctttgatttttttttcttccttttcttctaaagctgcggtgttttaaccttattctcggcattgctgcattctttataggaaccgaatcccgtgcacattaagtttgacaaatttatactctaaaaattgtcttatattattgtatggctaaaatataatgaatgtgaagctaagacttaacaaatactcctatatacatatatagtacattttgagttcatgtacattatttttttcttgaattttcaataatatttgctagttaggtgtgcacatacatacgtacatttggttttgtgaaaatacactcactgaaggttgatatggatctagaagatgtgtgaatcatgtgtggttcttgtaaagtaaatatatttggattatgtatcagcgtatcactatcaaccatgtatgtcgaatatacttatatatgtacataaacaatggaggagcaatttgcgctcccatgaactgttaataatctgactgaagagtacttataaaaacagcccatattagttcatggcttacgtatgccagacgacgtgcaactgcaattcttacattgacctgcacatttcctcccttcccaagcttcaaggacggtcaacaagagggtatcataaaaaaaaatgaagctaaaaatattattggcaatttggcatgcaactaacatgtgttctagcacagtagcagggaccttatacaaattcaactgggtaaaattattgccaagcaactatcatgtgagtggcactgtagcaaaggccttatacaaaataattcgacagtatgcctttttttcccccttcaaattcacagtgctaagcgtgtgcaagaaatggttctttcaggggtgggaaaagggaaatagggtgtacggtacagccagtgaacaatccaaaattttcttctctgaaactagtatttttaaaaacatattcttctcgatcttgaatcatttcatgaaccttccaaaattattcgtctcctgattgaagagactgacataaacctaatctgctgatctctatacagagatgcgttggcactgtttacatacaccctgccggccatgatgttatcccatacggcagatccttcctttcggtcaatgcattaggtgaaaaccgagtcgtcttacatgcatgctatcacatatatagattgcaggagcagatcgaacaaaatgattaggtcaacatgccgtgtgtccatgtggatcggagtacgctagaaatttttaacctggaagctagagttaactgtgccattagcaaaagatcactttattaaccttgcaaacggcaaggtcaaaagctctttccaaaaaacgagaaatatacttttgacattttgacagatgagtgagctagcactagtgttcttcctgcttcgactactaccatatatgttgccttccatttgttgctcatgccactacaggcggctaaagaaacaattcacatgcattatgttattttttttcgcaaattgcatcagttacctaaccactcctcgttctgccatagtttcattagtttaatctctagtttaattgagctttctgtgcgttcattaagtaaagtacaaggacaggcaggccagaagtattctcgttggaccatgcatgtattaataagcagcagtgccggtatgcgtagtatagagtaattcgtctgaacctttctcttttgtgcaatgtgcgcggagaaaagaaatgcatggctgtgcttgatgtcgaccattgacgatgacccacctaccgtgtatgaacaatcgcggaaatagaggataattagagataagggtagacaaacttggatggaccatgatcccgaacaacacttggcattttggcaatgatattagggcccacatgttaatgagcagtattgtagtatgtattgtagtatatctctgtttccctattttgccaattccttttatctttgtcggttatgtttctataaaccggttgagtagataagggaggtttcgtgtctatatgtactccgcaccgatatcaatccaattttgtgttgagtctattccgcttttatggtatcagatttttttcgatctaccgctctaagcctaactccaccaacaccgccatgtcgacggctacctcccccctcttgccagagtccctcgtcaacgttgtttccacgtccgttgccgacgccgtccgcgcgtcttaccaagccctgcccggctcgacaattgatgacgccatggccaagacggtcaccgactccgccgctgatcgacagggcatccgccgccgacccgccgtacatgctgccctcaaacagcacctgccggcgctctccatagcgcccaccgccacctcgtctctccccaccatggacatcgctccttaattatctctctcggttctgtttctataaaccggttgagtggataatggaggtttcatatgtactccgcgccaatatcaatccaattttgtgttgagtctattccactttcagtttggttcatgagatgcattaagtctgaaaagtaatatttcttgaatataatataagggttggccttatctttaaaaaaaactagtggatcaatccagcccatttttctctatcactaacatgtgaaccgtcacttaaaaagtaggtcattttatctctcataccaaacggataaatgcgatcttcctattttcgaaatatggatgagttcaaccaatctcatctcgttctgaaatcaaatacctctgtgtaaaaaaaaaagcggccgctgtattttttcagtagatgaaggagaaaaagaaattcggaattctgaacgttcgtgtgtgatttgactgatttatcatctgaaatatctgaatgaataatgattaggatttctggaggaaacgaagaaacgagcgagcagaaaatgagtgaaaaggaacgaacacaaacgctgaccatcctctgctgcgtgtgtaaaactgcagccctgtccaacaaagcggccggccgcgtcgtccaaaagactgatcgctcatcgatccgtcacatgcaagttgccaaccatgcggtgaaatggtgatggttctctataaaaagagacccttccaacctcaccctgtcaattgtgcagcgagacaccgatagctagctaactaatcttccccttcgtctccggcattattccacttggacgaacactagctcaccggccggccatggcgtcttcttccgttctgatcaagctgctcgtcgtcgtcggctgcgccgccgcggcctccgcggcgacgctcaccgtgggtggtagctccgggtggacgcttggccagaactacgatacttgggcaagtggccaaaccttcgcggttggagacaagctcggtgagtccttgttttcttttggcttaatttggtagtagtgatcagaatgtttggaatttcaggctggaatttagtcatatttttgttacaatttcttgtttcatgcttttctatacatcaaaagagaaacaaaagggtagaaatttattggagggagtagcacataagtgtacttcttttgccgggtcggccgaccaaattccattaagatagagggtatgcaaatttataaacctgtgaatttcgacaaaaaaaaaagctatcaaaaccgaatggagattggtacacaaacaacctcccgaaaacagaaaaatgtgctacggcttggctgttcctctcccaaatcctttaaaacttcagcttccttccagattatgatttcctctttgacgattctagaacacgcgtgcattcctttccttccaaataagtggagtactaattaatactcgtgactaatcaagcataattggtaatttcccttttcagtgttcagcttcgttggggcgcacacggtgacggaggtgaacaagaacgattacgacaactgcgccgtcgcaagcaactcgatcagctcgaccagcaccagcccagccaccctcgacctcgccgccgccggcatgcactactacatctgcaccatcagcggcactgcgccggcggcatgaagctggccatcaacgtcggcagcggctccggctccggctccggctccgggacgccacccagcaccaccccaggaagcagcggcacgccgccgggcaccccttcttccccctccaagccgaccggcggcgcgtccgccggcctgcaggccagcgccgccgtcgccgccgccgccggcgtcctcgtcaagctcgccctcttctgatcgggcccacctgccaggatagaggcagtgcatatgattcttgtttcttgatcatttcgtctgacggccggcatgcatgtgtgtgagagagatgagtggtttgctagctagctagatgatgatggtgatgatgatatggggttgttgttccgttccatcgtgtacttagtactgtaattacgagctgtcatgtgatttgttttctcatctccatggatttgtataattttcctctgaattttatcatctgcatattgatcggacactctatatcactctatatcaatcttgcaaaaagaaaaaccggtggttaaagtgatggttaacggattggtcatgctgagcaatgcatgatctaagcttgcctaggccgatcactgtagtaagaatgggaccagaccgacctgaaagaagagcaatgagacgactactaactactaggacactagcctagaggaaaagaatcgaataatagatcgaagggcaggtagtgcgtcgttttcagagaagggaatacctcacatttctgcttctgttagaacaaaagtttcctgcttcaacacctgctccgggggtaagagtcagacggttagcttaggtaccaaagttctctgatgctaattagccgtgcttacctttgaaatgagcaactgaatctgtcatgtcagtgtctgaaatgagacgacgacgacagtggacacggcggattcaacttcttgatttctttagtgatggtgggagtaggttgggtttggtgaggaggaatacacctttcaatctcaaagcatcaaggcggtgtgtatagatgactagatgagtgtgtgccagccgcctcagactccttgaacacaaggaaagaattaaactccttaaagaaagaaaagggttgagacaatgagaccgtccgtgatttggagtatatcaccgttccagagtatcagtcattgtcatacaatttgggatattaatttgttagcgagaagatcacaacatgttcgttgcaatttttcaggtctctttaccagactttggtagaccgcagtgagagctccaatccaaatgacagtaggctgagaggtaaagagaaaaaaaaaccctcaaaactaagttgacttgtgtaaaactagtttcgactactcttgagtataatgagttgagtttgattttgaacttttgcttcgtttgccaatatgtgttcactatttcggaacctataaatatttcaacgacaagagaggaggggttgctatatcagagactttgaataataattaaactcaaaatttgaacactttactttaataaaattttttgttaagttgcatagtttcaagctgaaaaaaaaatcctattggaactttatttcaaacctgaattttgaaactctagatctcaaattgtgagacctacaaggttgcacaacacaaccattacgagtgtaaacacgactggtcactggtagatctatgattcaaaattatcattttaacctctactcaatctgctctatattatagttcatttttaagtttgtcataagtcaatatttttaatttagtgaagcttactgagaaatataccaacatttttaacacgaaacaaatatactttaaaaatatatttaataaactaattttttattataaatattatcatgtttttctataaacttaattaaattgaaaaaaaataaattaggataaattggacggaatatatcgatcggatgaaaagaaaattgagatgaaaataaatcaaataaaacagtagtgagtagtagcactagcagcttgctttctactccctgaattgataagtggtggatatcctcgcgtttcattggtgcgcgctggaattgtgcgtgaatattataattccgttgaaccggtcttcgcgtgctggaaattgtgcggctactggcgttgggaatccctggcgttggcgtttctttgcggttttgacaacgaccagtcgactattcacgacgacccggccccctaccatgctgtccatgcatgatttttttcgccggactggcgtgaagagtgtccatgcatgatgaactcgatcaacccaaattccaaatttgccatcccaaattcccaatccctgaacacacggcctgccccacacacattggctgcattttgccatgcaaaataatgtgcttctgattttctgaacctcgcgcgtgcgctttatccaaaatgagaagaatacgcgttgacagacaactgcgccagcttgtccatcttggcggccgataatggagtaatggtggtcatgaggctctttttttttttttttttgagaattacatattacaacgcagacactcacaacgcacgcgcactcaaccctctgtcgatgggtacgtcgcctaccactgaaagcacaacgccgttaaatcctagaaaattcgctcccacggggagtcgaacactgaggctcttgtaaccactaggctacatgccctttcgcatgaggctctttctttgatcgacttaggaacgtcctaaggctgtattcgggaactccacctcacctatgaaaaacgcagtccattaacacatgattaattaagtagaagctatttttttaaaaaaggatcaatatgattttttaaagcaactttcttgtaaatttttttttgcaaaacacacaccatttagcagtttgaaaagtatacacgcgaaaaacttttttttttaattttgagaatttaaatcctaaatcgtgaaccatgcaatagaatatttatacctcgatttaaaaagtgagctataaatattctatttaatttaaaagtaaattgcatcgtcggtacacaaacttgtcagatggatacaaacttataaaatactcgttttggtgcacaaacttgtgcggtgcatgcggggaagtaaaaaggacattacatgactaatcttgttgatttaggggtcgattaggatactatgggagcgttcattctggtgacatagggtgagaaaggacatcgtattctgggcgtacgcttcccaaactactaaacggtgtgttttttgcaaaaactttctatagtaaagttgctttcaaaattcatattaatccatttttgaaatttaaaatagttaatacgtaattaattatgcgctaatggctcacctcgttttgcgtatcttcccaatcttctcaatcccctcctcctcaaactcaccctatgtaaacatatatatgagaaggttaccattatacatacacctattcaataaaatatagaatataatttagtgatagtagaaaaagattaaaaaaattgaacactgatataagggttagaaatatatgaaattcatcatttcaatgataaaggataaagtagagataaaatttataaatattacatgtcttatgcatattaactatgcgtatacacgccacatcctaatcaacatcaactttataaaattaacattgtcaagttattttggtcctcgttcgcatgaactagacaagtttgtgtactgaaaacgagcattttataagtttatatactaaattgcacccacctaacaagtttgtataccaccaatacaatttactcttaatttaacaacagtaatctcctccttatacaaagaatctgccagacaaacgtaagagttgaatcattttttgaaaggactttactaccaggacttagcctagtaatgtattttcgtaaaataaaagacttatttacaaagttcgaagcagatacaggaattagaaagtttgtaaccatgaaaaaactatatgcttaagatgtcattcattttgcacgtatgcaaaagaataagagttgaatcaatatttaataacgatcaatttacaattatatcacacaatcaagtgagttgtattggatttggatcctactacatatgccttgtttagttccaaaaattttttacctaaaaacgccacatcaaatctttggacacatgcatagaacattaaatatagataaaaaactaattgtacaatttgcataaaaattgcaagacgaatcttttaagtctaattaatccatgattagtcataaagtgttacagtaatctacatgtgctaatgacagtttaattaggcttaataaattcatctcgaggtttccaggcgagttatgaaattagtttttttatttgtgtctgaaattcccttccgatatctagtcaaacgtctgatatgacaacaaaaaattttctttttgcgaactaaacgcacccttagctcaaatttcaaaacgagatgatttttggttgatacgagagcagcgtgcatgatatccttgcgtttcattcgtgcgttggaatgctgtgtgtgaatcaatataattccgttgaacggtcttgcttgtgctttggataagataacgacctttgacgacgacccaccaaaccatgcatgcatgaacatgagcacttgctcccacacgcatgggctgcatttcgcctcttaaattaatcaaaacagtcgacttctcaaccttgcgcgtatgctttatccaaaaatgcgagaagagaatgcgcgttgactggacaggctcctgctcctgtccaacttagcggccagtagtccccagctgcagctagtactcatggagtggtcgtcatgaaactctcagtataaaaggaccctgcagcctgatcccctgtcaatacaaccagctgcacgcccattcgtctcaaacacacattctttgattcttccttcaatttccccttttcaactctgtcatcaacttaattgttagaagcgacctaaagattttgcggccgatcgagcatggcgtccccttcggctctgatcgcaatgctcctcgtcatggtcgtcggctgcgccgccgtggcctcggcgatggagctgagtttcattgtcggagatgcgcagggttggaacaccggcgtcgactacaccgcttgggcgaagggcaaaaccttcgaggctaacgacacgcttggtgagtctttctcgataatcaatcacttcattcgcacaatgctgctaaatgctaatgctatccagtttgccaattggcatttgaaatcgaacgctgattttatttggtgtaattaactgttttttgccttttttgtttcttcagtattcagatacgccaggaagcagcacacggtgacagaggtgaccaagagcgactacgacgcctgcaccgtcagcggcaaaccgatcagtgatttcgaaggaggcgcgcttgtgacattcatagcgctcagccccggcgagcactacttcatctgcaaaatcggcaaccattgcgccagcggcatgaagctcgccgtcaccgtctccaactccagcgacaccccgaggccgcaaccttggattgggccttactccacgccagccagcgcgtccgcacacctgcacgccggtggcgccgtcgtcgcggcgcccgttgggatcctcctcaatctcgccctcttctgagatcgcattgacgcgtcaagcggcatgaacgttggcagggtgaagccaatgcatgattctttgtagcgtttctgatgaaatttgtttgattattttgtttacgttcgatcgggtatacgtgcgtaatatgatttattggtcttgtgatttattttctccttatattcatttgtatatcctctgatataattttctgtacatctcagcattctgtatgccattcagtgatgtaggttagagtaacaaagaactttgctgtgatgtctttatactaacttaaaagtgaactcgttatccttccatccctttcttctcccaccgtgcttcagtgcttgcacgcagagcgtagtaggtgtgtcaaatactcctagtaaatgccaaggaaatatgcctccagtccggtcgcacccgcacaaacccgttccaacccatctcgagaaaggcccattccatctgcttcgccacggcaaaaggcccgcctcttaacggcccaaataggcccttctcacgggggactacgtccgcgcgggccgttggggcccaggtaaacccccgcctgggaagcccagcttggatcgggaaaccctagccgccggccgccatcgcccatcgccactatacatcacgcggcgaagagagggagagtgattggccgcggccgccgagaataactggagattcgccgtcgagcgaatgcagcaggctatagcggcgtagcggcgacgaccgccgacggggatggcccctgtggcgacggtcttgacggccgccatgtcctcgtaggccgcctctgcgcagtaggcgccggcggtgccgtcgcttcgactacggaggttcgtagctcgcgctctacgccttctagatccggaatgattctaggggatctgcttgtattctgcatcttgcgcgtaccacgttttttatgaaattattgacgaatattttaggtctcttcagtttctgcgtgcttacttcaagtttcggcatggagatgtatttgggttttcgcgttgatgttctttgtattgcttttaggtctattgctgatggactgacatctgattgtttaaagtagctagtgcgtatttattcatcctcaatgatgagagatgcattactgaagattttttcctaaaaaaaactgaatgtatatgtggcaaaggcatatccaagtgggcttttaattgtaaatatgttcattgcacttctggtccgcattagtgtgacagcaaacaacacaataagcatattacttttgatctgattgatagaccagacagctgtctgatgcttctattgcctatctcatgcttgattatagcatatttgcattgtggtcttgattgtaaggctgtggttgggattcactagtttcacatacttggaaagaattcttggagctacctttctgggaaaaccctttaataaagcaattctaactcttatccattaacaaaaatgccttcagttgggtgtaaaaatttatgtattttctgcttatctgactataacgtgttatgttttcttggacgtttttatgattggtgccccaattttcaccatcatattttctgaaaacatctgtggtgttttgatgaaatgcaggttgtcagttgtgttaattcttcagtcatccgaattgttgagattccatattgtttggtcataacataaccagtatttttatttctgtcattcaaaactctattgtgctctttattgcttatttatatctaatcaacacttgatatagtgccagcctaaaagtaaactagaaacctactaacctagtgatggcacattgttgtcttgtggccacaaaaggatttccttttttgtcttagcaggtgtgcttgtggcaggaagtattttgacgaatttgttgagttttttcttttggggtttacattgtaaacttatatgtgatttgcaggtttctggaccaaggtccttattgtggattagatttggatgattttaaaactctttaaacacaggatgcagaacagctcaataacagaagcgctggaccctggaggtattcctatttccatgttgatattaatgcagcttgatttttagtgtcatcattttttcattgaaaccaattggctcggtagggctatctccaatgctggtggaatatgaagtccggagcatattgcttagtttaaatttgttgtggtgaatagcgaggaaatcagctctttatgagtttgctcaagattgattgaagccagaccttttggtgaatattatcaaggacagttcatatggctagaggaataaacgcagccacacataaattatctacctgtaggaggataacccctgaggattgacaaggaatcaaggtgatattttgctacctaatgctcttcaaatagttagttgaattttcttccgcctattaagaaaatgcattgcatcatattttgtggtctcctcctccctagtccctaatgctgtatgcgtgtggattgtgattagtgttatggcaatgaggagaaatgaaaggccggtcttacggctgcctcccattcccttcccgattcaattagtctctggtatgggacgggatggtagtagcatgatgtgcagttcggcgaaaggttctctgagccattctttctttacctccacttatgttcagtacactttatttcgtgttctttttagggtaaaaatattgcaggttattagggtcctcattcagtgtgcagatatacaacaatgcacgcacgttggaatttgcatagtcttgcgattttgttcttgcatactcttccagaagcattgatagcttttgtcgaactcctgattttgttcatagtttcagttatttgctggttatgggcccttccagccagccttcctctggattcttgttcttcgttactatcatcactgggcatcataggcgccatattggggcttattgtttgttgatttgagccgtctgtgccttttttgcttatttgttgtgtcgagagctgttgctttacttggaagtagtagatgtgctgatatgaaacaattacggtgtaatactccgtagtccgcaaatgactaacttatttgactgtccatgtcatctgttttgtattattgagctggttagagcatgtttaatagtagataaccggctataagcttatattagagctaacttgtatatacatcgttctatgggctgcttttcgatgacgcggctgtggcctttccctatccagatttctggaggaccagaaaagtagaaacggcccgtgctagccactcgcccgaacaatattacggagtatttttacccctggttttagaatatggcgaagatcgacgtgacgattatctaagaaacgtgaatctcgaatactatcgtacattcatagattccagaatgccacattgtaccgtgatgattcgtctaagaaatgtgaatataccgtgttgccatcgcgggattgtttgcctgttccacacgtacccggccacctcacccatacgcgcagccacattacaagtggtacaagcaagagcccgacggcacagcttgcaagagctccaccgtctcaacctcggggctaccaccgacggctcacacgacgacttcttggcagcagtggtgacactggcgatgcaagtgcaacaacaacaacacgacctcgtcaacattgataacacctcactcgagcacagcaccggctccaactccgtgtacaatagggacggcggctacatgatgctgatgagcaccgcatcggccacgacacgcggtggcgagaaaccacgagtagcaggtggttcaagacggccgagggatcacggcggcgacatacaaaatgtcttcgcatcgtgccgttagaggccaatggctggaggataggggcaaagataacataattgccctgcattgttcgctcgatgtaaagtcctaccccctctgttttttaatacatgacaccgttaacttttaaacatattttttactatgtcttattcaaaaaaaattgtataagatataaatcatgcttaaagcattttaagtgataaaacaactcgcaacaaaataaattataattacataatttttttaataagacgaatggtcaaacgcgtgataaaaaatcaacggcgtcgtctattaaaaaacgaaagtaatacattttttttttacttattctgatttaacttgtggcgtgtagtcaggatggaacgaggaggctttcctgactttgtgtagtcgtcatataaatcaggatggaaggataaggctttcctaacttgcgtgtaccgtgtagtcacaaaatggaaggatgagaggatggaaggataaggcttacctaatttacgtagtcagaatggaaggatgaggcttttctaacttcctgtacttcagtttacagttgagtcatgaagtcggagaattcacttctgggatggagccaaactaatcaaacgtgtgccaccaccactggtttcatcccaaaagtgtcatcgctaccggccaaacccgccccgcccgcgcacgcactaaccgcaccgaaaaaccgcctacgcgagcgtgtcggccgcgggcacgttaccaacgcgcgcagcccaaacgccacgcgccctcccctcgccgcatgtcttgccgtgctcacccaccccccaccaccaccacctccagcaccggacgcctctcccatctcccatcacacgcgagatgctgtgctccccagctggccaccaacgtgacaacatcatcacgcaacgaaagccacagcggtagaatcgaaacaaagcaaacaggagtagaatgctacagtaatacagcagagggggaaaaatctgagcagatctgaggagctagatcagaacagatcaagcaggcaggagcaatcggatgacaaaatctctactaataatgtccgaaagtagattaaagaaaagaatccggtgggggaggattatacaatggcaagcacagtctctctctcactcacaaaagctagatctagattaaaacgcaatgggattagcaaccccagagcgaaggggggaaatagctaataataacaataataaattaacggcagtaatggcggtgatgatatcggcggcggcgaggaactcatctccgggagccggatctcagtagaacgccgcgacggctgccacggcggcccaggcggcgacgacggcggcggcggagggggagactccggacgcggcgctcggtggcggcggagacgtcggggcctccgtcggggactgggagatcgaccccggagccggcgcgggcggcgagaggacggggggctccgcggtcggcgccgaggcctggggtgacggtgtcgcggcggcgctcggggcgggcacgggcgcgggcgcggaaaccgggggaggcgtcgtcactggcggctgggcggcggaaggagacaccggcgccacggccggcggccgagtcggcggggtcgccaccggtggctgcgccttcggagccggcgtcgggaaggcgctcgggccctgcgccaccgccgcggcggcgaagagcgcggccatggccacgaccacgaggtggaggcgcgccatgggatggcggcgaggagagctagggtttgggtttttgaggttggtgggcttcgctttgcaacttccaagtgggggaggcggcgaggcgggcgatggatgatggccttcaggtatgggggctataaaaaagggggcttttaactatttgccacggttagttttagcaaataactatttgccacccctatctcaatgacatgtgggtctacatatgtctatgacatatgggtccaatggcaaaaagttaattgtcacatctaaatgtggcaaatggttaaatatctcaaaaggggggaactgactacgcggtagaaacgaaaaaggaagagttatagatagcgattaaaaattggagattggtttatttggaggatttatttaattcgagattttggacggtgattacgccatcctttttaagtcggttcggccgtcggatggaggatggccgttggattggctgccagggtgcagatgatatgggtacagaatgttgaggctacttataatgaaagcaaattctgcaaaacaaacgaacggtgcaatatcttcatgtcaaagcaaaagatattttccattcacgtatttaaaacagttgacttgtccgaaattttaaaccaggtagatatatttggaacttttacatatatctcatattcgaactaaagcctagggatgtcgatccaattccgggctttttggattataggactaaaaaaaagtcaaaataggaaaagaaaagataagagcatatgcaaaacaaacatatgaattctaaatagaattgtaaaacatgcgtcaaacaaagcaaaagcaaagaaaaaaacgtaagaaatgaaataaagacatgtcagagtgcatgaatttttttttctttgtttctagtagaatccacatgatttttcttgggtttctgtaagagatcaattcctttgaaccgaacggtgttacagtcacgaatccatatgaatccaaaactctcttttttttttcctttgttttttctcatatcagaatgggtatttttgtcaccatgggcaagtgaagtaattttttctcatcatattctctttcatcatgttaaatgttatttttattcctaattaagatttaagaccagctctgaagttttggccacaagtcaaggtcggttgccttttctatttgtgataatgcgcgtccgcctataacaatgccgcgtcaatcttaatgtcagtttaaaattgccagagaagtggatatactagaatagacaggctatttccttacttaaaatgacactagatgagtagtaggagtatgtttttggttcttttatctaaaaaattgttttgtttggttaattgataaatattagctttgagaaatctttggtcaatttaaaaaaaatcctttaatcggaagaaaatggacatgacaccttttggaaccatggatcgagtcttatggagctgtgctcaattattgtattcacatccgtttacttattcagattttaagtctagagtagtcgccgctgaactttttgacagtgactgtttctcccccgtaattttgataaattgaccctttgaaaaaacttattttgatattgagccgtgtcaaaaactaattttaaaaatagaccattttctcacggcatcttacttggcgctgagataaggtccgacgtgtcccgcaaatcacacgtcatgcgatatcagggccaaattctttggcgctaacttacatggtctggattgtataaatagcatgcatgtacacccttactgtatggaaggtgtatcctggtggtggagggctgcctctcataagtcaagggttcgaatcccgtaacttcccatttttctttttttttcctttgaggaacaatactgcatacataattatgtagcaaaatagagggtgaaaaaaaactgaaatatgtaaatttataccgactattaatctataaataccacatacataattttgttccttccatatttaaaaataaaataaatttaaaaaactaagctataaatactgcatacataattttgttccttccatatttaaaaataaaataaatttaaaaaaacatccatatttaaaaataaaatgaatttgaaaaacatgtgagatttttaaatagaacatcaaaagatgcttgtacttagatggaaaaacttgcgtggctaaggattgaacccattacttcacaagttctcccccaagctatcttgtctttgtgtgcaatggaagcttgtagataactaatatttgtaaattgaacagagatctttggtgctgacctcggatgacgtgtaaaatccgtgacacctcggatgacatctcagcgccaataatagtggcgccgagatgttatatctcagcgccaatctctatggcgctgagaaaacggtctatttttgaaattagtttttggcatagttcaatttcgaaataagttttttaaaagaatcaatttatcaaaattacgggtttctccccgtattttattatagcttagccaagtctttagtggaacatgtaaacgatgaaagggtattatagtggcatcacacatcaggtgattaaggatcgtgctatcaagaagtcaacattaactggacgtctggaataccagagtgcatggcacgctaggcgtatttacgagctgatgcatccagagaccaaagaccttggctgtggtcttaccccaagttttccaactatctcccttgtttttcaggcacacacttttcaaactactaaacggtgtgttttttataaaaaaaattatacgaaagttgcttaaaaatcatattgatttatttttgaaaaaaaatagctaatactccatccgtcctataatataagataagaagttttagaattggacacggttattaagaaagtactatatccgtttcacaatgtaagactttctaacattgcttatatttatttagatgttaataaatctggacatatatatttgtttagatttattaacatatatatatatatatatatatatatatatatatatatatatatatatatatatgaacaatgttataaagtcttacattgtgaaatggatggaataggtagaagtgagtgatggagggttgtgattggatgagtagtgaagataggtggaaaaagtgaatagttgagggttgtgattggtttggaagagaatgttggtgaagaagtggttatattttaggacaaatcctaagggctaaaagttattatatttttgaacgaagggaatacttaattaatcacgcgctaatgaaccgttccatttttcgtgtgcactgctctggttgtgacaaccttgctccagcgaacacttcagtgcaaatttgcagccgtatgaacagctcagaaatcagcgtatttactactcgatccgtctacgtatccagatatagctacatatccgacaaatatgtccagatttataggtgaaagatgttatatttttataatggagataatccaagataatgatacgtaaatgaaaggggaagacgaccaggcaatgtagaccggacagtagagtagactacaagagcacaaaagtctttacgtgctattggatgtagcagtgcgccaccagcatcaatcttttgctgctgaattgcccataagctgacagcagagtcgtgcatcactgcatgacctaggatcacggaccgataagccaccactcaggcctgtctctttacatttggagagttgatacaccaatctcagctagatatacaaatcatcagccaaatatctaccctacagacattatccaagaggaactttggataaccttcttctatgttgaatgggcacacggcgcccttgtacactatgaagtatgaaaacaatcttccaaagtgcaacttctgaaggatcttccttcaacgaacacagttgcaatgtttggtaaaactccagttttttcctttatgttcacttctatcagcatgtcactgaaagaatcttctataaacgaaatgaaaccatcttctgtcttgttccaaaacactgcagaaaggttaaaaacattaataaaataattgcacaacacaaagatgcaaaacacacccttgtagaatctttattgttctaaaatactacagagttcagaggaaacaagaatgtatgcaaacgttatgataggaacataaatacagtaactcagcagtcacggatgaaatgattacttacagaagtatacttgtttccgtctgtacatggtttgcctatttcacttggtcacctctcgaacttacagcctctaccatttcttcactactaccttcagcaactcccatttccttcactttttcaagttgcctgaggagatctaacctctctggagcataggtggatgggatctacaaaataccagatgcacaatgtacataattaaatcatgccacaggggaaataatgaggggtcatacaaagttacgaaccatggaaggcacatatctctggatgaaagccaaaatagcagcatgcccaacagcagttacctgggaacattatgaacttgtttacaatgctgtatccatgaagatatttgcactgaacattaaagttcactaactaaaaaacatgactggttatctttagtcaatgtggatgaagtaaagaagacaggcttctgaaaccaaaattgaaataaacaacagtctgggcctagaaggctttatgcttgttcaggaggggtaaatcgaagtacaacaaatacttactggcagaagcatgagtattcctataggaacaacagaggctaaatctgtcagggttctttgaagagcctgcttttccttatgagttagttcatccccaataagagctcttcttaacaaacccatagcagctcctgtgtcaattgctaagagctgtgtcccttgcacaacagtctgtgtagggaaaaaaatagagaaaaaggaaataagttgcaggtctgcattctagacattttttttccctcaaatatggaggagagctgcattctggatttcagtaatggaagcattcaaatatgatgatgcgccctggtggcacaaaggcttcatggcaactaattaaattatgtagggccaataccaaatatattttcaagaaaatgtaaatggccttaccgtcgtggtttccttaaccttctctactgatttggtaataacattttctttcttgctagctggaccagaaggcattgatacaggagatgatgacacggaagaatccaatgtttcatttgcgacatatgtctcctggaaaatgacaaaacaataaataattcttcaaaattgaaaacggatgtgcatttatggtcaaaagcaatagtgagaatatcatatgaaacacataactcagaataaagtactctgtccagcattgttgcttaagtgctaactcaaataccaggtgcattcatgtcaacatttagaaagcatatattaagaagcatacctccttttgagcattatctgcgctcttttgaactcttttctctaactcaatcagctcacgtcttaactgttcaaaccggaggatatcatttgattgtgtgtctttgttatccacattagcgacagaaacctttatgagaaaaaaaaagaggtaaaatctgttaagtaagaacatggtgcaacaagatatctttgcatcaatggtgttgttctcaagaacagaatacatgcttccgcaactattatatactatacagagagactgttagtaagaataaatcactaatcattgatgatttttgtgatccccatcattgttaaatacaacacctaaaaaatttgctcgaaatataattgctaaaaggacagctcaaatattcattgcaagatggcagcttctattgttttaccctattgttgtttgaaaattattaaatgcacagtaatgcatgctacagaacgcatacattttgatctgaagtttgttggacaagctgaactctccttccagaaggcctaccaaagaggtcccaaattggacgacgtttgttctccactctggtgaaaaaaacaatagcggttattatccaccctgaaatcacagaaactacagcagaatgttacctgtttgctggtttttgtggtgttgagctctcattagcattgctagctgtctttccacggccttcctcgacagcaggagataatggtctgctactagcatcagcctaattgaccatcagaaaactttaggatagccatcatagtagtaatgaacagttgtaccaagtagaacatatggaacctctattatgttgactcacaaacatattaccaaaaaaaaatcattatcaaatattgggtgggaatcttagaaatatggtggttctacatggaatcaactaacttcgttgtgtaaaatgtcaaccatgttaatcagtggaaggagaactgacacacctttaaagtttaaacacagtaaacaaaacttaaacagtccacccaatgaaactactctcgggggagtagaagaacctaaattatatcaacagaatgtccctaaagaaataatatctcggttttaaatatctaaaatgtgcaacatatctacgtgaatgcatggccaactggagcgtcaggaggctgacgttgaaggagatgataccactttccacttgtgttatctttagttgttatcagtttatttgaagcggatgttatctttaggtaactagttggtacccacgctttgttgcgggataagtggataaatgcatgttattcattatagaaattatagattatagatgtacatgtttaaataatgtgaaaatgatgtggagataatgatttgacattacttgcatattgagttctaaaaatacaacaaaattgtaaatgatatgtcatgtttgcatgatatttaaaatactctagataataactgctagtgggtccacttgcatgtgatttaaaatactctggatgataattgctagtatgcgatgatgtggcacacttgcatgttgagctttaggagttagtgggcatcaactttatagtaaagataggattagttagtgaagctgttaggaatgtaactgttatactgtattagttagcacatgttaggaggtggtctaaataagccaagccatcattaaggactaaggagaaatatatttcaagacttcctactctcgtatatccctgcccttgtggtgatgttgtcagtcatcagctggttgcactgcttgggtccagggccatataatcagggcatgtgataatttggtgttggcgtcaaccaccacagctggtgcagaaagagtcagccctaccaggcaacaccaaagatcaacaaaaccaccatcagaacgggtgcaactatcattcactttatcgctagcacaactactggctttgccatcaacttgcaagccccatggacgccaaaaaggcagccctgatgtggtttcaacacttcaccatccagcgacttccatgctgacaacatcaatgacttgaaaagcgctagccccatggggcatgccaatgaagactttttggcatgactgcaccacctgttgatcttgtgactgtagctggtagaggtgcagcaaccggccatggtagatacattgacaaccttcagaagcacagtctgtgtgatcttgacagcttggtgctctcacatgacaggatgcccacactgcaacctcttcaccgtggagatttcaaggggtgcaactggtcaccaccctgcaggttgaggacaaacagctagaaaggaagggtgaagttccatgatacacccattattggagatgtgatcaaggcaagaggccttacagccaatggaatgtcatgaacagcccaacaggagcttaggaagcatgaggcagctggatgcagaacatgtatagttggttaagataaggagataagatatgtggctcgttgcgtggttaatgctgccctatttaaaaatatatctggattttaatcagattaagcaagaaataatcataagtgtttggactaggtaatcatccatagcccatgtagtgtggcccctggtcatcagcatggttgtgttgcttgggtctagggccatctaatctatacatgtgacaattgttatttcagtcattgaggatgttgtttctattattgagaaatagctggcccttaatagccattgcagttattggaatgcactctcctgagtcctatgatggagaaattaaagtgtccacatacttgtagtaattccttttccagatgaaatgcaggctagtaaaaggttgtatgataattaagctcacctcaagaaattctgtttttgctcgaaaggaagcctcaagaaactcagcctctttcttcagccttctaatcatttcaagatcagaacatgcagcccttagatcctccttaccagagttggaactggagagatgcaattcttggagcaaatcttctaacttaaccaaagcttcctcaacactttcaagtgactgcaattattgagactaacttcataaattttcaccactacaatatatattcagaagtaattaaattagcatttgttcaaattgccattgtaaactgaaaacaagcatacacaactaagcacaaacataagtaagactgaccataagctttttggcaaatggcaagtctaattgagaacataaaaatgcatataacttaacagtccgaaaaatattttttttaaaaaaaaaacacatctaacatatgatcttgtacagttattaattgtaaacagatatacattaaatggatcaatccttcatctcttgcatatctcagaatacatctaatacatgtcacgctttgaatgtgtaagcatatcaaaaggagacggtggcatctccctgcatgtgcagccttgcatcgtaatgaatttgatgtctgagcttatagtgttatggccgggagttactatcagcatgaggcctgcaatgatgtttcgcatagtgccagcagtgcatcaagttgcttggagcttctttcacagtttacccttatccaacaaggctatttttcaccaaatattatatattctcattaggggctactcatgaaagcaatcttaacatcttattgtttgcttacagagaaataacataagtccactagtcatatttcttgtccacaccaatattctggcaacagccatgagaatataaggcctctcaccatccatcccaccctccaccccctcccaccacaccaaaacaaaaccccaaaacacacacatgcaccaccgcttccctctgaaactggcatataggttccatgaagaaactataatataattagcagtttagcactgatatcagcaacatcatcttggaacatgtcaaatgcacaataatttaactaactcctcacaaaaaataataatttaactaacagtactgagaattactattgttgggatgtgtgagaaccagaagaaatactagtaacgttaaagtgcatcatgtaacagataccttgtcaaaagaggctagctctgtcctagcaaccaagtgttctttggcttctggaaaggtttggtcttttggcatatcatacctgcatcagaatgagcagataaataataatattcttacaattgtacaaacatatacccaagtaacataacaaataacaatataaacatcagaattatatgtttactttgttaagtccagttccttcatgcaatcactcaacatggaatgcctacaaaaatttgaccatatattagaaacgttggttcgcatccatatctgcggcaaaatgtgagagagcatgactgaatttggatgtaccccttggacagaaatctggctgcctttacatttgaagggttctcaagccatgagctgtactttataaaactagtcatccaataagagcacacatttagcactcttgatattatttctcctttatgcacatcctctctaccttcaattgttgcagctggcacatcaccactgtaaaatggaagccactcgagctcttcgcaaactacctggaaggtgaaaaggtcataaaaacacaaaaaaggtgcatagcattgagagctcggtgtattgcctgcatactaacctccacatacagctgataagaactaatcgaagacaactgtggataatataacacactcccaccaataagatacctggatgattgtaagcttgttaaggtgagagctacatcataattacgcaagaaaacagttatactgtagcttatgtacagaaacataatttcatcgagcaaatggcaattcaaaattcgcatcattcacaccttacaatatcattgattgaatcatccagattggtaagatgattggaagacaaatatgtttgcgtacttctgcctaaagcaatgaaaaacccaaaaattgctaaatccttttccaaaacctgcagtaaggaaaatagttattttggaaggagaattcataaagctagacgaaatatcttttgttccaacctcaatactttcacttgttgtcaatcttgaccatatcttttcacgatcaagagcccgtagcaactgtttctgaaccagatcaatccaaaacgatatctcaacttcacgatcactggaaaacttagggtcagcagcacgaggaccaaaattgcaaaggaattctctctgaagaccaatatcttttgtcaaggtatatgctttacttagagggacaaattcaagaagcatatccatgaatcgaccaatgatatcagggaccatggaaaagaactgctgacaagaaacttttgttgatccaagctttgtgatagcagcaagacatgtcaaacctagcataagtagagaaaggtcactttcactagtattcatttgctggcgttcatggcatctgcaagcaacaaaagaaaaggtatccgttaatgtattagttcatttatcaaatgaagcccaacagaagtaaacaacttacattgctgttgcagagttaaaccgtggatcgttttcaaaagagttaacaaatgttctcacaaccaaaggattttgatcagatgagtaccactggtacaatgtaggttcccttttcgacagctcattttggatagcaccctctagagaactaagtaggcgggataaactgcaacagaaaattaaatatgattaaataggagaccaagaggcatgttctataatcacaaattgaactgttatgtacaacatagaggttagatctgatttggcttcatcatgctgtcaatactatgttcatgtaagcttgactattgaatccagtagaaggctcattctgggtcaacaaaaatgcaaatacagcagaaacctgtagactctagcagtaacttttttttcccatgaatcaagtggatcaattaatttgcatgctcttctgacagcatatgttttattgacattaaaacttaagaaatctaccagtcaagaaatggaggaatatatttctctaataattaggctatagatggaaagcaacttatgagacaggaattagctccaagaaaacttaatatacagaggaagctacataaaatgtacattacacaccatttgctctctaaggtattaaaaagcaaaattggctccaagatgatagatagttgtagtcttaaaaacacaccaggagaaaaaggataatgtcagcaattaggcatgataatcaaggcaagtgctagagggcagacctcctctgaacaaatacattgatatctctatctctgccatttcccctagatgaaacatcaataactgcttgcaacaatgaaccgacagcagcctgcaaacagattattttagataccagacaataaaaagtttgcatgccaccaaaattcagaacgcaacagctaatatttgttttactgaagatttatgtgtgagaactaataaacatcaactcaaagaaggttcaattgccgcgattggctctaagttgattaaaagactctgcatcttcatatatgaaaataatactccagacaccagagcagaacacttcctctggtggcagagtagcactactaatatcctaaaaggggtgaacaaaagctaaccaattaatagtttaccaagttcaacatacatattcatctatacaggcatccatatttcataagacctctatggatgatatcctgactacatcatcttttctttttctaaacaaaaaaagggaaacagtagggtgcatgcaataaaatctggcttacaaaatttcaatactagttttctgcgtggaaggccaaaagggaaaagtcaagagaaactatttaatcaatgacatgaataatggtcactatcattttatgggcagatatatgcctgaagaaagttcagtcctgtacctggtaagagagtggttttatccattcattgttatccacaccaagccattcctttggaaaccaagagttttttgatgatttgctgtgatctaagaaagccaattcaatagatcttgcagcatcatgtattgattggacaaggccagtgcttatatcctcgctttgtagtgctttaaccaatttcacccttatatcatccatctcgcttgccgaatcaacttgtggggatccgttaacagataaaccactgctatcatcttgagaagccaaaggaataagatggattgtccttctagttctctgaaatgctaccctctgtctcctaaattctagccatctagcactgtgaatgatcttctcacattctgatgctgaactcctgaaatagctctttctcttataaacacgtgtatgaaatttttgactcctcagatcaaccacacttctgcatactaatctgaatccatatactttctccagagtgtaaatcttcgatgtgctgcaaacacgttcaaccatttgatccattataataagaaacagcaagaaaaatattattaacttcactgtacaatgaaacctattccataatcaaaaccagtagcaaacaatttaagaaacgctggcaagctactgttttaggaataagcatccgccgtcaaattgccactgaaagcacaatacgggaaacacaccgtgtgcataactgcaagcctcaacagaacagaagaggaaactactagtagtaaagtatcccagttcaattggccatgtcaaagctccggccgtcaaaaccgcaatgctatcgccatcaccaaaacggcaacctacaacaccaaatttgacgaaatccctcggcggcgcacgccccgaaccgaaatcgcacagataacttagtgagccagtgacgaattcaacgaccctactacctctacccctcccctccacaatccaagctcgcaaccagcgcattccaccgcaacccatccacccacgagctaaacggcaacgactaaaccagcgaatcggcccgcagcaccgcggccagaaggagagagaggagatgggggtgggggggggacccaacctggcaccgcacatggccgcgcgcggctgcgacccaaccgccgtcgccatcagcctccgcccccgccgccgccgccgccgccgctactgctcgccctcgccggcggtgggatcgatgcgcgcgcgtcgcgacaaagcgatgggccggaggcggagagggatagggtttataccgggagggaagtagcggtggggaagcgagcggccgcgaggacggaggaggaggaggaggagaaggtggaggagggcccccggaaacgataggctccgggagaggccaccggtgctcgtcacggggaccagaccatctctctctctccccaactttctctcgtctcggtttttcctcgcgcgtttttctttttttctttctttttttttcctccttcctcgtcgactggagtactggacatttcgcatttttctttttcttttttttttttgcctcgcaccactgctgtcgtgataaggccatttacggcgttgaaggaagaaaaagaacaacacgtcataccgttgagctgcattcaaacctgactagctttgacatttttgttttatgtttagtttaaaattaactctttgaatcaagccggtagaatattaccttagtcaaatttgaacaactaacaagcttgttttttgctgggtctactcaagagagtgttaaagtcaaaaaaaaaattactcaagagtgtgctctgtgtttgtgtgaactagttcacatgctaaaattttagcacagaaaagaactgcagatataatggcatggcagattggcaggcatcacaatttgctgaaagaacactacattgtcactttgtacaccacgctcaaatagatgtccccacaaccgaaaatgaaacttatgcccaaataaaagaatcaaaactaagagaaagcatatccgttctttcaagagaactgattgaacatggtaggtacgtattcaggccacgtaatagagtgggcattatcatcaaacgacgatatgaaaccattagtaagttagtaagatgtttgcatatggtacatgtatgcattaagtgctaatagcattgcactttgtagctacagatacactaaacctatagagaaccatcttaaacacatatattccacctcaaacacataaatacacacacatacatataaaacaaaatatatgcatccctcaaaaaacattacaaacatcaaacatattacatactttaggcgtaaatgcttgggagaggtgcataaacatgcatcatatattttggataacggaagatcaaggagcgtaaaaacttttggcaggatgacaagtgcaaaaaactggagatacataaaaccaaaactggagcacgacgagtgcgcttaaaatcaaattcgtggattatattccaccgccttaagaaaaatgaatatagttaatctcctggagtttactcttgctcgctagcactgtcaatctgatcttgctccttttttatgccgccatcagccaaggtgcttgtattaccactaggccgggttccataaacatgccccatctttaatctctttgtttccatgtaacgccgattctcattggttattggtgtcaacagtggcactctgcccaagacactcaaaccatagcccttcagtccagtatatttcgcaggattgttagtcataagcctcatggttcggacaccaagatctcgtagtatctgcagagagaaaaacagcaatgagcggaatctggaacagcgtgaacaggaacgctatgtcacaggttcattttcaatagttcaggagtacagacaatttatatatacctgtgcaccaataccgtactctcgtgaatcaaccggcagacctagatcctcattagcctcaacagtatcccgcccatcgtcctgcaaattgtatgcacgaagcttgtgacccaaaccaatgcccctaccttcatgtccacgaaggtaaactactacacccctgccagtcttctcaatcatggtcattgccagggcaagttgattcccacaatcacacctggctgatccaaatatatctccagttaggcactccgaatgcactcgcactaagatatcctggccatcaccaacatcaccctgcatacaagggaaaaatatatattctaggttcaacttcttcctggatgagaaagtctggtagagcttataacttaaatacaataaaagaaaccgttgcttcactactttctaacaatcattgcagatgaaccatgtcctgggtatcactgaatcattagttgcgatccagtctgactaatgtaacggcaaagatatcttgttatactgtaatttgttcaagagtttgtacatgtgattctacttttctatataatgcataagggcatggattttacttttttttatttaaaaaaagtaaacgctctcctaaaagtagacattgtatcaaagtacttaacatagtctttgttgagggatgcttaccttgaccatagcaatgtgctccatcccatcaataagagatcggtagcaataagattgaaatgatccccattgtaattgtaaaggtgtaacacaaacacgttctaccaatctgtctctcttcctcctatacctgcataagaaaattattagtagctgatatatatagtagccggaaagttccacaaaacaataatccatgtattataatttataattcatatcttccacaaatatagttttacatgtatatatatcaactgtgctttgcattcctgtaagaaaacatttgcttgaaatgtggttatgaagtacaatagaaaaaatgacctgttctcccgttactacttatcatgaaaccattagcccttctgtaaataataattactcttaaattttgtacttcaatgcagcatgtatgattcttatggaaaaaaggattgacacttgaatatattaaataaagcaaacctaatcaagtccgcaattgaaattatcttcaggttctcccttcttgcaaaatcttggagttttggcaataaagccatggatccatcgtcatcatcaacaatttcacaaagaacagcagcaggaggtaacccagccaacatggcaaggtcaactgatgcttcagtatgcccagcccttttcagcacacctccttctctatatttaagaggaaaaatatgtcctggcctgttgaagtcttcaggcttagaattaggagatgcaagtgctaagactgtatttgcccgatccttagctgaaacccctgttgttgtgccttctttagcatcctacaatacaaatatttagcacagacagattagaaaaacagggcataagcaatatgctctcatagaaggcaaaaactggggaaaaaaagtacatccatacacaacaagcaaaggagataggaatgataagacactcgattatgtccatcttttgcacaaaatagtcatggacataacatagttttttaaaaggaatacatacacgcatcaaagtgatttcaatcaaaaggtgacccttttagctcattctaaccaaagtggttaacagaccccaatggttctctttcttgttaacacaagttaccatatatgtaaaatgatcttgtgctacaaaaagcaataacagcgaatgaaaatacataccactgaaacagtgaaggcagtccgcagcttctcttcattttcctttgttgtcaccataagaggaagttctagtctttccaggtcatcttctttcatgctgacacatacaatgcctgtcccatgcctcactatgaaagccatagcctcaggtgtcacctttgatgctgccattataagatctccttcattctctctatcttcatcgtccacaacaatcacatactgcaatataaacactgtcaacagatgaaggaactacttcaaaaacctaattaatgctagaaaacatgatattttttaataagatccatacttttccttggcgaatatcctcaatagcttcaggaatggatgagaaaccctcagttgggctgtctaggtcaagctcgtcatcatcagcagaaaaaccatcaacaacaggtgccatatcagcagctatggtcccaagtgcagcagcatctgcttgaaccactttagaaggactagcctgtccatttataataacatgttctgaagaatcacccacagcatgagatatatgaaaatttctggcccgatggttatacggcaagtgaacagaactgattgtcctcaaactgtttgatgtagaatttggcataattgaacgatcagaccgcaatccagaagtcctgtgttggctgtaaatgctgctcagccgtgacatgagatttgcagtacaggaatccatctgaggaaaaaaatcagaactatgaaacaagttaggaataaaaatattcaaataatatacccaaaggatgtgatggaaaaaggaattcaaattatttcagtaacgttacagagattttctatgttactaccgcagtaccgccttgtgcaggggagaatctcactttcctcaaaaggaaatttagaataagtatctagtgcctattgattaccagaaatgcggaataaacccttgaaaacaacaatccatctcctaaataaaccaagtcatctagaatctagagtaaagctaaacacagcaaaatcgcataacaaacaccctcaaaaactccaggggcggacctaaagtaccgcatgagattcagctgaaccctcgaattcttttggaaacaaattgctatctattattactgcacctcgcacgcgtccaagtaatagaatggggaagaaaccggatgggtttgattgaacggaaacgaatcgaacaatcaactaaatccggacgagctctacaccaagccggctcatgacgtggcgctgagagagagaagaacgatttaccttcgattccgttctaactcagatggatggccggccgcgtctacccctggcctttacctgatcacccggctgtgcgcgcgcgcagccaggtaaggcggccgcgcacgccgtgcctccggagtccggacctgttcgccgggagcgggaggaggctggccgtgcctccgccgggaggaaggagagtgacagagcggtggcgtttggataaagagggtggtggaaggtggaacagggaagatacgagagtggttcgggtgctttgttcgttcgggagaagacgagacgagacgagccgcgcgggtggggatggcactatagggcaagtctgcaacgtcgacaggtaggtggcggcgtggcacagtgtaccgatgtaaggaaaagaaaaactaatggaaaggtgcaccggaggtcctgatcttgtcaccgagatacgaaaacgtcatcgaaccgcaaaaccagatatacggggttccttagctatatgaaaccggtcacccgaggtccttcgatggtttgaccccggttttagtgtacgtggcggctgagtcagcgtgggccccacatgttagcatgccacgtaaacaccatctctctccctctcttttctccacattttttttcactgacgtggcaaat

SEQ ID NO: 12340 - DNA, 4057 bp, Oryza sativa
  unsure (1)..(4057): unsure at all n locations
cgcatgctgccgcccgcgacgagctcgccgagatcccgcccgatccgtcgcctatcacgctcgtcaacagcgccgagcggatctggaggaagagagatgggagagggcaggatgtgacttcaccgccgcccatctcttatccttctctctccgccgccagctgctgctccagccgcatcttggaggcagaaacagctggtccttgagcacggtgcgcgcgggaggccggtgccgcagcggggagctcggcgtcggcgtcggcgttagcttgtcggtggcggcgaggcgcggggttactgcgtcggcgtcggcttgtcggtggcgacgaggcgcggggttactgcgtcggcgtcggcttgtcggtggcgacgaggcgcggggttactgcgtcggcgtcggcttgtcggtggcgacgaggcgcggggttactgcgtcggcgtcggcttgtcggtgcaacgaggcgcagggaggccggcctcggcgtcgccctgtcggaggcggaggcggcaggtccttgagcacggcgcgtggcgaccagcattttctcgacctgcgccgtcctcctctccacatcccccaccgccgcagccttggccggtgcaagaatctgacccggcctgctcccgtgtcgcagccgccgccaccgccacctcgtcgccccggcgatctcctccccaaccgccggccggcttgcaggagaaaaagtgaagagagagaaagagaggagaaagggagaggaggggagagagagagagggagtgatgacatggcatgctgacatgtgggtcccatgctgactcagccgccacgtataccaaaaccggggttaaaactaccaaaggacctcgggtgactggttttgtatagttaggagactctgtatatctggttttgcggtttgaggacgttttcgtatctcggtgacaagtgcaaggacctccggtgcactttttccaaaactaatacactattatgtccatcaacccatcggacgtgggctccaagcccagaacagagagctagtttgtccagtggaagcccaaatgtattgaccttaggcctaataagagttcataatgacactgaaggtgtgttcactttgttgcaaaatgaaacttgccaatgttttgtaatgctgaagcaaaggttagatggtggtagcagtgaaatattctaaatcaacaaaatttggtagggttgtgttgttgattgtcttgccaaaattttttatgaggttaaaaatgacaaaaagtgaacacatcttgaattttagagtgaattttagaaaaccccatgttttaggaccaatgtaacacataaccacaggttctatttattttcttcacataacccaatgcattctatccaattaacacaacaccacagatttaaatatgggaaagtaccacaatgacaagtgacatggcagacctgctccacatcagctggccccacctgccagatcaatgcgtgagctatttagggctgggaagcacccatcctctgttcccgcgcacgcgacgacgcacccctcgtcttcctcgtgctcgctgcggcagttttcctcctgttacaagttcagaggggcagctcgtcgtgcacatgcaaaggcaagcatcgcctgttctgttttgcatcaactgatcaaactgtacatatacttcctatcttctaattatacaaagcttgtgtgtgtgtttgattaaacatggccaggacctgacaatgtttctgctcgagttttttgtaagtaggtcgatcaccaaggtgcctgacactgtgttcctatgaaaaaaaaatgaaaggaaaaaaactgacaatttctatgcattaagcagaacaatggagcaaacgttataaaaacattccatgtctgaataaaagcaccatagcaacagttaatatgtgacccattgcaggtccaaggcataagaaatttgcaaaacgaatccatatctgaaatatatacattgtgaagcagagaaaaatacaacctatttgccgagaaaaaaaaaagaggaagccatgtctgctcttttgtgaagcagaaaaaaatgttgcaggcctttaaatgttaattatggttagttttatatctgactgcaatataatagttgtaatagaatagtcttatacacggtccaatctacatgctttttttatttgaaaaattatggtccaatgatgaaaagcaattttgcaatgacaaacagaagaacgattgcaaagttgtaatgccctaacaataatgggttcccctaaattacattttactagccctaatttcttgacaagccaaacatgatcaaatggctggatttaattcctcgtcaaagaaccatgaagcagagtgtccttgcaaatcaccaaccaacatgctttggagtcaattcatatgatcatcacaagaaaagagatgaatgttacctgctaggaatgatacctaacgagttctcttcctccagctaggtcaacatcaccatcatcaccggaggccatcatgcaagagatggttggggaacgtcgccaccgcctgcgtacgcaagaaagacggaggtgccgcgttgtgtgcgtaggaacagggaacacacgcttctgttctcccgcgtgatcccaccataataggccacatattgacctggcaggtggggccagctgatgtggagcaagtttgccatgtcacttgcccttgtggcactttctctcactaaaacctatggtattatgttaattggattgaatgcacggggttatgtgagaaaataaacgaaacctgtggttatgtgttacattagcctcaaaacgtggggttttctgaaattcactctggattttaatatcctagagaaaatttggaggtaaaagttacctaatattagagactagtagttgctaaaatatcaaggatttcttaatagaacacctaaaatatcaaggagctcccaagtgaagcaagaaaactctaaagtttttttatgctttgtttggcataaacctatatccattcatcccaaggatgggttaggattgcagtcaatttgccagcccatcccgagagataggctcatactataattgaagattatctgggtgagtgaattaaggataaattacttactctaccattgttacgcaagcgtaactgcgcacgactgcaatttttaaagtaggagcgacaataacgatcatctggagtgtcagccacacaatccttatcagacgacagagctactgccacggcacatcacgccatatcctcgcacacggtcatccccaactcacgactatgactcactgccatccggtcccacgccgatcccgaagcaacaaaaccgtggcctgtgaacagaaaagcatcatatcccaccaaaaaaagaaaaatacacgcaaaaaaacatcgaccactgtcaccgccaactgtacacagagaagatgacaatacggccctacctttacacgcgagcaatgggccccacctgtcagtagaaccctggtgacctacgtctccccggatataaacaaacaaaataaatcctacccgtagctctctctccgcacgcagcaaccaccactccccnnnnnannnnattccgcggctcctcccccctcaccgccggtcgccgcgccgccgacaatggagcgcctccgcgtcggcatctcccaccaccgggcggcgcttccacttccgacccaccacaaccaacttccgccgccgccatctccagctacaggccttccccagctccctgtccctctcgctccccatctagccccagctctcgcccgcccctcctagcagccacctcctccccccgctcctagcttccgcgtccgccgcccaggccgcgggccctgcccccgcgcgggcggcgggcggcggcggcggcggcgagaagccggttcccctactcgtctccctcgccgtcggcctcgccgtccgcttcctcgcgccgcggccggccgaggtgaccccgcaggcgtggcagctcctctccatcttcctgaccaccatcgccgggctcgtcctcggcccgctccccgtcggcgcctgggcatt

SEQ ID NO: 12341 - DNA, 19563 bp, Oryza sativa
ggccggtggggtgttcccttccatagtcaagtcgctatctctttcgggctggcagcaagccgaacgacccatcggcgaggaagctgggctcctaccctgtgcagtctcagttacaggtaaaaagttacttgatatctgcagatgttaaaaatgctatgcgttttaattagtactccattcatgaatggttgtgaaatgggagatgcatttcgcctagatatttataatgttcagctgggaacatgcttctttttttggtggtctctatgacatgttattgaagaagtgctaagaatgagatcttcacttacttttgctttggactgggtgtctatactatttgactggagtactaatgtgcattgatcattctattatcccatccgtctcaaatactacttgatgtatgatgaaatgctcacgctgtattattaaggttgcgacttatctttgttagtgataatatataatgtttgttatacagtcatctgactagtttatatcacaacagcagaggtaaaaaaaaactgtttctaggtgcaccctttgcttctttgagaaactaaaactgaaaccaataaattgtagacgtggtacaattctgactctttctgtaaatagtaaatggtaggaagcccaaaattgaaagtttggttgaaattggaacgatgtgacggaaaagttggaagtttgtgtgtgtaggaaagttttgatgtgatggaaaagttggaagtttgaagaaaaggtttgaaactaaactcggcctaagtgaagtgtggtttaaaaatggttgcctggtcactttatcaggagctacatttaaaccaaactagcttgtactttatgaattgaacactttgttgaatcgattgaattcacaaacattttaattgtttggttaagtgcatgagtacatcatacatttacttttgaggttgtcagatcctactatatgctgaaagcaatacaaactcctggtactaggtttcttttgaaaaggcatgtttagtgaaaacttttcgatatattgcttctgggatgttaaaactgtatgcatgctctgtgctttgatattttacgttttcacacccataaggattgcatttgatcaatggcattgttgtgttggtttctgctgcttcacaggcatctggtaactcaagtgctctcttcctgactgctgcagcacaaaatctcttgtgtctgaagttagctgaggagattggtgttaagattgcaaacccatggatatcttggtttaaggttgctagtttgcctgccatcatttctctcttagcgacaccttatttgttatacaaaatattcccacctgaaataaaggacactcctgaggcccctgcaatagctgcacaaaaactgaagaacatgggaccagtaacaagaaatgaatggatcatggttgctacaatgattcttgctgtttcactgtggatttttgggtaagattgatctctctttttactaatttattttttccatgagttaatttgccatatatactttggtctatgattatgccacatttcctgttgcatttttcataagctgtatttagctactccttctaacgtgatagtgttctgtcgatggatacacatgatatacctggaacaactctttgttttaatgtttggggacagctttcttaggttctgtttggcattgcagtgttttatttttttataaacgtttatactttctgatataacagttagctgaatgcattttggataacaggaaatcttacttgaattagtaatgatttatttaactaactagattccatggaacagcacaaaacaaaaccacaaccacaatctggtcctttgtagctgtagacctgtagtgaattatcttcttccctttagcattttcctctgaacacgtttttgtcaatccggaatcaacccaggttttcaaattatgaatcatgattatggagatgtttcactttctgttggtaaaatgttcaacatgattgaaaattttcttttctttttttgtaaaataaatagcatattcttcttctgcattgctgacttttgcacaaggaaagatccattaccttatattggattaatattaacaaggaaagacaccctgcaacatttctctcttatggcaacatattcgtaattactgtaactagatgtcaaactgtgcattgcacggctattcttatggatatttaaaaatattaaagagttttttttctgatttaatagttttgaaattcgtatgtaataaatattgagttgtactccattttaattcttagttgtaactttttcatgttttaataaatctgaaattcgaaatcaataaaaaaaaccgagttgaattcactttacaatgttaaattatgatctatggtagtgataatatgatgcatttattcaacggttagatctttgtggttaacgttggagcttgtaggaagtgcctaattagtataggtataaatgcgtttttctaatgcttacttatttttgccagattgcttcctaaatctttatgcttggttttcacttcagtacttcacataatgtggatataatgcatgttatcttaccaagtgctacggcaacaagatagcaagagcattaacagaaaagataaagaatgctactagtccaatctaaattaggagttattcccatatcgttgcattttcggtccttttgagatattgtcagatattcagatgtgtgcttcatgttgtattagtcaaactacagcttatatatatctgttatacatttttttttgcagggatactatcggtgtgtcaagtgttgttgctgcgatgattggtctttcaattcttcttctgcttggggttctgaactgggaagattgcctgaatgaaaaatctgcatgggacacattagcttggtttgctattctagttggaatggcagggcagctcacgaaccttggaattgtatcatggatgtcaaattgtgttgcaaaagttctccagtctttctcattgagttggcctgcagcatttggtgttcttcaggcctcctatttctttattcactatctctttgcaagccaaacagcacatgttggagctttgtattcagcatttcttgcgatgcatttagcagctggcgttccagctatactgtcggcacttgctttgacatacaattcaaatctctttggtgcactgacacattatagtagtgggcagtctgcagtatactatggaggtaagtttttctgtgtgcacacttcattgaattcaatttgttttcatgttgacactttacgacacattattctttaatatttgcctcttcttgtttgtaaaagatctgttgttagagaaagagcataacaaatattttacttactacgtatggatagagtattcgaatacaagccttatttgatatcattatgtaggactacattgaaaatccaaatgtagcctaataaaggaataaaaccataagctaatggataccagcagacaatttaaaaaattccttggtttcttttactgttaggtttgtcatattttatctttaagcctttgtgtgtacttcttatattgagtacatgttttccttgtgcagcggggtatgttgatcttcctgatgtattcaaactgggttttacaacagcagcaatcaatgctgtgatatggggagtcgtcggtacattttggtggaagtttttagggctttattgagtcattgcaagtgttaagttgaccaaaagtgttccttactacacctgtaattcatggctccctttctggagtggtagtcattttttcttcagaggagtttgatgagtgcataataatggaacgatgttcctcattagaagtcttgaacatgatacacttgtacaacccagaagggttctcataggcgttttgtacaactcccatgcatttctcatgaacgaaattaactgcaggaatgagtcttgattccttgagcatattgttcatgtactctcggaactgtatggattgcttttgctatatgccgtgattgttaatttattatataggaccatgagtttcatcagacaacacaggattgctaagataaaaacatcaaaggccaaatgtgccatcttcctatccaacaaattggatggcagagtggcagactattttcggagcgtatttgtctacaatatttgccacatgtgaatctttgatgaacttgtgcaaaacccttcagcaggttagtgcatttgacttgaaggttttcgtttatatttgaccatgaaatgaagcatttgacaagtaatctgcaccaatacttgtccatttgtattccagtagtgctaccgattcatcgtgtttgtcactttgttgattgctattcgtcaggagaagtgctgagcaactgaagttagtgaagttttcgaagacattctattcaacttaaacttttgggttgaactgattagcacccgtaacacaatcactcttgtaagttgcaactgttgggaagaatttggttgtttaaacatgacgctaattttgatccgcttctccagagttcaggaccctaggccccctagccaagtctctccttttttccaattccataggagaaacatgaggccatgttcaatgcgtagccccaagtcgtgccttcacaaacggtgtcccgcttccgtcatcgggccgtgtccttggagagaggcgcggctcctggcagaggaacgcacgcctctagctccttttcttgagccaccgcttgggcctatgcgttggacgactgcgtagctcatggatacggcctcccgcaccacaaatttcctcttccacccttggcctcgtcgctgggagtaggcgggaggcacatagcaatgcggaggagtcggaggtagcgaggtggtggaggagccgacggatttgtgacatcgacgacctggggacggcggagggagagggacgggccccgcgaacccgtctgtcagccaccaacgccccagggatggggcaggcccactagatccgacgacgacctcgtgatggcgactgctcgccgtcagccatcagcagtgacgggcgaagggagaggggtggcgacgtgttgggacgaagtcggagcggtgccaccgccgctgttcccttcttgcctcgccgccacctccctcgccctccccagcgtcgccgcgtctcgccccagccgtcggtgaagggagcggtgggagctcgagctgcagccggatttggcgtgggagagtggacgatgagcggcgacggcgggagagagaggcgagcggtggcggcggcagctggggagggcgaggagggaggtggcagcggcatgagggagagggaaagggagggggagggggagggggaggacggcgctgagcggagggagtgagacgaggcgaagaagaagaggcaggagcgaaggaaaaagagaagagagagagagaggaagagggagaagagaggggtggtataggaaaacacccattgtgggttttttggttgggacaaccattgtgggcttgagtacctttatccaattgcttcagattttaaagagaccacctagatgtagccttcatcagtttactggtaattgagtgtccctgatagtgtcctcggttagtgaggacttttaggtggggctttgatgatagatgccctgtaaggttcagttctcagtctcaaggaccacagtatggcatttttttttccttccagcagccgaaccaatcactcagaaaattcagtatgcaatcactagccgtgggggctcgtcgctcgcctccacagtccacacacgtacgcggacgtggagccgagcgtgacgggacatggacacggacatggcccgtgccggcaaccacacgcgcgcatccagcgtcgtgggctcgtggcgtctcgtgcatgccacggcagcacaggcagtcgcgcgcgcgcgtgggggagagaggaggcttctcgccttccgctggatagcggccgagccgtcgtttctttgccgccgcgccgtgcgacagatggatggcggcatcgcgcggtggtggggagggggtgaatcggttttccggcatctttttccacggcgcgtcgtcctcgttcgtccacgccattttgtttggattcgcccgttgaaaagcgtaccaccggtagcagagctatacgccaaacgtcccggtgaacgataccggaagatgggttgcacacttgcacacctccatcttgcagtcatgaacttatcctctagtaggcctctagggtggagcagcagcaagccagcaatgctgccggaatatcggccattcggcagtcaggctccacgtttttttttttacgaaaagcatgaaatttaggggtttcgacgcggaacgaaagcaaaatctgagtgaaatttcaaataattttcaagaattcaaatttaaaacgataaatttgactaaaatttgattaaaatctgattgaaatttggtgaaaactgttataccactgagtatccggatcttgtattcatcggaaaggtgaaccctaaccaaagtctttctttttcctactccctccgtcctaaaatataagcttttttttatctcggcacggtctgcgagatgctattttgaccaacaatatttacaaaagtaaaatgttttaaataaagagagttgcatattatgatagtccatttaatgataaatatagtaacatgaaaattatattattaatatttttaatttttgtgctataaacattgaaaatttaaaaaatttgacttcgtactattaaaaaataattatattttgggacagacggaatacgtgaaggagacactgtgtcaacctgtactgtggacgtcagttccatttcatggtccatgcagatatgaatatacctatgcaatatttatgatgaaagcaatttgtgagcccccatctctcgtgccatgttccggcccggggttccttggcgctcaccgtgtttggtccctggtcttttctgcagaaaggctttaaaactgtgcgctcagaatagtgcacccagcagtgtggaggacaggaggaggcacaacaaatacctaactgcttcgagcaaggctgaccaccgtggtcctcgctctttaggttaaaatctcctgtcaatgtaatctaccgcagttaaaccttcgagcatttttatacacggataatttgttaagattttcacatgaatggagtcatttttgttaggaatcagaaacaaaactttgtgctccaaacaaaaaaaaagggcccaattattatggacgaagccaaatctagctcctgattctgtgcagtttaatcagtttttctactttgttgtgttcttacaaatccattgtttgtggcggttatagctttaaaatagataaaatggatattctcattaacataaattgtatttatattaccatcatctaaacaatataataatagatgaattaaggcacaaaagagcatccaagaacacccaagaatggaccctaccgtggtggtgctggatgccaggggcatgctggtgttgccgggttgggctagccctccgcctcactggccggtagcgctagatcaccgaacaaggtgccacgtagaggcgtagtcgcacgcccgcggccacggttccatacagggcacgatgtcggtgctgcaatcaccaccgcagtgaaggtaggggtgaaaacggtacaatttttttaaagatttccggattccgttttcagtttatcggaaatgaaaaaggaaatatcttccgaaaatagtatcggaaatgggataaagatttttttttttgactgttttgctgataaccgtattgtctagtaattttcgccaaatttttgaaagtttcaataatttccgtcagaattctgaaagttccctagcggctagtagggatgtcaaaaaaaaaaaaaaactcgaggctcgcaagctgttcaaggtcgactcgtcctagcctcgatttgagctcacctcgagctccaaacgagccgagtctaagcctctccgaaagctcgcgagcttcttcgagccaagctcgagcttcctacgagcctaataatatatgatttttattgttatttaataaattaggacatcaaatatattatttatatgccttgtattggcgtcatatatttattttgttttttttcttcttctatttgaagttgcatttatcctctagtgggttttggtgattaatgatgaataaggttaagggactaatgtgtttattgagatatacaggtaattagtcccaaggtgatcttaggtgatcaagagatgcttggagacccctacaactttcattcatgcggatttgaaactcgaaagtcaataggatagtttaatttttgaaatcgagtcttaggaaaaaccgtactattaagaggggtttcaagtgtggttctgagatataaaaatttcctcttagtgggttcatagtgatagaatatttttgggaaccatttttgcaaatgggtccagaccggacatagaaggctggccggaagttccggtccctggacccagaacttccggaccttgcattggatgaaatttgcgtaagtgttggctggaagttccgggggtcaggaacttccagacttcttccagttcaaaaatgtgagtaatggctagatgacgtcacctagccgttatatatatctagatcgcacccagctcactttttggccattccacttcagttctttcatcccctaggttgttctagcctctcccaagatccctttgcttcctccactcaaatctagagcctttcttatgaaattgtgagagtagatgagagtgtaggagtaatttggagaagctttgaagactaggtgtggttgagcactttgaatatcttgtgggttgtcactcggggcttattactcttggagatcttctcctagacggataggtgtcgcccgcgagcttccgaaatcttgtggatgtcccaggaaagtttgtgaaggttttcctcacctccgcaaggaaacgaggtaagtgattaaggattcttttgctaagttttcagaggttctcctaggtagagcaacttgcacttgtggtcttttctagaaggatttgtgagttggatcttggtggtcactcaaattctagaaaatgacctaggagtgttgagttgaaggccttggactttctctgggttctctgtacaagtgaggcaaggggttaatcgagacccggctctttggagcacctcaacggagagtaggattgcaagatccgaacttcggtaaaaaatcgcccttgtcttctttgtgatgattctgtgcatgttgttgtgattgtgtatctgctctgtcttcatgcagtttaattcgtgcaaattagtttaagtctttgctagatcttcaggtttttctgttgcccggaagtttcggtgtttagaacaccggaagttccggtctgtctgagtagactggaagttccggtgttcctcacccggaagttccggtcctgctgaattttaccgctatgatttgtttgtgaatttcaggatagcctattcaaaccccctctaggctacatctttgcgcgttcactattaatatgataaactagaaattaattatttttttatagattttccttaaaatatacattgtgctacttaaaaatcaagctcggtagtcgagctcaagcttgatcgagctcgaaccgagtctgtctgaaagctcgaacattttataggctcagatcaagcttggctagagcttgtatcgagctcgagtctaggcaggcgagcttgctcgagctcggctcgttgacagccctagcggccggccagcccaacccatggcagacttgtagcctattaggaaggggaagtggccaggaaaaacgttgttaaccctaggacgtggcatgtgaattttgctgaactttggtctactcaaccgatcgatgttgaagtatcgccaaaatttgtttatattgttcgtcaaacttatcatatcattaatcatcatataacgatattgtgtggagtgtgatgatgtaagaatgaagtaataaagtcattttcatatatagttaaatgtgttattatgccacgctccgctgttttcgacatgaattttcaacttccgaccaatattggcagattccattctgacggtcccgtttccaatatcaccgataaaacacgaacatagatagcgcacacttacatttttaatctaccaaaattgatagtgtacacttccaaggtttttaatcttttccaaaattaatttaattaagaaaagattaattcaatcagatcatatatagtgcagtggaaatgggtgtgtggttccaaccccaaggtcatgtgttcaattcttaacacgctcacaaattcttcttagagcatgtataatagcagagtgtaagccggctaaatgctgaggtggaggagagaagagaggagcgagaggagaagcgggctgtaaacttacagccagcttggacacaagaaccaagaaattatgtgagagagacaagtgggctctgtatttatttattgtaaatagctaactattacacgtgtgggctaagagaaggctgcaaagaatcttatagctaacaagtcagctatattattaggcttgctcttaaaaaaatgtttggaggatgtctccctctaaatattgttttttttaatcagcccatagatgctagcgagctgtgattggaaaaacaggaaaatgctgcagaaagttgcaaccgtggcataaaacttgcgtgtaatttcccccttcatattccctgagggcaagtcccatctactttgctgaagaatcccctccacaactcaagagtctctgatgagataccttctgtcttctctggtgattacctcgttgtctcaagccccacacacgttacatcgagcaaacatttgtcatgcaactgtacgtgtacatgacaaaccaaaccgctacgctctcctccttatattggagaaaaagaaagaaaacacggaagaagaacattctaatgctttcaaaatataatactactagagagtggaaacattgtggtattatatagtcttgattttgtacaagaacaaatatctcaaaagaagattcctaccatagactgatagacattagacaaagatcacccttttttggagttccattttctttaatgtaatctcattctaggactcgtcgttttcgtggcagctttgtgtaatcacagaggtattagggcacatacaaaggtagagaccggtgtggtctctacgttaattagatactatcacgttacaatagttaagataatacggtctctaaccattaatgtaccaaaatactttcttactagtcatctttcctttattagactcaatgcaacgaaaaattttcttaataaatggctaagaatcgactctatgccattgtcatgtgtagcaaccatctttctctttccttcttcatctctcttccacgtcacaaaatatacttacatgccaataaaaagagaccgctaataaagacccttgtacatacccttacaacaacaaaaaaaaagaaaacggattcgattggattttgtcagcttaaacaaaggattgtgccgccaaagaacgtctcaaaagccgcgattactttctccatgacagcagccgagaggagtaaaaaagaaaagaaaaaaaaaagatctcggccgccgccgccgcgcggcgtcttcccctggccgcgcttgccacggcgccatgccgccatcggccccatcccgctcgacccatttcgcatctcccaacgccgacgacgacgacgtgctgccgcgctacctccgcgttttcgttacggatggaacatgaaagcgaaacgcagggcacttggccacttgttacctcgcgaatttgcacttaggccgagtttagggtgtatttaagttcacgtcaaaattagaaatttagttaaaattaaaacgatgtgaagtaaaagttagaagtttgtgtgtgcaggaaaattttgacgtgaagtttcaaactttttctttaaacttctaactttttcatcacatcaaaacttttatacacacgtaaacttccaacttttccgtcacatcgttccaatttcaaccaaatctttcaattttgacgtgaactaaacacacctttaggacatttttagttgaggactaatattaacacatatttttaattaaggtaactaagcttagtcatgtcatatttttctgtaaacaaaatagtaacaaactaaacttaagcaaagttaggtaagaaaataaagtgtatgatatgtgctatgcagctaagggttaaacaaaagtagatttatgcatgaactgaatattacctgataaaactgtggcttgattaagataaggtgtgataaatttagttaccaaacaaaaatgcccttagactttgctactcccgtactccggtattatggattttggctcattttttacacagcttctgagcacgtctcgtccggtgcaaagccaaaacagtaacagcaggtaaaagaaaaatgtgcaggagttacacgagccaaagcaaatcacacgaagcaaaggcgaaaaaaggaagcgttggctcccacaacttccccccgcggaacaaaagctgctttcctaccttcccgtatagattggcgcgtagcgtcgcctcgtcgccccccggtgatccggctctctctccccagtccccaccaccaaaccagccaatggaagcgcgtcgccttttgggctaatttgcccccacaagctcaaaagcccgctcccttttgccatgtccgattgccagtcggggtccccccaactctaccaccgccaccacaccggcagcccatgcctactcctacagtcctactcctctgtccgtcgtgctcaccactctcactcccacgcagacgcagggtggaggtccggaacaaacagaacgctgtgcaactatgagcaattcgtcatgttcaaatgtaggcactggaagcagggaaatagggggaaatagggttcacaatcctgataatggatcgagattcgctcatgagttgtttcatcggattacactgaatccattaaaaaaccgatgaaaaaggccaaaaccaatgaaatttggataaattttttcaaaaatttttaaaatagtttgaaatttttttattaactaaaaagccgagtggtttatgttttcaacccggttcaaaaagttcggatttcgcggaatccaaacaggattccactggaactgtgaaccctgagagaaatttatagtgctttccagttgaacacttcaaatgcaggtagggaacttggtaaaaactagaaagaaacacgcgctacgctgcgtgcacggaatatatggttaatggcacatagtagatatgatgtccggtatgtaaacatcgatatggtagtcaacactacgtgaggaaataatttatgttgcaaccaatatccaataatttccagtctatttgtataataatgtgcacttagacaaaagtagtagccacacgtggaaacatatatatcgtgcctgcatactgtagaatagattagaaaaaaactcaaggatcctaggattcatctctttcggggagccaagaagcactcttcctcccttttctgaatcttcggagaggcaaaagaaccacagaaacattgacttcaagggaaacattctacatttccgtatagctatgctcttcgtgacacctgcaatacaaagatgtcttgtctttttaagcttgataataaatagtacatcattatatgtattcgcaataatatatataaaagatgacaggtacttcctttgcaaagtggcattgaataatgagccatgctgtacattatgtctaaagctccattttgcatgactgttcattcacaagtatattctcatgttccattgaggggcaataaacatggcataaaaaaaaatcaaataatctaatgaaaattccttgcaaaaaaaaaaggcttagcaaagtcattctgtgaaatccaacctaggacaaaaaaaatcataagcatgtttaccaagggaaaaattcaatctgaaaggatggaccggtaacaaattccaaaactatcatgtgcaaggtgcttgctagaaaatgataacagtactctcacatatggcatatatatattgtgcaaaattgattaaatttgaggcagagatttgaaagaacttttcacatgccaaaatatcttgaggtagaccaagcacaaaatagaattagacaaataggtggacataaatgacaatttataattgagtaaaggaacactacggtggaaggccgccgctccaaatcttgacatatcttgcaaaagaaaaaggcttttcccttgtaagaatccaacaacttttactatgcttcttttgaaaagaccggacagaaatcatatacacagcagcaacgtgtgcaaatagtcaaaaaagaagctacaaaaattttgtgtagacaacttgtgagcgttacaataaatatgataatgcattcagaaacagcacataaaagtttataccatgcataaaatttttgacacagaagacactttgttgctctgtttttagttctactggtttgaaacagtagcgatcaacaaactataaagtggcagaatcaataccaggatccatgaaaatatagaccacctcaacacttttgaaccaacattctcatgtgaatatttttattgtatatgcaatagcattaaagatttttaaggttagaaaataaggtaatgatctcacctcgttgctcaaagaagaaatctcctcgactgtagatcaactgacttggatagaagataagcacacgcatcattcagagaaatagtctcaagtttatatctattattggacctgcaaggaaaactgaagaagtattattccacattgggatctagacaacaaccaataacttattaaacacattagcattggaaaagtaacagttttttttcttttttggtttcacatgttgcatttagcaatacatatgagctagtattatggatggttcatacaaataaagtttagaagtaagaaacattggggcaatatttcaatattagcatgaccaatatcaccaccagtaatttccaaaatgcttgaatcacttaacattagatgggtaatactgcataaatattataatccttgttaaaaagaaatagccaatcatgctaggggaattggtagtctatggacctggaataagtttgcacatcaagcataagtaaaaaaaaaaaagaaaaaaagaggtatgattgaaactctaggaagccaaattcaaagatttgacgtagtaagtaccccaggattattgttaaagcatctaaattgcacatctaagatgttccataaagaacatgatcaatgcatacatcagtcattctatcaacaaagaaaaatgacttgttagaaagggatggaagagagcacttgctcatagcgtaaacaccatacctaccagtaactacaattaaataacagaatgagtaatcccatgtcacatatatcactgggagaagacaaaaaaacagaattagtaccttcaaatagaagccacagtagtttgcacgtgagctgatgccattgcttttccgtgggtgattctgcaaccgaatgagcaggagatcaataatagggataaggatagggaaggatccagatcaggtatgtatgcatataacagtagaaaatttattatatagcttagtggtttaagcatgggaaaacagtatataccgaattagaggatcattccatggattcaccgaaggtttagggtcatgctgcaaagtgagcaccagtccggactggataaattggatctatgagcttcaggatgaacaggtaaagctaaggattaggagggttaaagggaaaaaaaagggaggcaaaagggctgcataccttaccagggcatggtcgaggcggagatgccgttgaaggctggaccttggtgtgcccaaagccctaatccatgcggatgccgaggcaagagcaggccatagaggccaattcctctagctgcaacggagaggacaataggggcagcggcaacgacgacgatcgacggcggcggcggcggcagtggcagtgcggtggcaggtgaggagattgcatacaccatctgagagagatagtgagacggcgagccaccaaataggaagggggtgaggaagagggaggcagtggtggggaagagataaaagaggataagagggtggcggtggctcatgttcctcacctccgtgtgggcacatcaaccggcgagtaggacgggggccatcacgctgatgcgatgcgatggccttgctaggaaagagtggcggcgacgatggatgcaggagggcgaggcggcgacggcgacgatcggaggaggagggtgaggtggcgaagcgacgcggcgggcgacgaccggcaggagagaagcccgcacgacggcgcgaggttgaggggctgagggcgaggaacacgaaacggctagggttttggtgtggcctggcgaaatcggtgccgtccgttcccaatccgacgatctcacagctgtgtaaggggcgccacagctgggacacgtggacggtcagatcgatgccagtgcgaaatcggacggaggattgtacggggattgacacgtaattaacaaaaaaacgtgaggacttttttgcaaaatcaggatgacgtggcgcgctaattctccagcactcccgcgacgtttagagagattaatatgatagcgtctggaacagctagctgtgtggctacaacacaacaggactcaacaagcaaacttctgctaggagtgctactcaatccgtccctaaatataagagattttattggatatgatacatactagtatagtgaatctgacatgaaaatggtctagattgttgtactaggatgtgtcatatccaaccaaaatctcttatatttagggacgaagggagtatatcgtttcggctgcacaaccacagccagccgaacaaccccaacatgtttaaaatgtcatttattatagttttaaccgtataactagtcgcttgagtagctagctggacctaaatattttctaaatgtggctcaagaaaagccttcccgggcaaaagaaactgaaatgatgattttgaggtttgtaactacttactctgttttacaatgtaagtcattatagcattttcctatttatattgatgttaatgaatctagatagatatatgtctagattcattagcatcaatatgaatgtggaaaatgctataatgacttacattgtgaaacggagcgagtacaagtttataaaaatcacataagaacaaaacatgacagattcttcattctagcaaaaaaaaaaaaaacagttcattctcctgttcatgtagcacgatcatgtctattagagttcacaattttattccgaggttaaaatgtgaggcctaacaagatgataagtttgcaaaatgcctagcttaaagtttgaaaagggtacacgtagaaaataaaaaggtagaatttttttcgagaaaaaaaataaaaagtagatgttagaaaagtgtcctaacaaacacaacaaccatggtcactctttaaccctcagtccctcacctactcagcagtcagcaccacgtttgactctgcttaatagatttagtgaacgtgcttaaaactaaaaagtcattaacatataattaattaagttttaattatatacaaaattagaaattaaaattatttaatatgttaaaacaacttctacataaaaagtttttcatacaaaatactctctccatcccaatttaatcatcctataaggtggtgtttagatccagggacttaactttagtccctgtctttagacactaatttagaatattaaatatagactacttacaaaactaattacataaataaaagctaattcacgagacaaattttttaagcctaattaatctataattagagaatgtttactgtagcatcacatatgctaatcatggattaattaggctcattagattcgtctcgcaaattagtccaagattatggatgggttttattaatagtctacgtttaatatttataattaattttcaaacatccgatgtgatagggacttaaaagttttagtcccatctaaacagggcctaaggctatcctcaaccctccatgtcatctagtttacatagcatttaatatattgtcacataagaaaaatgtgatatggtaagagagttaataaggagagagataaaaagataaagaaaccatttctcatgcaagaaatcatcaatacacaagaaccaataatgaaaacaaggggataggtaaagaaaaggagagagatataaggcgattagatgagaatttaattcgaagacaccatccattggatatatagtttatatacatagtgtctatatgacatagcaagtatgaaaactatttaatagtttttctgggtttgatggcctaagcaaatgataccaagaccaaaaacaacaagatatctatcattctgaaattattcatcatcgatcaaggtgctccatcacttcttgttcaacaaaaattaattcacactttaaatgttacatggatttgaactaatagggattaattgattagtcgcatgtttgcatacatgacattccagataaacaaagagacactttgttcgatgatgatcattttgagaaaacctcaaaaatcatagggacgattaaactgggatgaaggaaatatacttagtattgtttagcaattttaaaaatatgctaataaaaattgaaataaaatctgtagcgtagcatcaggcggccgtttacccctaaactctcctccctcccccctgccttcttttatagcgcacacagttctcgcaaggaaccgaaaacagagaggcaagaaaaagaaaacggaaaaccccccgcccagcccaaccacttcactcctcccactccagtactcgactccaccacactccagtccagtccagtacactccgcacacgcgtgccacagggatcatgcgaagcctcaagaacgtcgcctcctcctcctctagcggcgtctctcggttgtaggagacgctcgtcgtctttggacggatcggagcttgggggaggaaggcgacaaccatggtgccgatggtcctgggtcacaagacgggcggccacaccgacgacgccaagtgccatcaccggaggcacagcaccgagcaaccccacctctccccattacccttcccccggccacccctctcctcctgatcatcacgcctttctctgcttcttccatttgatctttgtgacaacgtcgtcctcctcccgctactcttcgaatcttttgtgaatttcacgtcgtgagacagtagggattgaagcatgagaagtccagcagcgcttctcccggtggttgcagatggtaagttttttttggttggtggttttgtgtggtgattggagatcttggttgagatgggagtgtgtgtttggttgtgaaaggtggtggtggtgttggggtggaaga

SEQ ID NO: 12342 - DNA, 6350 bp, Oryza sativa
ggcgagcttctcgtcggtgaaggaggaggaggaccaggcggcgtccgacgccgaccccccggccaccggcgcgccgcagggctcgtccgagagcgactcgagcgcggtgctgaacgacgcggagatccttccacacaagccagcgccggcggccgccgccgacgccgcggcctcggaggagacggaggcggtggtgaccggcgccgcgctgctccaccacgccgaggtgttcttccacgggcagcttctcaaggtggacgacgacgaggcggcgttcctaggcgacgacggcgcggcgtgcggcggcttcttcgccgacgagcatctcccgtcgctgccgtggtgggccgagcccaccgagcaatggacgacctagctagccgcgaaaactttgcttacttggctggggcgaataaacaattccgtagggggttttctgcaaatttttgtaaaatgaaattgtacctagtccttttttgtcaaaatcctccccctctagtacgtgggccacgtggccggtgagctagaaatggcactcctggctttctctggctcaagcagcgaacgatgcagaaaggggagccaagggagattcgtgggaaacgcaggggaaattccgcaaaagtagcgggagagaaaaaagtgacagtagtgtactccgtagtgtggaggaaggcaacggcggcagcgctggagggaacagtgtcgctgtcggtgggcccggcgccacgtgaaaagcagacttgtcgctgacagcgattcctggcgtctgcctagtgtgtctacgcaaaaagccttgccacacttgccctcctttcctggccacaagagtgtagttcctctcacaagttcttttgtttgtgaatttttttttgcaaaaccatctaaaatatcaataaaaaaaatccgatttggcacaaacaaaatttttttttttgcagaatattggatggaaaaaacaaaggtgatgggtttgattttagtttagaaagaggcttatatcatcatgtgagtatcttttaattgattgactagtcctgttcgtttccactgtaagaagtggattaaattttgaattttcgtggcacgcttttcaaacagctaaacagtgtgtttcgtacgaaaactttttatataaaagttgttctaaaatatcagattaatccattttcgagtttataataattaaaactcgattaatcacacgttattaccacctcgttttacgtgaaatacttaatcttcatcttcagaagattcaaacactacctaaggaagtgttagtttagtccctcgacttattttttggagagatctcccaaacacctcctaattctttttttgcagtttacactgagttttgatttacccttgaagaactctcgattttcgtggacacgctacctgaaatatctttcgtgcaaaaactttttatatatgaaagtttttaaaaagataaaataaattccccaaataaatttacttttcatctttttattttaaaaaattataatagctaataattaattaatcgtttgctaatgatctttttattttccgtggctggaaaatctcgtctaaatgcatgggcccttatactctgcatacataggcaatgaaaaaatattttagaataaggtttttatataatttagtggtcctatagtgttgatggaaaacacggtggcatgggagattagctaaaggcataaaaatacaaacccacaacaaaatactaatccaatctagaattaacagttaaattcaagtttggttgcatcttatataagctaaagaagtgaagaactgcaaagcaaaacaagagcatcaccgactgtggaaggagcgttggattttctttggacggacaatgatgtgtttctaggagcttggctccactgtggggagcacgatggttaatttttggatggcacgaataattacggccagagtaaaaggttttggtactacctcgagccaattttcagcagtacggctgcactttctccgatcctttttggctcgtcctctgcatgtgcttttcagtgtggatttccattcatgagctgatgatgagggtgacgattctttccattaacttttgttccctttggtcctgcagaaccataaacaaacctgcagtttgttttaaacgcaatggacattcgattagccgcttgttggaacaatacaagtttcagtccatcgtttgacgtatactaaaatatattaacttttggtccagattcataactaaaatacttatattttgggacggatggattactaattgcgtataagtttataactcataacatcttattaacgattaaaaaaagttatatgtattcatattaacaatttaaaacctaacgttgaaaataaaccacgatgaaaaaaaaacaataaaatcagcactaaaatcaagttttaacatttaaattttgacagtggcatatgaatctttaatgtagtactactattataaaaaaaaattatagcatatttgagtccctaattgaaatgcgagctttgttcttatgtgattgagctgtcccatatgaaattcgattgttctagaaatccctaaagttattttgtaaagctaggctgttttgcatcaaattaatcgaactgtgcacaagaaggtgattgaaattgtaaaatgcaattgtacgggttacaataggagttagcaattgaataagcccatccattagccaagcaagacaagtcagtacatttcgccacctttttgttgatatccaaacggggccatctcgaatagaccaatcaccaattgactttctttgtttcttttgtccactagttttctgatctattgttgtcgtgttgcaatttggtttagtatgtgttgccattagaaagtgacggggaggaggacggagaaagatgtgcattgatcgagtgatggagtgtaagggtgacacaattgctgcaaacaaaggacccaaattggccatgtctgaaacgaattaatctcaaatataagtcatttttagtagtttcattaatacttttgtaaataaagtcattatataacttttagtcacattttcatcttcgttaaatgtaaatcgctgcagaactttctgtcacattttcatctttaattacacaaatgtctttgtcagatacttgacaactctctaaaaagtaaattaaaatagataaatcagatttttctagtgatttagtaaaataaagggtaacaaaataatttgagctgtaattttacttttgtttcacaggtccaaaatgaactgtgtcggttaccgaagaagacaattaattactagtacaagagatgaacggtatgtgcaatagcctccttgagaacaaaagagccttgtacttctagtagagcatgtcatgtgtattgtgtactggcatctaaacctacaaaatcttcaatgttgcagaaaaacatactttaaggaagactgaaagagaatggagtcgttatgagcacgtcaaataagaatatatcatgatcaatcatactccctcatgtttttaatatataataccgttgatatttaacatatgttttgctattcatgttattaaaaagaactactccctcctattttacaatttttgatgttttggacaatggtacgatctacaataatatatctttgactatatatttctattataatatataacaaataagtaaacatttaagtttattaaaattaccttttaaggctaatgtataaatcatatctagtgtccttaatagttattgatagtaaaaaaacgtaaatattagggaatgacctaatatcaaataatcatttaagtttattaaaattatattttaaggctaatctataaatcatattctagtgtcctcaaactaaatatttaatagttattgatagtaaaagacgtgaatattagggaatgacctaatatcaaataattagaagggatgagactttgaacccaggtcgtttattccatcaccttgtggagctagccagaagacccatcagcgtttctcaatagttattgatagttaaattctagtaaatgatttgtatcaatcttattcaaaacgtcagaattatggaactgagggacgtacacaattattatttatattactgtgatttactttattagtgagtttgatttcttttttgctaatcagccatttataatttgtataagccaaatgtgaagagctttttttttaaaaaaaaaacatagccacttatttacgaaatcaactaacattgctacaatcaacatggctacaaccaatatggcaatcaactaaatccatagtaatcacagccttaaagcgatggagttaatcgggacaccttcaaagatcatgaactacaagaagtgttagatatttgaatggctctttcgttaggctcgttatcccggttcaaacacgaaataattcctactgtagaaacagagaaaaaggagccctgaataaaagggacaggggaagtggaacgcgactcaccaaacaaaggatgggccccaaataaaaaggcgctttgtattcaacgctcgaatttcgtgggccccaccacagggaaaacaatcgacgcaggcttccgcgaccgtggccacgcgtacccacgctcacgggaggcagggccacgtggacgtggggccgcgttgtcatcgacgtcgcgcgacacgggggggtcgtgtgcggcgcgcgcgcgcgcgttcgatgccgtgcctggtggtgcgctgcgccggtggtggtggtgctggtccctcgccgctgtcccgactcgcgtccgatgacgtgggcctgtaaccatcgtatgggggcccgtggtgggccatcgtccggaaaggcgaaagcttcatcgtggcgcgggacgggtggggcccagtctctccctcgaggtgtaaatcttgcacagttgcacacttgtgctgagcttatcggttctctcgtctcaaattgtcatacataaactttgtgcttattacaacctcccataacattttaaaattgttctaaaatggttgttacataaatcattttcgtttcaatttttttttcattttatccttaatcaccatcccaccaccaactatatatggatctattcggctgcacatgccacttatatagccgttacaaccaacaacttgccgaacgctccctataaagaattatggcttgtttaatgtttatatagttatagacatttttaccaaaaaaaactgagcctctactttcttgttctcataatataactatttttaaactttttataaagattaagaggaaatataaaaaagattagattgtccatcgctatggtcagtgggtagggttgtaaaatcgagtgtatctttatatttcatcgctacaaatatttaaaggtagctattttttatataaattctaaacgtcaaaagttttaaataggaaaagtaggataggaatttgaacttccaagcaagacaaagacaacgatgctttgttttgttctgagctggtctgaaatattgtactactttatttatcttaaaatatatttccttcgttttaaataaaccaacctacgattaagtaagatactatacaatatacaatatagtaaatctggatagacttctaagtgtaccatataatgtttcattcagttttaaaatgaaaggaatactcctactaagtgttgtggagagcggaggagaggcaggcgagagcatagcagttctataccgggacacaacttgataaaccatcactgggctctatgtctgagatgggtcggctagcccataacaggcctgctttatggattcatgattcatgacccacctatacatttgtcgacaaattttcttctaaaaatttgacagatgtaattatagtacaatcatagtgtaattacactgtaacttatatgtaattacactgtaacttacatgtaactacaatgtaacttgtatgtaactttcacgtaattttgaatcgttagatctattacaagatttgttctagtgacgaacaaaaagatcacagtacacacatatgtgaaaagatttgttcccacgacctcgattttaccgaaataacatgttacggagagatttttgaaagttacatacaagttacattatagttacagtgtaattacatgcaagttacagtgtaattacactgcgattgtactgtaattacatctgtcaaatttttgggagaaaatttatcgacaaatatatagcaaaattgctaaagtatcgtatctgtggttctggatattcctaaagcatcaggatcgagtaacaaatgttgttaagatgaaacaatgaatttgttttgcgagaaa

SEQ ID NO: 12343 - DNA, 3180 bp, Oryza sativa
  unsure (1)..(3180): unsure at all n locations
gtttgccagataatccaaaaatgttaacttacgctaccactctatctattgtatacaacataacgtgtccattcaataacccaatttatctgttaatctaggctctcggtccttcccctcccacctcctaatttctgacgtaggctctagcctcgtgatgacgttatcctcaacgcggcgacaacccaccacacgacggcgagcaacttattgtcttatcgattgcatatacacataacatctgacaatattaatttgctttcgagatgagtccgcaccaactatgcaacgtttccaacatcccgaaactatccgctcctcacccgcacatgctctaaatctgcttaaaacaaagaaattactatgtatttggcccatgtgtagagcttacatccgactagtacatgtgcaaagcacgactcttgtttgtctgggctcgcatggtaagaagaaaagcttagagattggtggatatgacacgattagatgagagttgtacgatagagtcgtacatatagcaaggtaaaaaaaaattggtgtaggatatgatatgactatcctaaatccgctttggtttcacccctacgatctataaatctctactattataaaaattaaagatgttttcgccggtattctgttacgttatccgtgtttgagttggtttttaagtttgtttgcttttggaaataccgattcgtgtttgagacggattttaagttcgtttgctttttgaaaatatggatctgtacttgagtcagattttaagtttgtttgtttttggaaatacaaaaggagtagtataagaaatctttttaaaaaactcgcatgctaacttgagatgaatgtcggactcctaattgcatctcatgattttctaaaataaaatatttaatagtgaatttctcctgagctgaactgtataacaataataaaataaaaattgcattcacccgttgcaacgcacgggcatcttttctagtaaagaaaaaaacaaatcatactatgaaaagagtagccacattttctgtttggatttgttacttgttattctatgaatgaagtttggtaagtgaaatgataggtggtaaaataatttatgttgtgaatttttcatgactatttgggttgcatgtataagacaagggcaaccctggatgacttaaaaatcaacttccccatgataccaaaatcctacatgtatatgcatctcattttgttcttttattctcatcacgtttaattatagcatgatggttcatatttcaaacatgctccacatagcatcttccatttttaagttcctgaacgccaaaaataaacaagaagggaattcccaatccatcgaggtcctcagcttccctcctccgcttttcttccagtctttctcctccgtctctcatcctctcgaattttctttccccccgtctctcatgcgccattgatcggatcgcttgatgccgnnnnnnnnnnnnnnnnnnnnngctgccgccgtcgccgggcgactccgacccgtcggggtctcgcgacatggacgacgaggacctcgtcgaggatctcctcgtcaccgtcaactcggcgcgggccttcgtcgagttccgccgcacgcagcgcaaggagtgcgccaacctcctccgctggctggagctcgtcctcccgctcctcgaggagctccgcgactcggcgccgccgctcaccgaggacgcctaccaccgcctcgccctgctcggacgcgccttctccgccgcgcgccgcctcctccggtcgtgccacgacggcagcaagatctacctggtccgatatatcctgcattcctcatcttcctccgtcatcgtctccaattataaaagttaatcgatataacagaacgtgttctcgatcgcttcagttgttaataaactaaaacacgttagacgatgacagacacgaacacacaacatttgttaacaagattcagccgaaagctatgatctcaaagctctgcttacgaacgctactccctattcaatatagcacctagccgctaagagtgtatggtctcgtcgccatcgatcttaacgatcttgcattgcttcgtcttgtctcaggcgctggagagcgaggcggtgcaggggagattccgcgccgtgtacgagaagatgaactccgctctcgacgggatgccctactcggagctcgccatctccgatgaagtcaaggagcaggtaagcctgcctgcatgcatgtttctgcctgcatgacacatgcacaggtcagacatgatcatcatcatcgatcgccatggtttctttcaggtggagctgatgaacgctcagctgacgcgatgtaagaagcgggcggacacgcaggacatcgagctgtccatggatctgatggtgatcctcgacaacaaggagggggagaggaacgcggacagggcgatcctggagaggctggccaagaagctggagctgcagacgctggcggacctgagggcggagacgatggccatcaagaagctcatcagcgagaggaacgggcagagcggcgatagcaccaagcagatcatcgagctcctcaacaagttcaaggaggtcgccggcgtcgacgagaagaacgtcctcggcgaggtctccgtgacgaaatccctcgacaagtgcccctcgttgatgatccccaacgacttcctctgcccgatcacgctcgccatcatgagggatcctgtcatcgttgccactggacaggtataccaaaattctccaagaacaacacggtgagattcgaacgagtttgacgaatttgaatacctttggtttttgtagacgtacgagaggaggagcatccagaaatggctggacagcggggagaggacgtgcccgaagacgcggcagcggctgtcgcacatgtcgctggcgcccaactacgcgctcaagaacctgatcctggaatggtgcgacaagaacaaggtggagctgcagaagagggagccggagcccgtggcggagcaggacgacgagcatcagcgcggcgccgaggacatcccgtcgctggtggaaggcatgtcgtcgatccacctcgacgtgcaacggaaggctgtgaagaggatccggatgctgtccaaggagtgcccggagaacaggacgctcatcgccgacagcggcggcattccggcgctcatcgggctcctcgcctgcccggaca

SEQ ID NO: 12344 - DNA, 12478 bp, Oryza sativa
caagctcaccatcgggaggctgggcggcatcgcgccgctcgtcgagctcctccagaacggcagcatcaggggaaagaaggacgccgccacggccatcttcaacctggtgctcaaccagcagaacaaggtgagggccacccaggccggcatcgtgccggcgcttctcaagatcatcgacgacaaggcgctcaacatggtggacgaggcgctgtccatcttcctcctgctctcctccaacgccgcctgctgcggcgagatcgggacgacgccgttcatcgagaagctcgtgcgtctcatcaaggacggcacgcccaagaacaaggagtgcgcgctgtccgtgctgctggagctggggtccaagaacaagccgctgctggtgcacgcgctcaggttcggactccatgaggatctctccaagatcgccaagaacggcaccagtagagcgcagaggaaggcgacctctctcattcagctggcgcgcaagtgctactgaagatgaggaccccgtttgtaattgtaactcattttctttccccctctttctcagtagaaaaaattctgttgcttgccctgttctagctgaatgcatatgtggtgtatcgccagaatggggaattggtggtggaattgctgaaaaaaaacaccctaaatgtatttgtgccgatttcagtcaaactagttgatattcctataccattataagctgagttagattttaatgctaggatatacgatattagtttatacaagatcgatatattccgttataagtagaaaccgggtagtaagcagtattaaatagcaccttattatctggtagtaaatattgtgcaggtggtaaagaacaactaattgtgtgtgcgtgtgtgtggggtgggggggtgtttagtttttttgtgtaaattttttaaactatacggacacacatttaaagtattaaacatagactagtaataaaacaaattacagattctacctgtaaactgcgcgatgaatttattaaacctaattaatccatctttagcaaatatttactataacatcacattatcaaatcacggcgtaattaggctcaaaagattcgtctcgcaatttacatgcaaattgtgtaattaattttttttccacatttaatgccctatgcatgtgtctaaacatttaatgtgacatttttggtcaaaattttttggatctaaacaaggcttaggtaacaatgctagtgccgaatggaaggaaataaacaatcttatgtgtataatttatctgacacaccagtcacattgctaccagcaatggatgatttttttttctcaagtgaccccaaccttattcatcacccatacgcataagcattgtaaatgtagtaaagaactactacccactactgtttggactcacactaataccgagtttggtaagatacattgaggaagctctagcttaaaccatcatggttgaaaagacacaatatgttttcttcatttttttcgattaacatgttaatttctactagtccttgagagcaaacagatggctccttttcatcctctcacttaatataaacaaacttgagtaaaatgtacagtcgatcgttaaagttgggctatgtgtaatctagatccatgaacttataaatttagatatgtatttcttatcttgatttaatatagtactccctctgttctaaaatataagagattttgaagggatgtgatgtccatattcatattcgcagtcctagaaagtgttacatctctccaaaatcccttaaattatgggatggagggagtatcacctaaggtcaaaaatgcaaatgacttagcttgggtgctgatatggtgtcctcgccatggtggtgagaattttgcatgtaagcctctatgttatcatattgctaaaattgactcccaccactgctaaaatcgaccaccacagtgtccatggtaaaggagctgaagagatggcgactagaacggctattgagagtttccaaagccgaaatagataacatgatagggagagggtgattctgcaagcttggtacagtgtggggttgtcgttgtgaaggctgatgatggacctcatattacgagaggattacggcaacaatagcgggacaattcaaaattcaaaagttttgataaaagctacagagaagagtagtgcacgttagagttttgggatcgaactgcataggactcactgaaatagactaatttcagaagttttgcataaatataactagctgggtggcccacgcaattgcacggctagcatccaaacaaaatcatatatttttaagtatgattttacttagaatttattaaatagctatctcattgtcttaagagtttgaaagaccaaaccttatcatccccgtgtttctaattatatagttttttaaaagtcacaccagttgctaccctttatgtcatcatcttctttatttgcttgctcgttctaccactatttctattcattctctttggaacctttaaaaattggatcttataatttttagagtttattatcacgttgggttttgtttttataatttctaacatcccgtcaaacgttgccattatactcctctatggcccatccaccatctcttcttctttttgtcattgagattttaaaaatcgaacataattatcgtttgggatcatttttactttttagaagtcccgccaaaccgtcagcgactttgccattgtacttctctatggctcacgcgctgcctcccttctttattgccattgtacttctctacggctcgcccgctgcctcccttctttattgttattgagatttaaaaatcgaacatgattatcattgttttttttaccttttataagttctgaacctttaattgtcttgttgggttttttttttataatttatagaagtctcgtcaaacgatgccactatgctcctctacggcccgtccgcccccctattgtcattgtgattgtaaaaatcaaacatgactatcattggaattcattttttattttctagaagttccatcaatcgtcagcggctatactcctatacaccccgccagctgcttctcttttttattatcattgagattttaaacatatatgattatcaatggggtttattttttttactttttagaagtcccggcaagcctttgctcgtttgcttcacggcctgcctatcatacctccttttaatcgtcattaggattcaatctgttgctttattaacagtttttatatgtcatatcaaccaccaccactctactcatttataggcctgttacttaatttatctcgtcatgtgttttacatggtcttttattgaatctttcaatagtctttatttttatcacaaattttaattatttataaattgtattcctaattgaaatcttattttcctttttctaatttcagaatttattttttttctaattttaattaatatcgtattgtgttcttttaatattttttattttttattttcaacttaagtttgtcggtgacatgggaccgagagtatcgtgactagaggcttgggcagccgcggtcacccacgtggcttgaccccctcgagggggtcgggcctgagggtgacatggcctccccgccctctgtctccccgaggggtcgggccgctcccgtttcggccccgagggctggggcgccccgaccccttgtggttttggcgccacgtgtgtgggttaggtgagcacagcggcgcccacctaccgcatttatagcgggttggacgagcgcgccacgcggcatttaatgcggcgctacgcgctcgcttatccggtccgtgactggtcgcagtgtgtgaccggtcacagaacggtcagatcacgggttaggaggcaacaggcggcctttcacacgcctcgccccgtcccgtcggaatgatgagagactctaggcactcgtccctagccggagccggcgtgctaactcctggagttagcacgtcagttccggctagattcataccaggcttcatcgcaaccattacaaggaagtcattttatgaagaagggctgacgtgtggcatgctaaactgacgcgtggtagacaagaatgaccggtttgtgactggtctgacgccggtcacgtcatcagcaaacaaccgtgctcccacgttgcacctgcttccggcagagtggaggttggtatgacccatcccatcggagggtcattcggacagtagccattgcaaatctccgcccattaatgaaggaaggacatggttatcccagtgtcaggcgaaggcacgagccaagttttggtcaaagtagggtgggtccccacccaaaagaaggataggtagaaatggtgcatgtggtatccccttgagatataaaaggaggaccatgcctaccaaggggggacgggagctgagagaggagagaggagagaaagagaaagaggaagagggtttctagagcttgaactctcttactcttcagctctttgtaactccttcacacacagatccaccagaacacaggagtagggtattacgcttctcagcggcccgaacctgtctacatcgcccgtgtcttgtgcatttgctctcttgcgaaacattccacagatcgagggcttagaacctcacctagcgcccccggccgaaccggcaaaggggggcctgcgcggtctcccggtgaggagacccacgctgcgtcatctggcgcgccaggtagggggcgcgtgtgtttttctaagccctcatcctctttcgtgtgcgccaagcttctcccgctcagcccaatggccgaacgggcagtggcgcacaacctctctccgacgctagcggtgacgacggggagtagaacctgcgccgtcgagctcgtactccaccgcccccctcgcaccgaagtcttgggcgggaggaggcgctcgagggggtcgaaagatccgcgactttgccgcccacgggcgatggagaaggacggcgagacggggagcgtcgcctcctcgtctatggcgatggcagcacgccccagggcgcgctccaggctgcgggcgcgctcctgcgtcacccgtccgtcgtccccgatctagagactccagcccgacgttggccggatgacgtggctgacttggtcatgacggcgcagcagcgcctaggcgccggcgggcggtcctccgccaccaaggcctctggcactgctaccgccggctctgtgtcatcgaggcggagggcgcggcgagccggcggccgttgcccgccgttcgtccgccattccctcgtcaatgcctccgacccaagaagatgtgcgtggggggccagatgcccgcctcgatatcgagcgccggcgcaatggtcgtcgtgctgcccacgcaacggagggcgcttcctcgtccggagcgccactccgatccgggcatgggggccagcctcccgtgtccccggttggtggtgccggctgtcgagcctttgtggcgagccttcggaacgtccgttggcccccaaggttccggcccaccatcaccgaaaaatacgacggaagtgtcaaccccgccgagtttctccagatctacacgaccgggatcgaggccgccgggggtgacgacagggtcatggcgaatttctttcccatggccctgaagggacaggcgcggggttggctaatgaacttgccacccgcgtcggtccactcttgggaggatttgtggcagcagttcaccacgaacttccagggcacatatccgcgcccaggcgaagaagcggacttgcatgcggtacagcgaagggacgatgagtctcttcgctcgtacattcagcggttctgtcaagtccgcaacaccataccgtgcatccccgctcacgcggtgatctacgcgttcagagggggtgtgcggcacaaccgcatgctcgagaagatcgcctccaaggagccccagaccaccgcggagctttttcagctcgcggactgtgtggctcgcaaggaggaggcctggacctggaactcctccggttccggtgtggcagctccggccgcccccgggtccgccgctcggtcagggcggcgggacaggaggaggaagaagaggtcggcccattccgacgacgagggtcacgtcctcgccgtcgagggtgcttcgcaggccacccgaaatgggaggcctgcgagcgacaaaaagaaggaggccggcgctcccagcaaggaacgcccgaccggcaagtggtgttccgtgcacaacacctcccttcacaaccttgcggactgccgcgcagtcaaaagtttggctgagcgaacgaagaaatgggaggaagaaaggaagcaagagccccgtgagggcaaggccccggcggcttccgccggcaaccggcgaagtgaggccaagcagaaggccccaagcgaggacatcgacgaaggcggcgattgccttggggttccaggagcctggggccaccattcgccaccgtcgatgggggagcgtgcgctcacgcttctcgtcggagcctcaaggccatgaagcgagagcttctggccgcggcccctacccatgaggcgacgcggcgggcgcggtggtcggaggttgccctcaccttcgaccagaccgaccacccgccgtacgttgcccggggaggacagatcgcgatggtggtttcccccaccgtttgcaatgtgaagttggggcgtgtcctcatagacgggggtgcagccctcaacatcctttcccccacagcctttgacgccatcaaggccccggggatggtgctccggccgtcccagccgatcatcggtgtgacgccggggcacacttggccgctaggtcatatcgacctcccggtcaccttcggtggttccgccaacttccgcacggagcgggtgaacttcgatgtggcggacctcagtctgccctacaacgcggtcctggggaggcccgcgttggtgaagttcatggcggcggtccactacgcctatctccagatgaagatgccgggccctgatggccccatctctgtccatggcgacctcaaagtcgcgcttgcttgtatggagcagcgcgcggaccacctcgccgtggcgtccaagcccgagggtggcgacgagaggctcagcacctccgtcccagccgccccgaggcagcggatgatcacgtgcgacgaggtcccggtcaaggaggttgccctgggcgacggcccgtccaagaccacacgaatcggtggtcttctagacggcaaataggaagacgcgctcgtctccttcctgcgggcaaacgccgacgtcttcgcctggagaccggcggacatgcccggggtccccagggaggtgattaagcaccgtctcgccgtgcggccgggcgcaaggccggtccggcagaaagtgcggcggcaggccccggaacgtcaagccttcatccgcgaggaggtggcgcgacttctggaggccggattcatccgagaggttatccatccggagtggctggcgaacccggtcgtcgttcccaaggcgaacggcaagcttcggatgtgcatcgactacaccgaccttaacaaggcatgtcctaaggacccttaccccctgcctcgcatagatcagattgtcgactccaccgcggggtgcgaccttttgtgttttctagatgcatactctggttatcatcagattcgcatggctagggaggatgaggaaaaaactgcattcataacccccataggaacttattgttatacgacaatgcctttcgggctaaacaatgcaggtcctacttttcaacgtactactcaaatttctttgggtagccaaataggacgtaatgttgaggcctatgttgatgacttggttgtgaaaacgcgcaaccaagagaccttactctcggatctagcggaaactttcgaaagtctccgctccgcccgcataaagctgaaccccgaaaagtgtgtgttcggtgtgcctgcgggcaagcttctcgggttcttggtctgtgcccgaggcatcgaggccaaccccgagaagatacgagctatagagcggatgcgccccccaagtaagcttagggatgtgcaatgcgtcaccggctgcatggccgccttaagtcgattcatatcgaggctgggagagaaggcactacccctatttaggctcctcaaacgccccgggccgttcatctggacggaggaggctgagcgggccttcactcagctgaaggcatacctcagttctcccccagtcctggtcgccccagagccagatgagccgttgctactctacctggcggcaaccccgcaagtggccagcgcggcgttggtcgtggagcgcgacgaggacaaccctcactccgcgcatccccaccctatgtcgactcgacccgggagagagcagggacgtgaggcccccgagccgaacggtggcccaaggcccccgacggccggagctggccctctgcccgcttgtccgacggtgccaggcgcccccgacccccaggacggcctcggggccactgcgggaaggccgcgcctatcgccctctgaccccgaggtcgtcggcacagaagccgagtgcgccccgcgcggcctctcggacgaagagcgccctggagatgcggcccctagcgaagaggatcggccccgccgaaaggtgcagcggcccgtctacttcgttagcgaggccctccgggacgctaagacccgatacctcaggcccagaagatgctttacgctattctgatggcttcgaggaagttgcgccattattttcaggcgcatcgggtcacggtggttacgtcttaccccctcggccaaatcttgcataaccgagagggtactggatgggtggtgaaatgggcaatcgaactctctgaattcgatttgcactttgaaccatgccacgcgatcaagagccaggccctcgccgactttgtggcagagtggacaccagctcctgagcccgtctccgaccccgaggccagttcgggcccctcgcagctgcctcacaccgcctactaggtgatgcagttcgacggctccctgtctcttcagggcgccggtgcgggggtcacgttgacctcgccgagcggagacgtcctcagatacctggttcgcctcgactttcgggcgaccaataatatggcggagtacgagggactccttgcgggactcagggtggcagctggacttgggatccgccgccttctggtgttaggcgactccctgttagtggttaaccaggtctgtaaggagtaccggtgctctgacccgcagatggacgcttacgtgcgccaggtgcggcgtatggagcgccattttgacgggatagagcttcggcacgtgcccagacgggataacgcggtcgccgacgaactctcaaggctcgcttcctcgcgagcccagaccccaccgggcgcctttgaagaaaggcttgcccagccgtcggcgcgacccgatcccctaggggagacggacgcgcctgaacggcccccgaggtctgtcggagtccagacctcgggacccgaggggagcgctcccagctcccttagattgattgcttggatcgctgagatccaggcgtacctcgcagataagactctacccgaggaccgcgaagggagtgaacgcgtccagcgcatctccaagcgctacgtgctggtggaagggaccctctatcggcgcgcggctaacggagtcctcctgaagtgcattcttcgggaacaaggcgtcgagcttcttgccgatatccatgaaggcgagtgcggagcccactccgcctcacgcaccttggttggcaaggcctttcgctagggtttctattggccgacggctctcaacgatgcggttgaccttgtccggcggtgcagggcgtgccagttccacgccaagcaaacccatcagtcggcccaggccctgcagaccatacctctttcatggccgtttgctgtctgggggctcgatatcctgggtccgtttaggcgggccccgggcgggttcgagtatctgtatgtcgctgtcgacaagttcactaagtggcccgaggcttacccggtcatcaagatcgataagcactccgcgcttaaattcatcaggggcatcactgctcggtttggggtgcctaatcgtatcattacggataacggcacccagttcactagtgaactcttcggtgactactgcgaagatatgggcatcaagctctgcttcgcctcccccgcccaccctagaagcaatggccaagtggagcgcgccaacgcagaaatcctcaagggcctcaaaaccaagaccttcaacatcctcaagaagcacggggactcgtggatcgaggagttgccagcggtgctctgggcgaaccgaaccacgccaagccgagcaaccggggaaacgccttttttcctcgtctacggcgcggaggcgattctcccatccgagctcaccctgaggtcccctcggccaaccatgtactgcgaggctgatcaagatcagcttcgcagagatgacctcgactacttggaagagcgaaggcggcgcgcggccctccgagccgcgcgctaccagcagagcctgcggcgctaccatcagcgccacgtccgggcccgatcgctctgcgtcgacgacctcgtcctacgccgcgtccaaacgcgtgctggactgagcaagctctcaccaatgtgagagggtccgtatcgagtgatcggcgtcccccggccgggctccgttcggctggccacgggcgacggcacagagctgcctaacccgtggaacatcgaacaccttcgtcgcttctacccctagtgggggtcgagtgtcaggtctcgggctcgggccaacaccgcacccccccgggcgtgcagggttggccgggggctaccacatgcataagcttatattttttctcttccgtatttcaataaaagcattttcgatttcctaaggactgtgtctgtgccattgtttcctttcgaagaatcttggcttgaattagcacgctcgtgctcgatcctgccctcggtggcccgggccggctaaaattgccaaaaggggcccagaaccgagccgtgccccggggcgtggtgaactccgggggggaatcggcaaaggcccacaatcgggtcatccataaccctcggtcaccacgttcccggcctggccagtctcgacacgtggatctccccaggcactagccccgacccgcgccatttgaggctgggacctgggcacgagcccttgtttaagctaagacacagaaggaccgtggcacagaccatcctcgtctcatacacacaacaaatgaaattgacacaaaaatttcctctttatttgattgcagattaaattagtctatacaagaaaggggcccgaaggcctcggaagaagaagaaaaagctatttaagattggcgggggcctggggctcacttcgacgcgcccgggccgcaggcctcgtcgtcgctgtcgtccgcaccaccgtcaccgccctcctcgtcggagtcgagggcgaacgcgagccgaggggccataccctcgaagctgtggacaatgtggtcggcggcgtcccggacctgcgcgcgcgcgccgtcctcggtcccaggagggaactcgtccagcgctacccacggggagaagtctgggtccctggtctggtagcttgccagtacgagctccactgccccccgggcgaggtctctcgaggatgacttgatcgtctcctcgagctcctcggggagccgctggagggtcccggccatctctgagaggcgctgggcaaggcccccctggttggcggcgtacttcgcggtccgcccgccccagaggcccgcctgccgcccggcgcggtctagacgggagacggcgtcccgaagcatgccgggccctacctcgcctgccaagcggagggcctcgacctccccggtggacgagtccagcgcgccctgcagctcggcgatggtgtgctcggcagctgcgaggcgggcgactaggtcgccgtcgcccgcggccgccccgccgctgcgcgccctcgcgtccagctcctttgcccgcgcctcgagctcagcggcccgctgatccagtgcggccctctcggcgcgggcgccttccagattgcggcgcgcctgctcctcccgcgctgtctcgcggagggacaggctgtccgccagcctttgcgccgcggcctcggcctcctcgagagctcgctcccgctcggtgagcgcatcctcgcggaggcggagtgcgaactcctcttcggcacaggcggcctcgtgcgccgccagtattgcctcccggatggcgacggcggcctcgcggtccgccaggtccctctccttcgcgcgggcgcgctcttccagcgccgtggcgcgagcctcaagggcctcttcgcgccgccgggacgccgcctcgttctccgccgcccgccgttcccgggcagcggcggcgtcaaggaccccccgtgcggcgtcgagcttcttccctagctccgctgcctggctcccgtattggaggcggaggtcgtcccgcgcctcggaagacttcaa

SEQ ID NO: 12345 - DNA, 8062 bp, Oryza sativa
  unsure (1)..(8062): unsure at all n locations
tcgcaggttcgtccccgcgcccactgcggccgtattcagtctcccatctcccaaggcaagcggtccgccaggtccctctccttcgcgcgggcgcgctcttccagcgccgtggcgcgagcctcaagggcctcttcgcgccgccgggacgccgcctcgttctccgccgcccgccgttcccgggcagcggcggcgtcaaggaccccccgggcggcgtcgagcttcttccctagctccgccgcccggctcccgtattggaggcggaggtcgtcccgcgcctcgttcagcacggcggtggcgatgagggcagtctcccgctcctcctccacctccctggcgatctccgccagctccctccgacgggcctcgagctctgaggtgtgccggcggtgtgccttgcggcccgcctccaccatggcctccaccgagcgtcgcccctcttcgacgcgcgcccacgccgcgtcgagctccgcccgctctgcctgcaggacctccatctgggcacttaacccgtccaacaccgtggtgttcgcggcggccaaggcctgcagaaggggctccgcgctcagtggggcagcggaaggcatgggggagagctgcctcggtgagggtgccgcacggctcggcccaccgatcgacgtgccggactcggggacgtcccccgaagctggctcgtcctgagcgtcgcccgaggggtcgggcccgagcggtgcgcccgcggcctcgtcgtgggtggcctcggaagtcatcgtcgcctcgggcggagtcgggtcgggggcttggcaggccgcctggcgtgcgcgcgccgcctccgcctcccggacggactcctcggcccggcggagtctggcctcctcccgagcggcttcctcagcctggcgagcccggatggcctcctgggcagcttcctcggcttcccgaaggcggtccgcggcttctcgccggtcagcttcccgcctccgggcctccgcggtcgccgtctccccggcctcagactggccggacttggaatggcgagggggggcgcgacgggatctcgctgaggcagaagaaaaaccagaagacaaaaaacgggtgagtgaaaacttgccttgggagatgggagaatgaatacggccgtagtgggcgcgaggacgaacctgcgaggaggtcggttaaacgaccaccttggggggagatgaggtttccccggcatggttcggtccccccatcttgcggagccgcttcttctttcgctccccctcgggttgcgacgtcggcgcggtaccctccgggcgcctgctgctggcacgtaccgccccgccccctcggggaggagatggggaaggggtaccctcctgcttcctcttcccccgggcgtcagcagggcggctgctcccgtcgcggggcccagaagcatgaccccctcccggggtagattgttcccccctgcggctcacgcccgcgccatcgtggcctcgaggggcccgctcccctgacgccccgaccgcttgcatgacggtcaggatgttggcgcgctctggatcgctgcagagcgggaggacaccttgggggatgagggatgcctccacggagctgagattcagcacccgttggatcaccatcttgaagtcttcagggacccagtcccacttgaccccctggtgggtcctcatgtagtcctcggacccggtgtactcccaggcgccccgggcgcgccgctggagcggcgcgatccggcgacgaaggtagtcgccgtacaccatggcccccgtgagcccctgggatcgcagacccgccaggcggtcaagaacggcgtcgtagccgtctcccagatctaccggcgcccgccagctggaggcctgcgccgggggctggctcggaagtcggagacgcgcttcgtcggcgagaggggtgtagaaccagtcgctcttccagtcgtcccacttcttgcgaaggacgcagggaatgtagcggttcagcaccggcccctgcggctggaagtagcagccaccgactaccgacggtggcgacaccggctgtacggtgaagaaccaccggaacagccggagagatgggcgcaccccgatgaacatctcgcacaggtgcgcgaagatggccaacgtcattaccgcgttgggggtgaggtgcgccatctggagatcataaagctccagaacatccatgaagaaagaagagaatggcgggaccagccctgccattgcgaaagagaggaagaagacggaccgccccgggtagtgtggcgccgggcgtccctcacccagcgcgaccacctcccggccggtggcagattccggcatgaatcggcgcggcagcccggcctgcctctcgctcacgatgcgagaaggcggcagcacgctaccgtcgagcggtgcggagccccgtgccatgacgccggcggaggaggagcttgagagcgagcgagtgcggcgagggtagggcgcaggaaacgaggagttagagcgcaagcggcgaaggcaaggggaataatggcgagaggaaggaaacgaatctcttcctcggcgtctttatacccttaccaacgctatgcccggctcctcgcttcccgcgcccactattttcgccacctcgtttctcgcgcccacgcctccaccaatcccactcgcccgtttgcggcgcacgaggcggatgtgcggccgtagcagttgagatgggacagatcgagcgcgcgttaaccatgcgcgccaaacgcgaaaagcgccatcattacatctccaggcgaaacgaaccggctcgtcccgattcgcgcgctactcgagtaatgtagcggtcttgaagaaggccgctcattattatcggtcggttttcccttgccgatgcgcgcgatttgcgaccgctgggttcctgcccgcctgtagagaccggccccacctgtcaccaggcctaaggagtggcgtcacgcccgagcgcttccctcgaggggggcgatcgccctggcatgacgccgggggctactgtcggtgacatgggaccgagagtatcgtgactagaggcttgggcagccgcggtcacccacgtggcttgaccccctcgagggggtcgggcccgagggtgatgtcgaaactagatttcggcaataataaaagggggtggctatcaagctggaaaagtgtatgggtttggagacgaaggatttatacaggttcaggccttcttattcaagaagtaataccctactcctgtccggggatgaatccgccgagtgtattattgattgtatggtttggagaaaatcaacctctgcccctagaggcacccggaccccccttatatatgggaaggagtccgtgttacaaaagataatctatatccctaacggaatatgcagatataggtaaaatacagtcgtaaccgactaagtctcaaggtgtttccttgatgtacaagttaagaaacgaacccgagatacaaataagatattatatatatattcggtatcctatatccagtccaaatatcatcgccgtgtagatatgggatatccataatctccacagtagcccccgagacctttgcagtcaaccatcatagccttctcaaagataataatccgagtgcttcaaacttttcatgccaaggcctgccgagtagcgaagacgaagactgtaaagggcgaaaaaataaggaatatggtgcatcaaatagatgcacctaattaggtgtagcccccaactatgtgattagttaacaaactaaacatatagttgagaacaaaataatagcacaatcgtgcatcatatgacaaaagcatatgcggcacctaaagaggcattctagccgactgctttttagccataataaaaagaatccgagtggttaacactctaaaaggttcacgaatgaacacacttgacaggcatccgaataaaaaactctaaagattacccaccaaatattataaaaattatggtaatgaataagtctaatagcctaagctatgactatccaccataattaaaacaggcatatgtggtgtagaatccgagtaaataaactcataaaggatttaccaaccgcctaaaaaaaatgactacaatatataatcagcctaagccataatattggtcaataaaaatgcacacttacgtggcaaaaagcaacgatattgtatccaatcaattgcttaaaaacccaaacaacaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcgaaaagtgcctgagtccctaaaagaacatgacaggccacacctgaaaattcgcattgcaataattccgaagaattatatgaccgcgtaaaaaaggattttatcagcattgggcaacactattgtgcgcataagttgccaaagcaaaaaatgcctaagtccctaaggagcacaatgggccacgctgtcaaaagtattgggctgaggtactgttcaggcctaagcccattcgcacctccgatacccttaacaaaaaatcccgtgatccaagcgccacttcgtcttccccgccggaactctcgccattttccccactccctgctacagtacggagctgcgccggcaaactagggttcaccaatccactcaaatccacattcgaaaagttcatcaaaatctttcccgtaattcaccgccttaatccctcacctctccctagccatcccccgaatcaaatcagcgcattcgggtaaaatcaatggcggaagagaaagaaagctttgaaggccaatgggcgccatccgacgtgatggaggagaacctgaaggagatggtggcgcacggcgttctccctgccaaggagatcatcgggtggcggccagcgtgcggtgaggcttttccgtcccccgatacacacgaggttgtggtcttctctcatttcttttatggcggcttcgctcttctgacctcgaaatttttccgcgggatattaagcttctatggaatcagcttgcatcacctaaacccaaattccatagtccacatcgccaatttcatccatgtttgtgaagccttcttgggaattaaaccccacttcgctctgtttcgccgaatcttctttctcaaaccccaaccaaacaagagcaagccatgtgtagtcggaggggccggatttcagctgaggggaactctgagccagaagtacttctcaatgcccttcaagacttcaaacaaagggtggcatgcgaactggttttatgttcagaatcctgagcctgctcttcccgagtactcttgtcttcccccagtgtaccaagatacttggaactctcttccgattggggacgaagcagcccaagccttagagttgatggaccgcatgctaaaactcaaagaacaaggcttacaaggagagcagatcactcggcacttcatcaaatgccgactggcgccagttaaagaaagatctcgtacagcttttgagtttgacggcaagcatgatcctaatcgcgaagaaccagactccctggattttaaaatcatgaaggagagaatgtataaaatcttctcaaatgctattgtcgtcagctactcacatcagctgccagttgtgccatataatgcattcaatccgcccccgcaggtatgtatctgaaatcttcaacctatgaccaaaatagtatcttgtcttcatgttgagttaactaaccatggaggcatcttaatcaggaatatgtattgataaaatctgatcccccaatcactcagcgccggtctcctcgccagcacaccgttcagggaggtggagggccaacaatcagaccagattcgcaacctcaaacctccaatccaattggacagacaggttctcgcaagagaaaactggtgcttgacaacgatgaaggcgacgacgacaacaaatctggggacaagggctcgcctaataaactcccgaagcgtaccatgcccaggaaaaaactggctggccgtcaaatgccaaagattagaacatcttccaggtataaacctcttggtaccatttccctttgacatgcttctctcatagaaattatactaaatattgaaagaacactttgcaggaaaccatccgacatagatccaactggaaaagatcctgatcaagctgtgacagagccaaatttatccaaggatcctgagccaactgccgaaagccagccgactggcgcccatgcttcgggtgataaggccgatccgagtgaccagccgccgactggaaaccagtcgacagcagctgaaactgcaacaacccaagagcccccgactggaaaccagtcggatgcaggtcccgatcaagaaatccctgaagttggagcgcagacgacaacttcccaaggaccagagactggtaaagactcaatgattgggtctccaaataaagaacaagggtcacctcacgctcagctaggaacatcctcaggtaactcgtcttctcaagtgataccgatttaaataactccagtttatttgcctaatgtcttggaaatacatcaggaccaccgggcgatggcgaagaagaaattccccgcataaaggcggctgatgattctcgtcctcctatcttgctcaaatggtgggacgagaactcacaggttgccggcatcgtcataaaccgtcaaaaagaagatgaggaagtgtgccagctgaagaaggcgcttggggaagccactcgtattgtgaatgtaaatctttcaggcgactgcctttgatgactttgttttctttttagcagaactaaaccatgaaccatcatgcagagaatccatcttcgtaacgaagccaagaccgcaactttggagaagctggttcctcatttgggaactcttgaagcagttagggaccagctacacgaggccaaggagctcgccaaaaagacggaaaaagaattaagggagcgaattgctcagctccaggattcaaacttcgagctgagtggttcgtcaaaaggtaatcttctagatctgtcccattaatctatgctgtcataactgtatcctcaaccatttggatttcaaacagcgcaagccaccaagatggctcaaatggagaaacaaattgaagccttgaaaaaagacaaagtagaactggctgcgcaaagggactcggccttgaaggaggttgaaggtactgccagctagcaatctggacgtctctcttttaaatgcagcagattcttatcataaatgtgttttgtagatcgtaaaatcaaatctcaagctcagtttgacgtcctggttggtaagatcaagaggcttgaaggggcaagagatgaagtcgccaatgtcgctacaccactcgtccaagctatgttcctcaataacagtggtctgagtgcactcgacgcaaccgaaattttcgacaagctgaaagttgctccggatgtatatttcaagaacatcaagaaagctagaagtatgggagctagcatggcattggcgatgaccaagtccttgtacccgagaattgaaattgacgccattgatggctttgctgacgggacaagcgaagaggctgctcttgatcttatcagcaatgctcaaaacgcggctgacaagattgcaagtgacgttgtagagcaattccgcaacaacgaccttcagccgagcaacaataactctgatgatgaaaggactgattctgactgagtatgaatgtaacaaatggaggctcaatttgtacaatactggtgtatatatgctgtgcttgatagttctagccaaatctttgatttcttaaaagcttttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12346 - DNA, 2052 bp, Oryza sativa
  unsure (1)..(2052): unsure at all n locations
caaccatatgagcaatcattgagtctccattaattttttctgtcatatactatctctattataaaatatagcaacctctaaaaatacgaatctggacatgaagatttgtagtctaggataggtcttatcccatcgtttaaagttgcctacatttctagaaccnnnncaaatatcctattaaaaacgggggctattagttctcataattactttgtcccgtcccgactttatccttatataacctatacaaagtcatcccccactaaagtgcacattaaaaactaaatttttttgttcttaaaactaaaccaccttaacctttgattcaattccagccattcagatttgcacataaaaccttctggattagcaattcaatcaattccacttggngataacaattcaataataaaacatttaccaacaacctaaattaaagaggcccaacctacccatcttcttaattttccaaacatacagtcggaataccaacagcaacacatgtggtatcccaccagttataagctctttaatcttccattgaagttattttatctcctgtaaccggtgaatcagatgaacagtcggtcttcatgcctttatatacctctctataaattcactgggactttgttctcgattgatcatctgtgcttggcagtctttccatgcatctagttgatttatttgcccactcctctgctcatgctgatgcttcaacagatcaacatgcacaatccgctttggtcatctctctcttgcttgcttgctcatggatttatttttctttttcttactaatatcatttgttgtttagttgtagaatctgaagagaagaaaagaagtagtagtttcaaatatttcttaactttctgttctttgtgaaggttgcagatcttatagagagaattgaagggttggtgcattactatattcacataccggttgaaataataagaacaatttttttttcagttggttaaaataaataagaatacctttttgtttcagtaggttattgacatcttcgactgaacttttgaaagtttctacttcattaaaactatagtttggaataagcaattacatagcatctttgtgtaatcacgatgacgtatattgtctaccatttttctgtcttgctacatagcatagaacaatctatgttagttttttttttgtaataatagaacaatctatgttagtaccattcaatttattgcatctgtgttcaattggccttagttctagtaaaaggaattggcctttcactagacaatcagcgtattctgttatgattcaaatttcagttgcttattattataacattggtgaagtgttcagtgtataacaatacaatcattcatacctaattttttatctttatattactcttgtatttccgcagcaacgcgcggggtgtcatctagttagatattcttggatccgctcgtaactgcgtttgaattgatgatggaagtttcaaagtactagtgttatggatcagatcattaacatgtattaacccatattggtacactcgtgcacacacgatgggccctgtcttaaactatgcgaccaggatgtatcaagacaagcagttagcttaaccactaagcttagctttgaactcatcgatggcgatgagaacttcaagtcttcggtcgtcaagtcacactcaagagtctcacgttatacgacagaaaacacgctttcaaacatggaaaacctccatctcccctcgggcactcgaaacacaccaaaaactcccaaattccccctacttcaaacgcgtcgatacccaaagagagaaaaataaagaggggaaattcaaaacctcccccaaaaccctcgccccaccgccgccgcccccgccgccatggacagggcaccgccgcgcggcgccccgcgcgacgccgtcggccagcggtggctcgccgtcttcgtcttccaggccgcgctctcagccgcggcctccgcgctctacctcgccgngtccccgcgccggcgccacgcccgccttggcgtgccccggggccttctcctcgcgct

SEQ ID NO: 12347 - DNA, 2144 bp, Oryza sativa
ccgaggactccgggtgggcggctgttgctgggatggagttccgcggcgctgtgttgggagccgtgttcgccgcgcactatttcgggcgtcggaggtggttgctccagttccccgttgtgcaggtcagtgaagtggggaaaagtagggttctcatctagaatggcgttccgaatcttatcaaattgccaaatggctgtagctcctaatagaggtattgcgactatagagatcggaattttaggtttaaagttagcttgttacgattttagattacctacttaggtatgattgatggtgctggtgattttttgttattgaatctaagcatggatgtttttgataactgtggcttgtattattggtatgttgggtctaagattctttgtgatttgttccgagtttaactggttcccacttcccactagagagcttcatgaattgatcaaatgattagggaatagctgctagcacctctgtaatattcaggttgatatacattggacatacatgtgctattctcagatgagaaatttgattatcatgtttgataagacactatagcgctgttttataattctccagaatatacgatattcagaatccacatgcatgagctgtagtttgctttgatagttattgatagagaagtttttatccatctagatcttttttggggagacatggtttatattgatctaaattatatgtgcaattctctgatatctatagctctgtttggttaatttttttgcccttgcgattttttaggcttgcatgttgtttacttgcaatccttcagcacttcccaccaattttgccaattgtcttacttgctttcttaatttgttttttgtccagcgacctccgttctatggtttgaaaatggggcttctgccatctggaaaaagggctctgaaggtgtcacttcaggccttcttcctttcctttatcttgattttcgttcttcctcagcaattcagaatcagaggatccattggaagccaaattatcgcccaaatcggtatttttataatgagcactgccgttgccttctgttgggaaataagtcatcattttgtccaggtttgttcttcacaatccaacttcaaaggaaaaaagatgttatatgatgtacttgttgtattgcctggaatgcggagattgacgtcatttcctgaaactttatagttcataaccataattcaactgctttcaacaaatttcaggttgtgcatacaagaaggtgcagtttcgctccaccacagagcactgctgctgcagagactaatcctactgagtatatcctagaaacattggaactgagtgatccaagatcactaatgcagtatcttgcataccaagatttgtgtgctgtatctgaatgtaacttagaaccatggcgtcgagcggccttctttgaggaatctggtgagacttacaaaagaattgtgacagcttgtttgaagccgcttgaggagttcacgtcaaaaattgctgaagctcttgaagggttttctagtgagaaaccagaattgttgtcacaacagttcaaacttgctgctgcatttaatgattcacaggtaagttactcatcagtttcttctatctgttttacctcttatgttgtgttcggctgttttcctgtttttttttccaaattgttaatcatgtttgcatttgtgttgatatagaacatgaaatggttcctttgtttaggagttaagaccaaaaacagttggatcttactgtagaatcagttcggtgtttactgtttgttttttgctttgtcactcatgacagattatctagagttgaattaaatgtacgtactataatcttaactgcaccacattggttagtgatacacatacataatgactagatctgcatccaggaagatctgcttgtaaaggttagtatcatagtttgaagtgttcagacttcagacatcttaggagttcattttgagattgatagcttgtgagtgctgatgtctactttatttataaccagtctaatttgtggcaacacatttagttctagtggatgataattggatatttagtgagtgttaactatcatcatgtgagattgtggtctctaaaaaaaattgcccagcactgcaacagacaatagcatatgca

SEQ ID NO: 12348 - DNA, 1141 bp, Oryza sativa
ggacgggtccggtcgcaaagatcgccgggtgggggcaagaactttgggactttcgctgcgcttttttgacacgtcaggccacgccgctgctaacgaccgacccgagaggggagccgcaatccaccaccgaaatggtggtgtccggggcgacggcgcgtcgcgcttccggaagccgcgcgagcggggagcggatagaacgatagtaaaaaccaaggccgcttttcccgggttgctacaaatgggcgcctcctggccacaaaggtgtggggcgcgcgccagaaaattcacgaaaaatcgctggccatgtgtttttgttgctttcttttctcccggtggatgacgcgtggggccatggcgggactcgtccgaggcgcaacatgtggcagtggttgtcttggtacaggggcacaggggtgggccgtggggtgggggagggggatgacgtggcggggagtaaagaatagcgtcgtgcactcggtgcttcgtgggctctcagtcctcagacggggacataattcggtccacgtcatcagatttgttgggatgcagttaatctggatgcacttttgctgtagtcctactccctccattccaaaatagaataagttcacttcatgaccctcaaaagagacccgaatctaatccatgatcttaaaccgcaaaaccggatatcttcacccacaaactattgaaaccggtgcaatttgactcccttggtggctttggagggtggtttcgctgacgtggcgctgacgtggcggtgttgacctagtctgtgtgctgacgtggcactgtggtggcatttcaattaaaaacatatatgtgggacctatttgtcattcacacacacaagattgtgaggcccactgacatgtgggccctacctgtcatctcttccctttctttttcctcccggacctcccctcctcctcccttctttctttctgttctccctctccacttcgggcgtcgcggggagcgagcggcggtgggtggagctggcagcggggggcgtgggccggattggtggcggtcgacgagagctgaagcggcggcgggctagagatgacgcgagagaggacggcagcgccgacgccgaccagattgagcgggggcacggtggtctacaggccggctacgg

SEQ ID NO: 12349 - DNA, 684 bp, Oryza sativa
ccattggaccaagtaatcctccaagggccattgcaagatcaggaagcgtatgttggcccatggatgggcatctttgcaaatgttccagctgagaaacaaaggaggatggagctagtctgatgcagcagctagctaatttcaatccctcgcagtttactgctgtgctctgctccgagggtaggtatactggttatgcagttgtcggtttcagcaaagattggattgggttcacgaacgctttggcattccacaactacttcaaatcacaacgtctgggtaaaaaggattgggcagcacttggacaagagaagtacatctgtggatggatggcaaaagaagaggactacaaatctagtgacccagttggtaggtttttgtcagcaaatggtgatctgaagaccgtgtctggtctggaaaatgacctgtctcgcaagactgagactctcatagctaacttgtcacaccagattacagctaagagcaagtatttggtggaactggaatgcagatgcaatcaaatgaatctctctgttaaaagggcaatggaagaaactgacttgctgcacaaaagttacaatgaaggtacatactacaaactgttcatatgaataattctcatgccatgggcatatgattgctatgttgttgtctacttttattgccaatttgccagaataataatat

SEQ ID NO: 12350 - DNA, 2922 bp, Oryza sativa
  unsure (1)..(2922): unsure at all n locations
ttttaattccgaatttcagctatttttaaattgtatttctatttggactctcctttccttttctaattttagattttatttaatttttatttcaaattttgattaatctcgtattgggttcttatatgganaattattcaatattgcttatttttaattccgaattttagctatttttaaattgtacttctacttggactcttcttttttttctttttcttttatttttatttcgaattttgattaatctcgtattgggttcttatatggaaacctctttcaatattgcttatttttaattccaaatttcagctatttttaaattgtacttatacttggactctccttttctttttttttctttttcttcgattaatgtgggaatttcttttaatttttctaattttggatattatttttttaattctgaattttaattaatcacgtattgggttcttatatggagtcttctctcaatattgcttttttttaattccgaatttcagctaattttaaattgtactccgatttgaactattctttttttttgctaatttaggattttatttttatttttactcccaattttaattaatctcgcattgtgttcttatatggactcttcttttaatattccctatttttaattccgaattttagctattttaaaattgtattccgacttggactatccttttcttttctaattttggattttattttatttttatttggaattttgattaatccctcgtattgggttcttatatggaaacttctttcaatattgcttatttttaattccaaatttcagctatttttaaattgtatttctacttggactctccttttcttttctaattttggattttgttttatttcatttcgaattttgattaatctcgtattggggtcttatatagaaactattttcaatattgcttatttttaattccgaatttcaattatttttagattgtacttctacttggactctcattttattttattttctttttctccgattaatgtgaaaatttttagcccccagagcgaacgtggtgcctcctttcaaagctgttttaataatataaatagctgggtggcccgcgcaattgcgcggctagcaaaaaaatcatatatttttttaagtatgatttccttgaaatttattaaatagctatctcattgttaacactttgaaagaccaaaccttatcatcctcatcctcatgtttctaattatatagttttaaaaatcacaccagttgctaccccttatgtcatctcattctttatttgtttgctcgatctatcactttttctattcattcttggacctttaaaaattggattttatagtttttagagtttattgtcacgttgggtttcgtttttataatttctagatgtcccgtcaaacgttgtcgttatactcatatacatctcgtccactatctcttctttttattgtcattgagattttaaaaatcgaacataattatagtttgggttcatttttactttccagaagtcccgccaaaccatcagcggttttgccattgtactcctctacggctcgcccgatgcctcccttctttattgtcattgagatttcaaaattgaacatgattatcattggtattttttactttttagaagttccgaacctttaaaaattagacttgtagtttcattttttataatttttaaaagtctcatcaaacgatgccactatgcccctctgcagcccgtccgccgcctactctttattgccattgtaattttaaaaatcgaacataactatcgttgcaattcattttttattttctagaagtcccgtcaaccgtcggaggctctgcaactatactcttatacaccccgctcgctgcttctcctttttattgtcattgagattttaaaaatcgaaaatgattatcaatgtggattttttttctttatactttctagaagtcccggcaaccgctttacttgtttgctttatggcctgcttgacgtccctccttttaatcgtcattaggattctatttggtgttttattaacaatttttatatgccgtatttgttagggttacgggttaggcttaccctttactgtcacgtcccaaaacgaccctaaaatacattctctaaattatgcctagaataattaaaatccgtgtgaaagcctccaaaaattaaaatgtgcaaagtaaaagtcaaataaggcttacaggatttttgtatatttcctaaaagcctaaaatatgtaaataaattttagtggaattttcatagcacaaataataattgttaagaaataaacaaagttaaaaaggttttataaaaaaaaaccctaaaaatcccccttccctctcttgggccggctcggcccacttccctccccctctctcctcttccctcgcggcccacacggcccctccccgcgtgcgctgctgacgggcgggtccgcctgccaccctcgctgacgggtggggcccacccgtcatctccttcctcccgccgctcccgccgcctcgcccgcgcctagcgccgccgccgccgcgaatcccgccgcctccggccgttcccgcgtgcaataaagtggggggaaatattccccgtgatcccctccccctttccccccatttttccctctctctctctcgcatacaaacgggcggatttgctcccgcaaatctcgccggcgccattgatggcggccggacctcccggccggtttccttcctctcccggccgccctctcccccttccaaccctatttaaaccctccccgcgcctccctcgcctgtatctgccccttgccgcaccgttctccctgccggaatcgagctcgcgccatccccctctctctcctccgtcgcagacgacctccggccggccctctccgctcgccgggacc

SEQ ID NO: 12351 - DNA, 13149 bp, Oryza sativa
  unsure (1)..(13149): unsure at all n locations
tcgggcgcgcagagtggccgccgagtggggcccggccgtcagccgcatacgccctcgggtgcggctgacgcgtggggcccacggcgcaggccggtgtgagcccgggagcgcccggtccaccgtggaccgtgaggctgccgcgtgggccccactcccatggacccggtccgcgcgccctctcccctcggctgacgcaataaaccatttttaaattaaaatttaaatgaagaaattcgcaaatattcacttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagcctttttcctttccattggtcgtgtagacgctgcagcttcggaagatccgctcttcgtgaaggttgaagccgacgtttgggaaagtgatcaaggcaagtcacatcatccttgaacatattgaatcccagtttataaaattattttgatttaaattaatgcattatcgctttatttaaattcccgcgttatcactgttttatttagccatgcctatttacctttgttatgacctaattattattgctattgttattattaccttgttcaccctagactaaacaaaacccccaactagtaggtaccctatgcatggtaccactagtatgaatttaggtagatgcttcgctgcttaattaagcaacattaggtggttttacaactctagactttgggaatgttcatatcacctagacactatggaatggttggattattgtggaattggattcacacctccccctctattcaaaatcctcaaaatggttttaggctgggctcggggtgcatggttttgattgtagcacctcggccacataaggaccggtcttcgggcctatgttgcaaagcactaccgtacttccacatgtctagtgggtaaggcttagtttgtggctcagtctggttataaacaaaagtacacggatggagatggacgaagtcaggggtcgatggacatctctagggcaaatgaaggctacacgagctgcggcccggtagtcgagatgtcatggcacagggctggtgtcctgctgctaggggctcagtcctgcctacctgtcccagaggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgattagagtataacctattcgaatagccgcgccctcggttataggcaagcctagcaatgtacccaagttagtgttttaattcttaaaacctgcttaacaactaaaatgtggaatggttggcctgggttggcttgggacgagctgggacccagggtcgggttgccagttcggtctgaatcatcgtaggtcttgggttaaggcaggttcgtgtgggttcacggccttgattaataatattgcatagctctaggatcgtatttacaaaatagctttgagcaactaagtgtcttttaatgctgtttactgcaaaccctaaccccctatgttataactcccttgtactcccttgcatttattctgcacttgtgggtgtgtcttgttgagtacggtggttgtactcagtcttgctcaatttttcccaaacccagaagaggagttcctggaagatgaaggctttggtgtctagctcgtgcctgccgtcaagcgcctgtggtcgtcgccctagtcttccgctgtttttttcgtttgtcttcctgtgtgctgggccttcgccgcccatgtaataaattatctatttacacttccgcttgttaaactctgtattgtatcaacttttggtgtaccttgcctcctgggacaaggaataatacacgcacgtaaggaacgcccgttgggttatttccggtcgtgacatttacccttcgatatacgttacatatcgatatggcatacccacgcgcatgcggatatttcctgtatatcctaaggaaacttttcacggaatctacagatgggaagaatcctactcgggcagaactgggtcgttggcgtatcgtatagggtctgatacctccgagttctatgaggagacctccacatctgcgatataaaaggggccccccggggagggtttaggatcgaatctcagacccaacacaacctccacagcctacgaagccggagcttgcgaggagccaagtcatcgagagctagtcgaatcaactcgactacaatctcgccggatccgacaagttcccttgttctctttgtaacctgtgttttttaccatataatcccacatcaactggattagggctattacctgtcaaggggcctgaaccagtataattcttgtcttttgtttgcttgatgtcatactacgtagatccttgtatcaacgtaccccaataccctctatatccagtctacgggtatcacccgtcgacagtggcgcgctaggtagggggccttggtacttaaggttctactactatgtcatccagcttcgtcgacaacaacgtcagcaccagcctcagccaagtactccctgcttcaacaatgctggtatggactcaagtcggcgaaatcgtcttcccggtttacaccacgacaccgatctcaaccggtcctccaatgaccggagacgagaacgcagtggctacgaaccaaggcgattccatgtcaaaaaatcctctcgtcgagacggagaacggaatatcgacgacatccaagctcaagagggattctgatacggccaaaccttgtccttccgacatgaaccacgagccgacaaagatgacttccgaagccacaaggtcttggtgtcctatccacaaaaccaagaaacacaccttgcaagattgctgggttttcctcaacgtccgtgctgaaattcgcgcctgcaaagaacgtggaattcagcgtacttctccaactcgggatgtctattgtcctattcacaagacaaagaatcaggacctctcgagctgcaaagtctttctcggcgccatgaaagctcagtctcctaagtcatatgtccccatcagggataatgacaaggaacaaggagtgactccaacttcagatcgattcgttggagtaatcgatatcgatcctcacgaaccatcggtcttacatctcctcgaggactatgggtcatcgacaacgagcacgccgcgggaggtattggctatcgatgatgttggcacgtcagcgcacgccaacgcagaagcggggaaacaatcgactactcaagcccagcacatcaggcccgttcaagcgatactgagggaaactccttacgatcccgttctgaacgttgacctcgagcgttggatagaacgactatgggaatcggtgactaacctcagcaacgcgtttgaagaagccgctaccgcagcacaccaggagcagccaccaactggcgaggccaatagtgaagatccggaacggagggaatcacctcaacgagctaccccttcacctcgcggcactggcgatcttcgagatcaaatcaacggccgccgggaagcacgacgcacacgagacaacgtgaatcgctcttgacgtcatgtctcttcacggcgccatgataacggaaatcgaggagactgctcaaacgaggaccgggaccacgacaaccaccacgatcacaacgatcgcgaacgacgggtgccagacaatactggtcatggccgccaccgtatcgacgacgacgatggagatcggcgccgagacaacagtggaagacgacgacaggattctcgagatccaggccgtcatcctcgtaatcgtacgccggaaccaagtgacccatcgtcatcgtcatcatccgcgtcctcctcatcgtcagacagatatccacgaaggacacacgatcgccaacaacccaccgccccaacgctgggtgtagggctttcggtcgttccctacgtgatgtctgatggtctgagagattccgacccggagcaatagaaaagtatgatgggagcaccgacccagaggagttccttcaagtctactccacagtactctatgctgccggagcagacgacaacgcgatagcgaactatttaccaaccgcgttgaagggttctgcacgttcatggctgatgcatcttcctccctactcaatctctttgtgggcagacctgtggcaacaattcatcgccaatttccaaggaacatacaagcgccacgcgattgaagacgacctacacgcgttgacacagaactcgggtgaatcattgagggaatatgtttgacgtttcaatgagtgcagaaacacaattcctgaaatcaccgacgcttttgtaattcgcgccttcaaatccggtgtcagagatcgctacactacccaggagttggcgacaagacgcatcacaatcactcggagattattcgagatcgttgagcgatgtgcccacgctaatgttgtgctaagacgcaagaacgataggccgaagaccgggggagagaagaaaccagccacggacacatctgagtcaagcaagaagaaaaatcgcaaaaacgggaaaatgaaagctcaagcggaagtcctcgcagcagaatacgcaaaccctcccaaacacccagacccacaaagcagcgacacaaagaaatcatggtgccccatacacaagacggacagacattctctggaagattgccttgttttcaaaaagtcgctcgagaagcacatggcatttgaaaaaggcaagcgagtacgcgttgttgagacgaacgaagagacggctcctcacgaaccggactcagcgtatctagactccaacctccacgtctcacacatcttcggcggttccacaacgtactcctctaagcgagaatacaagaaagtggaacgtgaagtctgctcgacatggcagggggctgcccccaagatgaagtggtctgagcagaagatagagttctcggaagaagaccaccccaagaccgccgttatcccaggatgatatccgatcatggtcgaacccactattcggaacatcaaggtagcgcgagttctcattgacggtggcagctcaatcaatcttctttttgccagcactttggacgcgatgggaattccgcaaaacgagttgacaccaactgatcaacccttccacggaattactccccaatcatcgtccagacctttgggcaagattacatttcccgtgactttcggccaagccaacaacttccgaacagaacagatcacctttgatgttgctgaattcgatacagcttacaacgccatcatcgggagaactgcacttgcgaagttcatggccgcatctcactacgcatatcaagtgcttaagatgccgggaccaaagggaacaatcactatttaggggaacgcaaagctggcggtgcaatgcgacaagcggagcctcgacatggtcgagcaaacgcccagcccacccgccacgactgagccacccaagaaagtgaccaagacaaataagacgccgaaaccagacggcgccatcaagattgttccactctccagttccaaccccgacaagaccgtcaagatcggggcaacactaaacgagaaatagaaactcgcgctcatcaccttcctccgcgacaatgccgacgtgttcgcttggcagccgtccgatatgccgggggtccccaggaaggtgattgagcacaaactcatggtgcgacccgatgccaagccagtaaagcaaagactgcggagatttgcaccagaccgaaaacaagccatacgagaagagctcgacaaacttctcaaagctggcattattagagaagtacttcatccagagtggctagccaatccagtcatggtgcggaaggccaacggaaaatggaggatgtgtgtcgacttcaccgacctcaacaaggcgtgccccaaggatcactttccacttcctcgaatagaccaactggtagattcaacagccggttgcgagttattgagcttcctcgacgcttactctggctaccaccaaatcagcatggcaaaagaggacgaagagaagacagcattcatcacgccgtttggggtattttgctatgttaagatgccattcggactgataacagctgggaatactttccagcgcacggtccagggcgcacttagcaaccagcttggcaacaatgtcgaggcttacgtcgacgacatcgttgtcaaaaccaagacaggcgactcattgattgacgatctgcgggaaacgttcgacaacctccgacgatatcgcctcatgctcaatcctgagaagtgcacgttcggagtaccgtcgggcaagctgctcggattccttgtctctggcagaggaatagaagcaaaccccgagaagatcaaggcaatcgagaacatgaagtcgcctacaagactcaaggaggtacaaaaactaaccggatgcatggcagcactaagtagattcgtcgctaggatgggagaacgaggacaacctttcttcgctctgttgaagaaacaagacaaatttgtatggacataggaagccgaagaggcattcattgcactcaagtgctacctatcaaacccccctgtacttgttgctccccaacctaatgaagaattattcctctatattgccgccacgccacactccgttagcactgtcattgttgtcgagagagagaaagtacagcgactagtttattacgtcagtgaagctctccacgacgcaaagacaagatacccacagatccaaaagttgctttacgctgtcatcatgacatcaaggaagctacaccactattttcaagcccacagagtcacagttgtctcctctttccctcttggtgaagttgtgagaaacaaagacgttgtcggccgcattgcgaaatgggtagtcgagctgagccagtttgatgtccactttgtgccacgaacagccatcaagtcccaggtactcgccgacttcgttgccgattggactatgccagataacaaattagacaaccaaggcgacaatgaaacatggacaatggcgttcgatggcgcactcaacagccaaggagcaggggcatgatttatcttgacgtctccctccggagatcaattcaagcacgcaatccacctcaacttcagggcaaccaataacactgcagaatacgaaggactactcgccgggatacgagctgcagctacacttggggccaagcgactaatcgtcaaaggggactccgaactagtcgcgaaccaggtacacaaagattataaatgctctaactccgagttatccaagtatcacgcagaagtcaggaaactagagaaaaagttcgatgggatcgaggtccgacacgtctaccacaaggacaacgtcgagccagacgacctagcatgacgtgcgtccagacgagaatcgctcgagcccggcacttttctcgacatcctgacgaagccatcggtgaaagaggttagcggcaaagtcagcccgaacacccccgacattagctcggaggtcaccgaggcagaacgcgccattgccgacatcgaaaccacagacgactggcgcatcccactaatcaaattcatcagcagcgaggggagttgcccgaggacgatacagaggccgagaaaataacccgtaaagcaaagatctactgtacggtcggcaatgatctatataagaaagcgccaaacggggtacttctcaaatgcgtctcgaccgacgacagcagacacctcctcctcgacatacatgaaggcatatgtgggtcacacgccgccggtcggacattggtcggcaaagcttttcgacaaggctttttttggccaaccgcccttaaagatgcatgcgacatggtccagcgatgtgaagcctgtcaattccacagtaaacacacaaagctacccgcgcaagcgctccagactatccctctgacttggccattctcgtgctgggggctagatatacttgggccattcccacgaggacagggcggctacagattcctattcgtggcgatcgacaaattcaccaaatggatcgaagcagtacccacgggggaaatcaaggccgacaacgccatcaaattcatcaaagggatattttgcagatacggacaaccacaccgcatcataactgacaacggctcctagttcatcagcgccgatttccaggactactgcatcgggttgggggtcaaaatatgcttcgcctcggtctctcaccctcaaagcaatggacaagtcgagagggcaaacggcatagtattacaaggaatgaaaacccgcgtctacgacaggctcatgtcacacgacaaaaggtgggttgaagaactcccatcagtactatgggccgtacgcaccacaccgacaacgtctaataaggaaacacccttcttcctcgtgtacggctctgagaccatgctcccaggcgagctacaacatcagagtacacgagtacagaagtactccgacaagaaccaggaggagtagagagatatcgatgtaaatcttctcgaggagcatcgggaacgagttgccgtccgagcagccagctatcaacagaccctccgccgttatcacaagaagcacatccgtgcacgcatactttcgatcggcgactatgtcctccgacgagttcaaagccaagcagggcgaaacaaactctcacctaaatgggaaggaccttacacgatcacacaagtcttgcagccaggcgcattcaaaatcgtagacggcgacggtcgtgaattagcaaattcttagaacattgaccaactacgtaaattctatgtatgagtcaataccatccatacctgtaagcacccttacagtattaataaaggctatttctaggcccatattacaatcaacgtgtttcccccgatgatccctcactctgatgacacctagtgttgaaacctgtccttatgtccctttacgccgtctcgacaaggcctctgaggaacctaagggatcttcggctggggacgcccagagccgataaggccttgtcagatcctgtagagacgaaagaccatataagatctggtcgtgtaagagttctcgccgtgcgtattaaccaagccgtgaaatcggaaattaactttccaacttcacggctgggggctaggatcaaagcttattcaaccaaggcaggtcaaaggtccaagagccttatcctccgagaaaattcctccgacgacaaggctgggggctagggagagtgtacgactcaaacggctgactaaagtcgttaactgagaacgcactcttacacatgacatccagagtaagagacatttgtcaaagatagatttctttattcacaaaatactccttacagttttttcacaaatctttcgctacattacatcttttcctaagatatttgtcatagggtacgagtactaccaagaaggccaacgccagtccatagactagaagatcttctcggccaacgacgacattgaccttgccagatggtctatctccgccggagtccttcgagaacgagcaaaaccctcacgaagatattcgaggtccaggcgcgggcgatgatctcgtaggcaagccaacacgtgccccccagcatatcggctcgatcgatgacactcctgcttcaaggcctcgtcgatacgctttccgattccatcgagttgggcacaggccccattaagccacgagatgtacccggccgccgactcctcgggatctccgcggactactcgaagctccctgcatactctggccatggatgtgcagcaactcttcaagtacgagttaaaccacacctcacgacctcggagcgtttccacagtctgctctttcttcatggccagcatggttctctcgagctctgccacttcaaacttcgtcttccagtattggatacaacgatcttggctagcaaggacaccctcgagatctgctaaacgtgataaccactaagtcaagctatacatctctttcgggatatggctgacctagtcaggtgggcattaaggggtgaagggactactaacctgaggaagtcgtcgccgtccttccctctatatcaaggggttgatccacatggtcaggcgagacgtgtggttcaaactcgagtaccggaattactgccagtgactcgagctgcccgcgctgctggacatcctcgtgatcagtatctctacagaggacaaaagttcccgaggtcagcataccaaagtaagccgggatagtaatcgcacgcacgaaggcggtcagagttcgagttttacacattatctaggaaatacaagaagtcctactcttcaaaaagggggagaacagactcccccagatcaccgacttcttccatcacctccttacgcgtgtcgctggccgccccctggtccaagatctcacgcagatcgagttcaagacgcgacagccttacacacgcgaggacatgacacgccccggtgtagattccgtttgacgtctcctccgcaatcctagccgcatgcttggaggggatttcccccatcgccgtcaccaattctgcgagagaggaggtcagcgaaaactcatcgggattcaccgggatcgtggacgtgacgccgcattccccgacgagctggtgaaggctagtgtaggtgaccctcaacgagccccggatctcagataggttgttcccgagttccgacattcggtcctcgagccccttccgttgtcgctcgttgccggctgccaactccctcatcttcgtgaggtcttcacgggcttcaaccaactcgcacaccagtctgtcagcacgcgcgttcgccgtcgccgcttccgacctcgcctccgcaatctcgcggtcgatgccgcgagcaccggcttcgaggaggcgccccatctcgacttggagctcctcccaggtgaggactgcagctggcagatcacgacctaccgcggggtcgctgactgggccactaggcatcgcctcccggctctcggctacgggcacgacatccgttgaggccacgacgggcgacgcactggaagctcctctagacttggctcgtgcagcctttgtccgcgcctccctacaggacgaccatgagtcagacaataatcgaataaaagcgcggggattcaagaattcatctacttacttctcgccgatcgtcacaatgcgttgtcgtcgtggaggtgggggagacgcgtccgaggcctgaaagacaatcaacgcaaagtaaggaaaaatccttcttgctgcatgatttaacgacaaaataaattaccgagggggtcgacgccttgcgacgatgtccgcttacagacgagaatttcctcggctttgtcggaacattgccaccgctagtggtggcagcatcagacacctccttgacgaccttcacttttagagatgacgccacctgatggtccgcgagcggtccgatgacatcagtcaaaggaagagcctacgctcaatcaagtcataaagtgatttcgaaaggagaatgcaggatgtttatcgaatatacttacgttgatggctttatcacgttccgccgcccccttttcacaaaggggcacagggatgtcactcaccgtggtcgggccactgatcatcacttggccgacgcggcgctccacggttttgccgctcagacctgttaatcgagaaccaaccttcgataagtcaagaggaatgcaaacacaagtatgtcaagataaatgcgagaaagataccccgaggagaaacccgggtcgcgtcctctgnnnnnnncctgataagctggatgggcccgagcctgaagcggctggatccacctaccaacgaagtctgcaacgacttcatatcccgacaaaccccgtactcggagatcgtcgatgatgtcgataaacgactgaagagagggggtcaaggggggctttgcggtccaagacggaatcttatccggttgatcttcgggaaccacaaagacagggttcgagttcttgatctcaagataaaaccacctattcctccacttgctgcgagaagaaggcactggaagggaatgtaacgcgacttcaggccatcccgaagtcggaacccgacgcaaccagataccctgttggattccatccaacacagttcgtagtaaaagcgaaaaagatcaaggaaaggctctaccccaatgtaggcctcgcaaagatgcacaaagatgctgaggaaggcgatggaattggggttcaaatggagaagagaaagaccatagaaattcaaaaccaggagaagaaattcggaaggtggagggagaaaaccgcagagaacataatcttcgatcacaaccatgcgacccaagatgggctgaggattagtacctcatgcttccctctccatggttccacagccaggaagagtgccatcctcctggagtttcttcaacgttgcactggtggaagccgatttgccgaggtccattgctgatcgaaggtcgccggaaaacgagcctaggttgacgaactagggtttcttgcggcggctgagaaggcaaagagttcttggaggtggtgcgtgtataacaggtttggcggacttcaaaatggactcccaaaattcctttaaataggcgcactaccgacggtgcgaattccagggaacagagagagatgcccaccggaaatttctggtcccgttacgcgcggcggttttttggacttcagtttaaaattcgctcgtgaccgttgggcttcaaatggcgtgctcgactacggtctatctccacggtcctcgcaccgggaatgacaacagtctcgacacccgaagtcgcaaatggttgcacgagttcattttaagcagaagtcggggactactgtcagggttacgggttaggcataccctttacccttcgatatacgttacatatcgatatggcatacccacgcgcatgcggatatttcctgtatatcctaaggaaacttttcacggaatctacagatgggaagaatcctactcgggcagaactgggtcgttggcgtatcgtatagggtctgatacctccgagttctatgaggggacctccacatctgcgatataaaaggggctcccggggagggtttaggatcgaatgttagaccc

SEQ ID NO: 12352 - DNA, 6638 bp, Oryza sativa
agccaagtcatcgaaagctagtcgaatcaactcgactacaatctcgccggatccgacaagttcccttgttctctttgaaacctatgttttttaccatataatcccacatcaactggattagggctattacctgtcaaggggcctgaaccagtataattcttgtcttttgtttgcttgatgtcgtactacgtagatccttgtaccaacgtaccccaataccctctatatccggtctacgggtatcacccgtcgacagtattaaccgccaccaactctactactttataggcatgttacttaatttatctcgtcatgtgttttagatggtcttttctttcaatagtctttatttttatcacaaattttagttgtttataaattttattcctaattaaaatattttttttctaatttcagaatttatttttttctaaaaaaattagttaataacgtattgtgttcttttaatgtttttattttttattttgaattttagttgtttcaaagttgtattcctacttgaactctgttttaatttttctatttttggatattattataattttatttgaaattttaattaatctcgtgttgggttcttatatggtttttctttaaatattgcttctttttaattccgaatttcagctaattttaaattgtaatcctacttgaactcttctttattttcttttgctaatttcagatttatttttatttttattctgaattttaattaatctcgtattgggttcttatatggaatcttcttttaatattacttatttttaattccgaatttcagctatttttaaattgtattcctaattggactctctttttcttttctaattttagattttattttatttttatttcaaattttaattaatatcgtattgggttcttatatggaaacttcttccaatattgcttatttttaattctgaatttcagctatttttaaattgtatttctacttggactctcctttccttttctaattttagattttattttatttttatttcgaattttgattaatctcgtattgggttcttatatggaaacttctttcaatattgcttatttttaaatccgaatttcagctatttttagattgtgcttctacttggactcttcttttctttttttttctttttctccgattaatgtgggaatttctagcccccacagcgaatgtggtgactcctttcaaagctgttttaataatataatagatagatagattttttgctgtgaatctggacaactgtttatccagatttatagctaaaaatgcttatattttgggacagatgtagtaattatatatgtattacatattaaataaattgattataaatgatttagaggtatttcctgctatacttgctctaaagataacaactcagataatgatgagctagtggcaagcgcaaaatggaagttaggaggacgaaaatatggttccaaacagaaaagccaaaggctaggatttattctaatagcgctttaagatacgtgcaggccgcaacaccggatcgaccaaaatccgcaacatgatatcggaatccgcctttgcgaagcgcggcggcggtgaggtggtgtgggcacgccaccgtcggcaacgacgaggcgagtagccgaaacggggaggaggaggaggaaacggaggcggagggaggcgcgcaggcgtctgcgccgatcaggtcacggcgccgctctggaccctccggtacgtctcgtctcctctgtcctttgcttttaatctctccgatcagggaaggccaacgcgtccacgctacatactaaccctcgcgtaatcgaaatcagtccaaagaggcgtcaattcctaatccaattcaaacgggtggagaggttaaacctagatcctactccaaattccgcaagccacagccgcacaatccagatgcagtttactgttcagagctggtctctcaaagtctcaacccctttttctgatttttctccatgatccccatcctatccacgccagttcatcgagcagtagcatatttctatctacttctactgtgtcctattaacaatttggcggcagagctgactattcctttatgttcttcatttgggttgcttggagttggagaagagattaccccaccgtttgttccatgctgctgtattttccaaaaatcatgctctcattggcttcccaccatttctgcgcctgatcctctccaaagtgcttccgactgcgagattgaaagagttagttattgcaaaggtaagacatgatgccatcgttgacaactgattgattataatctaggttcttgggggatctcacctgaaccggatgcgcttgatgcacttcttcccaccgggggatgtaaccactgtcgcgtaaaccccgcgctcgatctgctcgatcacaccgttggaatcggtaggagcagtggtggcatctgttccctcggtgcatctggtgctgccgttggaagttcttctgcaattctgatgcgtaaccgagtaattcgccatggaagcaattgaaggttgtgtgcattccctatccacctgcctgctgttgtggtgatctctgttgctcttcgactgttgaaattcgctggtgaatacatttttgtcaggtgggtctggtaattctgcttttagtgattttgcactggcgatgtggctaggcatgattctggagttgtctaatttctcaccagccaaaaggttctttgataaaaaatcatgctgcacaattgggcaccccacacaacttatttagaaaaaaaagccggtaaatctgtcaaatggagataggtcatcggttttatacctgatcgatcaaaaccttaattatgtctttagcagctttgcacttcgcagcctcatccttggcaattaaccaagtctcctcgacttttcgtttgtacagctgaactttcaggctcctttggcggcactgttttgcaagagtagttacctgcttatataaaacataatttccatctttatcactaaattatacgttgcataccagaacaaacattcagtgaaaacaaataatttaaacagatccacgaaacatgtttattacagagaatatggtatgtcagttacctgctcttgaagctgtttcacttcttccaataatatattttccatcaagtctaattccgcttttgaatcattagcagatttgagcaaagagctggcaggtttaggtgccattgtctcattcattacccgtacaatagaaccagagactgtctgtttattcaatgttgaacaataaggaatgctctctctcacacatctgaattgactggggcactctactaggccccatcttaatgtcctcacatgatctggcacagccaaattctgacttctctgatgggggctttgtgctgatgccattttctccataattgcatttgcttccttgaatatgcgcgccaattttggcgtatatgatcttatttctattggacatacctcatccttttggatcttctgttgtggatctaattttctatgctcctcaactttctgcatttgactgaaacatgcatcacaaacacggtaccttttgctcctatctggtgcaagagctgctctggaaaccttgttattgctgcaggaattgcagaacatggaaccacagttgtaacagttgtgcttcttcctcgtaaagccaaatgttagctggcagttgctgcacacagattggtccttgcttgagagtggcctatgtaaacaaattgccatagtgaagttgaaaccacaagctatactatgcacctgcttgtcttccaaggcctcgaccagagtcgggtagctcctgtcaacatagtcacctaaaccaagttgcccttctgttcctttgccccatgtaaacacctttccattcattgtcaaaactgctatatgtgaagagcctgatgatatctctctgacaaactctgtcttaagtggcccctcaattaaacaaatagatgtgtcctcagacagagggttccctaatcgtccgtgttccttgcttccaatggtaaaaacaacaccggttattgtaagcacaatggtttgtgcttttgcacaggatacctgagcaaaatcaaaatcattgagtggctcaacacaagttggtacaagtttcatctttttgtcagcatgacccagcttccctctatccgcatcaccccatgtgaacagcttcccactaggagcattgctcttgacagtgcccattctttctacaatagcagctgtgtgccatggtccacacgcaatggccttggctcgtacccctttcagggactccacttgtttgggccgagcaacggtcagcgtgtcaccatgtccaagaacaccaaaggttccatctccatatgcgaagagctggccagcagaggatatgatagccgtgtgccaatgaccacatgcaatcttcaagattgagatgccatccaaaggaccaaacaatttatgtgggaaccattggcttctttgatactgatcaccccacaaacccaagcagtgagtcccttcaccccattcataaagttctcctgaaattgaaactgcacaggtgtgctttgctccaaatgcaatagccttcactcgtgtagaggcaagagactcgataattttaggatctgatacactgacactcactttgtgccccaatctcccaccattatccacaccccaggagaagacctctccctgcttagtaactatcgctgcgtgtttctctccacaagcaacgctctgcacatcaataatatgtgtcgtgtttaataaccttggaagtgaaacattggcttttgatacatctccatgatctaaaacattgccaggaacttctccccagacaaagatgtccttcagagaagttgctccatatgcaacatgtaacccctcagatgatttttgtttaggcagttgggtaattatttgctcgttaagtttgtcagcaacttttatatccctgcaactgtgttttaccctattaaccacatcgggagtgaccttttccatgtagtagtctaggtctgaccatgtcctctgccttggagagaagaatggttctgagaaatccagattgctttgcaaaacatttttctgcatcagcctaggactgccatatattgagtgtaccttgatggagaaatcatgtagaaaaacatgtcatttcaactaaaaaggtgaaacacactttgtaactgagaacatagggcaacttatgaccaatcgtaggtcgtatcgctctacttagtttcatgatttgcaagaaaaaaaaagaggtgtcgcttatcatttatgcaaaagtctgtcaatgtggttgtcatttagctgtatcattattgttatatttggataagaactaattagttgaaatgaataatatttcaacacaactagcatgaccatcatttgaaatattacatatttacaatttcctgagcctatggatcaaatcgtgttacttagcataacttaggaaaaatcaaaacacacttgtagttgtggtaagttgcaaaattatcacatagaaatcacagcatgcacaagttatagaatgaacctgtttaaactttcttgtgtcatgcacagcaaatagcctactcctttgctgaatatagctaggagggctatttgtacagctgtttatccgacggctacttgttgagtcaatcaaaagtactggactgcatggaactgatagtaaggttgttaggcctatataccaacattcagcttgatccctatctttgcaaatctgcgaaatgtgatttagaaaaatgttacggaaggtaataatgtgaaggataaaatttacaaagtctaaacaacaggcctagtgagtaaaaataccaagtcaagtgaacattcaccattcttgtagaagactgacaatgagtgggattccttttctggccaatgcagacgtaaaagttttgtctgtaaaatactagaatcctcagaaaatgaacgtgttctatccttaatgatgtactatggacaaagaatagcaatgtgcttgagaaatgaaaaccacatactgtcttatgtccaagaactacacttgagacagagctcaagttcaaacgcttttccctgtctttggaataccacatgagcattttctcatcctgcaaaagaagcatgttaatgttatttagaggcacagcatcttgaattctaatgttttaaaaagataagacgttaatgtgcagtttactcaatctacttatctgaactggatacgttccatgggaactgggaagaagtagatattgcagacctaattttagaatatttaatattcaaacatcataccttgttgtgttcatagtgttacaatcttctctacattacggaaattgaattgctaatttcagaataaaggatggatggtgggagtgcagagagctagatttggagtaatctactgacgtagctgtatgtatggccataaatgttaatctcattgtgacatgtcatctgtttatcagcggtgggaaaacaaggaacatctttgaaaggttgcggaggaacatcgtgagatcttgatatgcagatagatgaaggagaagtggataactgggcggaattcatctaagagttctggtcatggc

SEQ ID NO: 12353 - DNA, 7335 bp, Oryza sativa
atttggaactttgggcggccacagaagcaaatgtcatgctcgctcaacatcttggaaaaaaaatgacgtgcatatagcttactatatcctgaaaatgaaataatggtgtctaatactttctcaataagaatgcagtgtttattggctccttgaagacaaacaagaagagcaaatccatccaacttagcaaagatgcattgttggaattgtaggagagcaaaagaagaatcattggcataagcatgaatataccacaatgctttaaaagaagatgcaaaagaaaaacgcttcatgttgcatacctgctcgactcctctagctgcagggctcctcccctcaaagctcccagccattgcagccaggaaagacgcagcaaaagaaacggagagcgatgccttgcccctgagctgagctcaagttcaaacctcctttgatcaacagtgggagaaagcaaaagatggcagcaaagtgacagaaagaaagaaccacgcaaggaaagaagcaaagcaagagagaggacggacggacgggggcagagcttgaggacggacggaggagggagaagaagcagcaccgtcactgaaggcgacctgcgcaattcaggggccccggaaaaggaaacggtggcaattttattaactgctgggtttaaagatgagagaggcaggcagtcagtcttcgttcgacacaacctgcagaggtaaatcctgttctcccttttgattctgcgcccctcgctttccgtatattttctcttgggtagtgctagtgcggcatctctctgtagtttgtgacttcgagtgtaccgaacagcagtggcatttagctttcctctgttagcgtgagtaggcgcttcagaaatcttggatttcatgtcaaatctcaggatttgccacaactgcatgccacaagccccggaaaacctggtcactgccttccttttccctagcatctcttcatcagtcggtacattaaactacctcagttttgctgaaaatcttgcataattggatcatccgatctctgattaccatgatcagcatttctcaaagaatgcatcgaataacagaattactccactaccgtaacaaccttacattgtttaaaattcacgggcatccgatctgtctagggtggccagttaaccatccttggctccttgcccagctgtggtccagaaacgtggtactagtatcgtgatcatgagtttggacgttttagatagtaatgaggttggatttgcagaggcaagcatccacgcactgctgttaggattttgggacagcacatgatggtccgaaagaagagacgatggaggggggtagtgatgcagcacgtgtgcagcgtaggcaggcgctgcccccgttctggcctgcacaactgtttggtcactcctgtctgcaaatgatgccgtctcggtcgcttttgctgacttgatcttgctggggtacgttttttctctccctttttctccaacgagcagcgatcgtgacgtcttcgtagctcataatttcgtattctacctttcgtctccccagtactgtatgtatcagtatcactgcctacaaatgtactatgtctaccggtgctacgtgcatttatgcgctcacctttgctcacgacatgtctattcattgcgcatttatcctattgcagtcgtactgtgatcagttgtactgctggtgctgctttggtcgtgtgcatccccaaggattttctgcggtgtccactgatcaggtaggagttgaattcgtcaccttgttctcgcaaaggttagtgttagtgtttttgcaagggtagattgcttattaacaccagtggtcatggagccatggagatgcttaaggtgacgatgttgttacagctggaagtgaaaagatggatggtggggaagaaaaggtagagaaggcaagtaggcatgtgaaagcaccaacgagacaagcatgacgggccaagggaaaagataaaacttgtcctgcctcctcaacagcagtaaatgtgttgatttgttccccttgcatttcccgtgtagcgtcatggcattggcagtaactcgtggacgatttctctagcgattgttacccgctgttcatgctcaaaatggcaccataatcttatacacagccctactcttgttctgcagctatttgcacttgttctgcacctacggtctcaaaaaaggcatatttgtatgcctcctacacgggtaaaaacaggtgcagcaaatagtaccagtaagtccaaattaacccttttattactgtggatgagacaaaatgtaggagctagctgtctgctggcatgtggagtgactggaaggcatggcatgtgaaacttgtgaagccatacagtacgaagtaggtgaaaaacatacacatcccctcactgggtataaagtttgatttggcctaaattgaggccggtggttgcgctactcgtaggcacgtactacatacatcgggcacggtcccgaataattgcgtcaaatcggtcgctggtgattggcacaatggcacgtactaggagtacgtcttgctgagttcctgtcatgtgacagggttctgtgcaactcggtgttgttgtgatgccattagatggagaatttaggacgtaatgcctacgtgcattgcaccatttactttctgtaagtgcatgcacctcggcggaacctttatgagaggttctctctttggaacatgcaagagtgaattagtggacaataatgccaacattggttaatttagttagtccatgtagctcggacacatgccgcatccatggctgatggctccaccgctccatgtatcaaattggcttttcgtgcatgcgatgagttgctagtctcctcaactctctcgctcttagaaggattatattgcaattgtacgtttgtatccattggatgcatacacgcgcaggtgaaactttttttttttgaaattttgagcagatgaaagtgaagaacagcatgcaatgcaggggctgatccgtgatctttgtacggagttgtcaaaatgcgcctcaaagctgtccttggattatacacagatacacttactagctgtgtccacgcataaatacatacgatggcctacgcggctgtccatgtcctaccatcttaggttcacaatattgatctgttagccatgtaggagtaagactctgtttggtttccaggacttattccaagtctctgtcacatcggatgtttggatactaatttagagtattaaacatatactaattacaaaatccattccataagcttggactaattcgcgagacgaatcttttaagtctaattacgccatgattttgacaatgtgatgctacagtaaacttttgataattatggattaattaggcttaaaaaatcgtctcgcggattagctctcatttatgaaattagtttttttattagtctatgtttaatactctaaattagcgttcaaacatccgatgtgacatgggctaaaaagttttagtcccatctaaacacttcccgaggagtagggacctctcccagctcatgacatgcgtccttgcttggagtgtgtcctagcggtaataattctatgtcaaaagaagcaccgctggagtgatcagagaactgcacgctctcgctctttgaagcactgcatgcgtgatgcgtatgcgttcgtgttgggtcccttctaatgagtagtgatccatggtctaccggcaaagcctagtactaactcgcaccagcataatcttgatggtcttttattagataacaagctactagaatacatctttgatctctgcatcatcagtaattcatataaccataatctcgatctgtgcctagcatcatctttgattctttacatagaatccacattttaacgaatggcattcgagttattaaggcctacaagttcagatgggttgcatgctgggtttacaaaaccgcacgattatcatgcggttactatgcatggtaacattttcagtttttaaaaccatgatatgtctcgcggttaccacacagttttcacggtaaccgcgcagttaccacggtacgtaaccaccttaccatgggggtgtgataaccgcgccaataacaataagggaaaccctggttgcatgcagagtacagtagtttgagcagcagcatgcatgggaaaggaggcaaacaatgaggtggaaaaggagggacacggatgatggccgcggtttcccgggcacgggcacggccacgcgtgccggacggggcgtgaacagaagccgcgcccgtggtgccgggaaggaacagcaacagcctggcccggcatcgcccgtaaatggagagtttgggtacttgggtgggtcaccggcggctggaccctcgcatgtgcatgtggtgaagaaaatggagtttgtttgtgtggtctctgtacttgcttgtatggttcgtgcgtgtacatgccgagcaccctggttgctcggtgaaagctttaattggatcacgcgataattctcactttacggattgatttgtatataactactccatccgatttcttaattcttgattgatatttatcatgttttagacctgggttaggaggagaggagaaaaggcatcgggtgcatgagaaggaggcggagttctgattgccgtgaaaaaaaagacatacgtattagggaatgacctaatatcaaataattagaaggagtgaggctttaaactcagatcgtatagcccaccaccttgtgaagctagccggaaaacccctgggcgtttctcatttagatcaccaggataccagccaccttcatccacctagcagaaatgaatgcctggtacgagttagggaatccgctgttgtcttcttcctgatgcttcgccttctcaattgaccttctctatgtatgttttggcacgcgctggtgatggtgcatgtgggtagtgggcggcggtggtatcgggagaggaagactgcgacacctgatcttgaacaagctgtcgcctatcactgttcatggcactggcatgcatatcctccaatcctcgacccgtggaaaggtggtgcacgaccagtgtggcacacaggctgtgcacatccaactgtcgtcccacccaatagaccctgacgtcagtctccgtggctccctttgcaccgagctcctgccgtcagtcgttttcattgtcccaccgctaggtcttgcatcaacttaccggtccatccccatggcgcaagaagacctgcttatggcccctggtcacctacaccaccatcgcttgtgctattcctcggctcgttatcaaggaggaccgacggcggtgcgcacctcgtgcgaaaagcacactactaggaaaaccattttcgcaaaacgagacccttccatttttctaggcgggtatcattttcggaactaaatgtcctcctgtgaaaacggcaacgggggatgggatgctcgtccgcctgtgaagatgcattttggtagacagacgaaaatgcatcttcgcaggcttttgcttacaggtggaccggacggccggtccacttaggaaaaccgttttcatccgctggaaaaaatagttttcctagtagtggcagatacaaggatgggatcccgtacttttgcatttcctataggctaacacctttatcatctctaatcctagcttatagcaacacaattagtagatatgggatggatagctaggtagagagtctccacacaaacaaattttggttgcttgtgggggtgttcccgaggcttagagggataaccgaagtagtggcgaccggcggtggtgatggtgaggccagtgacaactttgtagattgggagagggcaggggatgagtttggtggcaggagaaaagggcgccaaccagttagggctggacgtggtagatgatggcaacgctcgttgctggaggctcggagcgatgattaaccttcttaatcacttcggtcattaatcatccaatatatgtcagatggcgactacaatgcagtgtaacgtaggaagactaattcattaacaaatattgtgtgttcatgtatcaccttatctgacgtgtcttgagtgatcaatgactaaagcgattgacaaggttagtcgtcattcgctatatcagctgtggtgcgggggaaaatctggttgcccaaacaaagctcgtcagagggaggctgtggttggcatccgaaggtccaagaggaattttgattgaaaaaaaaaaaaagagaagtgcacaggtccgagtgaagtccgagtcagacacctcacagtagggcagacgaacgtgggctgttttagacgcatttgtgcgtgtggcccggacacgcgaacattcgtgcattagcccccaacccgtgcatcctgcctgcctgcctgtgcacgttctcactaaagccatgggaccggcaagcgtcgcatcctctttaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctctgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttatatagttgtacacactggtacagtggtacgtgcctacactgcctgtgctacgtactggctgccgggggtcggtgcaaccgtgggcggcgcgccaacctgtttcgaaaaagtcaccactagctcgaagcagagggaatcgatcagggtgttttttttttttgaaccatcagggtgtatcacttgcacatactccatcgtttcttcttatattaaaaaatttaccctggctatgaatataaacaaattagttttttctgataatactccactcagaattattcatccagaaactcaagcacgaaaaagacaacatacataccggacattagctctttctaaaacatatataataaacttgccaaataaaaatcaatagtttgactatgtcgagtatgagtacagattaccccctctgtctaaaaaaaataaatcaaactctaaattaggtatgattacatattacccctccgtctaaaaaaatcggtttgatttattttt

SEQ ID NO: 12354 - DNA, 3817 bp, Oryza sativa
cgcctgcaaatgggcggcgaggggggcatggaattttgcaggcggcccccttgccgccctgggggagggcgattttgtactgtgctctatatttttttatataaatatcaatagttatcaaatctttttatattgaaaactatacaagattaaaatctccaagattggtaaaatacaattttattattttttaggccatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtaagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtataggtatttaacagtattaataaaaagtaaagtaccgtgtggcgagggatcgacgctccgtgagaggaagagctgacgaacgcgcctgaagaggtggcgaacgcccctgcggagctcgcgaaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctgttcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtatggctcgatgatgtaattatcataaaaatttagaaatgaacaatccgaactcacgagtggtcggcaggggggacggtcggctgcacgttgccgggaaacacctgcctaagtccgaactgtctcatcacacgctgcggccagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacacgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacataggacagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtacaaaacactgatccggtcgcaaataagcacgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtcgacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtataaaacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagtgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaagattgaattgaaattacacgatagaagtatttagtccgaacactcattacatcattttat

SEQ ID NO: 12355 - DNA, 483 bp, Oryza sativa
ggcttcatacaactgcaggtacatccaccatccgccttcaagacacattcctgcacggcttgcttgcgatagataccacgcctgctcctatcaacacacattatttcataccgatgcacttgtgtgccttgagcaacaactatatgtctccgtgcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtacccgaactcctcgcattacccagttgtacacctctgccaaattggttgtcattatgccataccgagatccatcggtgtcgaacaatagagcccacttctccttaggctcattctcaatccactgagagaaatttctgatggccgaccctgacctccttctcattgttggtgggtca

SEQ ID NO: 12356 - DNA, 719 bp, Oryza sativa
agatgccgtacctttgtaattctttattattattattctttgaacattttctaataacattttgaaaagaaataatcatcatgtaacttatacggaaaagaagcgagcaactttcggtgtcggcttatatatgtagtttttgcaataggcacacgcacgtgaccgctatttgcatcatgccttattggtttgggacgaaaccaagcgagacatgtaatagatgaatgaagcaactacaacccagttggaaggtcaaaatctgtaattttgaagttgcaaaacctaacttcgaagttagatcgagtactgttatagccatttgggctgtgttcgagatatggtggtttattaatatataattaattaaatattagctaaaaataacttgaaaatatattaatatgaattttaaagcaacttttgtgtagaaaattttattaaaaatataccgtttagcagttttaaaagtgtgtacgtataaaacgagagtggtgtgttgaaaagtgaagaaagaattcagccttagttgatactcccggatgtgtgaacttttgataactcctccttaaacgtatgtgtgaacttttgattactcctccttaaatgtgataatgggggcgtggtaagggtttggacatgccataataaccttgtgaaagggatgaaaacgatgttgcggtagtaaactggtgtcatcgtggctggtactgtagctaaaa

SEQ ID NO: 12357 - DNA, 1208 bp, Oryza sativa
cagagagtgaggaaaagactgttttgtgtgtgtgagatcgagagagagagagagagagagatagctggccggccgggtgtggtccagggaagaagaggtgtcagtgacagtgagctagctagctgggggtgatggtgcatggcatggcactgctcacattcatgtcgacacacacagatcgatgcatgcacgcgactatgttctgatcaaccggggagtaccacctttcagccccaaaatcaacggtgatacttcagtcctacagtagctagcacccaaccacgtacatactgattgatggctccatgcacacacacacactagacactactatagctgatcgatcgagacgtataggtgtgtgtaccgtgtatcggtgtatgtgtaggagtagctcgatgtgcatggcgagtagtatgtgtaatttgccgcgtccggccgtatgaccgtatatcgcttgtttggttggcaccgtacgtacgtacaagtacgtcgcatggagttagtgttatggatacggacgtacactgtacgattatctcatgttgtgtcgctgcaagtacgtaccatggggttgatatatacctggcgatacgctggtgtagcgtacaccgttacatctgtacaagcatgcagctactagcttctagctagctcgatctcacatttactggcgccatgaatgtggtagtcgtagtagtagtaagaacagcagcagctgcaggggtacatggccatctcacacagatctgcagaggcttctaattccacacctgacacatgcatcatgatgttcaatcttttccctctccccactgttggccggtagaggccgaagacctgcaactgaaagcaattaagcgagcacacctagagagagagagtgtgagagagagagaggagcatgcatgggcattgtcattgggacgcagtggcagaaaggaaagataaaactgatggagaggccaaagagatgggcagccttttgctatcgtagaacatgcaaaacaaaaggccccttctttttcagagagcggcagaaggaaggcaggcagggcaggggggggggggggggcgcttcgctttccatttccacgcagcccaaaagaggtctcggtttcttctcatctcatcgatctcggtttctccctagctcgatcatcagctgccccatgcttcctctccctctctaccggtcgagtagcttc

SEQ ID NO: 12358 - DNA, 2253 bp, Oryza sativa
gtttcgaggggttatgtaacgacacgctagctgcaatacagtacaggtacatactccatcagcccacatacaggtagtacgagatggcatgcatgcgggagttagcggcgtcgctagctggactggccggctagccacctctctcttagcagcaacagagcaacaggctagtcgcgcagtgagcactcactgagctccgcatggcacctgctactctgctagctgagctgccgctactcctccaagctgcatcatgcgggcggaggcccacgcctccgcgacccaagtaagacacgcacatgatcgacatgccgcgcgctgggccacgcatctctctccaccccatctctaccggcgactaggtacgtactactgttcaactgtatgccacgccgtcgtcgctctgaggctgagactctctctctctctctctctctctctctgatctatctctcactccaaacagtgcctgcttgacgactccggccaacagacaggcctggctggggtacatggggcatgcagggcattcatgcttccaagccatctcgttaatgcgaggcctatggactttaaccagcccatcactggactcgattggtggtccaaactcctcctcctcctcattatcagcatcccctcgattatttggttccatatcgtttgctaagaattttttttttcggaatggttaggtggccggaaggacttttttgggttgtttgaaacatgcataccttgatgatttcaattagcatgatcctcaaaaataatgttcctgtaataattaatcatctcttgatttttcagtaaagaaaaatcacgttgaatatgtggttcagattttggattgtggtgtcggatatggattatgtaagatctctctagtttgctgtttcatgttacgggggaaacaaatttggtgtggtgagggagttgtaggcatcagagttgaaatccttgtgcatctataaatgatacaggaaatgaatgttatatattttcactgccttaaataaagtttcctacgatgactccaacacattcaccaccttatatatgtagtgcactagtacaaaaaaatgtttttgcatgcatgcggtcagaatcgatcttcacaagggcctaggcggcccgcctgtacgtaggtgtctacagaattcaatattttcacgtgcgggcgatccaacagcttgcgaaaatctattatcgatcgtaggcggttgcctctcatttttcacagattgtcagatgttgtgttttttttcacagattatttcactttagagtttgcctctcgtttttatctacaaatttagtcgctaaatttcacataaccgaaaaatcacatgatcaaagttgaaataagttttattcgcaaaataaagttgaagtaacaataagtttgattgtatgttttcaaaagcattgattgaatggatatatggccagggtgaaatagatcgatcagtatatggcctgtaagggtgcgttcgttctgggggattgggtgagaaaggtacatagtattccgcacgcacgcttcccaaactactaaacggtgtattttttgtaaaaattttctatagaaaagttgctttaaaaatcatattaatccatttttgaaatttaaaatagttaatacttaattaattatacgctaatggctcacctcgttttacgtatcttcccaatcttctcgatccccctctcctcaaactcaccctaagtcaagctcatatataatcctttgggtcccacacgcagccttgcatgcatgcttagtgaccacggtattacgcctgccgcagcctgcagctagccaacctgcacctccggacttacttggcgcatgtgagtagaaccatccaaccagaagccaacaagctgcattaagggccgggtaaggcacgcgcgcagcgcgctcaatcttgcacggcaagggaaggatcagacgagagagacgacagctgagagagacgcgtacgtgttggtcgttgagggcgagagaatcagagaaagcaaacggatccggtataatacggtctgtgctttgtgtagcatcacaactggattgagagaaagaggacggacgacgcataaagccaccgatcgatcttgccgtctttggggcccccggcctctctctatcatatatatgatgtacactagaaaaatatccgttcctttacaacaggtgaaagttattttaattttattattgttatatacgttttactttaggtaaatcta

SEQ ID NO: 12359 - DNA, 2382 bp, Oryza sativa
cttaaaaaaagtatagtactacggcatcaggcattaaacaaagacaagacctcgtgtttgagtgattcatatcgattggatggtttaaaaatctactacgaaatggatataaaattcttaaacctattggttgtggccagtccagcgtggaggctccctgcgcatatgcatgcatgctagtaaaatttgtctattgattgatctggacgttacagtaattttatccacagtttgaaccttacacagcttatttattctttatatattccgatggaacgagctcaaatgaactagtacttttcttgttcaacagagagagatcgaaagagagaaactaggatgaaccaggctgaaaaaaaaaacctaatccgcacttctttattttgggactaatggaccttacgtcatcgtgcgatgccagatgaaagagagaaagtcaatctttagtccctcgactatcactcgaatctaatccacataccttaattaacgataaaactgggtgtatcgtccccttcaactatcaaaactggcttattttacctttccgagtgattttgaaggtggttttatccggtgtgacggttacatggcattaggtcagtgtttttatctgatgattttgatctacttgcgctagcacacggtgcttatgctgcataaaaaataaaatcactactgccaccttatccctccctctcctcatctctctctctctcccgctgtcacattgggaacagtgtggcccaacgcgcgacgcgacagacaatagcacaacgacagtggcaacgccgagcaaatccaagtgattaggaaagtgcttgggaaaacaatggcggagaggtggtaggaagaaggacatgggatgggaaaaagccaaggtcagaggcgaacctagcctttttgtcgtgagaagcccgatagcagtgagagtatgaaacttggaggccgcgatgatgacaagggcctcggagagctatgcttggatgaggggcgatgcggtaaggaggagctatacgtagtcaaagagtgggaactgggaagtggtggttagcgtcgtcactgtagagggagggcttgggccaatgacgccggaggaaattcttaatatggacaagttgtggcatgaggaggggcaatggcgagcagttctagcaagaagccttagaagcacacggtgaatactaggctctgatcagtggcgagatgtacggtggcgttgggggagagctacttagcgaaccattccaccaaagtatcgagcatctttagcgccacctccattcctaccaccaaggttgatagaaggcaactgcattttgattgaaccaaggagatggggagaggagttagagtgccattaagagagagagagagagaggaatggtgaagaggatgagaggtagtcacttacatgtgtcccccatttcaaccttttcatttcttgaagagagaatagctaatgtttcgctggatctggcagaccagctgtcggcaggcgttgcttcacatttgtggtcagtgtaactcacggactcacgagaacggatagttcgtcacttgcaaaagaaataactcaagcctattaggtttttcttctaatcttctttcgactagtataaaaaagggatgggaaaacaacacagcacggttgtaattaacaaaaagtcatacagtaccatacaggcagctgctgctccgtaaccggttgcccctggggcctggcacatgagtacttctgtagttctgttcgctgatgccggccgggcggctgctactgtagtgcgctgtgctcgaccgcatccgcgcatgtccgtcgaccgtcgttcgccttcttcgcggtgcactcagaattaaccaagcaaaattcctccgccgcaataccgaacccgcgagccagtcggctgccgaaccgaccgtctcttgcgccggtgaaatcctatcccaagtcccacacgctgacacgcgcgcctcatcagcgagatggttcggtctcgttggtttgggagatgcaacggttggcggacgaggaattcgggacgttgggcttaaggctacaatgggcaacaaaaattaggaataatttcaccggaggtccctcaacttaacaatgagatttttttaacatccctttaaccataaaagcagaaatgtctacccctaaactcactcaaaccgttcaaagaaggtcccatgataacacatatgggtagtttcgctgatgtggcatcctgtcagaaaaaaataaaaaaataaatatgtggggcccacatgtaagtgagaaaaaaaatgtgggtttaaccattctaatcagcaatcttctactcttttcctttttctctttaattttatctttgcagcaaaggggggggggggggggag

SEQ ID NO: 12360 - DNA, 3323 bp, Oryza sativa
cgcgcgctcgcccacctgctccggccgctctcggtttccgctacccgctccacaccgccgccgctgtcgccgctccgccaaccgcgctctctcgccgctgccgttccactttgccggccatgctctcgccgccgcgctgctccggacgcacactcccccgccatcgccgccacccggctccactctagcggtcgccgcgcgctcgcccgcctgttccagccgctcatggccgcccgctgtcgctccccctctatggcaaagataagaacgaaaagaggagagaggaaagaaaagagaaaagaggagaagatttagaaaaagaagatatgcgggtcccatatttttttttccttttcacttacatgtgggctccataacttttttattttttattttgttgactagaatgccacgtcagcgaaaccaaccatatatactgccatgggacaaactttgaatggtttgagtaagtttaggggtatacctttctggttttgtagttaaaggactaaaaaaatctcgtggttaagttgggggacctctggtgaacttattcccaaaaattaagcccagtcaatagtccaaagttccagtcagttaggttgggccgtctgcgcaattgctagcagaaactgagtaaactgggccgtgtaatctgtatgtccattcaaaatcaggcccactatatgttctataccgcagcaagacaatggtaagcgagtagcgacaggaaacgaccactcacgaaccaaaatctcctccactactggacattatccagccgaacattatccctggctactggctagattcttcattcttgatttgtgaataacacatcatcatcctgaacctgcagcatccgtgtctcggtgatagaatggctgcctggatggatggctagctcttcccccaacatgtcacacagccgatcagttcctgcatcgatcccgaatatgatgccaaaagcaaaaaccgtccttcagcattagcatcccccctgcaacatgctcgtgagcacggcatgtgttttgatgtcaacttaccacggcatccgtccgctagcgctagtatttatacgcctagttagtctccgcgatcttctccgatatatcgtgcacatccatatccacgcgcacacgcagccggctggaaggaagaaaaaatgctgcggttctggaggacgcagaggagcgtcacgtcgtcagacgccttgtctgtgagtaaaacatgtaaatgcaccgtcagaaggagatggagtactatacattttccatatgcatttctgagtgctgtttgtgtatgtgtgcctaagatcgtggagatgaacgtccacatggactgcgagggctgcgagaagcgcgtgaggaaggccatgtcccggctcgaaggtgccagtactgtttcgtgtgtgtaaagtatactccagtacgtgtgtgtttcgtgtgtaaaatgcgtgcgtgcgtgcaggcgtgagcacggtggagatcgacatggacacgcagaaggtgacggtgacggggtacgtggaccggcgggaggtgctccgggcggcgcggcggacggggagggcggcggagttctggccgtggccgtacgacggcgagtactacccgttcgcgatccagtacctggaggacgacacctacatggcgacgcacaagtactacgtccacggctacaacgccccggtgatcggctcctaccccaaccacgccttcacccacatcgtcgacgaccacgccctcgccttcttccacgacgacaacgtccacgcctgctccatcatgtgacctaaaatataatcttatttaaaatcctacatgccagcgacagatacatatctgaccaaatcgaacaagctaagtgacctaattagtggtgcaaaataagagatgaaaaaccaaatctaacttcgtcgatcatctagtaatggtcaagtagttgctcagcaatccaacgtgcaaagagtgtggtgatatgatagacaaattaacgaataggaattaaggtcgaactaagcttatcaatcgacaagttgttcttaattaattgcactatgcgaccctttttcttatgaacatgaattaaaaggaagggagcagtagaactggattgctaattaacccgctatccttttgaattgactattcgacgggcatctgcatggtatcgatgcttgctgttgacagcacaaggggaagaaaagggtggccctgaaaattttcaactgttgatgctagctagcggctgatctcgctgaggtatctgtgccagtaatttttgtctgcggataggacaacatggagaggatgactaggaaaaggagcactgttcaaactatccaaatgtctccaaccaaaagtgatgacccatccttgcatatgtgcgcatcagtgcatatgttcttatgctggtgtggggtgaagattctggtgtgaggggcaaacggtgacaacggaaaagaaggttcgaatataccctgttccctgattacaaatacagttatgagttctgaccattggattgtatacatatgacaaaaagagagtaaacttcagttcacacatcagaccaaattgagtacaggtgctaccagtatttggctttcgaagatattttacattgggacagcgagaggagtaagttcagttcacacatcagaccaagtttgatgcagctgctcaatgctctgtttgttcgttttgtcagggaatatgggctaacagtgacccaatctggattggattcctatcaataaataaacaaataaatctggattggattgtggaaatgataagaacacgcgtgcaatttgatccactttttatgcgatcaatttgggaggaaatgctctttcgtttcgctctcacaaacctgtgaacaatttccaccctctgaactttcagcattgttcttgtattccccacttcctgaagttcttaattctgtcaccaaacgacttggcatgcagaacaattcagtccctcacgagatacagaacaagaagatatattatcttataccccatgggccaggtaggtacaccagcaacaatgcaaatgccgtcgcatcgcatctcagatacttatgcccactaagcttgaccattatgttaacttggattaggggtaggctagagattgattggggcttatatgataacactacatatacacataaaccacaaaatcaagctatcaacattcctcatctcgttgatgccgacttatatctgccctgatagcgcctaattaacccgtgaacaacgtgtcttttcatcgtccaagtgcccaacccacacatgacaaaagccaaacgag

SEQ ID NO: 12361 - DNA, 5996 bp, Oryza sativa
caccccaacctgtgctgccctgttcgagcgaagaacgaaagcgacacgagccgtccatataaatccacgccgtcgccgccgaatctcgcgaaaaagctcgcaaatttctactcggggaagaagaagagccctctccaaaggatctcctcgcccggccggcggcgatggcggccgcggcgccgatgccggttgccggagcggggtggtgggatctcgtgaacggctcgacggcgtggcaggacgggatcttcctctccctcgccgctctctacggcctcgtcgccgcatcctccttcgtaagcatctcgccgcagtgctcatctcctcctcctcctcctcctgagtcctcctgactgatactatactctagttatgcttatgcgaaagcactgggggaaagattctttcagaattttgtgtcaagatggattaaggggtaaaaggaataacaatacacgtactccaactgggttggtgacttgagttcatggcaggagaataaagacttgatttttggtgcttgtttgatgggaataccgcagatttgcgatatcaccatcagcgagtttaattgggaataaagacggttttgtattagctttgtgctttgagcataccagtgttttgcatctgaaacttgtaaaagctgataatgaggacgaatattttacagaactttagatcaatcaatatgaaaaacctgcgatttgaaatagagatagctggacaaggacttgtgattatctgccatgcttatctttctgatatccggaaatcctgctggatgcctggatagacagtacaaaggacaataatgtgtatttatgccttggtatctgaataatgagtagttactacattagtgtgggaagtatgaactgcagatccagttcctatgcttacagatatggtgcacatgtgaatgctcgctgttaaatgattaaatttacttgaggaagacaaggcatacttaattacttatcatgtgatatgcagatccaagttgttaggatacagtacagagttcctgaatatggatggacaacacaaaaggtctttcaattacttaatttcattgtgaatggaggtatttgttcaatttcacttgtagtacaagttacatgctcaactccctttgtgcttttgagtttaatgtgatttcaatctgcagcgaggtgttctatctttgcagtccgccgccaagtccaacaagtgaaccctgaggtctggacatctttgctattttctgtcttgtaattgttatgtttcacccaattggccagagttatattcttcattcatttttattccagatctttcagcatgttattcttgatcttccggggcttgcattcttcacaacgtatgcaatgttggcacttttctgggctgagatatcttatcaagcacgtggtctagagactgaagggcttagatcaggtttctacactattaatggtgtaatatatgtgatacaggtaaagcaagttatctctaaaagtctgtattgattagtgattgctatttatcagattttgtataattccgttagcattgcaataatcaatagtacaccctattgcacaagttgcggtgatcagatattttctttggaactgtgaatttcaagaaatttgttatagaccatgaaaagctgtgatgcgcttatccatttttccctgaaaagaaaagatatactgttgctagtatgcactgatgtgaaacaatgagatactggatgaaagtagaagggaataactttagctgttattgtgccacttatcttgtgatggttcagtgcttgcttagtataaaacttccgctaggctgcgtatctcaaaatactcactcaagtttatttcttcaggttctgctgtgggcgttgttgtggcacaatccaaacccatctatgatagtcctttcgaagttgttcattgcaggcctatccttttctgcagccttgggttttctgctatatggagggaggtaggactaagagtattactgaatgactcttaaccaagtttcatcaatcatagacagccaaattggctggctagactagctgcaaactatgtaaccttgaaccatttagtctactaataacttatacgtagaacagtatttcaagaaaatgtccacttattcagtgcttcatctagcatttgacattaacattcatttgccctgttttgattggcaggcttttcttcatgctgaagcgttttcctattgagtcaaaagggaggcagaaaaaactgagggaagttgggagagttgccactatatgcttcctttgtttcttggcacgatgcattatggtaaggttttcagttctctgatccttggatgagtttttgagtttcagtgttccatttcttacttgagcggttttgacactgcccaatttgttttgcagatgtgctttgatgcatttgacaaaaaagctgaccttgatgtgcttgaccatccaattcttaatttcatctattacctggtacgcatgaatcctgcgaccatattgtttacctcagtgaaatcaactttttttccccgttatcagttctagctagaaattgatttccattatcaataccagctaaatatattctgtacttgttcttatcccctgtttggctgtacttgcagatcgttgaaattcttccttcatctcttgtcctgtttattctgaggagaatcccttcgaagctacggctcgcccagtatcatcccctcaacagtggctaggggatgaaaacggatgaaaacatgaaagctaaaaatatggagaggcctgcaaagtgacacggctgcaagcccaggacatgaaaaaaaaggatgacccatggtctaaaatctctaacccttgttcaaaatgtgtatagatagggatctgaaatctgaagttttcccacaaccttcacctcctgtagctaaccttggtggttcaaggtgctgatgatttcgtgtaaccaattgttcctttgtaacaatggaagcaagtgtcctcgctcttttgagcgagcaagccaatgtttgtcttgaaaaattcttgggtaatccattggtaattgcttactactgataatatccgctttgctaattgctagcacaactcgaatgtgctggatcaaatggtaatccagacatccagtatcaacgaaatttttgaagttttgcagagtagcagcgtgatgcagaggtttctaccaactccgcttcgtcagaagcgaacgccgccacctaccaaacgcatgaatcatacgaaatttcaaaattgaagtcttgaccctaccaaactccgccattcttctgttctggtctgcaaatatttttttctctttttttttttcgataactactcgaggcttggaaatctccgagccgcgagcaaaccctagccgccgccatggccttcctcgccgctgcctcgacccgcgcgccgttcgccgtcgcggcgtcctcctcccggcgccgcaccgtcctcgccgcggccgtcaaggccaccggcggctccaacccggccgccccgcaccccgtcctctcctccctccgcctcgccgcctccgccgccgtcatcctcgccgccacctccccggcggccatcgcgtgcaccccggcaccgccccctcctcccccggaggtaaccgtcgcggcctcgcccgacgatcccgtcaccgacgacccccaccccttcgagaagctaatcgtcgagaccgccgcgctcgccagcttcggcggcgcggaggccgcgcgggcccgcctttccgccgccgccgccgccgccgccggagtcgtcggcggccgcgagcaatacgcccgcctcctcgccgcgcaggagctcttcgtggacggcaaggtggacgacgcgatcgccgccttcgaggagctcgcccgggaggaccccggcgactaccgccccgtgttctgccaatgcgtgctctactccgttctgggcagggccgccgagtcggaatcgatgctccggcgctgccgcgagctcgccggcgaagaatccgtcgccgatttcgtaatgccggtctcgccgttgccggtcgattcgtcggaggcggaagcggagccggattcgccggaggcagagacggagaagctgtgaccggaatggccggtgtcacggttggaataaaggtattcacttgactcgcgatacaaatgtagggagatattaaatggcgatgatttgataatttttcatgcaattttagatttcaaatactacatgattttacatgtcctccaaataaaatgaagcgatcatgagaatttgatcgtattgataaaacagtttccacgatgatcgcattgcttagaattgagtcatttgcaggaatatcttatttattcctcaatcctgatggtggttaatccaccgtcgcagtgaaatttgttggaatcgaccgatcaactaagctcatcttcactctttgctcgtctctggactctggtagctgatctaagaacgtatacaatcaacatgtatcgcagcgacaaatgatcatcgtttcagcactagcaggttaggcagagcagccacaaatttcaagacaacgttgttttacgctgtaggactccatgctaatgccagtgctcaatgctgatacccggtcacattatttgtccccattctgagcgaacacggtgaaatcatgtattgctgctgtctgtgttgatgttgagggaagttatctgtggatcacgtaatgcggctgctagtaacagaaatatctcctagatagcattgttggcctgctggggtaatgacttccaactgatgaatgtacaaatggcatgtaaaatgacggcaaactagccctcgtgctctctaccaggaaaagagagttgtctcttcctacttcccatgggattgtcttgtgctgcatagctatccaggcggtctcaactcttctgcttgctataggaccagatgagttctttctttttgccaaccaaattcaggacgagttgggctgttggagtttggccggagcaaaacacgttacgagattgttgccatgaggtgcaaggtggtctaacgtgcaagcatgtttgcagtcagcaacgtacaatttttcatttttttttcttcagcttttgatgtgtgcttaatctccttctattaatataacgccaagcaacctgtttggccctttgaaaaaaaaaaaaacacactgacgagacaacgactcaataaccatccctggtagttagaaactcgacttgctttgctggtaaaaggagcattcaacataaaaaagacaaccatttattatgccattcaaatacttcttatcttgattttgaaacatcagttgcatcaccaaacataaataaaaacacaatatttggttttcccgggcttcaccgtggtcaaagaaataacttggcccatgttagcaatcccgagcaacgttttggccgatcgagcaagttgccatggcaacgaagccatgcatgcaacacaagatgcagagaaagaaaaccagacgaaaataaagttgctaatgcatctgcataagcatgacacacttgaggacttgaacaattgacccacgacctcgatcaatcaatactggcggtggcggatcagcgacatccgggagcctcgcagcttctcctccacgacgtcgtcgagcctccgcgccatctccggcgacatgtgctccttccagtctccgacctcacccttcctgaagaaggccgagttcttgaacgacgaccaggtagccccgtgctcgccgtctcgatttgcctccacgtttctcatcctttccatactgcagagctccacgatagtttcggggacgccaccggcaagctcctcgccggtgaacgggcagccgaggaagccggcgagccgcctcacgctccccacgccgtcctccttgaggctctcgtaccggaggaacacgacctcctccggccgcgccaggctctccttccagtactcggcggcgtggtcccacataggcccgtac

SEQ ID NO: 12362 - DNA, 10569 bp, Oryza sativa
cacgacgcagaaggcgagcgccttgagccacgtcgagccggacttgggcatggtggcgaggatgacgtcgctggggcgggccacgaacgtgtcccgcgcggccagcgtcgccggcatcaggtgcgccgggtaccagaatccgccgtacctgcggtacggggcgctcccgagaccatggcaagacggtagggaggacgcgagcgcctcgtacttggcgagggcgttgcaccagccttccccgtcgccggcgctcatgtcgtcgcctgcgcctgcgcgcggcgagagcaggtgctcggtcactccggcggtggccatggcattcctgggtcttggaggaccaacgcctctatctatagatggccatgcatgccaatctgtatttactactccctccatcctaaaatatttgacgccgttgaccttttttaaaaatatttgaccgttcgtcttattaaaaaaatttaagtaattattaattcttttcctatcatttgatttattgttaaatatacttttatatatacatatagttttacatatttcacaaaagtttttgaataagacgaacggtcaaatatgtttaaaaaagtcaatggtgtcaaacatttagggaagtaggaagtacaaaatagtactccatccattccaaattgatctacatatttcataggtacatcaagactaagaaaaactaataattctctcatactatatttactctagcaacaaacttaatacatgcatcatccccactatttcctagccaatagcaaatcaatatattgcatgtgggttataaatacatgtgtgcatggatgcatgcatcaatgtctatttactccaatgcagaaataacgaatagacctaataaatgaacacaaatatgcagatcaatttgaaacggatggagtaattaactgggggtgcagaacttgtgcgtgttaaaaaattattgcaagatacacatcaaaaggtacgattatcaatctttttgcactaatgcgccatcgcctatttgactcttccagtctaccgacacttgttaataactagtgccaaatctctacttgcctctccaaatctgcatacaaaataaaacaggtgccaagcctaatatactactctttgtacgactgattgaatcatttccaatgccacggccacgccagcatgaggtttttttttagccatagtgtagtattttactagactagaaccaatctgatgagggtacaagatgtttgctgatcgacttgcacaaaagttggtgcctcttgtccgcctaaaccaagttgcaaattctgaccatacttttcaaattatttctatccagctagcagagtttctacttcgaaattctaacgcatggagagagtaagatacttcgcaaatcatggatagaatcatagagagccatgcctttcatcatatcaatatctcatcagaacttcagtacatatggttgagaactatattggatacatgcatatagctactagtatatatatgctttagttgaaagattccacatccgggagcagttcgatgacacaccggcgagtagaggatggattctaatctctcgggtggacgtccacccgtttcttacatgtcacctaaatgattatgaaaaaaatcaaaaaaaaattacaaggtaggttaatatataatatatcacttcacaaacatgtaagttcaaatttgacttttacgagtctatttcgccttcagtagtctatttcgccttggatttctggaaagagtaacggcggttagttactgtaaggaacggttactgctcaagcctcaaggccttagccaaacacagaattcagaaaggcgttaagctagctttctttcgcattaactaattaatttcactgcccaaatatgctgcatgatatgaaagagcacggaagaggacacgatcaaatggtaaagaaaataaatgtttaaaatgtcaggtttaaacgtaccccaaatcgcgagccgctaagacgcagggagtccatctcgagcaggtcgtcgacttcgtccagctcgatgacggccctaattatcgcattgttgagttctttatcctcgctcgcgttaaagaggcagcctctgttctttgcatcagccactatctcacgccaaatggtctttgctactcgctagagtatttgcattgccaagaatccaaagacagtgcctgcaaaaacaaaaacaacaatggatcaaacaacaaaatcggagtgaaatcaactctctgtgcgactgacgtaattggccgggaggatcgaggcaacctacttggcccgggtcagcgcgacgttggtgcggttgacgttggagaggaacccgaccgatccggtggtgttgctgcgcacggcggagaagatgatgatgtcctcctcggcgccctggaacccgtccacggatcgcaccttcacggtgaagcccccgtgcgtctcgtacgccttcccgagcctctcctggatggcgcggacctgccccttgtacggcgacaccacgcccacgcacagcttcctcccggtgtcaaccgactctgcacaaaccaagctatctgagctcagcgatgccatgccagaatgcaagggcatgatgcaatgtgtacctttgaacaatctctgaacgatccgggtcacggcggcgacctcgatggggttcatgaggctcttgtcgtgcttgcccttgctctccttgccggcatcgacgttgatgaaggagtaggagccgtacattggcccggcaaggggcttcctctcgtagtccctgtgtaatacgttctcgccgtcagatatcttgttctcgtagaagcttgagaccgggaacttgctgatccctgggtgcatcctgtactgcacatccaggaggtgcttcgggtgtcccagcgaactcagcctctcaaacaggctccttccaaactcagcatcttcacaaacctgtgaagaaacaaacagacaattgttacatagcatagtaatagagattgtgaatgttctactaatagagatggtgagagcttaccctgcttttgacaagtgccggcagctgaaattcatagccgatgagaacggcgtgacgaacgccagggagctggagaggtatcagtgactcgcactccttcagctgtgctgcctcgtcgacgacaaggagatcaaacgggcttgcttctggcaggtagtgcagacgggatgagctagaagctgtgcagagtatgcttttggcgttccggactaggaaatcttctatcgaacgcttgtcgaaaacgttcggaagttcaaagtgatcagataggtgttttagcttctgaagacactgagctctagcatccttcagctctgtactcacactatcttgcacatatgtcacgaagttctgaaacagtgagctgatgctgccatcggggctgagtttgaacagggttttcaggctctgttctgatttgggctccacaagtttaccaaaaaattttagcatgtgcagggcctgggtcatgtaactgaaattctctgcagttgtagctgacctggggagataatcacagaaagtcttgacacaaacattaagatcattctcaagccgtttgtaattacttatgaagtattccttgaactaggaagatagcccgcgcattcgcgcgggcatgtattgtgggctgcatgtttcaaaaacttataagaacataatattaaccgaatagcactgtcacacttcgaagtatgttttctccacaaatattattcgttggtatttgttattttccacaaacgtgttatctaacaacttaaaagtgtttcacattgttgtaatgtaagcaacatgttgttaatcatatggtttaaaaatctttgtggcttttcctaaatatttatggctgaccaatagctagtctccaaaatatgctctaaagtaatttatttcttttacttgttaaatatagttaatttggatttcgactcatgaaagtttactgcaaataatctaatgaggtgcactaataaaaaaatagtttagatggtatagttgtttaaaaatttctatcacgaaatatgttttctatctaactaataagcatgaaaatagggcaatgggagagaaggaaaagaggaggcgaggttgtgctcgtgcatgaggggggagggcgcagacatgcacatgtacggacataacataataggacagctagacaggagggatgggattgggccttttctctttttgtctatctattaagataaatctaatggtaaaaaaataatgagaccatggtaaaaggcatatttcatataaattatgagtatatgtgattttttttaattatttcatattttattaagtcaatttagatgacatgtaaaaaaagtagggatgttgtctcttgacaaaacactatttaatagtcgagtttctaatttttgtttgacattgtagttttaatttacatatgaatgtttctagaataatgtggatgagaggaatggggaggaaggggaaaagatgtttttttatttaaaagtttaatagagatagatttaatgttaaaaataataggtttatcgatttaaatagaaatcattgattaaatgtttcttccgcagtatttgtagtactttttataatttattagatgtgccatgtgatgagctagaaacactataaaggatgtataatggaccattattatataatggatagatctgtatgatattttatggggatctgcttaatgaatctttataatataataagcattatatagtaattatttatatactaagctgctagctagaaaatatggataataaagtgagtaaggagagagggtagatcatttacaatggcatgatatgtattagtatttagttatcatataaaggatatgagtttatatccaaatggtctatttcttatatgtatatacacaccaacacatggcataattgaaatcaaatatattataagaaattataattatttaatattaatattttaatataaaaaatttgctacctataaataaatggagaaaaaagagagaaggtgggggacgtacgtacgtggtttttttttacaagcgtacgtacatagtttggtgtatgtacgtgatggagcggatacgaatgggttttgagattttttttccttgatataagatggatctaatggtgtgaaacgatgggtccaccatgttaagttgtagcgcccgtttcgtcgtggcgcctagtgggaaaactatctcttaaaaatcctaaatgcgaaaattttctccttgtttgttgtccagtgtccgtgccattccagatctcaattccccaatccattgtcgaaatccaaaccctaatctcaaatccgtcccaaatcaaatcctctcgaaaagtctattttgcctccctcgagttcgtgggccaatctcttctccccggcccatttcctcctcagcccaactctcctctcccctccatccttgcccgcacatgtgaggcacgtgcgccgctcgggcgctgagcgagagagagactctctctctctctttcacttctccctccctctctgctctcgttgccacttcccgccgatgccgctcaaatcgccgcgccacccgttgcttcccgcgcgcgcgcgccaaggtggccgaccggcaagtcgccgccgccatcagcgcctgctgcgcctgagcccgcgtctgccgccctgtagccgcgcccttccaaaccgccccaccgtcatcgccgtcgtcatcgacccggccccgctactccgcgcgctagcttccaagggatggaggcagagctcctcctcctgcctcgtcgccctctctccctccttcttttcccaaagaagcaaggggcaagccccctttcttccttcctttttcccttttctcttccaccaccggcgtcatcctccctgtcgctgttttggccgctagccgggacgccagctcgctggcttgaccgcccaaggtcggttttcgaaccgacataaccgcccaataaacccgagcccctcccctaaacccatctccctcgctttcgccttccgccattgtcgcctcgccccgtgccctgttcgtcgtcgcccttcgctgtcgcgtgcgccggaggagccggtgcgcgctaggatcggaaggggactccgggcactcgtcttcttcctcttccccggcccgaggccggagagatcactcccgtgccgtcggcctctcgtcacagcgccccgtctcgtctcggtagaacacctccctgttctccctcctcgctcttcctcctccccttagactcgagcagtagcttgtgtagcctccccgtagctagcctgcgtcgccccgaccgctgccgccgctcgcagtaggctcaccgccgtcaccgccgtgctcggtagtagccgcctgtcgccggccttcctcggcgatgttccgtccaatccgacgctagaaacggattcccggagtcgcgtagatgctctagctcgcccgaatcgatctcccgtcacgccatcgctgatttccccctttctcgccgccggttgctgccgccgcaatccgccgccgtcgagccccctccggcgaatccgagccgttggctcgctccctctcttttccccttgtcattctagtgtacacctcgtcgccctcgtcgtcgcacagcgtcccggagaaaccgtcgcctcccgccgtccattcgcggccggcgccttcgtctttctcccgccggcccgcgtggcagccacgaaggcgccacatcggcgctagctcggccggaacgggtcaagccgaccccggtcagccgctccctccgtccccgctcgcgtgcgcgcggcccacggagagctgagaggctgcgcgtgggccacttgcgcgccgcgtccaccgcaagccacacgcgtgcaccgcacccaccccaaccctagcgccgcgccacatgcacctcactcacggtgagccgagccgccgacaagcgagtcccactcgggaccacgcgaggtggacccggcccaccggttcccctccctctctccccgtgcgtgcctttgggccgccttctcgagcccgccggcccattagctcggccgagccgcgccccttctctcgggccgcaccctagccgcccgagggaagtctgttcctcctccctctttcttttctttttcaaagggtttaattaaatccgtattcctttagaccaaaaatccaataatcttagaaattcaatatcttctcaaccgtacatccgtttgactccgctcaacttccaaaaatcctcaaatctcgagatctacccaatggcacgcttagaggtcaataatagggctttaatttcgctgtttgttgagtcgtctcgttcgcgtgtagcttccgagctcgaagacccagagtgcgcggatttcgaggatcaagcttaagatctcgagcaaggcaagtcacctttgatcatcttgcacctataatttaaatctaagtatttcttttccgcaaataatacatggataggattaacacaagaaatttggccgcggcttgcgagatagcctaccggcccccatcctaattgctgcaattagcctccttgaattattgaacacttaaacctcctttgtcgactgttgtacttcgatgtacgggccttcgggcacgcacgtcggagtcctcccctcaaatttaaaatatccaacgatgggtaaaacttgggttttacaaaagacttggaaaaacccgacgcctgggtcgatgcttgcgaactaaatgaatttccaaaaatcgcagaccgggggacgtgccgggagcacggtttcctgctcttgcacttaaggaccgattcctttggaatttcatctgaacatataacaagtacgaccacatgggtggaatgggacacccctggctgagtaattagctaatcaggggagccttgatgccgggagacaagtggattcgccagggtggtgtcggggaggacccctgggcttcctggcatagtatggtctaggacctaacctgttgttggtctgggacccctctcgtcggcatatggtaaacctgtgtcggctctcgaaatgccttgtcatgaaagccttaaggtcaccagacgtggctgttctccatgggctgggtgatccgggttagtaatgtcgtgtgggtaaagtgtgccccctctgcagaggttattaaactgttcgaacagccgtgcccacggtcatgggccgatgtaaggtgattccttagtgtagttttgttcgactagtgcttggtgaaattgctgttgggaatttgggttcgatgtttggaacatctgtagctgacgggatcagctaggcccgggtggccatttgaaagttgtggccgggtgccaatcttgaatcaatcaaagactgatacattgcacatactctgaccggacgagatgtactgtctcatccgtgtcgtttgagaagcactcacttagttgttttaaaaatgagtttaactaaaaatcaattgtaaaaacaacagcctttcctttgaagccttcattaaacacataattcccatgacttgctaagtactcctgtattcacccttgctctatataaataatccccccagtggctgaagaagatgagatggaccccgctgacgaggagttcttcaggagcaagtcggctatgatgagttttggggtttcgatctggttcccaagtcgcgcctgtgatgttaggttcaagtcttggcttctgctttcctcttttgtaatgcagttgtgagctcggggtctgtccgcagcccaacatgactgtactcctactctataataaagagacctctgttgctgtgatattctgtcttcctgtgataccagctctatttcctgggattggtatcggttaacaggttaatttggagcgtcacaggctggttccgttcggggctagttcggggcgtgacataagtgaaaactgatggttggatttttattttttcctcataatttctataatttgttagagtgccacatgacgatataggagtgttcgtaggagccacatggcggtttaggagcgtttgtaggaagtttaatggacttttagtatataatagatagatggcattattggtatgaccttaggaacatcctcctttacctgctttttatcattctccttgttcttgtttttgttccttttcttctcagcaagatcctcttctatctccctttcaatttgctccacatatgaatcatactgaaccagaggttgctcaagaatccgtatcatggagctcagactgtgcacccaccctgaacctggactcaggcacttctgcagtcggcgagcgcgcttctccaagaagatctttgtcaggtttccgtccacgttcatccgatcctcatttccgaacagcacaacatcactcaaaaaacaggcttttccactgccagcagaaggatcctcgaggagattgaggacccgagatgcgacctcgacgacggcggtgttcgtcggagcgcaggtcagtgtcctgtggttcttgaccagcattgcccacaggagcgtgctgatggtcttcgtcttccctgtcccgggaggaccccagatcaggcgcacggaagagctccgctgctgcatcgctgacacacagtctagtactgccaccttttgcgacttgttgagcttgaaatcttcaaggccaccaagtgctctgtccggtagatgtaaaggcagttctgaagaatatgaacattcttggccgacctgccgtaagaattaaagaacatgcataagcaccaaattgcatgcaatggagcagatatattacatggtaatgcatacctttggattgcaatttactatcatccgaatgatgtcagtgttcctgacactagcaaccaccgcatccagttcactccatatgcgattgtacgtcgtcatgttgatcaggaacaccgcgaagagagacgattccaatccaaactgctgctcaacatgcttacttgacagcctgacgacggtgttgccttcagcatcctcggctttgagcaccgaggcaatcaccaagggcttctcaccgcgtcccaggtcagagatgtgcctcggtttccgatccgtcagcaacagtgtatccgcctcctttggggcgtaaacttcctgaaaaatgtccttgggatcagctttattggcgaaaaaactgtatatgagctgctcgtctgagcaaagcttaatcctggtcacttcagctgctggcgcatgcttgatgccttccagtgcagagcagagatcagcacgagtctcttcgatcagcggcacggtgaatgatcccatgtactctttcagcgaggagaaaattgtgggtattttcttaacctgcatcaaggcaagatcatccgcgagataatactcagattacagcgagagaacaagctggataatgcgatgtacgctaccattacagtggaagagattgtgtgcaaactgcagttcatgggataaatagttattccctccatttcatattacaggtcatgcaatctttttaagttgagtaaattttacaaaactacacgttttgtagtccaagttgcagaaaac

SEQ ID NO: 12363 - DNA, 3176 bp, Oryza sativa
  unsure (1)..(3176): unsure at all n locations
tttctgcaacttgaaccataaaacatgtagttttgtgaaatttattcttttaagtttgatcaaacttatactacctccaacacaaaacatatatactaataaaatatatttaatgttgtatttaatgaaactaatttgatgtaaaagatgttaaatttttatataaatttgatcaaacctaaaaaggtttacttataataagaaacggaggaagtaacaatctactgcttggttacctttttcttgagtaagtctttgttgagcacatctttgagggaccaagagaacatctgcttctccaactcgctctgcgaccacgaactgtacctgccatcttttgcccttgcggatctcgtccccgccccctgctgcaccagcacgacgtcgtcgtcgtcgctgtcgtagtagtagctcatcgctaccagcacgacgtcgtcgtccgtccggcgagcgaaaacgtttctggctccggttggaagctttgcaagtgtaggtgatgatctgattctactttctaggctgcagcaatgcgtcgaggatttgtagaggcacaagaccggtgggattccgtctgcgaattaatgtttgagttggggtgtgtagggtcgatccacccttccgtctctcagtgtgagtgtgtgacccatcgttctgagaagagaagcgcatgcggttgcattcgctagtgaaaaggtgagagggtgtttggtttactaggagcccaacaagtgaaatgcaatttactgattgttcaactgatcgtctgagggttgtttttctttatctattataaaagtttaagatgtttttactagaattttggtacgtcatctgtgtttaaaacggttttagttttatgtttcggtttaatctatatctctacgacaagaaatttccgacttctgtaaaaaagaaagaaaaagaagtccgactcaaaaaaaggtaaataaagaaagaaaagaaagtccaacttaacgagcgattttaaaaagaagcttacatcgtcacttaactagcgattaaaaaaaaagcttccgtcgtcgtcagtaaaaaaaaacatctcttgactatgtagaaaaaggaaaaaaaatctcccagtaaaaaacaaaaatgttcgtttggtttttttggcaccgatatttttttccttttttctttgcacgcaaaagagttttttatatgcacacattaaggtttttggtttttttttcctttttttaatccgatctattcaccgcgcgcctctcgggtactcttagtttttttggtcaatcttttttatcgccggtttttttctcccatgcgctagctttttgtttttctcatccggttttataatctcatctgttcaccgcacgccttccgaggtgaaccctagcgctacgccaccgccatatcgattgtatgttttctcctccaatttgattgaaaaatcgattcctcactcctctcatcattttctccatgattttccctttgattcggctttaattgtcggatttaatcactgttctacaggtgccgatgatgacggcgatcttccttggtcatttttatccgagttttacgctttgatttttgggtaaaaagagtagatcgagtggattaaaaaccctcgaccaattttggtttaccaagaaagattcggctggatttgattgggagatttgctctagcaaacgtgtgtgcacaggattatcttcgagaggttgaagatggtaatcacatttgaaagttgaagatggtagggtcggaaaccggtagcaaatacagaaacattaaattataaaaacatatatttaactttacataagtatgttatatgtatacataaattcaaacttatactatataaattataaattaactccattttagtcatgcacaaaagttagagatttgaatgaagagtcaatcaatatgtaagctatgggtcaagtagagacatgccctataatatcgacatatttaggattcgggtattacccatattcaaagaacgnataattcccacaagaatccggtaaatacggaaatgatcagtatacagccaaaccatttctgtnttcatttccatattttttaccatttccatttttgtttcggtcgaataccatttccatatggctcggccggtagaaagtcgataacgaacgccggtcggccgggaattaccgttaccgttttcacccctaatgtaaggtcatgtaaaggctgtgttcgattgtggggttcccaacccctctcccgcagcacacaaaacgaaccgaaagtttagcgtataattaattaaatattagctaatgatctataaaataaattaatatttctatagaatattttataaaaaaaatacatcgtgtagcagtttgaaaaatgtacgcgtgaaaaacaagtaactaaagttggaattcaccaaagaacacagagctagagactaaccaagcactatcatattcccaaattttaatagcatagtaggtggatctaggaaggataaatttgtcttttcctaactcagagcttcagatctatttttgaatttggaactctacgatacaggccctaattcactcatatgtcttgcacttcacattgactttttcacaaagagttaggacctcatcttttcacttatgcttatacttatgagccaaaacttgaattttccaactttaaaattgaagctgatttaaggttttttcatcgaagtttatttttcagcttttacttttagatcactaagaacacatatataaaaattttattcacaaactacttttcatttgcaaatatgccgtttctcttaaaatctacgaataagcgaaatgatgggaccgttaattttctcgttctgtgtgtgtttggtgtcctcaatgtcagcctctcacctttactattctctccgtttcaggtataagacgttttgactttaatcaaagtcaaactgttttaagtttgaccaagtttgtagaaaaaagtatttacattttcaacccaagataaatttattatgaaaatatattcaattattgatttgatgaaactaatacagtgttatatattactatatttatctataaactcggtttaacttgaaattgactttaaccaaattcaaaacgtcttataatggggtatattatatggcaatgctatagggtggctaaaagcta

SEQ ID NO: 12364 - DNA, 11576 bp, Oryza sativa
  unsure (1)..(11576): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggccccgatccgatctagatccagggaggttggcgttatactccaacctctcgggacagtctcgacggaagagttggatggttacctcagctcccccggcatcagttctcgaccaaccgagatcctcgactacgacgattttggctaccactacgaccacggcgacctcgacaacttcgacgacaactatgaggataactacacgcccctcttcttcggcgtattcatggctgacaacgaaacggaggaacagcgccaagcccgagaagcggaccaagatcgcgcacggcaagaagctgaacgtcgccgactggaggaagagcgacagcgacaagagcgagaacgactacagcgtgagcaacaagatcgcgaacggattgcaaaggaggctgaagatcgacgacaatgcgccttggaatctaggcggcgagcgagagagctcattggacaacaagacgtcgatgggagagcggtctttcgcacccctagcagaacgcggttgcagcaatcactctcctcaagaccctcctcatggaagacgcactcaaccaagctgatcatgtagtcaacatcttgaaccagacgaagaccatgatcgctgcctcggttccggccaactccgcaagcacccgcaccccgactggtagccgagtccctcatcttcgatctcaagactatcaccagccaagcctcagcattgccggcgccgaatctagtcgcaggagcaggggacatgatgaacggtctgttcgctcgcctcccgagcgatatagggagcgccgagttgaacgaccacactccccacatcgaaggcgccccatcgatcttcgcgacaccatcaaccagcgcccgcagcaagaggccatcattcaccggatcgctacgacgacaacgtggacggagttgccgccttcacaagcgatctgcgtcgagtggattggccagccggctttaagccgactggaatcgagaaatatgacggcaccaccaaccctgagtcttggctcaccgtctatggtctcgcaatccgcgcagcaggaggagacagcaaagccatgacgaactatctacctgtggccctagcggattctgcccggtcatggcttcacgggctaccccgcggcacgatcggatcatgggcagagctacgcgaccacttcatcgccaacttccaaggcacttttgaacggcccggtacacacttcgatctctacaacatcgttcagaagtctggagaatctcttcgagattacattcgacgcttctccgagcaacgcaacaagatctccgacatcaccgacgacgtcatcatcgccgccttcactaaaggcattcgccacgaggacctagttggcaagttcggacacaaacctcccaagacggtcaaacagatgtttgaaaaagccaatgagtatgccaaagccgaagatgctatcacggcgtccaagcagtcgggcactacttggaaaccaaagaaggatacgccgaccgcaagagggagtggaagaaacaaccacaaggatcgcaagcgtaagcccgaagaacttgtggccacaacctctccatcttcccgacaacgttcccgcgtcaacaccttcgacaagataatgaactcccaatgtccgcatcatcccaactccaaccacgtggccaaagattgcttcgtctacaaacagtttgcggagcaatacgtcaagaacgcacgtaagccctcagacggagatcaaggcacatcaaagaagaaagatgatgaagacgatgccctgaccggttttcaagatcatcacaaagaacttaatcacatcttcggcggacccctagcttatgagtctaagagaaagcagaagctaacggaacgggagatcaatgcggttcagcctaacacgccccaatacctttagtggtcagagatagcaattaagttcgaccgctcggatcatcccgaccgagtggtccacccggggcggtatcccctggtactagacccagtggttcgcaatgtcaagctccaacgaactctcatcgatagtggcagcgcactcaacatccttttcgctaagaccctggataatatgtagattcctcacacggaattaaagccgagtaatgcacccttccatggtgttatcccaggattgtcagctacaccactcggtcagatcactcttccagttaccttcggcactcgggagaattttcgcacagaaaatgtttgtttcaaagttgctgatttcgagacagcatatcgtgctatacacggacgaccggctctagccaaattcatggccgtcccacactacacctacatgatgatgaagatgcctggtcctcgaggggtcatatcactacggagcgacatcaagcaagccgtcacatgtgacaaagaaagttgcgagatggcccaaacccacgagaccactctcgcccgcgaagagatccgactggctgcgaccacggcaagcgagggagaagtgcctgcaaccaagctgacgaagaccgaagaaagtgatgccaagacgaaaaagattcccttagatccctccgatcctgacaagactgctgtaataggcgctgagtaagattgtaaataggaaagcgcgctcatcacctttcttcagaataataaagatatttttgcgtggaaaccatccgatatgcctggtattcccaaagaggtgattgagcactctttacatgttaaggaagacgccaaacccatcaagcaacgactccgccgttttgcacaggacaggaaggatgcgatcaaggaggaattaaccaagctgttagcagcaggcttcattaaagaagtccttcatcccgattggctagctaacccagtcctggttcggaaaaagacggggcaatggcgcatgtgtgtcgattataccgacctcaacaaatcttgtcccaaagacccttttgggttacctcgcattgaccaggtggttgactcaacggccggctgcgagttactcagcttcttggactattactcgggatatcatcagatccgactaaaataatccgaccgcttgaagacctcatttattacgccctttggggcctactgctacatcactatgccctttggattgaagaatgcaggagcaacctatcaatgcatgattcaaagatgtttttcaactcagatcggtcgcaatgttgaagcttatgttgatgatgtagtcgtcaagaccaagcagaaggatgacctgattgcggatttagaagaaacttttagaagcattcgtgctttcaagatgaaactaaacccggaaaagtgcatcttcggagtaccgtcagggaagttgctcggatttatggtatctcaaagaggcatacaggccaacccagagaaaatcaacgccatcctcaatatgaaaccgccaagctccgaaaaagacgtccaaaagctgactggttccatggctgcgctcagccggttcgtctcacgactcggcgaacgggggatgcccttcttcaagctgctgaagaagactgacaatttccagtggggacccgaagcacagaaagcctttgaagacttcaagaaacttctcaccactccaccagttttggcctcgccacatccgcaagagccgctactattatatgtgtcggcgacctcccaggttgtgagtacggtcctggttgtcgagcgtgaagaggaaggccatattcaaaatgtccaacgtccaatttatttcgttagcgaggtcttagtcgactccaagacaagatatcctcaggttcaaaagttactatatggtgtcttaattaccgtcaggaaattatctcactactttcaaagtcactcggtcacggtggtcacatcgtttccactcggagatatacttcataatcgtgaagcaaatggacggattgcgaagtgggccttagagttgatgtctttggacatatcgttcaagccacgaacttcgatcaagtcacaagcgttagctgatttccttaccgagtggaccgagtgccaagaagacatgccagaggaaaagatggaacattggactatgcattttgatgggtcgaagaggcttacaggaactggagctggggtcgtcttgatttccccgactggagaaagattgagctacgtattgtggatacatttttctgcgtcccataacgtggcggaatacgaggcgctactccatggattaaggatcgcaatctctctaggcattcgccgactaatcgttcgtggagactctcagttggttgttaatcaggtcatgaaagagtggtcttgtctagatgataatatgactgcttatcgacaagaggtacgcaggttggaagataaattcgatggactcgagctcacccatgtcctacgacataacaatgaggcagccgacaggctggccaattttggttcaaaacgggaagcagctccttcagatgtgttcgtcgaacatctttttgaaccaactgtgcccagaaaagaaacacttgaagccatggatactcaaggcgtaagcatgattgaaaccgactggagagaacctctcataaaattttttaccaaacaagaactccctcaagacaaaaatgaagccgagatgatttccaggtgcagcagactttacgttattcataagactgagttgtacaagaaaagtccatcaggaatactgcagcgctgcgtatctttggaagaagggagacaattgttgaaggatatacattctggtatttgtggtaatcatgctgctgcacggactattgtcggcaaagcttaccggcaaggttttttctggcctacagctgtgtctgatgctgacaagattgtgcggacatgcgaaggttgtcaattttttgcctgacaaactcatctgccagcccaagagttgcaaaccatcccgttgtcctggccgtttgcggtctgggggcttgacatggtcggcccgtttaaaagggcagtcggcggttacacgcatctctttgtggctatcgacaaattctacaagtggattgaggctaaacaggtcatcacgatcacagcagataaagctagagattttttcatcaacattgtgcatcagtttggggtacctaatcggatcatcactgataatggcactcaattcactggtggagcatttagatacttttgtgaagattttggcattaaaatttgttacgcctccgtggcacaccccatgagtaacggacaagtcgagtgcgctaacggcatgatacttcaagggatcaaagcacgcgtttttgaccgactacgtccctatgctggcaagtgggtagatcagctgccgtccgtactttggtctttacgcactactcccagtcgggctaccggccagtcgccgttctttttggtttatggtgcggaagcaatgttgccgagtgaagtggaatttgaatcactacgatttcggaacttcaacgaggagggctatgaagagggccgagtagatgacatcaatcgactagaagaagcccgagaagcagctttaattcagtcgactcgatatttgcaagggttgcgccgttatcataatcggaatgttcgatcgcgagcctttttagtcggcgacctggttctgaggaaaattcaaacaacacaggatcggcataaattatctcctttatgggaaggaccgttcataattgctgaagtcactcagccaggttcttatcgactcaagcgcgaagacggtactctcatcaacaattcttggaatattgaacaccttcgtcgattttatgcttaggcatttcgtttgtatctttcctctttgactgctaacttcaagtttttccttgaagttttcagtcagggggctactatgataataatggagtgtgatttttatcaattcaatttgcttacttgatttatcattgccctgtttggtctttcgacttaaccaatgaggactgaaggtttttaatagcttttgcgggttttaggctcaataaggcttgacaaaggcctttaagaaatcagaagctaagtatggaacaccaagcatagcataaattcatcagtattgtacaaattgagcctccactgtcattgatcatcaaaatcattgttatatcaatcagtatcagttttttcatcattagacttatcagacccagtcggccgaaggtcgacatcttggaatctctcaactacatcagcagcaatcttgtcagccgctttctgcgcatcactgatgaggtcgagagcagcttcttcgctcgtcccatctgcaaagccatcaatggcatcaatgtcaactcttggataaagggatttggtcatcgccaacgccagactcgctcccatacttccagcttctttgatgttcttgaagtaagtatctggagcgactctcagcttgtcgaagatttcggcagcatcaagtgtactcgaaccagcgttattgaagaacatggcctggataagtggagtagcggcattagcgactttatccctggctccttcaagcttgttgatattgtcaactaagacatcaaattgtgcttgagacttgatcttgcggtccgcgtcgacagattcacattaatgaatcagcatatagaagataatggcttttgaggtattgattattgttaccttcaacctcctttaaagtcgaatccctctgtcttgccagctctgccttgtcattttccagagtttggatctgcttctctagttgagatatcttggcagcttgcactacattaacttcggttaatcaagattacagagataacaacacaaatcagttgggcagagtttgcgcgaaccttttgatgagccactcagttcgaaattggactcctggagctcagcaatccgatccctcagatcgtgttcattcttcttggcaagttctctggcctcgtgcagttgactcctggtggctttgagggttccaagatgaggaactagtctctctagggttgcggtttttgcctcgttcctaagatgaatcctctgcggagcagtttaatcagcgctcgagccagacggtaaacaagatggctaaggtcaggcgtcaaggaacttacatttacaatgcgagtcgcttggttgagttcctttttcagtaggcatacctcttcgtcttctttttgccggtttattacaattccttgaggttgcaagttgtcatcccaccacttgaccagaataggagggcacgaatcttcggctgcttgtatacggggaatttcttcttcatcaccgatcattggtcctaatgcatccattgacaaaggttagacaatcgatcagagttatttgggtcaacatggtttcgggcaaagtgtttacctgtaatgatttctggacgaggacaagtggattcggatgcctttaaaggggatccagatctccggtcattgctggcgtcttgtccgcgagggttgtctgcttgggtttcgacttctggaatctcttggcttggccctgcgtccgactggtttccaatcgggggctcctgattaactccggcttcggcttcggccgactggatcccagtcgggggttgatcaccggattctaaattatcggttgccggttgattgtcactcggatgatcctcagtagttgactcggtttctttggaagaacttgtgtccacgttagtcgggtcagagtccttcccagacggatctatatcagatggtttcctgcaaatttgattatcagtattattgccgcaatgggtgcgcatcaatgcaagagagatcgttatatgagttgcacctagaagacttcctgatctttggcacagggcgactgggatgtttcttccttggagtaccctgttttgttagtttcttggttgtctctcggtctccaggcctcctggcggtatcatcggcttcgtcgtcacttagaaccagcttcctctttcgagaatctgactggctgattggatcagaagcacttggttgagtttcagaccgaattcttggtcctccgctcccttgcccagtttggtggcggggcgatcggtgttgggagatccgacttcatcaaagcaaattcctgggtgtaatatccttcattgttaactgattcaacaagaaaacaagatcatattttgagaaaggttgaagtgtatgaatacgtaccggtggaggaggattgaatgcattgaacggtacgactggcagcaagtgtgagtagctgacaacgatggtgtttgagaagatcttatacatcctttccttcatgaccttgaagtcaagagaatctggatcttcacggtttgggtcatgcttgccgtcaaattcgaaggctgtgcgagatctttctttgattagagctaaccgacacttgataaagtgccgggtgatctgttctccttgaaggccctgttctttcagctttatcatcctctccatcagttctactgcttgtgcagcttcatctcccattggcagtgagttccaagtatcccgataaactggaggaagacaggagtactcgggaagaacaggctcggggttttgaacataaaaccaatttgcgtgccaacctttatttgaggtcttgaagggcatggagaagtatttttggcttattgttcccctgagttggaaaccagcacccccaacgacgcatggtttactcttatttggctggggcttgaggaagaagatgcggcggaacaaggcgaaatgaggcctaatgcccagaaaagcttcgcaggcatgaataaaattggcaatatgcactatgaagtttggattcagatgatgcaagctaatcccgtagaaattcagaattccccggaaaaatcttgaggttggaagagaaaatccgccatagaagaaatgagcgaataccacgattttgtgtgtatcgggggtcaggaatgcctcaccaaatgccggtcgccacccgatgatctcttttgctggaagaacgccgtgcgccaccatctccttcaaactgtcttccgtcacatcggagggcgcccactgactctcgaagctttctctttcttccgccatgaatgtgaactggatggtctgatttagttcgagatacggctggaaagggatggggaatcggagcggtggatgtggggagaaatttcgtgaagtttttgagggtggattggagcggattgatgaaccctagtttgcccggcgcagttttgcattgtagcaggaaatggggaaaatggcgagagtttcggcggggaagacgaagagacgtttttcacttcggtgttattagggtatcgggggtactaatgggcctgggcctgtacagtacttcagcccaatactataatcagcgtggcctgttgtgatctctagggacttaggcactttttgctttggcaatctgtgttcacgatggtgtggcccaatgctgttaaaatcctttttaacgcgattcaataattctttggaattattatgatgcacataaaaaggcgcccgacagaaaggtgttataccattttttgtaagctttattaggctgcaaagctgtttgggttgatttgagatgactggtttattaatagtcattcttttagcatgttatatgcttattttggttatggtaagggtcacagcctaggctattggactcattaattaccatgattttctatcctgtttggtgggtcattttatgagatttttactcggattcctatcaaacatgtctatttttggacctttgagtgtttatcactcggctcttcttgtattttttgtccttgatatgctcaagttgagaagcagtcagctaggtatcttactaagtatcatgcgtgcttcgctataaaaccactcggttcttgactatatgtttagtttttcaactaatcacatagtcgggggctacacctaattaggtgtatctactcgatgcaccatgttttattttcgcccttcacagtttttgatttttagtactcggcaagccggagcaagttgaattgaagcactcagattactgttttttgtttcgagaaggctattttgtcaactgtgaaggtctcgggggctactgtggagattatggataccccatatctacataacagttgtaatttagtcggatatacggtaccaaatatagatggaatatctctatgaagactcgggttaggttctaaacttgtatgtcaaggaaatactcgggatcttagtcggttacgattgtattttatctataatcccatattccgttaggatatggactgtattttgtaaagcggactccttcccctatataaggagggtccgtgtgcctcttggggggcgattctttttttccagtttatacaatcaataacacactcggcggaatcatctccggacaggagtagggtattacttcttgaataagaaggcctgaacctgtataaaattccttgtctccaaacccatccactttcctagcttgatagtcacccccttttattattgtcgaaatcttgcttcgacaatgaggatgtccaaattaactcatgtcgctgccatggtttcttgtatatgattgctgccatgttgattggatgcaaaagtgcaccattaacattattagagctgaaaggctcgtcagttacagttgcggcatccaaatcaattgatggataggtaccggatgtggaataagttcactttagttctctcaatttgtcgtccagtccagaaaaccggacaatacatcccttaatttataaaactagtacaaacgaggtccctcggcagtattgaccctggttttagctgacgtggatcttttgactaagtcttcgtcctactatgcattgacgtgaggcttgcgtgacagattgatccaaaaaaaaagagcaaaattgaaaaaaaataaaaaaataaaaacaaaagatgtggggcccatatgccagtcaagcaagaagataaaattgtgtgttagtgggtcccacttcctccacctcacccctctcctccatctcctccccctcactctcaatggtgagtcaacggcgactgcatatgccaagggaggcaattgtggcggaggtggccagcgaggcagcgaggagggagttgcggcgttccggtggaggagaggatggaggcgagggagccgacgagctcgagctcgccatccctgctccagcttcatgaggcgttggaggagtcagaggagaaggccgagccgcgtcagtgccaccaccagcagtggtgacggtacagggtctagggcggcgatgcttgcgagcaagcccttgcggtggtcgaggcatcacatcgtcggagggaggagatgggggtgtcggggaaggtgtcgtcgaggtattggaggataaaagactcacaggcggtgtggccggcatggaggaagacggggatcctcttgtggatgaggttggagcataccaggaggttgctctagttaccgaggtcggacgggga
